United States Patent 8,362,325 (NUCLEOTIDE SEQUENCES AND CORRESPONDING POLYPEPTIDES CONFERRING MODULATED PLANT CHARACTERISTICS) - sequence listing, part 5

SEQ ID NO: 7956 - protein, 652 aa, Sorghum bicolor
  misc_feature: Ceres ANNOT ID no. 6086268
  misc_feature (54)..(610): Pfam Id: EMP70 Pfam Desc: Endomembrane protein 70
  misc_feature (7)..(652): NCBI GI: 10176814 NCBI Desc: endosomal protein-like [arabidopsis thaliana]
  misc_feature (10)..(652): NCBI GI: 38175639 NCBI Desc: endosomal protein-like [oryza sativa (japonica cultivar-group)]
  misc_feature (5)..(652): NCBI GI: 115480625 NCBI Desc: os09g0557800 [oryza sativa (japonica cultivar-group)]
  misc_feature (7)..(652): NCBI GI: 92897792 NCBI Desc: nonaspanin (tm9sf) [medicago truncatula]
  misc_feature (261)..(652): NCBI GI: 115477747 NCBI Desc: os08g0555200 [oryza sativa (japonica cultivar-group)]
  misc_feature: Useful for making plants with altered cell wall content and/or composition
  misc_feature: Functional homolog of the protein sequence encoded by LOCUS at5g35160
  misc_feature: Useful for making plants with altered cell wall content and/or composition
  misc_feature: Functional homolog of the protein sequence given in SEQ ID NO 13969
  misc_feature: Up-regulated in shoot tissues in response to methyl jasmonate treatment
  misc_feature: Up-regulated in root tissues in response to methyl jasmonate treatment
MVEDWVFSALIVAFLAFITPCESFYLPGSYMHTYQQGEVIGAKVNSLTSIETELPFSYYSLPYCRPQDGVKKSAENLGELLMGDQIDNSPYRFHVNVNESLYLCTTNPLDEADVKLLKQRSRDLYQVNMILDNLPVRRFTEQNGMTIQWTGYPVGYIPEGTSDVYIINHLKFKVLVHKYEQGKVKVVGTGEGMEFISEADSDAKSGYEIVGFEVVPCSVKRPEAMSKFNMYDKVDSVNCPVELEKSQLVREKEKITFTYEVEFVNSDIRWPSRWDAYLKMEGSKIHWFSIMNSLMVILFLAGIVFVIFLRTVRRDLTRYEELDKEAQAQMNEELSGWKLVVGDVFREPTSSKLLCVMIGDGIQILGMAIATIFFAAFGFMSPASRGMLLTGMIVLYMLLGIVAGYAAVRLWRTLKGTSEGWRSVSWSTACFFPGIVFIVLTVLNFMLWTRNSTGALPISLFFGLLSLWFCVSVPLTLLGGFFGTRAEPIEFPVRTNQIPREIPTKKYSLLFILGAGTLPFGTLFIELFFILSSIWLGRFYYVFGFLLVVLLLLIVVCAEVSVVLTYMHLCAEDWRWWWKAFFASGTVALYVFLYSINYLVFDLRSLSGPVSAMLYIGYSFIVSLAIMLATGTVGFLTSFSFVHYLFSSVKID

SEQ ID NO: 7957 - DNA, 999 bp, Sorghum bicolor
  misc_feature: Ceres ANNOT ID no. 6086272
  misc_feature: Encodes the peptide sequence at SEQ ID NO 7958
atgagtactgctaatcgctatcaacacatcaagtcaacgaagcctgttgtaggcaaagcaagaaaattgaaggatcttatgataaaaagtgacaataggatatgtgctgattgtggtgcacctgatcccaaatgggcatctgctaatattggagtgtttctttgcttaaaatgtggtgatgttcatagggcacttggacctgacatttcaaaggttttgtctataactttggatgattggtctgatagtgatatcgactctatgcttgaggttggtggaaactcatatgcaaattcaatttatgaggcttttcttccaaaagatcacccaaaacccaaaccagattcaacgatggaatataggacaaaatttataagagctaagtatgagacacaagattttttgaagccaagtttgcgcatttcatcaagatcatcttttaaatctaccacttctgtgaagagtgtagataacaatttctctagcacttcaaggaaggatgtctctgaagatacaagagaatttgttggagagctgaatattacagtggtgaaaggtactaacttggccgttagagacatgctaacaagtgatccatatgttattttaacactcggagggcagacagctcaatcgacagttaaaaaaagtgatttgaatccggtatggaatgaagtgcttaagatatctgttcctcgaaattacggacctctaaaacttgaaatatatgaccatgatattttctcagccgatgatatcatgggtgaagcagagatagatctccaaccaatgatcacagccgccatggcctttggagatacttcacgtcttggtgacatgcaaattgggaggtggttcatgaccaaagacaatgccctgatgaaagatagcacagtgaatgttgtggcaggcaaggtaaaacaggaggtgcacttaaagctgcagaacgtagaatcaggtgagatggagttagagctagaatgggttccgatcctctag

SEQ ID NO: 7958 - protein, 332 aa, Sorghum bicolor
  misc_feature: Ceres ANNOT ID no. 6086272
  misc_feature (21)..(142): Pfam Id: ArfGap Pfam Desc: Putative GTPase activating protein for Arf
  misc_feature (179)..(258): Pfam Id: C2 Pfam Desc: C2 domain
  misc_feature (14)..(331): NCBI GI: 140068173 NCBI Desc: c2; arf gtpase activating protein [medicago truncatula]
  misc_feature (19)..(331): NCBI GI: 34304192 NCBI Desc: zinc finger protein f35 [oryza sativa (japonica cultivar-group)]
  misc_feature (49)..(331): NCBI GI: 115444853 NCBI Desc: os02g0198300 [oryza sativa (japonica cultivar-group)]
  misc_feature (174)..(332): NCBI GI: 92885095 NCBI Desc: c2 [medicago truncatula]
  misc_feature (174)..(327): NCBI GI: 124359429 NCBI Desc: c2 [medicago truncatula]
  misc_feature: The sequence is a functional homolog of SEQ ID NO. 425 in the 11/188,298 US application
MSTANRYQHIKSTKPVVGKARKLKDLMIKSDNRICADCGAPDPKWASANIGVFLCLKCGDVHRALGPDISKVLSITLDDWSDSDIDSMLEVGGNSYANSIYEAFLPKDHPKPKPDSTMEYRTKFIRAKYETQDFLKPSLRISSRSSFKSTTSVKSVDNNFSSTSRKDVSEDTREFVGELNITVVKGTNLAVRDMLTSDPYVILTLGGQTAQSTVKKSDLNPVWNEVLKISVPRNYGPLKLEIYDHDIFSADDIMGEAEIDLQPMITAAMAFGDTSRLGDMQIGRWFMTKDNALMKDSTVNVVAGKVKQEVHLKLQNVESGEMELELEWVPIL

SEQ ID NO: 7959 - DNA, 861 bp, Sorghum bicolor
  misc_feature: Ceres ANNOT ID no. 6086273
  misc_feature: Encodes the peptide sequence at SEQ ID NO 7960
atgtcgtcgggacggtacatggcctactcgccctcgccgtcgaccaccccgcactccccccgcatcggcggcctccgcaccccgtctgccgccgtcgccgaacaggagaagtaccttgccgaactgctcgcggagaggcacaagcttggcccgttcatcccagtgatcccgcatagtgtacggttgctgaatcaagaaattttacgtgtttccacactattggagaacgcgtcccttttaaaccaaagtggccttgaacatggtagtccactaacaacgggaggattgtattcaaatggagcagctactgacatgaatgggtggacatcagcatttcaatcagaaagttcaccagcttatagctggcttggaggatcacaaggcagctcctctggacttattgtcaagaaaacaatgaaggtcgatatcccagtagacaaatatccaacatacaatttcgttggtcgcatccttggtccaagaggaaattccttgaagcgggtggaggcaaatacagactgccgcgtgctaataagaggtcgcggcagcattaaagatccagcacgggaggagatgatgcgagggaagccaggatatgaacacctgaatgaaccccttcatatattggttgaggcagagctacctgttgaaatcatcgatgctcgcctgatgcaagcccgcgagatccttgaagatctgctaaagcctgtggatgaatcccaggacttcttcaagaagcagcagctacgggagcttgcaatgcttaatggtacccttcgtgaggaagggatgcagagatctggttcagcgtcccctttccacaacagccttggaatgaagagagctaagacaagggggtaa

SEQ ID NO: 7960 - protein, 286 aa, Sorghum bicolor
  misc_feature: Ceres ANNOT ID no. 6086273
  misc_feature (1)..(150): NCBI GI: 115448377 NCBI Desc: os02g0722700 [oryza sativa (japonica cultivar-group)]
  misc_feature (1)..(283): NCBI GI: 24060154 NCBI Desc: kh domain-like protein [oryza sativa (japonica cultivar-group)]
  misc_feature (19)..(283): NCBI GI: 115464523 NCBI Desc: os05g0481500 [oryza sativa (japonica cultivar-group)]
  misc_feature (2)..(284): NCBI GI: 92893883 NCBI Desc: kh [medicago truncatula]
  misc_feature (26)..(284): NCBI GI: 19310523 NCBI Desc: at1g09660/f21m12_5 [arabidopsis thaliana]
MSSGRYMAYSPSPSTTPHSPRIGGLRTPSAAVAEQEKYLAELLAERHKLGPFIPVIPHSVRLLNQEILRVSTLLENASLLNQSGLEHGSPLTTGGLYSNGAATDMNGWTSAFQSESSPAYSWLGGSQGSSSGLIVKKTMKVDIPVDKYPTYNFVGRILGPRGNSLKRVEANTDCRVLIRGRGSIKDPAREEMMRGKPGYEHLNEPLHILVEAELPVEIIDARLMQAREILEDLLKPVDESQDFFKKQQLRELAMLNGTLREEGMQRSGSASPFHNSLGMKRAKTRG

SEQ ID NO: 7961 - DNA, 4014 bp, Sorghum bicolor
  misc_feature: Ceres ANNOT ID no. 6086275
  misc_feature: Encodes the peptide sequence at SEQ ID NO 7962
  misc_feature: Down-regulated in shoot tissues in response to salicylic acid treatment
atggcgtctccgagcggaaaccctaaccctaatcccaacccaccattcgagatcgggaagctcttcaggccaccgaaccccatgcccacccccacccccaacaccatcttccccggcgtcgccggaggcccggctggcccgccgccgccgtccggtccctactcctaccctccggtgaccccgcccttccaccgcggaccctacatccactacccgcaggacccccacgccatgccccgccccgttgtctccttccccatgccaaacccaaacctcaaccccaacccgaacgctaaccccaacgccgccgccccgggccccaaccccggcgcgcgcctcatgcagctactcgggaactccgggccgacccaactcgagaccgccgtctccatgcccccgcccacgtcggagttcgcgcagccgcagccgctcccagcgatgccatccgcgccgccggccaggatgctgagcagcaccagcagcaaggtgcccaggggacggttacttggcaccggggagcgagcggtgcacgatgttgactcgaggctgcccggggaagcgcagccaccgcagctggaggtaacaccgattaccaagtacacatcggatccggggctcgtgctgggcagacaaatagctgtgaaccggacgtacatcgtgtatgggctcaagctcggtaacatccgtgtgctgaacatcaacaccgcactccgctcacttctccgtggccacacacagagggtgacagacatggctttctttgctgaggatgtccatcgtttggcaagcgcgagcgtagatgggcggatatatgtgtggaggatcgatgaaggacctgatgaagaaaataaaccacaaattactggaaagattgaaatcgccatccaggttgtaggtgaggctgaagcttaccatccaaggatatgttggcactcgcataagcaagagattctatttgttggaattgggaactgtgtcttaagaatagacacaactaaagtgggtagaggaaaagacttcactgtggaagaacctgttaaatgtcatcttgaaaagcttattgatggtgttcgcttagttggtaagcatgatggtgatgtgactgatttgtccatatctcaatggatgagcacacgcctggcctctggatccaaggatggcacggttaagatctgggatgatcgcaaacaagtgccattatcaatttttaagccccatgatggtcaagctgtttattcagttgcttttcttacagcacctgaacgaccaaatcatataaatctaattactgcgggtcctctgaatcgagaagttaaaatttgggcttctactaatgaagatggctggttattgccaagcgattctgagacttggaagtgtactcagaccttggaacttgttagttctctggaacctagagtcgaagaggcatttttcaaccaggttgcagtgctgcctcaagcaagcctgattttgcttgcgaatgctaaaaagaacgctatctatgccgtgcatgttgagtatggcccagatcctgcctctactcgcttagactatatagcagatttcacagttgcaatgcctatactaagcctcactggaacacacgaaagccaaccagatggtgaacaagttgttcaagtctattgtgttcaaactatggccattcagcaatatggtctagagttatcactctgttcgcctcctacagctgatagtactgggtttggaagagatcctgctatttcccgtgtttacgaggcgcctctggaaatggcaggaacagagtcatctacaggaactagtttcacagactcttactctgtcagtgttttgagtaaaccaactattgaccagtctgcagatgttgatctgaaaccatcagcgccaccgcttgcatactcagaaggtgatggttccatgcctcttccatctgcacctcttgcaccaaagatggaggttcctggatcaggaccagcacctggaactcgtgatatagatcaatcagcctttgactatacaacaaatagaaacaaggaacgtgatgctttgaaaagacaagatacacccatgcccattagaaaagatatcttggtaaaagatgagccaagagatggtcacagtgatgttccaatgcttccaaatccccgtttgatgtttcaggttggagggaatgctacacacttggttactccatctgaaattatatcgggcactctctcgtctgctgaaaacaatgatgtctccaaatctgatggaggaaaaagtcaagatgtttccagcagaagttcccgggttgcagaagtggaaccaaagcatattgatgagagtaaaccagatcaaaatgtaggacttgaagctgtcaaggaaactcagattgtttgtgagaatatggagaaaactcagagttccttggagcaaactgttgaaatgatcagtgagcgctcagttacaactgataagtacagtgtggaagaatcacagtcatcatctgatcgacgggcatcagaccagattggtgttgctgatgaaaatgttctgaagaagtttgtggaaatccctgagaaaattgattactcctctgcctccagggagcaatcatcatcgtttacgaaagaggagaaagttttgcaccctcaaacatctggtcagccatctcctcctgtgagtgctttcaattcaactgagtcacatgagcctttgagctccacatacctacctgccagctccttcccagaagctgctgccacacaagggatgctgcaacagctcatggggatgcagaaggacatggaaaaacagcttagtactgtggttcctgcatccatcgcaaaggagggcaaaagacttgagacatcattagggcgcactgtagagaaatcgatcaaggctaatattgatgcgttttgggttcgtctccaggaggaaaacactaagcgtgaaaaggctgatagagagcgaatgcagcaattggttactctcattacgaactcaataaataaggacttgccttctaatatggagaagtcacttaagaaagaaatttcttcacttggacctattgttgcccgcgcaattacacctattattgagaagtgcctgacctctgctgtttatgattcagttcagaaaggggtgggtgacaaggtgtgcaatcagctggaaaagtctattactggaaaacttgaagctacacttgccaggcaaatccaaatgcagttccatacatctggaaaacaggctcttcaggatgctttgcgtactagctttgaatcattgcttgttcccgcgtttgagcaaacatgcaagacaatgtttgagcaaatagatggtgcatttcaaaagggaatgtctgagcactccattgctattcagcagcaagttgaggctgcacatactccgttagcgctaactctaaaagaaaccatcaattctgcatcatcaatcacccagagcttttcatcagagttacttgatggcaatcgcaagctattggcacttgttacttctgggaatgccaaggcacataataccagtgctctgcagccctttaatggtcctatgggtggcccccaagaggctgaggctcccttagatccaatgaaagagctgagcagactgatatctgaacgcaagtttgacgaagcgtttacaatggctcttcaaaggagtgatgtttccatagtatcgtggctgtgctcccaggttgatttgcgggcattatgtgcaatgaccccagtacctcttaaccagggggtccttctggccttgttgcagcagctagcaattgacattcacaatgagacatcacgaaaggttcaatggatgacagatgttgccatggcaataaacccgtcagaccagatgatcgcggtgcatgtgcgacctatctttgagcaagtctacaaccagttggcccaccagcggacgctccccaccacgaccgcatcagatggcaccagcatccgtgtgatcatgcatgtaattaactcggttctgcttagctacaagtga

SEQ ID NO: 7962 - protein, 1337 aa, Sorghum bicolor
  misc_feature: Ceres ANNOT ID no. 6086275
  misc_feature (235)..(274): Pfam Id: WD40 Pfam Desc: WD domain, G-beta repeat
  misc_feature (354)..(393): Pfam Id: WD40 Pfam Desc: WD domain, G-beta repeat
  misc_feature (1)..(1337): NCBI GI: 45735995 NCBI Desc: transducin / wd-40 repeat protein-like [oryza sativa (japonica cultivar-group)]
  misc_feature (1)..(1337): NCBI GI: 53792527 NCBI Desc: wd-40 repeat protein-like [oryza sativa (japonica cultivar-group)]
  misc_feature (97)..(1130): NCBI GI: 115467708 NCBI Desc: os06g0300800 [oryza sativa (japonica cultivar-group)]
  misc_feature (114)..(1130): NCBI GI: 53792528 NCBI Desc: wd-40 repeat protein-like [oryza sativa (japonica cultivar-group)]
  misc_feature (49)..(671): NCBI GI: 15231198 NCBI Desc: transducin family protein / wd-40 repeat family protein [arabidopsis thaliana]
  misc_feature: Down-regulated in shoot tissues in response to salicylic acid treatment
MASPSGNPNPNPNPPFEIGKLFRPPNPMPTPTPNTIFPGVAGGPAGPPPPSGPYSYPPVTPPFHRGPYIHYPQDPHAMPRPVVSFPMPNPNLNPNPNANPNAAAPGPNPGARLMQLLGNSGPTQLETAVSMPPPTSEFAQPQPLPAMPSAPPARMLSSTSSKVPRGRLLGTGERAVHDVDSRLPGEAQPPQLEVTPITKYTSDPGLVLGRQIAVNRTYIVYGLKLGNIRVLNINTALRSLLRGHTQRVTDMAFFAEDVHRLASASVDGRIYVWRIDEGPDEENKPQITGKIEIAIQVVGEAEAYHPRICWHSHKQEILFVGIGNCVLRIDTTKVGRGKDFTVEEPVKCHLEKLIDGVRLVGKHDGDVTDLSISQWMSTRLASGSKDGTVKIWDDRKQVPLSIFKPHDGQAVYSVAFLTAPERPNHINLITAGPLNREVKIWASTNEDGWLLPSDSETWKCTQTLELVSSLEPRVEEAFFNQVAVLPQASLILLANAKKNAIYAVHVEYGPDPASTRLDYIADFTVAMPILSLTGTHESQPDGEQVVQVYCVQTMAIQQYGLELSLCSPPTADSTGFGRDPAISRVYEAPLEMAGTESSTGTSFTDSYSVSVLSKPTIDQSADVDLKPSAPPLAYSEGDGSMPLPSAPLAPKMEVPGSGPAPGTRDIDQSAFDYTTNRNKERDALKRQDTPMPIRKDILVKDEPRDGHSDVPMLPNPRLMFQVGGNATHLVTPSEIISGTLSSAENNDVSKSDGGKSQDVSSRSSRVAEVEPKHIDESKPDQNVGLEAVKETQIVCENMEKTQSSLEQTVEMISERSVTTDKYSVEESQSSSDRRASDQIGVADENVLKKFVEIPEKIDYSSASREQSSSFTKEEKVLHPQTSGQPSPPVSAFNSTESHEPLSSTYLPASSFPEAAATQGMLQQLMGMQKDMEKQLSTVVPASIAKEGKRLETSLGRTVEKSIKANIDAFWVRLQEENTKREKADRERMQQLVTLITNSINKDLPSNMEKSLKKEISSLGPIVARAITPIIEKCLTSAVYDSVQKGVGDKVCNQLEKSITGKLEATLARQIQMQFHTSGKQALQDALRTSFESLLVPAFEQTCKTMFEQIDGAFQKGMSEHSIAIQQQVEAAHTPLALTLKETINSASSITQSFSSELLDGNRKLLALVTSGNAKAHNTSALQPFNGPMGGPQEAEAPLDPMKELSRLISERKFDEAFTMALQRSDVSIVSWLCSQVDLRALCAMTPVPLNQGVLLALLQQLAIDIHNETSRKVQWMTDVAMAINPSDQMIAVHVRPIFEQVYNQLAHQRTLPTTTASDGTSIRVIMHVINSVLLSYK

SEQ ID NO: 7963 - DNA, 2040 bp, Sorghum bicolor
  misc_feature: Ceres ANNOT ID no. 6086284
  misc_feature: Encodes the peptide sequence at SEQ ID NO 7964
atggccaagagaaagcagcagccgccgccgccggctcccacggcgaagaaggggagcaaggttgtgcccccaccgaaggctctgccgctcccagaggaggactccgacctcgacgtctccgacgccgaggagctctctttgtcggacgctgaggctgacgagctctcgggctcggacgcagatgccgacggaggctcgagcagcggcgacgacgtggaggaggaggaggaggatgaggaggaggaaggtgatgaaagcgacgatgaaccccttgcggacgacttcctcgctggtagcgacgaaggaagcgatggtggtgactctggactggagtcagatgagtctgatgacctcgaggcaaagtcacgagcaattgatgagcagaaactcaaggcggaagaagatgcagagaaggaacttcaaatcaacataagatcagaatctgacgagttcagattacccacggcagaggagctggaggaagaggcacacagaccacctaacctaccaaatctcaaaaggaggatatcagaaattgttcgagtgctctcaaacttcagcaagctgaggcagaaagatgttccgcgaaaagattatatcaatcaactgaaaactgacatcatgtcatactatggatataatgattttctcgttgaagcattaattgagatgttcccagctgttgagcttgttgagttactggaagcctttgagaaaagaccgcctgagtgcttgcggacaaatacactaaagacccggaggagggatcttgctgctgctcttataccaagaggatttaatttggacccaataggcaaatggtcaaaggtaggattagttgtctatgactcaaccatttcagctggtgctactactgaatatatggctggacattacatgaaacaaggtgcaagttctttcttaccagtgatggcacttgctccacaggagaaggagcgaattgttgatatggctgctgctccaggcggaatcatctatgcaaatgagttcaatgagaaaaggttgcatggacttttgggaaacatccatcgcatgggcgtgacaaataccatagttagtaactatgatggtaaagagctacccaaagttctcggcatgaattcggttgacagagtattgctggatgctccttgcacaggaactgggaccatctggaaggatctacaaatcaaaacatcaaaggacattgaagatatcaggaactgtgcctttgtccaaaagcaattgctgctagctgctattgatttggttgatgccaactccaaaactggtggttacattgtttactcaacttgttcgataatgatcccagagaacgaggcagtaattgactatgcacttaaaaagagaaacgtgaagcttgtgccttgtgggttggattttgggcgtccaggattcatccggtaccgggagcatcggtttcatacttctttagaaaaaacaagaagattttatcctcatgtcaataacatggatggattttttgtagctaagctgaaaaagttgagcaatacaatcccggtgacatctgagccgtctaaagcgtctgaagaagcagctgagaaggctgatggcgaagatgagaaagctatttctaatgaacaagagacagctgttcctggtgaagacgagaaaactgttcagatgaaaaatcagaaaaaggccaaggtgactaataaaagaacaagtgtcaccaaagatactggaggccataaacatgaatctaataggccaggaaagcatctcaagaaaaataaggataaggataccaaggaaattgatggccctgaaagcactgaaacaaatggagacaggaaagaggagcatcgtgaacaaaccaagcaaagaagccacaaaaggaagtttgcctctaataattccaaaaaagctggccctgagagcaatttgggtgtcaaagagaagagacaggtcagtgacaagaagccaaaaaggaaattcaagctgaggcgagaatgggaagctgaaaagaaaaaagatgccaagaggaggaagatatga

SEQ ID NO: 7964 - protein, 679 aa, Sorghum bicolor
  misc_feature: Ceres ANNOT ID no. 6086284
  misc_feature (233)..(507): Pfam Id: Nol1_Nop2_Fmu Pfam Desc: NOL1/NOP2/sun family
  misc_feature (2)..(423): NCBI GI: 115448399 NCBI Desc: os02g0724600 [oryza sativa (japonica cultivar-group)]
  misc_feature (12)..(659): NCBI GI: 92888294 NCBI Desc: bacterial fmu (sun)/eukaryotic nucleolar nol1/nop2p [medicago truncatula]
  misc_feature (26)..(661): NCBI GI: 125811367 NCBI Desc: ga21153-pa [drosophila pseudoobscura]
  misc_feature (8)..(626): NCBI GI: 76150625 NCBI Desc: nucleolar protein 1, 120kda [homo sapiens]
  misc_feature (16)..(626): NCBI GI: 287723 NCBI Desc: p120 antigen [homo sapiens]
MAKRKQQPPPPAPTAKKGSKVVPPPKALPLPEEDSDLDVSDAEELSLSDAEADELSGSDADADGGSSSGDDVEEEEEDEEEEGDESDDEPLADDFLAGSDEGSDGGDSGLESDESDDLEAKSRAIDEQKLKAEEDAEKELQINIRSESDEFRLPTAEELEEEAHRPPNLPNLKRRISEIVRVLSNFSKLRQKDVPRKDYINQLKTDIMSYYGYNDFLVEALIEMFPAVELVELLEAFEKRPPECLRTNTLKTRRRDLAAALIPRGFNLDPIGKWSKVGLVVYDSTISAGATTEYMAGHYMKQGASSFLPVMALAPQEKERIVDMAAAPGGIIYANEFNEKRLHGLLGNIHRMGVTNTIVSNYDGKELPKVLGMNSVDRVLLDAPCTGTGTIWKDLQIKTSKDIEDIRNCAFVQKQLLLAAIDLVDANSKTGGYIVYSTCSIMIPENEAVIDYALKKRNVKLVPCGLDFGRPGFIRYREHRFHTSLEKTRRFYPHVNNMDGFFVAKLKKLSNTIPVTSEPSKASEEAAEKADGEDEKAISNEQETAVPGEDEKTVQMKNQKKAKVTNKRTSVTKDTGGHKHESNRPGKHLKKNKDKDTKEIDGPESTETNGDRKEEHREQTKQRSHKRKFASNNSKKAGPESNLGVKEKRQVSDKKPKRKFKLRREWEAEKKKDAKRRKI

SEQ ID NO: 7965 - DNA, 1719 bp, Sorghum bicolor
  misc_feature: Ceres ANNOT ID no. 6086287
  misc_feature: Encodes the peptide sequence at SEQ ID NO 7966
atggcttcgaaggcaatgcctcaagttctcccagaaatgccaagcatcccaggcccgaatcaatgctctaagagtgcttcccctttagagattccgcagacaaacaattcctgtgcttcagcattgacagtgttaccaggaacaactaacctgagcaaatcgagtcataaacctgagccgaaggagcagaaaccagatcaccacctcaaggaacctgttgatgttgcgtcgatcaagtctcctgtagaatcaagcaagaaagtgttagtggagcatggaagcatgaatggaagttccacttcatttcagacatgtgaagggactagtcaagcaaaggttagtgcaagtgctaagttcactgatccatctgagattggtgacaggggcaatagtggaagatgcaggcctagcacaagcagtgatatcagtgatgagagctcatgtagtagcatgagtagcagcacaaagcctcacaaggcaaatgattcgcaatgggaagcaattcagacgatcagaactagagatgggatccttggattgagtcatttcagactgttgaagagactaggctgtggcgatattggcagtgtgtatctctcggaattgagtgggactaagagctattttgcgatgaaagttatggacaaggcatcactagcaagccgtaaaaagttgcttcgagctcaaacagagaaggagattttgcaatgcctggatcatcccttccttcctacactttacactcactttgagaccgataagttctcctgcctagttatggagttctgcccgggaggagaccttcacactcttcgacagaggcagcctggcaaacactttccagagcaagctgtcaaattctacatagctgaagtcctcctggcactagaatacttgcacatgcttggtatcatataccgtgatctcaagcctgaaaatgtccttgttcgggaggatgggcacatcatgctctcagacttcgacctctcccttcgctgtgcagtcagtccaacactgattaaatcctcaaaccctgatgcagaagcactcaggaagaacagccaaggctactgtgttgagccgtcctgcattattcagccatcatgtgcagccccaaccacctgctttggcccacgcttgttctccaagaccaagaaagatcgaaaaccaaaacctgaagttgccaccccgatcaaccattggcctgagctcatagcagagcccagtgatgcacgatcaatgtcatttgttgggacacacgagtacctggcccctgagattatcaaaggtgagggtcatggtagcgctgtcgactggtggacctttgggatattcttgtacgagctgctgttcgggaagacacctttcaagggatccagcaaccgggctacactgttcaatgtcattggccagcagttgcgcttcccagagtacccggttgtgagcttctcagcaagagatttaattaggggtctacttgtgaaggagccccagcaacggttggcttacaagcgtggagccacggagatcaagcagcatcccttctttgagggcgtgaattgggcactgataaggtgtgcaagcccaccagaggtaccaaagcctgtcgagatcgacaggccatcaaagcatccttcatcgccatcaggagctgctgatacttccattggtgcaccccagaaaggtgctgacggctacttggagtttgatttcttctag

SEQ ID NO: 7966 - protein, 572 aa, Sorghum bicolor
  misc_feature: Ceres ANNOT ID no. 6086287
  misc_feature (183)..(516): Pfam Id: Pkinase Pfam Desc: Protein kinase domain
  misc_feature (183)..(510): Pfam Id: Pkinase_Tyr Pfam Desc: Protein tyrosine kinase
  misc_feature (1)..(572): NCBI GI: 90178578 NCBI Desc: protein kinase g11a
  misc_feature (61)..(567): NCBI GI: 169788 NCBI Desc: g11a protein
  misc_feature (20)..(572): NCBI GI: 20259910 NCBI Desc: protein kinase 5 [arabidopsis thaliana]
  misc_feature (93)..(572): NCBI GI: 217843 NCBI Desc: protein kinase [arabidopsis thaliana]
  misc_feature (156)..(572): NCBI GI: 168618 NCBI Desc: protein kinase
  misc_feature (1)..(572): SWISSPROT Homolog: EC 2.7.11.1 Protein kinase G11A
  misc_feature: The sequence is a functional homolog of SEQ ID NO. 441 in the 11/188,298 US application
  misc_feature: The sequence is a functional homolog of SEQ ID NO. 399 in the 11/188,298 US application
  misc_feature: The sequence is a functional homolog of SEQ ID NO. 498 in the 11/188,298 US application
  misc_feature: The sequence is a functional homolog of SEQ ID NO. 310 in the 11/188,298 US application
  misc_feature: The sequence is a functional homolog of SEQ ID NO. 464 in the 11/188,298 US application
  misc_feature: The sequence is a functional homolog of SEQ ID NO. 340 in the 11/188,298 US application
  misc_feature: The sequence is a functional homolog of SEQ ID NO. 323 in the 11/188,298 US application
  misc_feature: The sequence is a functional homolog of SEQ ID NO. 358 in the 11/188,298 US application
  misc_feature: The sequence is a functional homolog of SEQ ID NO. 311 in the 11/188,298 US application
  misc_feature: The sequence is a functional homolog of SEQ ID NO. 332 in the 11/188,298 US application
  misc_feature: The sequence is a functional homolog of SEQ ID NO. 495 in the 11/188,298 US application
  misc_feature: The sequence is a functional homolog of SEQ ID NO. 312 in the 11/188,298 US application
  misc_feature: The sequence is a functional homolog of SEQ ID NO. 520 in the 11/188,298 US application
  misc_feature: The sequence is a functional homolog of SEQ ID NO. 366 in the 11/188,298 US application
  misc_feature: The sequence is a functional homolog of SEQ ID NO. 446 in the 11/188,298 US application
MASKAMPQVLPEMPSIPGPNQCSKSASPLEIPQTNNSCASALTVLPGTTNLSKSSHKPEPKEQKPDHHLKEPVDVASIKSPVESSKKVLVEHGSMNGSSTSFQTCEGTSQAKVSASAKFTDPSEIGDRGNSGRCRPSTSSDISDESSCSSMSSSTKPHKANDSQWEAIQTIRTRDGILGLSHFRLLKRLGCGDIGSVYLSELSGTKSYFAMKVMDKASLASRKKLLRAQTEKEILQCLDHPFLPTLYTHFETDKFSCLVMEFCPGGDLHTLRQRQPGKHFPEQAVKFYIAEVLLALEYLHMLGIIYRDLKPENVLVREDGHIMLSDFDLSLRCAVSPTLIKSSNPDAEALRKNSQGYCVEPSCIIQPSCAAPTTCFGPRLFSKTKKDRKPKPEVATPINHWPELIAEPSDARSMSFVGTHEYLAPEIIKGEGHGSAVDWWTFGIFLYELLFGKTPFKGSSNRATLFNVIGQQLRFPEYPVVSFSARDLIRGLLVKEPQQRLAYKRGATEIKQHPFFEGVNWALIRCASPPEVPKPVEIDRPSKHPSSPSGAADTSIGAPQKGADGYLEFDFF

SEQ ID NO: 7967 - DNA, 1185 bp, Sorghum bicolor
  misc_feature: Ceres ANNOT ID no. 6086288
  misc_feature: Encodes the peptide sequence at SEQ ID NO 7968
atggcctcccctacggcgggtgatgcccccctcgcggctccggctccggcggctgacgcgacggacgcggccctcgccgccgcggccgcggtgccggatccagacgcagagttcgggttccagcgcccggagctcgggaaggagaagctggtcgggacggtggggttccacgagcgccatgtgttcctctgctacaagggcccggacgtgtggccgtctcacctcgaggccgctgagtctgatcgcctccctcgcctcctcgccgccgccatcaaggcccgcaagcccaatctgaagaagaccatcaaattgaccatctgtgaaggagaagatggcactgaatcatcaaatggagatgtgttgatctttccagatatgatcagatacaaagggctgacccattttgatgttgacaactttgttgaagaagtgcttgtgaaggatattgactggcttcctggatctcctgagcctatgagtggttcgtatgtttttgtttgctcccatggaagcagggacaaaaggtgtggtgtttgtggacctgagttgattaaaaggttcaaggaagagataaatggactgggacttgatggtaaggtgtctgtcagtgcatgctcacacgtgggaggtcataagtatgcaggaaatgtcatcattttcagctctgttgccaagggagatgtgactggtcattggtatggttatgttgttcctgatgatgtgcctgttttgctgcataaacatattgaacaaggagaaattgtggaccatctatggagggggcagatgggtttatctgaggagcagcagaagcaagctctcgagcttcggagcatgctaaatggtggcaaagaatcccttgaagaaatcggaacagatggtgcttcttgcaaccctgcagcagctggtggatgctgccaaggtaatggtggcttcacctgctgccaaactgacttgccaaaggaaaaacaggacaagagcatcgcagctgagcagaaccccaagagctccgaggagaatgacaaggagggtggtgctggcagcaagaaggggaatacaaagacttgcccgatgcccacctggtttgagacctgggagagagctgacacctatgctgctcttgctgttgtcgcagctgctgcagcggtgtttgtctctttcagaatctacaagaacctcaactga

SEQ ID NO: 7968 - protein, 394 aa, Sorghum bicolor
  misc_feature: Ceres ANNOT ID no. 6086288
  misc_feature (49)..(263): Pfam Id: Suc_Fer-like Pfam Desc: Sucrase/ferredoxin-like
  misc_feature (35)..(349): NCBI GI: 27363400 NCBI Desc: at4g26620/t15n24_70 [arabidopsis thaliana]
  misc_feature (35)..(349): NCBI GI: 21536780 NCBI Desc: sucrase-like protein [arabidopsis thaliana]
  misc_feature (40)..(393): NCBI GI: 119935851 NCBI Desc: at5g55900 [arabidopsis thaliana]
  misc_feature (35)..(196): NCBI GI: 7269514 NCBI Desc: sucrase-like protein [arabidopsis thaliana]
  misc_feature (47)..(326): NCBI GI: 707001 NCBI Desc: clostridium pasteurianum ferredoxin homolog [solanum tuberosum]
MASPTAGDAPLAAPAPAADATDAALAAAAAVPDPDAEFGFQRPELGKEKLVGTVGFHERHVFLCYKGPDVWPSHLEAAESDRLPRLLAAAIKARKPNLKKTIKLTICEGEDGTESSNGDVLIFPDMIRYKGLTHFDVDNFVEEVLVKDIDWLPGSPEPMSGSYVFVCSHGSRDKRCGVCGPELIKRFKEEINGLGLDGKVSVSACSHVGGHKYAGNVIIFSSVAKGDVTGHWYGYVVPDDVPVLLHKHIEQGEIVDHLWRGQMGLSEEQQKQALELRSMLNGGKESLEEIGTDGASCNPAAAGGCCQGNGGFTCCQTDLPKEKQDKSIAAEQNPKSSEENDKEGGAGSKKGNTKTCPMPTWFETWERADTYAALAVVAAAAAVFVSFRIYKNLN

SEQ ID NO: 7969 - DNA, 1500 bp, Sorghum bicolor
  misc_feature: Ceres ANNOT ID no. 6086291
  misc_feature: Encodes the peptide sequence at SEQ ID NO 7970
atggccacctccaccaccacgctccacccgccgctgcgcgctccccgccatctccgcccgcttccacactcgtattcctcctcgttctcccgcactcgcggccgcgctcctatacgggcctcagcggcgtccgcatccgcgccggcccagcgggaggccgccgcgggcgtcccgtggggctgcgagatcgagtccctggagagcgctgcgtcgctggagcggtggctcattgactcgggcctaccggagcaacgcttggccatccaacgtgtggacatcggcgagcgcggcctcgtcgcccttaagaacatacgcaagggagagaagctgctcttcgtgcccccttccctagtcatcaccgccgattcggagtggggccgccctgaggtgggtgaggtgatgaagaggaactccgtgccggactggccgcttatcgccacttacctcataagtgaagccagtttagagggctcatcgaggtggagcagctacatagcagcgttgccgaggcagccttactcgcttttatactggactcgtgcagagctagatgcatacttggtggcctcaccaatcaggaaacgtgcaattcagaggataactgatgtgattgggacatacaacgaccttcgagaccgtatattttccaggcattcagatttgttccctgaagaggtgtataacatagagacatttctatggtcctttgggattctgttctcacgcctggttcgcttgccatcaatggatgaaaaggtggcactagttccttgggcagatatgctaaaccatagccctgaggtggaaacattcttggattttgacaagtcatcgcaaggaatagttttcaccactgaccgctcatatcaaccaggtgagcaggtatttatatcttatgggaagaaatccagtggtgagctattgctttcatatggttttgttccaaaagagggaacaaacccaaatgattcggttgaactgttggtgtctcttgataagtctgataagtgctataaggagaaattacaagcactgaagcgaaacggtttgtcagaatctgaaagtttccctttgcgggtcacagggtggccagttgagctgatggcttatgccttccttgtggtcagtccacctgacatgagtcaacactttgaggagatggctgttgctgcatccaataaaagttcatccaaacccagattgagttaccctgacctggaagaacaggcccttcagtttatcttggactgctgtgaacctaatatagcaaaatatacaaagtacttagagggtggcggtggctctccagaagtttcaatgaatgcaaaacaagccaacagaacattactgctaaaacaggtagcaagagatctgtgcatcagtgaacggagaatcctgtatcgtacacaatatatattgcgtagaagattgagggacatgagaggtggcgaacttagagctctgtcattgttcaatgggctaagaaaactctttaaataa

SEQ ID NO: 7970 - protein, 499 aa, Sorghum bicolor
  misc_feature: Ceres ANNOT ID no. 6086291
  misc_feature (78)..(306): Pfam Id: SET Pfam Desc: SET domain
  misc_feature (331)..(466): Pfam Id: Rubis-subs-bind Pfam Desc: Rubisco LSMT substrate-binding
  misc_feature (75)..(480): NCBI GI: 3403236 NCBI Desc: ribulose-1,5-bisphosphate carboxylase/oxygenase small subunit n-methyltransferase i [spinacia oleracea]
  misc_feature (74)..(480): NCBI GI: 109158162 NCBI Desc: chain c, structure of rubisco lsmt bound to sinefungin and monomethyllysine
  misc_feature (74)..(480): NCBI GI: 33357824 NCBI Desc: chain c, crystal structure of the set domain of lsmt bound to melysine and adohcy
  misc_feature (35)..(480): NCBI GI: 508551 NCBI Desc: ribulose-1,5 bisphosphate carboxylase large subunit n-methyltransferase
  misc_feature (74)..(476): NCBI GI: 1731477 NCBI Desc: ribulose-1,5 bisphosphate carboxylase/oxygenase large subunit n-methyltransferase
MATSTTTLHPPLRAPRHLRPLPHSYSSSFSRTRGRAPIRASAASASAPAQREAAAGVPWGCEIESLESAASLERWLIDSGLPEQRLAIQRVDIGERGLVALKNIRKGEKLLFVPPSLVITADSEWGRPEVGEVMKRNSVPDWPLIATYLISEASLEGSSRWSSYIAALPRQPYSLLYWTRAELDAYLVASPIRKRAIQRITDVIGTYNDLRDRIFSRHSDLFPEEVYNIETFLWSFGILFSRLVRLPSMDEKVALVPWADMLNHSPEVETFLDFDKSSQGIVFTTDRSYQPGEQVFISYGKKSSGELLLSYGFVPKEGTNPNDSVELLVSLDKSDKCYKEKLQALKRNGLSESESFPLRVTGWPVELMAYAFLVVSPPDMSQHFEEMAVAASNKSSSKPRLSYPDLEEQALQFILDCCEPNIAKYTKYLEGGGGSPEVSMNAKQANRTLLLKQVARDLCISERRILYRTQYILRRRLRDMRGGELRALSLFNGLRKLFK

SEQ ID NO: 7971 - DNA, 2190 bp, Sorghum bicolor
  misc_feature: Ceres ANNOT ID no. 6086294
  misc_feature: Encodes the peptide sequence at SEQ ID NO 7972
atggccgggagcagcgtccgcggcggcgggagcaaccgcttaccgctgctcgtgacggagaaaccgacggggatggcgacgtacgcttaccggctgttcgcgagcacggtcctcgcgggggttctcctggtatggctgtacagagccacgcacgtgccgccgaggagcagcggcgcccggtggtgggcgtggcttgggctctccgcggccgagctctggttcggcttctactgggtgctcacgctgtccgtgcggtggagccccgtctaccgccgcgccttcccggaccagctctcgcgaaggtacaaggaagagcagcttcctgggatggacatatttgtgtgtacagcagaccccactgttgagccgccaatgcttgtcatctccactgtcctatctgttatggcctatgactacccgcaggagaagttgaacatctatttgtctgatgatgctggttccatcataacattatatgctctatatgaggcatcagagtttgcaaagcactggcttccattttgcaagaagtaccaagtggaacccaggtcgccggccgcttactttggtaaagaagctacccctcccgatgcatgtgaccgtaaagagtggttttccttgaaggagatgtacaaagatttggcagatcgagtgaattcagttgttaattcagggaagatccctgatgtttcaaaatgcaagcttaggggcttctctaagtggagcgagaatacaagttttagagatcacccttcaatagttcagattttaattgatggaaacaaaagaaaagcaactgatgtcgatggaaatgtgttgcccacactggtttatatggctcgtgagaagagacctcaggaacatcatcatttcaaggctggatcactgaatgctttgataagggtatcatcagtgataagcaacagcccagtcattatgaatgtggactgtgatatgtactccaacaattcagggtctatcagagatgcattgtgcttcttccaagatgaagagcaaggtcaagatattgcttttgttcagtatcctcagaactttgaaaatgtggtgcacaatgacatctatggcaatcccatcaacaccgtcaatgagttggatcatccttgcttggatggatggggtggaatgtgttactatggcacaggatgcttccatcggagagaggctctatgtgggcgaatatatagtcgagactacaaggaggattggactaggatgttgagtaaaactgaagatgtcagtgagttggaaggaatggctgagtcacttgtgacttgcacatatgagcacaacaccctttggggaatcgagaagggagttagatatggttgcccactggaggatgttattacaggattgcaaatccagtgccgtgggtggagatcagtttaccacaacccaccaagaaaggggtttttaggcatggccccgacctcactaggacagatcctggttcagcacaagagatggacagaagggttcctccagatctccctatcaaagtacagcccatttctgctaggtcacaggaagatcaggctgggtcttcaaatgggttactccgtatgtgggttctgggctcttaacagcttccccaccttgtactatgtcaccatcccttcactttgcttcctcaatggcatctcattgttccctgagataactagtccctggtttctaccgtttgcatacgttgctgtggctgcatacttctgcagcttgtggtggaacgcacaaaggatgtggcttttcagaagaatcacctcatacctcttggccgccatcgacacaatccgcagattgcttggtatcactgagtcaggattcaccctgacagcgaaggtaactgattcgcaggccctagagaggtacaagaaggggatgatggagttcgggtccttctccgcaatgtttgtgatcattacaaccgtcgcactgcttaacctggcatgcatgatgctcggggtgacaaaagttttgctgcataaaggtgcgatgagtttgggagctatgtttgtgcaggctgttctatgtgcgctactagtagcactgaatttcccagtgtatgaagcagtgttcctccgcaaggacagtggcagattaccagcttctgtcagtctaatttcgctctgcattgtaatgccattatgtatattgccaaccaacttctag

SEQ ID NO: 7972 - protein, 729 aa, Sorghum bicolor
  misc_feature: Ceres ANNOT ID no. 6086294
  misc_feature (15)..(730): Pfam Id: Cellulose_synt Pfam Desc: Cellulose synthase
  misc_feature (1)..(725): NCBI GI: 115448407 NCBI Desc: os02g0725300 [oryza sativa (japonica cultivar-group)]
  misc_feature (1)..(725): NCBI GI: 16519227 NCBI Desc: cellulose synthase-like protein oscsle2 [oryza sativa]
  misc_feature (1)..(726): NCBI GI: 16519225 NCBI Desc: cellulose synthase-like protein oscsle1 [oryza sativa]
  misc_feature (3)..(726): NCBI GI: 71493366 NCBI Desc: cellulose synthase-like protein csle [nicotiana tabacum]
  misc_feature (11)..(562): NCBI GI: 115479753 NCBI Desc: os09g0478200 [oryza sativa (japonica cultivar-group)]
  misc_feature: Useful for making plants with altered cell wall content and/or composition
  misc_feature: Functional homolog of the protein sequence encoded by LOCUS at1g55850
MAGSSVRGGGSNRLPLLVTEKPTGMATYAYRLFASTVLAGVLLVWLYRATHVPPRSSGARWWAWLGLSAAELWFGFYWVLTLSVRWSPVYRRAFPDQLSRRYKEEQLPGMDIFVCTADPTVEPPMLVISTVLSVMAYDYPQEKLNIYLSDDAGSIITLYALYEASEFAKHWLPFCKKYQVEPRSPAAYFGKEATPPDACDRKEWFSLKEMYKDLADRVNSVVNSGKIPDVSKCKLRGFSKWSENTSFRDHPSIVQILIDGNKRKATDVDGNVLPTLVYMAREKRPQEHHHFKAGSLNALIRVSSVISNSPVIMNVDCDMYSNNSGSIRDALCFFQDEEQGQDIAFVQYPQNFENVVHNDIYGNPINTVNELDHPCLDGWGGMCYYGTGCFHRREALCGRIYSRDYKEDWTRMLSKTEDVSELEGMAESLVTCTYEHNTLWGIEKGVRYGCPLEDVITGLQIQCRGWRSVYHNPPRKGFLGMAPTSLGQILVQHKRWTEGFLQISLSKYSPFLLGHRKIRLGLQMGYSVCGFWALNSFPTLYYVTIPSLCFLNGISLFPEITSPWFLPFAYVAVAAYFCSLWWNAQRMWLFRRITSYLLAAIDTIRRLLGITESGFTLTAKVTDSQALERYKKGMMEFGSFSAMFVIITTVALLNLACMMLGVTKVLLHKGAMSLGAMFVQAVLCALLVALNFPVYEAVFLRKDSGRLPASVSLISLCIVMPLCILPTNF

SEQ ID NO: 7973 - DNA, 1401 bp, Sorghum bicolor
  misc_feature: Ceres ANNOT ID no. 6086297
  misc_feature: Encodes the peptide sequence at SEQ ID NO 7974
atggcctctgttccgaagcttcttctcctgagcctcctcgtttttctcagctatcgctctcccattgctcacgcaggtgatcatggcagctacaaggttctgtcccttggctctctgaggaccaagtccgtctgttccgagtccaaagcggttaagtcgtcgaccggtgccgccacggtgccattgcatcaccgtcacggcccatgctcaccgttgccgaccaagaagatgccaactttggaggagaggctccatcgcgaccagctccgagctgcctacatccagcggaagttctccggcggcggcgtcaatggcagccgcggcggcgctggtgacgtccagcaatcgcacgccaccgtgccgacgaccctgggcacctccctggacacgctggagtacttgatcaccgtacgcctcggctctccgggcaagtcccagaccatgctcatcgacaccggcagcgacgtgtcctgggtgcagtgcaagccgtgctcgcagtgccactcccaggcggacccactcttcgacccaagctcgtcgagcacgtactccccgttctcctgcagttccgccgcctgcgcgcagctcggccaggaaggcaacggctgctccagctcccagtgccagtacactgtcacttacggcgatggctcgagcaccaccgggacatacagctccgacacgctcgcgctgggctccaacgccgtcaggaagttccagttcgggtgcagcaacgtggagtcgggcttcaatgatcagaccgacgggctcatggggctcggcggcggcgcgcagtcgctggtgtcacagacggcggggacgttcggcgcggccttctcgtactgcctcccagcgacgtcgagctcctccgggttcctcacgctcggcgctggaacttcgggcttcgtcaagacgccgatgctcaggagcagccaggtccccacgttctacggcgtgcgcattcaggccatcagggtgggcgggaggcagctcagcatacccacctcggtcttctccgccgggacgatcatggactccggcacggtcctcacgcggctgccgccgacggcctactcagcgctgtcgtcggcgttcaaggccgggatgaagcagtacccgtcggcaccgcccagcggcatcctcgacacttgctttgacttcagcggccagtccagcgtcagcataccgaccgtcgcactggtcttctccgggggcgccgtcgtcgacatcgcctccgacgggatcatgctgcagaccagcaacagcatcctgtgcctcgccttcgcggccaacagtgacgacagctccctcggcatcatcggcaacgtgcagcagcggacgttcgaggtgctgtacgacgtcggtggtggcgccgtggggttcaaggctggggcgtgctga

SEQ ID NO: 7974 - protein, 466 aa, Sorghum bicolor
  misc_feature: Ceres ANNOT ID no. 6086297
  misc_feature (132)..(465): Pfam Id: Asp Pfam Desc: Eukaryotic aspartyl protease
  misc_feature (35)..(466): NCBI GI: 53792202 NCBI Desc: nucleoid dna-binding protein cnd41-like [oryza sativa (japonica cultivar-group)]
  misc_feature (35)..(466): NCBI GI: 115438424 NCBI Desc: os01g0608300 [oryza sativa (japonica cultivar-group)]
  misc_feature (50)..(466): NCBI GI: 115466080 NCBI Desc: os06g0121800 [oryza sativa (japonica cultivar-group)]
  misc_feature (113)..(466): NCBI GI: 24430421 NCBI Desc: 41 kd chloroplast nucleoid dna binding protein (cnd41) [nicotiana sylvestris]
  misc_feature (62)..(466): NCBI GI: 8979711 NCBI Desc: nucleoid dna-binding protein cnd41-like protein [arabidopsis thaliana]
MASVPKLLLLSLLVFLSYRSPIAHAGDHGSYKVLSLGSLRTKSVCSESKAVKSSTGAATVPLHHRHGPCSPLPTKKMPTLEERLHRDQLRAAYIQRKFSGGGVNGSRGGAGDVQQSHATVPTTLGTSLDTLEYLITVRLGSPGKSQTMLIDTGSDVSWVQCKPCSQCHSQADPLFDPSSSSTYSPFSCSSAACAQLGQEGNGCSSSQCQYTVTYGDGSSTTGTYSSDTLALGSNAVRKFQFGCSNVESGFNDQTDGLMGLGGGAQSLVSQTAGTFGAAFSYCLPATSSSSGFLTLGAGTSGFVKTPMLRSSQVPTFYGVRIQAIRVGGRQLSIPTSVFSAGTIMDSGTVLTRLPPTAYSALSSAFKAGMKQYPSAPPSGILDTCFDFSGQSSVSIPTVALVFSGGAVVDIASDGIMLQTSNSILCLAFAANSDDSSLGIIGNVQQRTFEVLYDVGGGAVGFKAGAC

SEQ ID NO: 7975 - DNA, 885 bp, Sorghum bicolor
  misc_feature: Ceres ANNOT ID no. 6086301
  misc_feature: Encodes the peptide sequence at SEQ ID NO 7976
atggctgcggcttcccacctcctctccttcttcctcctcctccttctccccgcttctaacgccatctactgcgacgaagacgactgctacgacctcctagggcttaagcaggacgcgaacgcgtcggacatcaagaaagcgtactacaagctctctctcaaataccatccggacaagaacccggatccggagtcgcggaagctcttcgtcaagatcgccaatgcttacgagattctgaaggatgaatccactagggagcagtatgactatgccattgaacatccggaggaggttttttataacacagctcagtactatagggcatactatggacataaaacggatcctcgtgctgtattgattggtcttcttctaattgtttcagcatttcaatacataaatcagctaacaaggtataaccaggccatggaaagtgtcaagcaaactcctgcttacaaaaataggttaaaagctttggagtttgagcgaacaggaggaatagctagcaaaaagaagggccacaagcaggtggataagaaagttgaagaagagctaagtaatgaggttgaattgcaaattcatggggttgaaaaaccgtctgtctggaggctgtatggtgtccaatttatacttttgccttactccattggcaaggtgctttcttggaagatttgttggttttggagataccgggtaaagaaattaccatacacatgggaggatgcttgctacttgacttgtatttcactccagatacctgtgaatacatggaaaaatattgatgagtctaggaaggaggaccttgtgagaagacacctttgggaaaagagcaacatggagaggtacactgcagagacgagaaaggaatcaaagcgtaggaggtag

SEQ ID NO: 7976 - protein, 294 aa, Sorghum bicolor
  misc_feature: Ceres ANNOT ID no. 6086301
  misc_feature (28)..(89): Pfam Id: DnaJ Pfam Desc: DnaJ domain
  misc_feature (7)..(260): NCBI GI: 4508077
  misc_feature (4)..(293): NCBI GI: 54644019 NCBI Desc: ga20648-pa [drosophila pseudoobscura]
  misc_feature (5)..(293): NCBI GI: 18859921 NCBI Desc: cg7872-pa [drosophila melanogaster]
  misc_feature (20)..(293): NCBI GI: 116126143 NCBI Desc: ensangp00000010358 [anopheles gambiae str. pest]
  misc_feature (12)..(202): NCBI GI: 119579488 NCBI Desc: hcg1994888, isoform cra_d [homo sapiens]
MAAASHLLSFFLLLLLPASNAIYCDEDDCYDLLGLKQDANASDIKKAYYKLSLKYHPDKNPDPESRKLFVKIANAYEILKDESTREQYDYAIEHPEEVFYNTAQYYRAYYGHKTDPRAVLIGLLLIVSAFQYINQLTRYNQAMESVKQTPAYKNRLKALEFERTGGIASKKKGHKQVDKKVEEELSNEVELQIHGVEKPSVWRLYGVQFILLPYSIGKVLSWKICWFWRYRVKKLPYTWEDACYLTCISLQIPVNTWKNIDESRKEDLVRRHLWEKSNMERYTAETRKESKRRR

SEQ ID NO: 7977 - DNA, 699 bp, Sorghum bicolor
  misc_feature: Ceres ANNOT ID no. 6086303
  misc_feature: Encodes the peptide sequence at SEQ ID NO 7978
atgccaatggcgtcgtccaccctccacttcgccgccgtgttcgccgtctccttcgccctcctcgtggcgtccgtgtcgtcgacgccaccggcggtgttcaaagtcggcgacgagcgtgggtgggcggtgccggcgaatggcaccgagacgtacaaccactgggccaagaggaaccgcgtccaagtcggcgacgtcctgagtttcaagtacgccaacaacgactcggtgctgctggtgtcccacgacgactacaagcagtgcagcacggagacgccggtgagccggttctcgagcggcgacaccaagttcaagctcgacagctacgggcccctctacttcgtcagcggcgccgccggccactgcgaggcgggacagcggatgatcgtgcgggtcagggccccctccgcactgtacggctcccccgcggcggcgccggggatgccgccggccgtcagtggcagaggcggcggcggcgcgcccaggcgcagcccggtctcctcacccgccgtgccgccggtcgtcggctcccgtgccggttccactgctcccaccccgagcacgagcccaagtccgagcccgagcccgatgccgcaggccagtggtgcgtcgtctaggcgcgtgcttggcgtcgtgtcatccgttgcagtagggcttgtggtgttggttgccagctccatcaccctgtccgtggttgcttga

SEQ ID NO: 7978 - protein, 232 aa, Sorghum bicolor
  misc_feature: Ceres ANNOT ID no. 6086303
  misc_feature (41)..(125): Pfam Id: Cu_bind_like Pfam Desc: Plastocyanin-like domain
  misc_feature (12)..(197): NCBI GI: 62861389 NCBI Desc: early salt stress and cold acclimation-induced protein 2-3 [lophopyrum elongatum]
  misc_feature (18)..(199): NCBI GI: 62861393 NCBI Desc: early salt stress and cold acclimation-induced protein 2-1 [lophopyrum elongatum]
  misc_feature (18)..(199): NCBI GI: 62861391 NCBI Desc: cold acclimation induced protein 2-1 [triticum aestivum]
  misc_feature (14)..(204): NCBI GI: 92883612 NCBI Desc: blue (type 1) copper domain [medicago truncatula]
  misc_feature (3)..(147): NCBI GI: 22775562 NCBI Desc: phosphoprotein ntepb1 [nicotiana tabacum]
MPMASSTLHFAAVFAVSFALLVASVSSTPPAVFKVGDERGWAVPANGTETYNHWAKRNRVQVGDVLSFKYANNDSVLLVSHDDYKQCSTETPVSRFSSGDTKFKLDSYGPLYFVSGAAGHCEAGQRMIVRVRAPSALYGSPAAAPGMPPAVSGRGGGGAPRRSPVSSPAVPPVVGSRAGSTAPTPSTSPSPSPSPMPQASGASSRRVLGVVSSVAVGLVVLVASSITLSVVA

SEQ ID NO: 7979 - DNA, 1242 bp, Sorghum bicolor
  misc_feature: Ceres ANNOT ID no. 6086311
  misc_feature: Encodes the peptide sequence at SEQ ID NO 7980
atgccggtcaccgccggcgccccgtccaccctcgtcgccctcttcgtcaccgcagtggtgctagctgccacttcggcgccggcatgctatgccgcgcacaatatcaccgccatcctctccgggcgccgggacctcgccgagttcagccgcgagctcgcggccacggggctcgcggacgacatcaacgggcggaacacgatcacggtcctcgccgtggacgacgcccacatggcgccgctgaaggcgcgcggcctcccgcgggagacgctgcggcacgtgctctccctccacgtcctcgtcgactactacgacgacgccaagctgcaccgcctccccggcggctccgcggacgtgtccacgctgttccaggcctcgggcgacgcgcccgggagcgccggcatggtgaaggtcgccgagcgccggggcgggcgcgtggccttcgtgccccaggacgacgacgcggggagcaccgccgtcttctacgtcaggtccgtccacgagacgccctacaacatctcggttcttcaggtgagcggcgtgatctcgtcccctgcggccgaggcgcccgcggcgacggccgatccaagcaggcgcaacgtctcggacgtcatgtccaagaacgggtgcgggcgcttcgcgggcctcgtggccaccacgggcgacgcggccgcgacgttcgagaagaaggcccacgacgacggcggcttcacgttcttctgcccggcggacaaggcggtggaggcgttccagccgacgttcaacaggctctccgccgacgcccggctcgccgtggtgctgtaccacggcgcgctggggcactactccatgcaggcgctcaaggcgggcgaccaagacctgggcacgctggcctcgctcgacggggggaattccaacttcgacttcgcggtgcgcaacgtccgcgacaagctgacgctggtgtccgcgacgcacaacgtggccagggtcacccgcacgctcgcgtacgaggaagacgtcgccgtgtacatgatcgacgcggtgctggtgccgtgtgacctcacggcggcgcaaggaacagggggaacggagcacggcgagctctcgtccggttccgatgggcgttcgggcgggaaagacggcggaggtggtcaccagacgagtggctcgacggcttcggctccgactccgtgctggctaccgcgtgaatggttcgccacttcggcgcttctgttcactcttctggcggcgtttgcgtctggttga

SEQ ID NO: 7980 - protein, 413 aa, Sorghum bicolor
  misc_feature: Ceres ANNOT ID no. 6086311
  misc_feature (208)..(343): Pfam Id: Fasciclin Pfam Desc: Fasciclin domain
  misc_feature (8)..(234): NCBI GI: 115349948 NCBI Desc: fasciclin-like protein fla33 [triticum aestivum]
  misc_feature (11)..(352): NCBI GI: 2104712 NCBI Desc: endosperm specific protein [zea mays]
  misc_feature (7)..(352): NCBI GI: 13377778 NCBI Desc: fasciclin-like arabinogalactan-protein 2 [arabidopsis thaliana]
  misc_feature (9)..(409): NCBI GI: 115349940 NCBI Desc: fasciclin-like protein fla28 [triticum aestivum]
  misc_feature (19)..(346): NCBI GI: 115349890 NCBI Desc: fasciclin-like protein fla3 [triticum aestivum]
  misc_feature: Useful for making plants with altered cell wall content and/or composition
  misc_feature: Functional homolog of the protein sequence encoded by LOCUS at4g12730
MPVTAGAPSTLVALFVTAVVLAATSAPACYAAHNITAILSGRRDLAEFSRELAATGLADDINGRNTITVLAVDDAHMAPLKARGLPRETLRHVLSLHVLVDYYDDAKLHRLPGGSADVSTLFQASGDAPGSAGMVKVAERRGGRVAFVPQDDDAGSTAVFYVRSVHETPYNISVLQVSGVISSPAAEAPAATADPSRRNVSDVMSKNGCGRFAGLVATTGDAAATFEKKAHDDGGFTFFCPADKAVEAFQPTFNRLSADARLAVVLYHGALGHYSMQALKAGDQDLGTLASLDGGNSNFDFAVRNVRDKLTLVSATHNVARVTRTLAYEEDVAVYMIDAVLVPCDLTAAQGTGGTEHGELSSGSDGRSGGKDGGGGHQTSGSTASAPTPCWLPREWFATSALLFTLLAAFASG

SEQ ID NO: 7981 - DNA, 906 bp, Sorghum bicolor
  misc_feature: Ceres ANNOT ID no. 6086317
  misc_feature: Encodes the peptide sequence at SEQ ID NO 7982
atggatctctgggagagggcccggtccttcgccggcgaggcggcgaagcggtcgcaggagctctccgcggaggcggccaagcgctcgtcggcgctagtctcggagacggcgaagaagtccaaggagatcttctccgagaccgcctccaagtcgcgggagatcgccgccgaggccaccaagcaggccgacctcctcgccggccagatcatgcacctcgcctccgacctccctgtgccctcgatcccgcccatccccgcgatcccgcctatcgccgccgccgcctcgtcggagtccgacaccgccgagcttgagcgctacggcatcaccgacgacctccgcgagttcgtcaagggcatgaccttaagcaccttccgcgacttcccactgcaagatgagccggagatgtctgatgtgccaacggtgtcgaatgtgcgtcaggatctgaacgagtggcaggccaggcatgccacacttgtcctctcggcagtcaaggaaatatcaaagttcagatatgagctatgcccaagatacatgaaagagcgcaaattctggcgggtatattttttgctagtaaacagctatatagccccgtttgagaagaaatacttcgaggagctgaaagtgaaagcagaggaagagaaaaaggattccccgaaggaagcatctcaagcatcaacaactgcagaaccgaaagacacaaaagcgccaagcaagtcctcttcaacaaatccagaacatgatctggatgtatttctgctgggggatctgggtagcgacgatgagggtcctgttgatggtgatgatgggctagatgatgactttgataggattgatgcgaccacgggtttggaaagtgatgatgatgacaaaataccagcaacagggaaggcagaagatgcaaagtag

SEQ ID NO: 7982 - protein, 301 aa, Sorghum bicolor
  misc_feature: Ceres ANNOT ID no. 6086317
  misc_feature (136)..(201): Pfam Id: BSD Pfam Desc: BSD domain
  misc_feature (2)..(197): NCBI GI: 42571647 NCBI Desc: bsd domain-containing protein [arabidopsis thaliana]
  misc_feature (91)..(244): NCBI GI: 115461106 NCBI Desc: os04g0662000 [oryza sativa (japonica cultivar-group)]
  misc_feature (13)..(130): NCBI GI: 6730653 NCBI Desc: f4n2.1 [arabidopsis thaliana]
  misc_feature (81)..(261): NCBI GI: 115485895 NCBI Desc: os11g0557300 [oryza sativa (japonica cultivar-group)]
  misc_feature (102)..(192): NCBI GI: 115455117 NCBI Desc: os03g0729900 [oryza sativa (japonica cultivar-group)]
MDLWERARSFAGEAAKRSQELSAEAAKRSSALVSETAKKSKEIFSETASKSREIAAEATKQADLLAGQIMHLASDLPVPSIPPIPAIPPIAAAASSESDTAELERYGITDDLREFVKGMTLSTFRDFPLQDEPEMSDVPTVSNVRQDLNEWQARHATLVLSAVKEISKFRYELCPRYMKERKFWRVYFLLVNSYIAPFEKKYFEELKVKAEEEKKDSPKEASQASTTAEPKDTKAPSKSSSTNPEHDLDVFLLGDLGSDDEGPVDGDDGLDDDFDRIDATTGLESDDDDKIPATGKAEDAK

SEQ ID NO: 7983 - DNA, 954 bp, Sorghum bicolor
  misc_feature: Ceres ANNOT ID no. 6086338
  misc_feature: Encodes the peptide sequence at SEQ ID NO 7984
atggcgagcagcaacgtctccaccgtctacatctctgtcattgatgacgtcatctccaaggtccgcgaggatttcatcacctacggagtcggcgacgccgtcctaaacgagctccaggctaccccaatccagactcctctgccagggacagacacagggatgtacaacatacccaccggcccttctgattatgccccatcacctatcagcgatatcaggaacgggatggcgataaatggggcagacccaaaagctggccgtccaagtccctacatgccaccaccttccccatggatgagtcagaggccgctgggtgttgatgtgaatgtcgcctatgtggaaggccgtgaagatcctgacaggggcgtgcagcctcagccactgactcaggattttttgatgatgtcctctggaaaacgcaagagggatgagtatcctggtcagtcccttctggttcttttgtacctcagcaagatggaagaaaatgcaaaccaactttggagttccatcatcaacaagcttgaaacaccaaccaagacaatcactccagttattccgcagtgtgatgggattcaggatgactataatgatcaatttttctttcaaggagttccaactgaagattataatacccctggagaatctgcggagtatcgagctcctacacctgctgttggaacaccaaaaccaagaaatgatgctggagatgatgacgatgacgatgatgaacctcctcttaatgaagacgatgacgacgatgatgagttagatgaccttgagcaaggggaggatgaacctaacacacaacatcttgtacttgcacaatttgacaaagtgacaaggaccaagaatcgttggaagtgcactttgaaggatggaatcatgcatttgaatggcagggatgttctatttaacaaggttggtaacataatatttttttggtcaagtttgtga

SEQ ID NO: 7984 - protein, 317 aa, Sorghum bicolor
  misc_feature: Ceres ANNOT ID no. 6086338
  misc_feature (8)..(314): Pfam Id: TFIIA Pfam Desc: Transcription factor IIA, alpha/beta subunit
  misc_feature (41)..(306): NCBI GI: 115463003 NCBI Desc: os05g0292200 [oryza sativa (japonica cultivar-group)]
  misc_feature (41)..(306): NCBI GI: 39545932 NCBI Desc: tfiia-l1 [arabidopsis thaliana]
  misc_feature (41)..(147): NCBI GI: 8778543 NCBI Desc: f22g5.14 [arabidopsis thaliana]
  misc_feature (41)..(306): NCBI GI: 1429226 NCBI Desc: tfiia [arabidopsis thaliana]
  misc_feature (46)..(309): NCBI GI: 8778565 NCBI Desc: f22g5.18 [arabidopsis thaliana]
  misc_feature: Useful for making plants with altered terpenoid content
  misc_feature: GREAT-hit functional homolog of the protein sequence given in SEQ ID NO 13000
  misc_feature: Useful for making plants with altered terpenoid content
  misc_feature: Functional homolog of the protein sequence given in SEQ ID NO 13000
MASSNVSTVYISVIDDVISKVREDFITYGVGDAVLNELQATPIQTPLPGTDTGMYNIPTGPSDYAPSPISDIRNGMAINGADPKAGRPSPYMPPPSPWMSQRPLGVDVNVAYVEGREDPDRGVQPQPLTQDFLMMSSGKRKRDEYPGQSLLVLLYLSKMEENANQLWSSIINKLETPTKTITPVIPQCDGIQDDYNDQFFFQGVPTEDYNTPGESAEYRAPTPAVGTPKPRNDAGDDDDDDDEPPLNEDDDDDDELDDLEQGEDEPNTQHLVLAQFDKVTRTKNRWKCTLKDGIMHLNGRDVLFNKVGNIIFFWSSL

SEQ ID NO: 7985 - DNA, 2019 bp, Sorghum bicolor
  misc_feature: Ceres ANNOT ID no. 6086342
  misc_feature: Encodes the peptide sequence at SEQ ID NO 7986
atggcgaggcttctcgtgctccgcgcagcgccgtaccgccactcctcccacctctgcgctgccaccctcctcgtgctctccccttcccagcaccgccacttcgcctccttcccctccccctccccctacgccgcgcgccgcatcctcccttcgccactccgcgtccctatccgcgcagtggagtcctcccccgggcccaccaaagaggagcaggatccgtctccggccgccagtgaggcccaggagcagctagcgcccgcggcgccggcgttcgaggtcgaagagctcgggtgggggacccagcttgctgtcaagctccgcatgctcgtggctccgccgtggcagcgcgtccgcaagggaagcgtcctcaacatgaagcttcgcggcgagatatctgatcaattgaagacacgcttctcgtcaggactgtcactaccacaaatctgtgagaattttgttaaggcagcatatgacccacgaatctcagggatttatctgcacatagagccactgagatgtgggtgggcgaaggtggatgagatcagaaggcacattgtggatttcaagaagtctggtaaatttgttgttggttatatgcctgtttgtggggagaaagaatactaccttgcttgcgcttgtggtgagctatatgcacctccaagtgcttatgttgctctgtttggcctaactgttgggcaaacatttctcagaggtgtccttgagaaagttggaatagaaccagaaattcaacgaattggtaaatacaaaagtgctggagatcaacttgcacgcaagagcatgtcaaatgaagtcagggagatgctggcaacactgcttgacaatatttatggaaactggctggaaacaatatcttctacacttgggaagaaaaaagaagaaattgagggatttattaattcaggggtctaccaggttgccagactcaaggaagaaggttggataacagatttactgtatgacgatgaggtaatgacattactaaaggagagagtagggcagaaagacaagaaaagtctgcgtatggttgactacagtaaatactcgcgtgttagtaaacagactcttggattacaaggaggaggtgaacaaattgccataatcagagcttctggaagtataacacggactcgtagcccattgagtgctcctggttcaggcattatcgctgagcagttaattgagaagatacgaactgttagagaatcagaaaagtacaaagctgttatcctacgtatagacagccctggtggtgatgctcttgcttctgacctgatgtggagagaaatccgacttctagccaactctaaacctgtggttgcttcgatgtctgatgttgctgcaagtgggggatactacatggcaatggctgcaccagtaattgttgctgagaaacttacccttacaggatcaattggagttgttacagggaagttctgccttcaaaagttttatgagagaattgatttcaataaagaaattctatccaagggtcgatacgcggagcttaatgctgctgatcaacgacctttaagaccagacgaggcagagctttttgaaaagtcagcacaaaatgcttatgcattgtttcgtgataaagcagccatgtcgcgatcaatgagtgttgatcagatggagattgtcgctcaaggtcgagtgtggagtggccatgatgcattttcaagagggttggttgattcagtaggtggactctcacaagctcttgctattgcaaaacagaaagctaatatacccaaggataagaagatccagctagttgaagtttcaaagccctccccatcattaccagaaatcttatctggcattggaggttcattgcttggagttgacagggcagtgaagggagtgctccaggacatgaccaccctaagtggagtccaagctaggatggatggaatcttgtttgaaaatttaggagatatgtcaggagaaaatcaattattgttgctcgtaaaagatatcatgaactattttgattga

SEQ ID NO: 7986 - protein, 672 aa, Sorghum bicolor
  misc_feature: Ceres ANNOT ID no. 6086342
  misc_feature (187)..(341): Pfam Id: Peptidase_S49 Pfam Desc: Peptidase family S49
  misc_feature (437)..(591): Pfam Id: Peptidase_S49 Pfam Desc: Peptidase family S49
  misc_feature (104)..(599): NCBI GI: 116230056 NCBI Desc: signal peptide peptidase sppa, 67k type [solibacter usitatus ellin6076]
  misc_feature (142)..(633): NCBI GI: 124003560 NCBI Desc: signal peptide peptidase sppa, 67k type [microscilla marina atcc 23134]
  misc_feature (106)..(626): NCBI GI: 37523775 NCBI Desc: protease iv [gloeobacter violaceus pcc 7421]
  misc_feature (129)..(617): NCBI GI: 113475281 NCBI Desc: signal peptide peptidase sppa, 67k type [trichodesmium erythraeum ims101]
  misc_feature (123)..(597): NCBI GI: 23128294 NCBI Desc: cog0616: periplasmic serine proteases (clpp class) [nostoc punctiforme pcc 73102]
MARLLVLRAAPYRHSSHLCAATLLVLSPSQHRHFASFPSPSPYAARRILPSPLRVPIRAVESSPGPTKEEQDPSPAASEAQEQLAPAAPAFEVEELGWGTQLAVKLRMLVAPPWQRVRKGSVLNMKLRGEISDQLKTRFSSGLSLPQICENFVKAAYDPRISGIYLHIEPLRCGWAKVDEIRRHIVDFKKSGKFVVGYMPVCGEKEYYLACACGELYAPPSAYVALFGLTVGQTFLRGVLEKVGIEPEIQRIGKYKSAGDQLARKSMSNEVREMLATLLDNIYGNWLETISSTLGKKKEEIEGFINSGVYQVARLKEEGWITDLLYDDEVMTLLKERVGQKDKKSLRMVDYSKYSRVSKQTLGLQGGGEQIAIIRASGSITRTRSPLSAPGSGIIAEQLIEKIRTVRESEKYKAVILRIDSPGGDALASDLMWREIRLLANSKPVVASMSDVAASGGYYMAMAAPVIVAEKLTLTGSIGVVTGKFCLQKFYERIDFNKEILSKGRYAELNAADQRPLRPDEAELFEKSAQNAYALFRDKAAMSRSMSVDQMEIVAQGRVWSGHDAFSRGLVDSVGGLSQALAIAKQKANIPKDKKIQLVEVSKPSPSLPEILSGIGGSLLGVDRAVKGVLQDMTTLSGVQARMDGILFENLGDMSGENQLLLLVKDIMNYFD

SEQ ID NO: 7987 - DNA, 918 bp, Sorghum bicolor
  misc_feature: Ceres ANNOT ID no. 6086343
  misc_feature: Encodes the peptide sequence at SEQ ID NO 7988
atggccttctcacccccgctgatcgactgggaggcggagagctaccccgcatacccagacttcgcagccattccctttttcgtcgtcttcttcctcgtcgtccgtttcttcctcgaccgcttcgtattcgagtggttagccaggaaattgattttcaaggaggatgagaagcttggtcctactacatacgcaggcaagagaaagatcaggaaatttaaagaatcagcttggaaatgcatttatttcctttctggggagctattggcattgtctgtgacatacaacgagccttggttcacaaccacaagaaatttctgggttggaccaggtgatcagatctggccagatcaaaaaataaaatttaaactcaaggcggtctatatgtatgttgctggtttttacacatactcgatatttgcccttttgttttgggaaacaaggcgctcagacttcggtatttcaatgactcatcatgtagcaactgtttgtctgatagcactgtcttacatattcagatttgctcgggtgggttcagttgtccttgccattcatgatgcaactgatgtgttcctggagcttggaaaaatttccaagtatagtggccacgagttgtttgcagatgtttcatttcttgttttcgtcagttcttgggtactccttcgccttatatattacccattctggattctctggagcacgagctatgaagttgttctgactctagacaaggagaagcataaagttgacgggccaatatactactatgtattcaacagtcttctcttctcgctacttgttctacacatatattggtgggttttaatgtatcggatgcttgtgaagcaaatacagtctagaggacacgttggggatgatatacgatctgattctgaaggtgaagaggaacatgaggattga

SEQ ID NO: 7988 - protein, 305 aa, Sorghum bicolor
  misc_feature: Ceres ANNOT ID no. 6086343
  misc_feature (90)..(302): Pfam Id: LAG1 Pfam Desc: Longevity-assurance protein (LAG1)
  misc_feature (5)..(295): NCBI GI: 62899859 NCBI Desc: asc1-like protein 2 (alternaria stem canker resistance-like protein 2)
  misc_feature (8)..(305): NCBI GI: 62899852 NCBI Desc: asc1-like protein 1 (alternaria stem canker resistance-like protein 1)
  misc_feature (8)..(305): NCBI GI: 7688742 NCBI Desc: asc1 [lycopersicon esculentum]
  misc_feature (8)..(235): NCBI GI: 34365553 NCBI Desc: at1g13580/f13b4_25 [arabidopsis thaliana]
  misc_feature (21)..(302): NCBI GI: 7658241 NCBI Desc: lag1 homolog 2 [arabidopsis thaliana]
MAFSPPLIDWEAESYPAYPDFAAIPFFVVFFLVVRFFLDRFVFEWLARKLIFKEDEKLGPTTYAGKRKIRKFKESAWKCIYFLSGELLALSVTYNEPWFTTTRNFWVGPGDQIWPDQKIKFKLKAVYMYVAGFYTYSIFALLFWETRRSDFGISMTHHVATVCLIALSYIFRFARVGSVVLAIHDATDVFLELGKISKYSGHELFADVSFLVFVSSWVLLRLIYYPFWILWSTSYEVVLTLDKEKHKVDGPIYYYVFNSLLFSLLVLHIYWWVLMYRMLVKQIQSRGHVGDDIRSDSEGEEEHED

SEQ ID NO: 7989 - DNA, 1107 bp, Sorghum bicolor
  misc_feature: Ceres ANNOT ID no. 6086344
  misc_feature: Encodes the peptide sequence at SEQ ID NO 7990
atgaattgtaatttcagtactaaccttttcaagcaggaagctttggggagaagttctccaacggccaggccatgcgatggatgccatgcagtgcaaagcgtggtttactgccattctgatgctaagtgtctctgtgtgtcacgtgataaacaggttcattctgctaatcaagtggctgagcgtgcgcatgtatgtgaggtatgcaagagtgcatccacagtattgacatgctgtgcagatgcaccagcactctgtaccacctgtgatgcaaagttgcactctgcaaatacactatctcagagacaccagcgagtgcctgtgctgccacttccagctgctgctattcaaaccacctccagttttgatgagggaaaagcttttgtcattacccatggtatcaaggaggaagaagaggaagtggattcttggctcctgctcacagaggattctgattatagcaattgtaccaactccaccgccactgcaaacaacaatagaaacaagaaaatgggttttggtgatgtagatcaatattttgaccttagtggatataatccatactatcacagcaacatcaccagaaacccagaggagcagtacatgcaagagcaacagcagatacagagaaggtatctagagaaggaatggaacgagtgtgcagtaccttcacagctcaccatggtatatgagcagcagcagagtgtttatggaattggaggggcaaaaaacgctgtgtcagtcaccagcagcatatctctttcatcaatggaggcgggtatagtaccagacaataccatagcaggtatatcaaacctcaatattctaacaactggtggggtggacctattaccagtccgctcgtttcagatgccagtgcatttgagccccagggacagagcagccaggatcctcaggtacaaggagaaaaggcaggcaagaaattttaataagaccataaggtacgcaacaagaaaagcatatgctcaagcacggccccggatcaagggtcgcttcaccaaaatatcagatgtagagcttaaagtggatctgatgtcctcaccaccagatctacccaacagtagctatggtaccgttccatggttctga

SEQ ID NO: 7990 - protein, 368 aa, Sorghum bicolor
  misc_feature: Ceres ANNOT ID no. 6086344
  misc_feature (299)..(343): Pfam Id: CCT Pfam Desc: CCT motif
  misc_feature (60)..(107): Pfam Id: zf-B_box Pfam Desc: B-box zinc finger
  misc_feature (1)..(368): NCBI GI: 36789793 NCBI Desc: hd1-like protein [triticum aestivum]
  misc_feature (1)..(368): NCBI GI: 36789817 NCBI Desc: hd1-like protein [triticum aestivum]
  misc_feature (1)..(368): NCBI GI: 36789806 NCBI Desc: hd1-like protein [triticum aestivum]
  misc_feature (1)..(368): NCBI GI: 21667477 NCBI Desc: constans-like protein [hordeum vulgare subsp. vulgare]
  misc_feature (1)..(368): NCBI GI: 107770485 NCBI Desc: constance-like protein [lolium perenne]
  misc_feature: The sequence is a functional homolog of SEQ ID NO 462 in the 11/479,226US patent application
  misc_feature: Useful for making plants with modulated growth and phenotype characteristics
  misc_feature: The sequence is a functional homolog of SEQ ID NO 462 in the 20070022495 US patent application
  misc_feature: The sequence is a functional homolog of SEQ ID NO. 370 in the 11/188,298 US application
MNCNFSTNLFKQEALGRSSPTARPCDGCHAVQSVVYCHSDAKCLCVSRDKQVHSANQVAERAHVCEVCKSASTVLTCCADAPALCTTCDAKLHSANTLSQRHQRVPVLPLPAAAIQTTSSFDEGKAFVITHGIKEEEEEVDSWLLLTEDSDYSNCTNSTATANNNRNKKMGFGDVDQYFDLSGYNPYYHSNITRNPEEQYMQEQQQIQRRYLEKEWNECAVPSQLTMVYEQQQSVYGIGGAKNAVSVTSSISLSSMEAGIVPDNTIAGISNLNILTTGGVDLLPVRSFQMPVHLSPRDRAARILRYKEKRQARNFNKTIRYATRKAYAQARPRIKGRFTKISDVELKVDLMSSPPDLPNSSYGTVPWF

SEQ ID NO: 7991 - DNA, 918 bp, Sorghum bicolor; identical to SEQ ID NO: 7987
  misc_feature: Ceres ANNOT ID no. 6086347
  misc_feature: Encodes the peptide sequence at SEQ ID NO 7992

SEQ ID NO: 7992 - protein, 305 aa, Sorghum bicolor; identical to SEQ ID NO: 7988
  misc_feature: Ceres ANNOT ID no. 6086347
  misc_feature (90)..(302): Pfam Id: LAG1 Pfam Desc: Longevity-assurance protein (LAG1)
  misc_feature (5)..(295): NCBI GI: 62899859 NCBI Desc: asc1-like protein 2 (alternaria stem canker resistance-like protein 2)
  misc_feature (8)..(305): NCBI GI: 62899852 NCBI Desc: asc1-like protein 1 (alternaria stem canker resistance-like protein 1)
  misc_feature (8)..(305): NCBI GI: 7688742 NCBI Desc: asc1 [lycopersicon esculentum]
  misc_feature (8)..(235): NCBI GI: 34365553 NCBI Desc: at1g13580/f13b4_25 [arabidopsis thaliana]
  misc_feature (21)..(302): NCBI GI: 7658241 NCBI Desc: lag1 homolog 2 [arabidopsis thaliana]

SEQ ID NO: 7993 - DNA, 1107 bp, Sorghum bicolor; identical to SEQ ID NO: 7989
  misc_feature: Ceres ANNOT ID no. 6086348
  misc_feature: Encodes the peptide sequence at SEQ ID NO 7994

SEQ ID NO: 7994 - protein, 368 aa, Sorghum bicolor; identical to SEQ ID NO: 7990
  misc_feature: Ceres ANNOT ID no. 6086348
  misc_feature (299)..(343): Pfam Id: CCT Pfam Desc: CCT motif
  misc_feature (60)..(107): Pfam Id: zf-B_box Pfam Desc: B-box zinc finger
  misc_feature (1)..(368): NCBI GI: 36789793 NCBI Desc: hd1-like protein [triticum aestivum]
  misc_feature (1)..(368): NCBI GI: 36789817 NCBI Desc: hd1-like protein [triticum aestivum]
  misc_feature (1)..(368): NCBI GI: 36789806 NCBI Desc: hd1-like protein [triticum aestivum]
  misc_feature (1)..(368): NCBI GI: 21667477 NCBI Desc: constans-like protein [hordeum vulgare subsp. vulgare]
  misc_feature (1)..(368): NCBI GI: 107770485 NCBI Desc: constance-like protein [lolium perenne]
  misc_feature: The sequence is a functional homolog of SEQ ID NO 462 in the 11/479,226US patent application
  misc_feature: Useful for making plants with modulated growth and phenotype characteristics
  misc_feature: The sequence is a functional homolog of SEQ ID NO 462 in the 20070022495 US patent application
  misc_feature: The sequence is a functional homolog of SEQ ID NO. 370 in the 11/188,298 US application

SEQ ID NO: 7995 - DNA, 453 bp, Sorghum bicolor
  misc_feature: Ceres ANNOT ID no. 6086352
  misc_feature: Encodes the peptide sequence at SEQ ID NO 7996
atggggagcgacacggagacggagaagaagaagaccccggtggcgctgatgcccatcgcgaagcccctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatgtttctcctattgatgtgattacacatgttcctatactatgtgaggaagctaatgttccttacatatatgttccatcaaaagaggatcttgcgactgcaggaaccacaaagaggccgacttgttgcgtcttggttctgaccaaaccaaccaagggggagctcagtgaagaggtgaaggataaactgaagtcagactatgaccaagttgtaacggaagttgctgaggctacgtctgcaatgttctga

SEQ ID NO: 7996 - protein, 150 aa, Sorghum bicolor
  misc_feature: Ceres ANNOT ID no. 6086352
  misc_feature (30)..(124): Pfam Id: Ribosomal_L7Ae Pfam Desc: Ribosomal protein L7Ae/L30e/S12e/Gadd45 family
  misc_feature (1)..(149): NCBI GI: 8346555 NCBI Desc: nhp2-like protein [arabidopsis thaliana]
  misc_feature (15)..(142): NCBI GI: 1431346 NCBI Desc: nhp2 [saccharomyces cerevisiae]
  misc_feature (15)..(142): NCBI GI: 59799862 NCBI Desc: high mobility group-like nuclear protein 2 (small nucleolar rnp protein nhp2) (h/aca snornp protein nhp2)
  misc_feature (15)..(142): NCBI GI: 44980751 NCBI Desc: abl115wp [eremothecium gossypii]
  misc_feature (15)..(142): NCBI GI: 45185115 NCBI Desc: abl115wp [eremothecium gossypii]
MGSDTETEKKKTPVALMPIAKPLAGKKLCKRTLKLVRRASEAKCLKRGVKEVVKSIRRGNKGLCVIAGNVSPIDVITHVPILCEEANVPYIYVPSKEDLATAGTTKRPTCCVLVLTKPTKGELSEEVKDKLKSDYDQVVTEVAEATSAMF

SEQ ID NO: 7997 - DNA, 1026 bp, Sorghum bicolor
  misc_feature: Ceres ANNOT ID no. 6086363
  misc_feature: Encodes the peptide sequence at SEQ ID NO 7998
atggagtccggacggctcatcttcaacgcgcccggctccggcgccgggcagatgctcttcctggactgcggcgcagccggtggtcccggcggcggcggcggcggcggcttgttccatcgaggcgggagaccgatgcttggccttgaagaagggcgcggcgtaaaacggcccttcttcacctcgcccgacgagctcctcgaggaggagtactacgacgagcagctgccggagaagaagcgccgcctcacaccggagcaggtgcatctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgccctccgcgcggaccacgacgtcatcctccaggacaaccaccgcctccgttcacaggtggtgtcgttgaccgagaagctgcaagagaaggaggcgacggagggcggcgccagcgctgccaccgacgccgcggcagcgttgccggcggtggacgacgtcaaggcttccttggccgatgacgtcgaggagccaacagagccggcggcggaggaggaggaggcggcgttcgaggtgcaacaggtgaagtccgaggacaggctgagcacgggcagcggcgggagcgcggtggtggacacggacgctctgttgtacggcgccggttgccggttcgccgcggccgttgatagcagcgtggagtcctacttccccggcggcgaggaccaccactaccacgactgcgggatgggtccagtaaaccacggcgcgggaggagggatccagtcggatgacgacggcgccggcagcgacgagggatgcagctactacgccgaagaagaagccgccgcgttcttcgccggacacacccaccaccacgcggacgacgacgaggacgccggccagatcagctggtggatgtggaactag

SEQ ID NO: 7998 - protein, 341 aa, Sorghum bicolor
  misc_feature: Ceres ANNOT ID no. 6086363
  misc_feature (78)..(132): Pfam Id: Homeobox Pfam Desc: Homeobox domain
  misc_feature (133)..(177): Pfam Id: HALZ Pfam Desc: Homeobox associated leucine zipper
  misc_feature (49)..(292): NCBI GI: 46242599 NCBI Desc: hox16 [oryza sativa (japonica cultivar-group)]
  misc_feature (49)..(292): NCBI GI: 45593096 NCBI Desc: homeodomain leucine zipper protein 16 [oryza sativa (japonica cultivar-group)]
  misc_feature (1)..(180): NCBI GI: 6016706 NCBI Desc: homeobox-leucine zipper protein hat5 (hd-zip protein 5) (hd-zip protein athb-1) [arabidopsis thaliana]
  misc_feature (1)..(198): NCBI GI: 18034441 NCBI Desc: homeodomain leucine zipper protein cphb-5 [craterostigma plantagineum]
  misc_feature (73)..(210): NCBI GI: 15148920 NCBI Desc: homeodomain leucine zipper protein hdz3 [phaseolus vulgaris]
  misc_feature: The sequence is a functional homolog of SEQ ID NO 110 in the 10/412,699US patent application
  misc_feature: The sequence is a functional homolog of SEQ ID NO 1674 in the 10/374,780US patent application
  misc_feature: The sequence is a functional homolog of SEQ ID NO 218 in the 10/225,068US patent application
  misc_feature: The sequence is a functional homolog of SEQ ID NO 259 in the 11/479,226US patent application
  misc_feature: The sequence is a functional homolog of SEQ ID NO 262 in the 10/412,699US patent application
  misc_feature: The sequence is a functional homolog of SEQ ID NO 266 in the 10/412,699US patent application
  misc_feature: The sequence is a functional homolog of SEQ ID NO 574 in the 11/479,226US patent application
  misc_feature: The sequence is a functional homolog of SEQ ID NO 585 in the 11/479,226US patent application
  misc_feature: The sequence is a functional homolog of SEQ ID NO 74 in the 10/374,780US patent application
  misc_feature: Useful for making plants with modulated growth and phenotype characteristics
  misc_feature: The sequence is a functional homolog of SEQ ID NO 110 in the 20040045049 US patent application
  misc_feature: The sequence is a functional homolog of SEQ ID NO 262 in the 20040045049 US patent application
  misc_feature: The sequence is a functional homolog of SEQ ID NO 266 in the 20040045049 US patent application
  misc_feature: The sequence is a functional homolog of SEQ ID NO 1674 in the 20060162006 US patent application
  misc_feature: The sequence is a functional homolog of SEQ ID NO 1857 in the 11/479,226 US patent application
  misc_feature: The sequence is a functional homolog of SEQ ID NO 246 in the 10/666,642 US patent application
MESGRLIFNAPGSGAGQMLFLDCGAAGGPGGGGGGGLFHRGGRPMLGLEEGRGVKRPFFTSPDELLEEEYYDEQLPEKKRRLTPEQVHLLERSFEEENKLEPERKTELARKLGLQPRQVAVWFQNRRARWKTKQLERDFDRLKASFDALRADHDVILQDNHRLRSQVVSLTEKLQEKEATEGGASAATDAAAALPAVDDVKASLADDVEEPTEPAAEEEEAAFEVQQVKSEDRLSTGSGGSAVVDTDALLYGAGCRFAAAVDSSVESYFPGGEDHHYHDCGMGPVNHGAGGGIQSDDDGAGSDEGCSYYAEEEAAAFFAGHTHHHADDDEDAGQISWWMWN

SEQ ID NO: 7999 - DNA, 2409 bp, Sorghum bicolor
  misc_feature: Ceres ANNOT ID no. 6086364
  misc_feature: Encodes the peptide sequence at SEQ ID NO 8000
atggcgtcgtcgccgccgtcaccgccgccgaagctgccgatccccggccgccgcaacatactcatcaccagcgccttgccctatgtgaacaacgtcccgcacctcgggaacatcatcggatgcgtgctgagcgccgacgtgttcgcgcgctactgcaggctgcgcgggtacaacgcgctctacatatgcgggacggacgagtacgggacggccacggagaccaaggccatggaggagaagtgctcgcccaaggagatttgtgacaagtaccatgctatccacaacgaggtttacaagtggtttgacataaaatttgacaaatttgggcgtacgtcctctcctcagcagacagaaatctgccaagcaattttccataaattgatggaaaacaattggctaacagaaaacaccatgcagcagctttactgtgatacatgtagaaggtttttggctgataggcttgtagaaggaacatgccctatagaagggtgtactaataaagctgccagaggtgatcaatgtgacaattgcagccatatgttgaatccaactgaactaattgatccaaagtgtaaggtctgtaagaatactccccatattcgtgaaacagatcacttattcttggatctccctctattagaaggcaagttggtgaactatattaatgatacttcagtagctggtatgtggagtcaaaatgccattcaagctacaaatgcatggttaaaggaaggactaaagtcacgctgtatcacaagagatcttaaatggggggttcctgttccaattgagaagtataaagataaggttttctatgtctggttcgatgcaccgattggctatgtgtccatcacagcatcttatacacctgagtgggagcagtggtggaagaatcctgataatgtggaattatttcagttcatgggcaaagataatgtaccatttcatacgatcatgtttccgtcaacactactaggaaccggtgaaaattggacaatgatgaagaccattagtgtcactgaatatctgaactatgaaggaggaaaattctccaagagtaagggtatcggagtttttggtaatgatgccaaggatacgaatattcctcctgaagtgtggcgatactacctgcttatgaatcggcctgaggcatcagatacactttttacatggactgatttgcaagccaaattgaacagcgagttgttaaacaacttgggaaacttcatcaatcgtgtgctcagctttattgcaaaaccagtgggagctggatatgattcaattatacccgacgctcctggtgctgagtcacatccatcgacaagtgacattgcagaaaaagtcagtaaatccgttgaacaatatcttgatgcaatggaaaaggttaagctaaaacaaggactgaagagtgcaatgggcatctctactgatggaaatcgctatttgcaagaaagtgaattttggaaactttataaggacaatccagcaaactgtgcgattgtgatgaaaacttcagttggtcttgtatatctccttgcctgtctgttggagcctttcatgccttccttctcaaaagaagtgctacgtcaattaaacctgtccccagaagaaactctttctttcagtgaagaaaagggcgaaagtgcgaaggcaaaaaccccttgggatcttgtaccagcagggcacaaaatagggaggcctgtacctctgtttgaggaattgaaagatgaaaaggtgagtaagcatagggaaacatatgcaggcagtcaagctgagaggaggtcaaaagcagtggctgacgctgaagccacaaaaattgctaaccagctcaacagcatagcattatctggaggctcaaaaaaggaacaaaagaaaaagtctggtaactcaaaatcaaaggtggcagaggcagaaatatctgttgcaaagttggagattcgagtggggcttatcagaaaagcagagaagcacccagatgctgattcgctgtatgtagaggaaatcgatgttggagaggaggctccaagaacggtggttagtggccttgtcaaatacattcctcttgaagaaatgcagaaccggaaagtctgtgttctctgtaatctgaaaccagtggtgatgcgtggtataaaatcacatgccatggttttggctgcttctaatgaggatcatactagggttgagttggttgagccaccagcggatgctgccgtgggggagagggtgacctttgctgggcactccggtgagcctgaggcttctctcagtggcaagagcaaggtgtgggagaagctagccgctgacctgcatagcagcggcgagcttgtggcctgctacaaagatgtccctttcatgacttcggctggagtgtgcaaggtgaagacaatagcaaatggggaaatccgctag

SEQ ID NO: 8000 - protein, 802 aa, Sorghum bicolor
  misc_feature: Ceres ANNOT ID no. 6086364
  misc_feature (20)..(414): Pfam Id: tRNA-synt_1g Pfam Desc: tRNA synthetases class I (M)
  misc_feature (646)..(741): Pfam Id: tRNA_bind Pfam Desc: Putative tRNA binding domain
  misc_feature (1)..(802): NCBI GI: 4091008 NCBI Desc: methionyl-trna synthetase [oryza sativa]
  misc_feature (3)..(802): NCBI GI: 109940177 NCBI Desc: probable methionyl-trna synthetase (methionine--trna ligase) (metrs)
  misc_feature (3)..(802): NCBI GI: 54290977 NCBI Desc: methionyl-trna synthetase [oryza sativa (japonica cultivar-group)]
  misc_feature (6)..(802): NCBI GI: 115468260 NCBI Desc: os06g0508700 [oryza sativa (japonica cultivar-group)]
  misc_feature (10)..(802): NCBI GI: 92893761 NCBI Desc: aminoacyl-trna synthetase, class ia; nucleic acid-binding, ob-fold, subgroup [medicago truncatula]
  misc_feature (1)..(644): SWISSPROT Homolog: EC 6.1.1.10 Methionyl-tRNA synthetase, cytoplasmic
MASSPPSPPPKLPIPGRRNILITSALPYVNNVPHLGNIIGCVLSADVFARYCRLRGYNALYICGTDEYGTATETKAMEEKCSPKEICDKYHAIHNEVYKWFDIKFDKFGRTSSPQQTEICQAIFHKLMENNWLTENTMQQLYCDTCRRFLADRLVEGTCPIEGCTNKAARGDQCDNCSHMLNPTELIDPKCKVCKNTPHIRETDHLFLDLPLLEGKLVNYINDTSVAGMWSQNAIQATNAWLKEGLKSRCITRDLKWGVPVPIEKYKDKVFYVWFDAPIGYVSITASYTPEWEQWWKNPDNVELFQFMGKDNVPFHTIMFPSTLLGTGENWTMMKTISVTEYLNYEGGKFSKSKGIGVFGNDAKDTNIPPEVWRYYLLMNRPEASDTLFTWTDLQAKLNSELLNNLGNFINRVLSFIAKPVGAGYDSIIPDAPGAESHPSTSDIAEKVSKSVEQYLDAMEKVKLKQGLKSAMGISTDGNRYLQESEFWKLYKDNPANCAIVMKTSVGLVYLLACLLEPFMPSFSKEVLRQLNLSPEETLSFSEEKGESAKAKTPWDLVPAGHKIGRPVPLFEELKDEKVSKHRETYAGSQAERRSKAVADAEATKIANQLNSIALSGGSKKEQKKKSGNSKSKVAEAEISVAKLEIRVGLIRKAEKHPDADSLYVEEIDVGEEAPRTVVSGLVKYIPLEEMQNRKVCVLCNLKPVVMRGIKSHAMVLAASNEDHTRVELVEPPADAAVGERVTFAGHSGEPEASLSGKSKVWEKLAADLHSSGELVACYKDVPFMTSAGVCKVKTIANGEIR

SEQ ID NO: 8001 - DNA, 2325 bp, Sorghum bicolor
  misc_feature: Ceres ANNOT ID no. 6086371
  misc_feature: Encodes the peptide sequence at SEQ ID NO 8002
  misc_feature: Up-regulated in shoot tissues in response to salicylic acid treatment
atggatctggaggccgcgggcggcggggaggcggcgcaacgcaagcggcggaatggggagtcatggcgcgcgacgctgctgctcgcgtaccagagcctcggggtggtgtacggcgacgtggccacgtcgccgctctacgtctacaagagcgccttcgccggcaatgacatccagcactcggagggcaacgaggagatctacggcgtgctctcattcgtgttctggacgctgaccctcatcaccctcgtcaagtacgtgctcatcgtgctccgtgccgacgtcggcggggagggcggcaccttcgcgctctactccctcatctgccgtcacgtccgcgccggcctcctgcccggcggcggcaccagagacgagctcatggaggaagacaaggtcaccgggcgtcgtggcgagcggcccgtgtccagggtcagggcggtgctggagaagtacagagtgctgcagcggctgttgctgctcttcgcactgctcgggacatgtatggtcatcggggacggcgtgctcacccctgcagtctcagtgttttctgcggtatctgggcttgagttgtcgttggaaaaggaacagcacaaatatatagaacttccagtggcttgtgccatacttatatgcttgtttgcactgcaacactacggcacacacaaagttgggtttctttttgcaccaatcgtatgcatttggcttctctgcataagtgcaataggcctctacaatatcatccactgggaccaccatgtttatcgagccctctcgccatactacatgtatcaattcctccggaagactcaaactggtggctggatgtcactgggtggaatccttctttgtgtgacaggctctgaagctatgtatgcagatcttggacatttttcacaatcatcaatccagattgcattcatatccttggtttatcctgcacttgtattggcttatatgggacaagcagcttttatttcacaacatcacaacattgagagcagttatcatattggcttttatgtgtcagtaccagaaacactcagatggcctgttctggtgattgcgatactagcagctgtagttgggagtcaggcaattattactggaaccttttcaatcatcaagcagtgctcttcattaagttgtttccctggagtgaagattgtgcacacatcctcgacagtgcatggtcagatatacataccagaaatcaattggatgctgatgatactctgcctggctgttactattggcttcagagacacaaagcacttggcaaatgcacaagggttggcagtaataactgtcatgcttgttaccacttgcttaatgtcactcgttattgtgctttgctggaacaagagtatcttccttgcccttggtttcctgcttttctttggcacgatcgaagtaatctacttctcagctgcccttgtcaagtttcacgaaggtgcttgggttcctattactctctccttcatatttatggtggtcacgtgtgtctggcactatggcacaataaagaagtacgagttcgatgtgcaaaacaaggtttcagtaaactggctcttaaaccttggtccttcactgggcattgttcgtgttcgaggcattgggctaatacatacagaactaatgtctggaattccagctatcttctcccacttcgtcaccaatctgcctgcgtttcaccaggtactggtattcctctgtgtcaaatcagttcctgtgccgcatgtggaacctgaggaacgatttctggtgggtcgcattggtccaaaagagtataggttatacagggtcattgtcagatatggttatcgcgatgtgcagaaggatgatctagagttcgagaaggagctagtcagcaacattgcagagttcatccgcagcagtggggagtatgacaagaatggcttcgtcgaggacacagataagccctccgagaagctgtccaccatcagtactggaattaatatgtgggaagaggatggagaacttgatgcatctggaacccctcataaggagatagacccacacaatgcagtacccaagcaaaagaaagcaaggttcatgataccgaagagtgctcaggtggacagtgaggtgcgccgtgagctgcaggagctcatggacgctagggaggcaggcatgtccttcatcctggggcactcgtacatgaaggcaaagagcgggtcaagtttcataaagcgaattgtgataaacttcttctacgagttcttgaggaagaacagccgtggccctgcatacgctgcgaacataccacatgcctccactctggaggtaggaatggtctaccaggtctga

SEQ ID NO: 8002 - protein, 774 aa, Sorghum bicolor
  misc_feature: Ceres ANNOT ID no. 6086371
  misc_feature (27)..(774): Pfam Id: K_trans Pfam Desc: K+ potassium transporter
  misc_feature (131)..(675): NCBI GI: 62900352 NCBI Desc: potassium transporter 10 (oshak10)
  misc_feature (10)..(774): NCBI GI: 3176686 NCBI Desc: similar to high affinity potassium transporter, hak1 protein gbu22945 from schwanniomyces occidentalis. [arabidopsis thaliana]
  misc_feature (1)..(671): NCBI GI: 75232649 NCBI Desc: probable potassium transporter 9 (oshak9)
  misc_feature (1)..(772): NCBI GI: 91204712 NCBI Desc: potassium transporter [phragmites australis]
  misc_feature (1)..(772): NCBI GI: 91204710 NCBI Desc: potassium transporter [phragmites australis]
  misc_feature: Useful for making plants with modulated biomass
  misc_feature: Functional homolog of the protein sequence given in SEQ ID NO 13565
  misc_feature: Up-regulated in shoot tissues in response to salicylic acid treatment
  misc_feature: The sequence is a functional homolog of SEQ ID NO. 279 in the 11/188,298 US application
MDLEAAGGGEAAQRKRRNGESWRATLLLAYQSLGVVYGDVATSPLYVYKSAFAGNDIQHSEGNEEIYGVLSFVFWTLTLITLVKYVLIVLRADVGGEGGTFALYSLICRHVRAGLLPGGGTRDELMEEDKVTGRRGERPVSRVRAVLEKYRVLQRLLLLFALLGTCMVIGDGVLTPAVSVFSAVSGLELSLEKEQHKYIELPVACAILICLFALQHYGTHKVGFLFAPIVCIWLLCISAIGLYNIIHWDHHVYRALSPYYMYQFLRKTQTGGWMSLGGILLCVTGSEAMYADLGHFSQSSIQIAFISLVYPALVLAYMGQAAFISQHHNIESSYHIGFYVSVPETLRWPVLVIAILAAVVGSQAIITGTFSIIKQCSSLSCFPGVKIVHTSSTVHGQIYIPEINWMLMILCLAVTIGFRDTKHLANAQGLAVITVMLVTTCLMSLVIVLCWNKSIFLALGFLLFFGTIEVIYFSAALVKFHEGAWVPITLSFIFMVVTCVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQKDDLEFEKELVSNIAEFIRSSGEYDKNGFVEDTDKPSEKLSTISTGINMWEEDGELDASGTPHKEIDPHNAVPKQKKARFMIPKSAQVDSEVRRELQELMDAREAGMSFILGHSYMKAKSGSSFIKRIVINFFYEFLRKNSRGPAYAANIPHASTLEVGMVYQV

SEQ ID NO: 8003 - DNA, 1557 bp, Sorghum bicolor
  misc_feature: Ceres ANNOT ID no. 6086373
  misc_feature: Encodes the peptide sequence at SEQ ID NO 8004
atggcgaccaagggagggaacgcgaggggcgtcccggtgggggcgctgctggtggccgcgcttctccttagctccttggctcccgcctccgcgtcctcgtaccccgcaagggtggtgagcgggttcctctccaatgcggcgtcggcggtggtgaagcggatgtggtcgctcaaatccaccaccaagacagcagcgagcgggggcaagtcgatggtgaagtacgagggcgggtacaccgtggagacggtcttcgacggcagcaagctggggatcgagccctactccgtggaggtcacccagggcggcgagctgctcgtcatggactccatgaacagcaacatctacaggatggcgctgccgctctcccgatatagcaggccgaagcttgttgctggttcccctgaaggatttcctggtcatgttgatgggaagctgcgagaggcgaggatgaaccatccaaagggatttacagtggatgacaggggtaacatctatgtggctgatgcaatgaacatggccattagaaagatcagtgatacaggggttacaactattgctgggggaaaatcaggcagaggagggcatgttgacggaccaagtgacgaggcaaaattttctaccgattttgaagtccgctacgttggcagtagctgctcccttctggtgattgacagaggaaaccaagcaattcgggagattcagctccactttgatgactgtgtgtaccagtatgaagctggttttcctctaggagtcgcactgctgcttgctgccgctttctttggctacatgcttgcactgcttcaacgacgagttttagggatgtattcaaatggagatgagcaggaacatgagagtccagtaaaagctaaattatctagcattccacctccataccagaagccactgaagccttctcttcgccccccgctaattccaactgatgatgaacctgtgaaacaagaggaggaagaagggctcttcacgtcaatcggcaaacttgtgggtggagcaaaatcatcaattgcagagataatcggcgccgcattctccagaaagaagcgagtaaacattcatcaccatcaactgggtaggccaacctcctggccagtacaagaaagctatgccatcccgcgggacgagaccccaccaccactggacacaagagccccgacccctcgtaagaactacgccttcatgtccaaggagccagagaagatccaccacatacggcacggccggcctcagttacatggctggaccggagaagcagcacctcagcagcagcagcagcagcagccaccgtcgcagccgcaacaggtgcatcaccagcagtacctgcagcaccacaggcagtactcggcggggccgcagaccttctacgagccgagctgcgatgcgaccaaggagatcgtcttcggagccgtgcaggagggggacaccagccgccgtcccgtggagatcaaggccgtgaaccatggggacgcggcgtcgtacgagcagaacgggctgcgattccgcagcagttacagcatgggctacaatggcaacaactag

SEQ ID NO: 8004 - protein, 518 aa, Sorghum bicolor
  misc_feature: Ceres ANNOT ID no. 6086373
  misc_feature (150)..(177): Pfam Id: NHL Pfam Desc: NHL repeat
  misc_feature (15)..(518): NCBI GI: 53793193 NCBI Desc: nhl repeat-containing protein-like [oryza sativa (japonica cultivar-group)]
  misc_feature (16)..(517): NCBI GI: 30698020 NCBI Desc: nhl repeat-containing protein [arabidopsis thaliana]
  misc_feature (56)..(517): NCBI GI: 3176691 NCBI Desc: contains homology to serine/threonine protein kinase gbx99618 from mycobacterium tuberculosis. ests gbf14403, gbf14404, and gbn96730 come from this gene. [arabidopsis
  misc_feature (56)..(517): NCBI GI: 3176691 (continued) thaliana]
  misc_feature (18)..(480): NCBI GI: 20856013 NCBI Desc: at1g23880/t23e23_8 [arabidopsis thaliana]
  misc_feature (56)..(251): NCBI GI: 9369390 NCBI Desc: t23e23.5 [arabidopsis thaliana]
MATKGGNARGVPVGALLVAALLLSSLAPASASSYPARVVSGFLSNAASAVVKRMWSLKSTTKTAASGGKSMVKYEGGYTVETVFDGSKLGIEPYSVEVTQGGELLVMDSMNSNIYRMALPLSRYSRPKLVAGSPEGFPGHVDGKLREARMNHPKGFTVDDRGNIYVADAMNMAIRKISDTGVTTIAGGKSGRGGHVDGPSDEAKFSTDFEVRYVGSSCSLLVIDRGNQAIREIQLHFDDCVYQYEAGFPLGVALLLAAAFFGYMLALLQRRVLGMYSNGDEQEHESPVKAKLSSIPPPYQKPLKPSLRPPLIPTDDEPVKQEEEEGLFTSIGKLVGGAKSSIAEIIGAAFSRKKRVNIHHHQLGRPTSWPVQESYAIPRDETPPPLDTRAPTPRKNYAFMSKEPEKIHHIRHGRPQLHGWTGEAAPQQQQQQQPPSQPQQVHHQQYLQHHRQYSAGPQTFYEPSCDATKEIVFGAVQEGDTSRRPVEIKAVNHGDAASYEQNGLRFRSSYSMGYNGNN

SEQ ID NO: 8005 - DNA, 1674 bp, Sorghum bicolor
  misc_feature: Ceres ANNOT ID no. 6086376
  misc_feature: Encodes the peptide sequence at SEQ ID NO 8006
atgccgccgcctcctcctcccccggcgggggcgcagcagccgcagctccacggggtggtcatcatcacgctccctccatcggaccagccctccaagggcaagaccatcaccgccttcacctacaccgacgacgccccgccccctccccggcccccggagccggtgatggggtacccggccgcgacgcaggtcaggcggcggccgaggcgggtgctctcgacgcggcgggtggcggcggcggcgctcgtgctgggcgcgctcgcggtcgccgcctactactgcttctactcggacgtggccgtgcagttcctggggatggagcaggaggaggcgcagaaggacaggaacgagaccaggtccttcctgctgccgctccaccccaaggcgcgccagggccgcgccctgcgggagttcggggacgtcaagctcgccgccaggaggatcgacgacggctggaggaaggctaggaacaagatggaggtcgcgaaggcggccgcggcggggaccaattccacggcgttgctcccgatcaagggcaatgtcttccccgatggccagtactatacatctatctttgttggcaaccctccaagaccatactttcttgacgtcgatactgggagcgacttgacgtggatccagtgtgatgcaccatgtacaaattgcgcaaagggaccgcatcctctatataagccaacaaaagaaaagattgtccctcctagagatttgttatgccaagaactgcaaggcaaccagaactactgtgaaacctgcaagcagtgtgactatgaaattgaatatgcagaccaaagctcctctatgggtgtccttgcaagggatgatatgcatctgattgcaaccaatggtggaagggaaaaactagattttgtctttgggtgtgcatatgatcagcaaggccagcttttgtcctcaccagcaaagaccgatgggatccttggacttagcaacgcagcgataagccttcccagtcagctggctagtcacgggattatttccaacatttttggccattgtatcacgagagagcaaggtggtggaggatatatgtttctgggagatgattatgtacctagatggggaataacatggacttctattcgaagtggtccagataacttatatcacacagaagcccaccatgtaaaatatggagatcagcaactccggatgcgtgaacaggcaggaaacactgttcaagtaatttttgacagtggaagctcctatacgtacctcccagatgaaatatatgaaaaccttgttgcagcaatcaaatatgcgtctccgggctttgtccaagacagctcagatcggacattacctttatgctggaaagctgatttccctgtgaggtatctggaagatgtcaagcagttcttcaagcccttgaaccttcactttgggaagaaatggcttttcatgtctaaaacattcactatttctcctgaggattacttgattattagtgataaaggaaacgtctgtcttgggcttctcaatggaacggagattaatcatgggtcaactatcatagtgggagatgtttctctgcgcggcaagttagttgtgtatgacaatcaacggaggcagattggatggacaaattcagactgcaccaaaccacaatcacaaaagggcttccccttcttcctctga

SEQ ID NO: 8006 - protein, 557 aa, Sorghum bicolor
  misc_feature: Ceres ANNOT ID no. 6086376
  misc_feature (186)..(542): Pfam Id: Asp Pfam Desc: Eukaryotic aspartyl protease
  misc_feature (187)..(556): NCBI GI: 145324889 NCBI Desc: aspartyl protease family protein [arabidopsis thaliana]
  misc_feature (171)..(554): NCBI GI: 62954888 NCBI Desc: nucellin-like aspartic protease [oryza sativa (japonica cultivar-group)]
  misc_feature (162)..(555): NCBI GI: 56692305 NCBI Desc: nucellin-like protein [daucus carota]
  misc_feature (148)..(551): NCBI GI: 21592493 NCBI Desc: nucellin-like protein [arabidopsis thaliana]
  misc_feature (166)..(550): NCBI GI: 140069451 NCBI Desc: peptidase aspartic, active site [medicago truncatula]
MPPPPPPPAGAQQPQLHGVVIITLPPSDQPSKGKTITAFTYTDDAPPPPRPPEPVMGYPAATQVRRRPRRVLSTRRVAAAALVLGALAVAAYYCFYSDVAVQFLGMEQEEAQKDRNETRSFLLPLHPKARQGRALREFGDVKLAARRIDDGWRKARNKMEVAKAAAAGTNSTALLPIKGNVFPDGQYYTSIFVGNPPRPYFLDVDTGSDLTWIQCDAPCTNCAKGPHPLYKPTKEKIVPPRDLLCQELQGNQNYCETCKQCDYEIEYADQSSSMGVLARDDMHLIATNGGREKLDFVFGCAYDQQGQLLSSPAKTDGILGLSNAAISLPSQLASHGIISNIFGHCITREQGGGGYMFLGDDYVPRWGITWTSIRSGPDNLYHTEAHHVKYGDQQLRMREQAGNTVQVIFDSGSSYTYLPDEIYENLVAAIKYASPGFVQDSSDRTLPLCWKADFPVRYLEDVKQFFKPLNLHFGKKWLFMSKTFTISPEDYLIISDKGNVCLGLLNGTEINHGSTIIVGDVSLRGKLVVYDNQRRQIGWTNSDCTKPQSQKGFPFFL

SEQ ID NO: 8007 - DNA, 1200 bp, Sorghum bicolor
  misc_feature: Ceres ANNOT ID no. 6086377
  misc_feature: Encodes the peptide sequence at SEQ ID NO 8008
atggacgccgtgctaccttccctcctcatcggcggcggactctccgtgtccgtctccattcccaccgccaccaaagccggcagccaatccatttcagtcccccacctctcgacctccgccctccgttcaacccctcgccgtcggggccgacggcgtttgaccctcctcgcctcatcttcgcagttgcctcccacgccactttccgccgcttcgactgagagccagtcgcgttcctccaggtgggtggttgtgatggatacgccctctgccgccgcgggaggcagcagggtgtcccgcgcagacgccgtggattactacgcagccacactggcccaggtcgtgggaagtgagaaggaggcgcagatgcgcatatatgaggcttcgtgggatggggcctacgagttccgctgcgagatcgacgaagatgcatcgaaggagcttgcaaagatgcctggagtgctatctgttcagccagatatggataacaaatcagagaagggtaatcacagcttgagtctctcgacatctaaccttgtaagcattagtgatagtgcttctacatcttcaagtgggaaaaatgagttttggcttgtccgaatggagaagcccggagttgaagtcgtgacgaaggcccaaatggtggatcactatacccaaatccttatgaaagtgttggggaacgaacaggatgcccaagttagcatatatcacatttcatgggagagggattatggtttctgctgtcatatagatgaagaatgcgcaaaagagttagctgatgttcctggagtgttatctgttcaacctgatatgaactttggatcagacaacaaagagtacaaaggtgatgatggcttgaaatcatctgaagggactgtagcagccgatatcaaaactaaaaggctctttgttacagggctttcattttatacatctgagaaaactttgcgggcagcatttgagcctttcggtgagctcgtcgaagtgaagataattatggacaggatatcaaaaagatcaaaaggttatgccttcatagaatacactactgaggaagctggaggtgctgctctaaaagcaatgaatggacagataataaacggctggatgatagttgttgatgttgctaaaactagatcgagagaccgtctatctggtggatctaatcaagcatttcgaccacactatcaggctagatga

SEQ ID NO: 8008 - protein, 399 aa, Sorghum bicolor
  misc_feature: Ceres ANNOT ID no. 6086377
  misc_feature (302)..(373): Pfam Id: RRM_1 Pfam Desc: RNA recognition motif. (a.k.a. RRM, RBD, or RNP domain)
  misc_feature (1)..(396): NCBI GI: 46390865 NCBI Desc: rna recognition motif (rrm)-containing protein-like [oryza sativa (japonica cultivar-group)]
  misc_feature (146)..(378): NCBI GI: 140052883 NCBI Desc: rna-binding region rnp-1 (rna recognition motif) [medicago truncatula]
  misc_feature (194)..(280): NCBI GI: 38344141 NCBI Desc: osjnba0041a02.8 [oryza sativa (japonica cultivar-group)]
  misc_feature (194)..(280): NCBI GI: 116310924 NCBI Desc: b0403h10-osigba0105a11.14 [oryza sativa (indica cultivar-group)]
  misc_feature (194)..(280): NCBI GI: 21617909 NCBI Desc: plastid protein [arabidopsis thaliana]
  misc_feature: The plant flowers significantly late compared to wild-type.
  misc_feature: The plant is abnormally large.
  misc_feature: Useful for making plants with altered alkaloid content
  misc_feature: Useful for making plants with modulated biomass
  misc_feature: Useful for making plants with modulated flowering time
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13266
  misc_feature: The sequence is a functional homolog of SEQ ID NO. 458 in the 11/188,298 US application
MDAVLPSLLIGGGLSVSVSIPTATKAGSQSISVPHLSTSALRSTPRRRGRRRLTLLASSSQLPPTPLSAASTESQSRSSRWVVVMDTPSAAAGGSRVSRADAVDYYAATLAQVVGSEKEAQMRIYEASWDGAYEFRCEIDEDASKELAKMPGVLSVQPDMDNKSEKGNHSLSLSTSNLVSISDSASTSSSGKNEFWLVRMEKPGVEVVTKAQMVDHYTQILMKVLGNEQDAQVSIYHISWERDYGFCCHIDEECAKELADVPGVLSVQPDMNFGSDNKEYKGDDGLKSSEGTVAADIKTKRLFVTGLSFYTSEKTLRAAFEPFGELVEVKIIMDRISKRSKGYAFIEYTTEEAGGAALKAMNGQIINGWMIVVDVAKTRSRDRLSGGSNQAFRPHYQAR

SEQ ID NO: 8009 - DNA, 864 bp, Sorghum bicolor
  misc_feature: Ceres ANNOT ID no. 6086383
  misc_feature: Encodes the peptide sequence at SEQ ID NO 8010
atgggggaaggtggagaagagaagtcattcaatttccttcaagttttgctcgagggcagcatagccggaggaactgctggtgttgtggtggaaacagcactttacccaattgatactataaaaaccaggcttcaggctgctcgaggtggaagccggattgaatggaaaggcttgtattctggattagctggaaatcttgctggtgtccttccggcctctgcaatatttgtcggagtgtatgagccaactaaaagaaaattactggagacacttcctgaaaatctgagtgcagttgcccattttactgcaggggccattggaggtattgctgcttcccttgtccgtgtccctacagaggtggtcaaacaaaggatgcaaactggtcaattcaagtctgcacctgatgctgttcgtctcattgttgctaaagaaggatttaaaggactgtacgccggttatggttcctttctacttcgagatcttccatttgatgccattcaattctgcatttatgagcaaattcgaattggctacaaagctgtggcgagaagggagttgaatgatccagagaatgcacttattggtgcttttgctggtgccatcactggagctataacaactccccttgatgtcatgaagacaagactgatggttcagggacaagggaaccaatacactggaattgtaaactgtgctcagacaatcctcagggaggaaggccctaaggcattcttgaagggcattgagccgcgagtgctgtggattggcatcggcgggtccatcttctttggtgtgctggagaaaaccaagtcgatgctagccgagaggaggaaccgcgagctacgggccgtcaaggacgaatga

SEQ ID NO: 8010 - protein, 287 aa, Sorghum bicolor
  misc_feature: Ceres ANNOT ID no. 6086383
  misc_feature (15)..(91): Pfam Id: Mito_carr Pfam Desc: Mitochondrial carrier protein
  misc_feature (96)..(182): Pfam Id: Mito_carr Pfam Desc: Mitochondrial carrier protein
  misc_feature (187)..(277): Pfam Id: Mito_carr Pfam Desc: Mitochondrial carrier protein
  misc_feature (1)..(282): NCBI GI: 34394981 NCBI Desc: mitochondrial aspartate-glutamate carrier protein-like [oryza sativa (japonica cultivar-group)]
  misc_feature (5)..(277): NCBI GI: 119391879 NCBI Desc: s-adenosylmethionine transporter [nicotiana benthamiana]
  misc_feature (5)..(277): NCBI GI: 140069183 NCBI Desc: mitochondrial carrier protein [medicago truncatula]
  misc_feature (6)..(275): NCBI GI: 119391875 NCBI Desc: s-adenosylmethionine transporter [capsicum annuum]
  misc_feature (11)..(283): NCBI GI: 63147372 NCBI Desc: at1g34065 [arabidopsis thaliana]
  misc_feature: The sequence is a functional homolog of SEQ ID NO. 398 in the 11/188,298 US application
  misc_feature: The sequence is a functional homolog of SEQ ID NO. 385 in the 11/188,298 US application
  misc_feature: The sequence is a functional homolog of SEQ ID NO. 517 in the 11/188,298 US application
MGEGGEEKSFNFLQVLLEGSIAGGTAGVVVETALYPIDTIKTRLQAARGGSRIEWKGLYSGLAGNLAGVLPASAIFVGVYEPTKRKLLETLPENLSAVAHFTAGAIGGIAASLVRVPTEVVKQRMQTGQFKSAPDAVRLIVAKEGFKGLYAGYGSFLLRDLPFDAIQFCIYEQIRIGYKAVARRELNDPENALIGAFAGAITGAITTPLDVMKTRLMVQGQGNQYTGIVNCAQTILREEGPKAFLKGIEPRVLWIGIGGSIFFGVLEKTKSMLAERRNRELRAVKDE

SEQ ID NO: 8011 - DNA, 1248 bp, Sorghum bicolor
  misc_feature: Ceres ANNOT ID no. 6086387
  misc_feature: Encodes the peptide sequence at SEQ ID NO 8012
atggcgaccatagtgaacacgacggaggaggagccgatgctggccgtggtccgcttcaccgccgagctcgcctgggccgacgcgggcccggaggtcgccgaccccgaggttacccgcctttgcctcgaggcgcaggagcacatcctcgcggggcgctggctcgacatggcctccctcatgctcgcctccgccgacctgctcctcacctccccgtcacgcgtcgcggacaaagatctggagtgcgttctctccgtcatctgcagcctcgtcaccaaggccggatccgaggacgaggcactacagatcaccaacctcatctgcagcaagctcatccagcagcctggcgacaagccagcgttgcgcctcaaagttcttttcagcttgtacaatcttcttctgagcccctatggcaaggcatttgtttacaagaaggctcttgagctcgccacggctggaaaagctgccgagtacatcattccatctttcaagaacatcgacagctttgtcagtgagtggggtattggcaatttggagcagagggagctataccttgctatcaccagcatcctcaaagaccaaaagggcatggctaaggagtacttcaactttctcaacaagtaccttgccacattcaaaggttcagatgatgaatcagctacaattggtgatgcaaaggaagaggccgttgcagcgatcattgagtttgtcaaatcgcctaatctctttcagtgtgatttgctcaatatgccagctgtttcacagcttgagaaggacgaaaagtatcagttggtttatgagcttctaaagatattccttactaagaggcttgattcctacttggagtttcagactgcaaactctgccttgctgaaagattatggactcgtccatgaggagtgcgtgaccaagatgcgcctcatgtctttgcttgatctgagcagccgttgctctggcgaaattccctattctgcaatcactgttgaacttaggatcaatgatgatgaggtggagcaatggattgtaaaggcaattgcatccaagatattggattgcaagattgaccagcttaaccagactgtcatcgtcagtcggcatatggagaggatcttcgggatggcacagtggcatggtctgcgcacaaagcttggagtttggaggggaaacattgccagtgctatcaacacaatacaagctaacaaagttactgaagacgggacacaagggatgcaaggcttgatgatccgctga

SEQ ID NO: 8012 - protein, 415 aa, Sorghum bicolor
  misc_feature: Ceres ANNOT ID no. 6086387
  misc_feature (262)..(364): Pfam Id: PCI Pfam Desc: PCI domain
  misc_feature (1)..(415): NCBI GI: 115456796 NCBI Desc: os04g0103200 [oryza sativa (japonica cultivar-group)]
  misc_feature (1)..(415): NCBI GI: 116317780 NCBI Desc: osigba0123d13.7 [oryza sativa (indica cultivar-group)]
  misc_feature (1)..(368): NCBI GI: 30678503 NCBI Desc: proteasome family protein [arabidopsis thaliana]
  misc_feature (44)..(396): NCBI GI: 62896687 NCBI Desc: dendritic cell protein variant [homo sapiens]
  misc_feature (44)..(396): NCBI GI: 23397429 NCBI Desc: dendritic cell protein [homo sapiens]
MATIVNTTEEEPMLAVVRFTAELAWADAGPEVADPEVTRLCLEAQEHILAGRWLDMASLMLASADLLLTSPSRVADKDLECVLSVICSLVTKAGSEDEALQITNLICSKLIQQPGDKPALRLKVLFSLYNLLLSPYGKAFVYKKALELATAGKAAEYIIPSFKNIDSFVSEWGIGNLEQRELYLAITSILKDQKGMAKEYFNFLNKYLATFKGSDDESATIGDAKEEAVAAIIEFVKSPNLFQCDLLNMPAVSQLEKDEKYQLVYELLKIFLTKRLDSYLEFQTANSALLKDYGLVHEECVTKMRLMSLLDLSSRCSGEIPYSAITVELRINDDEVEQWIVKAIASKILDCKIDQLNQTVIVSRHMERIFGMAQWHGLRTKLGVWRGNIASAINTIQANKVTEDGTQGMQGLMIR

SEQ ID NO: 8013 - DNA, 486 bp, Sorghum bicolor
  misc_feature: Ceres ANNOT ID no. 6086389
  misc_feature: Encodes the peptide sequence at SEQ ID NO 8014
atgggtaaattccgcaagctcggccgcggttactcccaccgtctctccatgctcaggacaatggtgtcgcagctggtgaagcacgagcgcatcgaaaccactgttgccaaggcgaaggaggtccggcggaaggcggatcagatggtgcagctagggaaggagggtactgagcatgcagcaagacgtgctgctgcctttgttcggggtgatgacgtcgttcataagctattcactgagctggcctaccgctacagagatcgagctggtggatacacaagaatgttaagaaccaggatacgtgttggcgatgctgcgccaatggcatacatcgagtttgtggacagggagaatgagcttcgagaggccaaacctgcaacaccgccgccgcctcaacgagtccctcttgatccatggaccaagtcacgtgctagccaacagtgggcaggacctaaaatcaccaagacctcggaatcagacggcttatga

SEQ ID NO: 8014 - protein, 161 aa, Sorghum bicolor
  misc_feature: Ceres ANNOT ID no. 6086389
  misc_feature (17)..(113): Pfam Id: Ribosomal_L17 Pfam Desc: Ribosomal protein L17
  misc_feature (1)..(159): NCBI GI: 18424850 NCBI Desc: ribosomal protein l17 family protein [arabidopsis thaliana]
  misc_feature (1)..(159): NCBI GI: 21555473 NCBI Desc: 50s ribosomal protein l17 [arabidopsis thaliana]
  misc_feature (1)..(159): NCBI GI: 21592350 NCBI Desc: ribsomal protein-like [arabidopsis thaliana]
  misc_feature (1)..(159): NCBI GI: 92897844 NCBI Desc: ribosomal protein l17 [medicago truncatula]
  misc_feature (1)..(159): NCBI GI: 10178068 NCBI Desc: 50s ribosomal protein l17 [arabidopsis thaliana]
  misc_feature: Useful for making plants with modulated heat sensitivity
  misc_feature: GREAT-hit functional homolog of the protein sequence encoded by LOCUS at5g09770
  misc_feature: Useful for making plants with modulated heat sensitivity
  misc_feature: Functional homolog of the protein sequence given in SEQ ID NO 13748
MGKFRKLGRGYSHRLSMLRTMVSQLVKHERIETTVAKAKEVRRKADQMVQLGKEGTEHAARRAAAFVRGDDVVHKLFTELAYRYRDRAGGYTRMLRTRIRVGDAAPMAYIEFVDRENELREAKPATPPPPQRVPLDPWTKSRASQQWAGPKITKTSESDGL

SEQ ID NO: 8015 - DNA, 1473 bp, Sorghum bicolor
  misc_feature: Ceres ANNOT ID no. 6086405
  misc_feature: Encodes the peptide sequence at SEQ ID NO 8016
atggcggccgccgccgcgggggctacaccggcgactgcgaggaagactctcttcaccactacagtcaccctcctctcatcctcactcacacgtagcagcagcagcagcagccgcagccgcagcctctcctgctctgccgcgtccgccgccgccccgcgcctcgcgccgcagccgccggaccttgtccggtgggtgcagcgcgagggtggattcgtccaccctgccctccgcgtcgcgaatcacccggaacacgggctcggggtctctgccgccgcgcctgacggcgacatcccccctggggacgtcctcatcgcgctcccgggccggctccctttacgactacggcgccccaccggtgccgcggatgacgtgcttgtgcagctcgcccaacaagtcccggaggaactatgggctatgaagctgggcttgaggttgcttcaagaaagggccaaatctgattcattttggtggccgtatattgccaatttgccagagacatttactgttccaatcttctttcctggggaagacataaaaaacttgcagtatgctcctctcctccaccaggttaataaaagatgtcgttttctccttgagtttgagaaagagatacagcagaagcttcatactgtgccctcggtagatcatcctttctatggacaagatgtaaattcatcttcccttggatgggctatgtcagctgcctcttctcgtgcattccgattgcatggtgaaatcccaatgttgttgcctcttattgatatgtgcaaccatagtttcaaccccaatgctaggatcgttcaggaaggaagtgtaaacagcttagatatgtcagtaaaggttgtcgctgagaagaagattgagcaaaatgcatcaataacactgaactatggctgccacccaaatgatttctttcttcttgattatggatttgtgataacaccgaatccttacgatcaagtggaactaagttatgatggaacccttcttgatgctgcaagcatggcagcaggagtctcttctcccaacttttcagcgccagccaagtggcaacaagatatattgtcacagctaaatctgcatggagagggtgccattttaaaggtaagcttaggaggcccagacattgttgatggacgcttgttagctgctctaagggtgcttcttgcggatgatccagaggctttgcacaagcatgacctgaaaacactgatgtcccttgatgtgcaagctcctttaggccccgctattgaagcatcagcactccgaacagttcttgccctttgtgcgattgctctccaacacttccacacaaagataatggacgacgaggccattctaagaggggggccacctcttaccacggagctggctgtccagtttagattgcagaagaagttcatgatcgttgacgtgatgcagaatgtcagcaggagaatcaagatgctatcgccgcagaaatccaccgcgtag

SEQ ID NO: 8016 - protein, 490 aa, Sorghum bicolor
  misc_feature: Ceres ANNOT ID no. 6086405
  misc_feature (59)..(304): Pfam Id: SET Pfam Desc: SET domain
  misc_feature (344)..(469): Pfam Id: Rubis-subs-bind Pfam Desc: Rubisco LSMT substrate-binding
  misc_feature (2)..(489): NCBI GI: 46390671 NCBI Desc: set domain-containing protein-like [oryza sativa (japonica cultivar-group)]
  misc_feature (25)..(488): NCBI GI: 18395523 NCBI Desc: set domain-containing protein [arabidopsis thaliana]
  misc_feature (33)..(488): NCBI GI: 144923593 NCBI Desc: nuclear protein set [medicago truncatula]
  misc_feature (355)..(484): NCBI GI: 49532978 NCBI Desc: set-domain transcriptional regulator [citrullus lanatus]
  misc_feature (59)..(484): NCBI GI: 62857953 NCBI Desc: loc549331 [xenopus tropicalis]
MAAAAAGATPATARKTLFTTTVTLLSSSLTRSSSSSSRSRSLSCSAASAAAPRLAPQPPDLVRWVQREGGFVHPALRVANHPEHGLGVSAAAPDGDIPPGDVLIALPGRLPLRLRRPTGAADDVLVQLAQQVPEELWAMKLGLRLLQERAKSDSFWWPYIANLPETFTVPIFFPGEDIKNLQYAPLLHQVNKRCRFLLEFEKEIQQKLHTVPSVDHPFYGQDVNSSSLGWAMSAASSRAFRLHGEIPMLLPLIDMCNHSFNPNARIVQEGSVNSLDMSVKVVAEKKIEQNASITLNYGCHPNDFFLLDYGFVITPNPYDQVELSYDGTLLDAASMAAGVSSPNFSAPAKWQQDILSQLNLHGEGAILKVSLGGPDIVDGRLLAALRVLLADDPEALHKHDLKTLMSLDVQAPLGPAIEASALRTVLALCAIALQHFHTKIMDDEAILRGGPPLTTELAVQFRLQKKFMIVDVMQNVSRRIKMLSPQKSTA

SEQ ID NO: 8017 - DNA, 1053 bp, Sorghum bicolor
  misc_feature: Ceres ANNOT ID no. 6086413
  misc_feature: Encodes the peptide sequence at SEQ ID NO 8018
  misc_feature: Down-regulated in root tissues in response to methyl jasmonate treatment
atggcctccctcaccgacctcgtcaacctcagcctctcggacaccaccgagaagatcatcgccgagtacatatggatcggtggatctggcatggatctcaggagcaaagccaggaccctctccggcccggtgaccgatcccagcaagctgcccaagtggaactacgacggctccagcaccggccaggcccccggcgaggacagtgaggctatcttcaaggacccattccggaggggcaacaacatccttgtcatgtgcgattgctacaccccagctggcgagccaattcccaccaacaagaggcacaacgccgccaagatcttcagcaaccctgaggtcgctgctgaggagccctggtacggtattgagcaggagtacaccctccttcagaaggacaccaactggccccttgggtggcctcttggtggcttccctggccctcagggtccttactactgtggaatcggtgcggacaagtcattcgggcgtgacatagttgatgcccactacaaggcttgcatttatgcaggcatcaacatcagtggcatcaacggagaggtcatgccagggcagtgggaattccaagttggaccgtccgtcggcatttcttcaggtgatcaggtctgggttgctcgctacattcttgagaggatcaccgagatcgccggtgtggtgttgacattcgacccaaagcccatccctggtgactggaacggtgccggcgcacacaccaactacagcaccaagtccatgaggaacgagggcgggtacgaggtgatcaaggccgccattgagaagctgaagttgcggcacaaggagcacatcgcggcctacggcgagggcaacgagcgccgcctcaccggcaggcacgagaccgccgacatcaacaccttcagctggggagtggcaaaccgtggcgcgtcagtgcgcgtgggccgggagacggagcagaacggcaagggctacttcgaggaccgccggccggcgtccaacatggacccatacgtggtgacctccatgatcgccgacaccaccatcctctggaagccctga

SEQ ID NO: 8018 - protein, 350 aa, Sorghum bicolor
  misc_feature: Ceres ANNOT ID no. 6086413
  misc_feature (97)..(349): Pfam Id: Gln-synt_C Pfam Desc: Glutamine synthetase, catalytic domain
  misc_feature (17)..(91): Pfam Id: Gln-synt_N Pfam Desc: Glutamine synthetase, beta-Grasp domain
  misc_feature (1)..(350): NCBI GI: 56681313 NCBI Desc: glutamine synthetase [saccharum officinarum]
  misc_feature (1)..(350): NCBI GI: 286124 NCBI Desc: glutamine synthetase [zea mays]
  misc_feature (1)..(350): NCBI GI: 121349 NCBI Desc: glutamine synthetase shoot isozyme (glutamate--ammonia ligase) (clone lambda-gs28)
  misc_feature (1)..(350): NCBI GI: 286122 NCBI Desc: glutamine synthetase [zea mays]
  misc_feature (1)..(350): NCBI GI: 434328 NCBI Desc: glutamine synthetase [zea mays]
  misc_feature (1)..(350): SWISSPROT Homolog: EC 6.3.1.2 Glutamine synthetase cytosolic isozyme 1-1
  misc_feature: Useful for making plants with modulated water use efficiency
  misc_feature: Functional homolog of the protein sequence given in SEQ ID NO 13877
  misc_feature: Down-regulated in root tissues in response to methyl jasmonate treatment
  misc_feature: The sequence is a functional homolog of SEQ ID NO. 371 in the 11/188,298 US application
MASLTDLVNLSLSDTTEKIIAEYIWIGGSGMDLRSKARTLSGPVTDPSKLPKWNYDGSSTGQAPGEDSEAIFKDPFRRGNNILVMCDCYTPAGEPIPTNKRHNAAKIFSNPEVAAEEPWYGIEQEYTLLQKDTNWPLGWPLGGFPGPQGPYYCGIGADKSFGRDIVDAHYKACIYAGINISGINGEVMPGQWEFQVGPSVGISSGDQVWVARYILERITEIAGVVLTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIADTTILWKP

SEQ ID NO: 8019 - DNA, 1914 bp, Sorghum bicolor
  misc_feature: Ceres ANNOT ID no. 6086416
  misc_feature: Encodes the peptide sequence at SEQ ID NO 8020
atgaccacttgtctcctgcgcccttatcctccggggctccctcccccttgccccgatcccaatcaacccacccgcctcgaatgggaccttggccgccggcgccgttgccagccccgccaccttctccggtgcatcgccgcctccgcggctaccttgcagcgagaactcatcacgctgcccatcacaagaaccacccagaaccccggccgagtgaacccacctaacctgttggacagaatgcctgacaggagcaccacgaagatttcgagcgcaggtaacctgttggacgaaaggcttcggacgggcggccagagagcaagcggacgtgatcctcatgagggcggcgggaagagcgagagcgcggacttcgtggcactggcgcacgctggtcggcatgcggaggtcgtcgagctcttctgcagtatgcggagggagggggtcccggtgaacaggtttgtgctaccgagtgtgttcagagcttgtgcctgcctatgggacagaaggatgctccaagccgtgcacggtctggtcatcaactgctcgttgtgtcagcatgtggtcgtaggcactgcgttggctgctgcatatattgattttggcttggtagatgatgccagtaaggtgttcaatgatataagccagcccaatgtggtctcttggagcgtgatcattggcggctatgcccgttcttctcagtgggacaaagcctgggatgcattctcagccatgcagtgttcgggcttgcttccaaatgtttctgttcttgttatggcaattcaagcatgcggtgcattgggctgcctggtccgagggaagcagatgcacacgatggcagttgtccttggatttggaaggaatgccaccgtgtggaactgcctcattgatatgtatggaaaatgcggcagcatggagagttgccggagggtgtttgacacagcgatcagcagggatcaagtgagttggaatacgatcatctcaagctatgttcgtcttggactttgtgaagaggtgctagaaatgatcgttcagatgcaggagtctggtttcactattgatcgtttcactcttggcagtggagttgcagcatgtgcccacttggctgacatagacagtggtcgtgcatttcatggctatttgattagaagagcgttagatactgaagtcatccagggcactgcacttcttgacatgtatagtaaatgcggctacatggatcttgctcgattggtatttgacaggatggatgagagaaattatgtttcatgggatgcactcttgtctgggtttgttgaaaatgggcgagttgattcagcacttgacacttttcgacaaatggagtccgcaaatataaagtctaaccaacatacctttgcgaaccttctgaggctctgtggtgacagaaggtacagagagtatgggaggcaaattcatggccatgccataagggtcataaaccagatgaatgtagtactggaaactgagcttatcgatatgtacgcgaagtgtgggtctattgaagtctctcagttactgtttctcaggatgaatgagcggaacttgatatcatggaacacattgctttcaggttacgtgggtgatggacagcctgttgccacgataaacatttaccgtcagatggagatggcatgtgttaggcctgaccattacactttagcaggtcttctaaacctgtgccgcttccaagggcttttgcgttatggaaggcagatacatgctcgtctcatcaagacaagttctgaaatgaatgttgtattacagactttgcttgttcatatgtacttcaagtgtaaacgatggcgggatgcgcacaatgtttgcactttgatcagagagaggaattctcatgtttatgaagcatttttcaaggtttatggagacgactacttgatctga

SEQ ID NO: 8020 - protein, 637 aa, Sorghum bicolor
  misc_feature: Ceres ANNOT ID no. 6086416
  misc_feature (218)..(252): Pfam Id: PPR Pfam Desc: PPR repeat
  misc_feature (319)..(353): Pfam Id: PPR Pfam Desc: PPR repeat
  misc_feature (420)..(454): Pfam Id: PPR Pfam Desc: PPR repeat
  misc_feature (521)..(555): Pfam Id: PPR Pfam Desc: PPR repeat
  misc_feature (3)..(637): NCBI GI: 115448537 NCBI Desc: os02g0735800 [oryza sativa (japonica cultivar-group)]
  misc_feature (67)..(603): NCBI GI: 38423978 NCBI Desc: ppr-repeat protein-like [oryza sativa (japonica cultivar-group)]
  misc_feature (130)..(631): NCBI GI: 54695180 NCBI Desc: ppr986-12 [physcomitrella patens]
  misc_feature (127)..(574): NCBI GI: 140042117 NCBI Desc: tetratricopeptide-like helical [medicago truncatula]
  misc_feature (144)..(632): NCBI GI: 15220337 NCBI Desc: pentatricopeptide (ppr) repeat-containing protein [arabidopsis thaliana]
MTTCLLRPYPPGLPPPCPDPNQPTRLEWDLGRRRRCQPRHLLRCIAASAATLQRELITLPITRTTQNPGRVNPPNLLDRMPDRSTTKISSAGNLLDERLRTGGQRASGRDPHEGGGKSESADFVALAHAGRHAEVVELFCSMRREGVPVNRFVLPSVFRACACLWDRRMLQAVHGLVINCSLCQHVVVGTALAAAYIDFGLVDDASKVFNDISQPNVVSWSVIIGGYARSSQWDKAWDAFSAMQCSGLLPNVSVLVMAIQACGALGCLVRGKQMHTMAVVLGFGRNATVWNCLIDMYGKCGSMESCRRVFDTAISRDQVSWNTIISSYVRLGLCEEVLEMIVQMQESGFTIDRFTLGSGVAACAHLADIDSGRAFHGYLIRRALDTEVIQGTALLDMYSKCGYMDLARLVFDRMDERNYVSWDALLSGFVENGRVDSALDTFRQMESANIKSNQHTFANLLRLCGDRRYREYGRQIHGHAIRVINQMNVVLETELIDMYAKCGSIEVSQLLFLRMNERNLISWNTLLSGYVGDGQPVATINIYRQMEMACVRPDHYTLAGLLNLCRFQGLLRYGRQIHARLIKTSSEMNVVLQTLLVHMYFKCKRWRDAHNVCTLIRERNSHVYEAFFKVYGDDYLI

SEQ ID NO: 8021 - DNA, 1101 bp, Sorghum bicolor
  misc_feature: Ceres ANNOT ID no. 6086417
  misc_feature: Encodes the peptide sequence at SEQ ID NO 8022
atggaggcggccgccacgtcgccgtcgccggagcagccgctgctccggcccccatccccgccgccgaatccccgcgccgacgccaggtccggcaccccggcttcgccttctccctccgcggcgaggccgagccgcctcgcggcgctcatcgggcgcgcggcggggcggcgcgggccctcgatgctggtgcgcgagacggcggcgctgcagctgcagcggaggcgcgcggactgggcgcactcccgccccgtcgtcgcgctcgacatcgcctggaacgtcgccttcgccgccgccgcggccgccgtgctcgcgtcctccgccgaggagagccccgtcaagccgctccgcctgtggctcgtcggttacgccgcccagtgcctggtgcacgtcgggctcgtctgcgccgacacccgccgcgggacgcggcgcgcccggggctccgcatccgacgtcgagtctgccggcgcagggacggacagctcggacgccgacagcgaagatgacgaaagggcggaagggaggagcagccgtacaagtcgttgcgagacgatgaacacgttgatatcatttctgtggtggatcattggattctactggctagtgtcaggtggggaggtgctcgagtatggcgctccaaggctgtattggttaaccgttgtgtttctggcctttgatgtgtttttcgctgtgttttgtgttgctgtggcctgtttcattgggattgcgctgtgttgctgcttaccctgtgtcattgctattctgtatgctctggctggccaggagggtgcatcagatgcagatattagtgttcttccaaggtatagattttctgatcctagtgaggatggtgagaaggggactgatgaaggtctgatgatccccatcctgaataatagtggagtttcaacaagtgagcgcattctacttcgtgaggatgctgaatgttgtgtctgtctctcatcatacgaagatggagctgagttatctgctctcccctgcaaccatcactttcactggacttgtattaccaaatggctgcggatgaatgcaacatgtccactctgcaagtataacattctcaaaggcagtgacagtgcatga

SEQ ID NO: 8022 - protein, 366 aa, Sorghum bicolor
  misc_feature: Ceres ANNOT ID no. 6086417
  misc_feature (315)..(355): Pfam Id: zf-C3HC4 Pfam Desc: Zinc finger, C3HC4 type (RING finger)
  misc_feature (32)..(364): NCBI GI: 92891213 NCBI Desc: zinc finger, ring-type; ringv [medicago truncatula]
  misc_feature (19)..(363): NCBI GI: 30677954 NCBI Desc: zinc finger (c3hc4-type ring finger) family protein [arabidopsis thaliana]
  misc_feature (187)..(366): NCBI GI: 46390435 NCBI Desc: ring zinc finger protein-like [oryza sativa (japonica cultivar-group)]
  misc_feature (57)..(365): NCBI GI: 38344371 NCBI Desc: osjnbb0032e06.5 [oryza sativa (japonica cultivar-group)]
  misc_feature (57)..(365): NCBI GI: 116310006 NCBI Desc: osigba0139p06.5 [oryza sativa (indica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
MEAAATSPSPEQPLLRPPSPPPNPRADARSGTPASPSPSAARPSRLAALIGRAAGRRGPSMLVRETAALQLQRRRADWAHSRPVVALDIAWNVAFAAAAAAVLASSAEESPVKPLRLWLVGYAAQCLVHVGLVCADTRRGTRRARGSASDVESAGAGTDSSDADSEDDERAEGRSSRTSRCETMNTLISFLWWIIGFYWLVSGGEVLEYGAPRLYWLTVVFLAFDVFFAVFCVAVACFIGIALCCCLPCVIAILYALAGQEGASDADISVLPRYRFSDPSEDGEKGTDEGLMIPILNNSGVSTSERILLREDAECCVCLSSYEDGAELSALPCNHHFHWTCITKWLRMNATCPLCKYNILKGSDSA

SEQ ID NO: 8023 - DNA, 1773 bp, Sorghum bicolor
  misc_feature: Ceres ANNOT ID no. 6086421
  misc_feature: Encodes the peptide sequence at SEQ ID NO 8024
  misc_feature: Down-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggccgacggcgggggcgaggaggggaatgcttcggcgcacaagggctccgcgcgccgccggggcccggtgccggcgggcctggacgcggacgacctcctcacactcatgcacgggtcggatcccgtcaaggtcgagctcaaccggcttgagaatgaagtcagggataaggatagggagctgggcgaggcgcacgcggagataaaggcgctgcggctgtcggagagggcacgggagaaggccgtcgaggagctcactgctgaattagagaaggtggatgagaaactcaagttgacagaatctctccttgaaagcaaaaacctagaactgaagaaaacaaatgatgaaaaaaaggctgctttggctgcccagtttgcagctgaagcaacactacgaagagtacatgcagctcagaaagacgatgacatgccacctattgaagccatccttgcgccacttgaagcagagttaaagctttctaggaaggagatcgcaaagctccaggatgacaatagagctttggaccgtttaacaaagcaaaaggaggcagcactgctagaagcggaaaggactgtacaaatcgcaatggctaaagctgctatggttgatgacatgcaaaataagaaccaagagctgatgaagcaaattgaaatttgccaggaagaaaataagatcttggataggctgcaccgccaaaaagttgcggaagtagaaaagctgagtcaaactgtgagagagctggaagaggatgttctgcaaggtggtgcaactgccaatgttgttagagattaccaacggaaagttcaagaaatgaatgaagaaaagaaaattcgtgatcgtgaacttgctcgagcaaaagttactgcaaatagggttgctgttgtggtcgcaaatgagtggaaagatgctaatgacaaagtaatgcctgttaaacagtggcttgaagagcgaaggttcctgcagggtgagatgcagcaacttcgggacaaacttgctattgccgagagaactgctcgatcggaagctcaattaaaggaaaagcttcagttgcgcttaaaagttttagaagaaggtttgaggggccctccaagtggttctagtcgtcctcctatggaaggaaagagtttaagtaatggacctccccgtcgactttcactaggtggtgttgacagtatctccaaaatctctccgaacggtgtgttaatgaggaggtctccgtctttcaattcaagatcctccctctctaccagcagttgtttggtcctgaagcatgcaaaaggaacttcaaagtcattcgatggtggtaccagatcattagaccgaggaaaagttctcgggagtgggcctcattcactcaatagatctacggatgcggttaaagattgtgaaacggctgacaattggaaggctaatgcagaagaaaaaagtaatgaaatcacaaacaatgattcagctgatatggtctctggcgtactctatgacgtgctgcaaaaggaggtagtttccttgagaaaggcatgccatgagaaagaccaaactctaaaggacaaagaagatgcaatagagatgctagcaaagaaagtagatacattacataaagcaaaggaagtggaggctaaaaagaagaggcaagagatagctgctctggagaaaaaatttgctgcagtgtgccttgaacaagaacgacttggtaatttgagaggacctggaacttctcagacggtttcaggaagaactgcatcgcggggtggattgacgcgcaacctccaatag

SEQ ID NO: 8024 - protein, 590 aa, Sorghum bicolor
  misc_feature: Ceres ANNOT ID no. 6086421
  misc_feature (201)..(552): Pfam Id: Myosin_HC-like Pfam Desc: Myosin II heavy chain-like
  misc_feature (1)..(581): NCBI GI: 52076974 NCBI Desc: myosin ii heavy chain-like [oryza sativa (japonica cultivar-group)]
  misc_feature (11)..(590): NCBI GI: 23463063 NCBI Desc: at1g68060/t23k23_9 [arabidopsis thaliana]
  misc_feature (9)..(588): NCBI GI: 92891211 NCBI Desc: myosin ii heavy chain-like [medicago truncatula]
  misc_feature (11)..(541): NCBI GI: 9945080 NCBI Desc: f5a9.19 [arabidopsis thaliana]
  misc_feature (201)..(590): NCBI GI: 15983420 NCBI Desc: at1g14840/f10b6_9 [arabidopsis thaliana]
  misc_feature: Down-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MADGGGEEGNASAHKGSARRRGPVPAGLDADDLLTLMHGSDPVKVELNRLENEVRDKDRELGEAHAEIKALRLSERAREKAVEELTAELEKVDEKLKLTESLLESKNLELKKTNDEKKAALAAQFAAEATLRRVHAAQKDDDMPPIEAILAPLEAELKLSRKEIAKLQDDNRALDRLTKQKEAALLEAERTVQIAMAKAAMVDDMQNKNQELMKQIEICQEENKILDRLHRQKVAEVEKLSQTVRELEEDVLQGGATANVVRDYQRKVQEMNEEKKIRDRELARAKVTANRVAVVVANEWKDANDKVMPVKQWLEERRFLQGEMQQLRDKLAIAERTARSEAQLKEKLQLRLKVLEEGLRGPPSGSSRPPMEGKSLSNGPPRRLSLGGVDSISKISPNGVLMRRSPSFNSRSSLSTSSCLVLKHAKGTSKSFDGGTRSLDRGKVLGSGPHSLNRSTDAVKDCETADNWKANAEEKSNEITNNDSADMVSGVLYDVLQKEVVSLRKACHEKDQTLKDKEDAIEMLAKKVDTLHKAKEVEAKKKRQEIAALEKKFAAVCLEQERLGNLRGPGTSQTVSGRTASRGGLTRNLQ

SEQ ID NO: 8025 - DNA, 3390 bp, Sorghum bicolor
  misc_feature: Ceres ANNOT ID no. 6086422
  misc_feature: Encodes the peptide sequence at SEQ ID NO 8026
  misc_feature: Down-regulated in shoot tissues in response to salicylic acid treatment
atggttggcagaactattcaggtccatggttttgctctaactgacagtgccgagtctgtcaaagaatttttggagcggatttctggtgctggaaccatctatgctctcaagctcaggcatccaaggaacatctctgccaactcaagggcgtttgctatagttcagttccagtcacaggaaagtgcttcattggtagaagatgtggttcaaagaaatgctccccggattggacgattttatctgaaaaccagacctgcagaccgggacattgttccaagaccaagaattccaatgttttctctggaggacactgtgctgcatttgggatgcttggttaaggaaaatattctatctgctctttttactgcaagtaatgtttcagttcaatttggatttgatatgaaaaagatttacttctacctctcctacaactttattaaatataaacttgaactttcttacgaaagtatatgggagatacagcttcaccgtccacctgcttataggtcacggacaaagttccttttgattcaggttcaggcagctcctaaaatttatgaactgctcccacgccgtccaggtcttatgtatgaggatcctttcttcaactggtttatggatgacacagatgaacaatggaccaggacgattgattttactccatcagttagcatcgggcaatcatctattttctgtctggaggtgccacagcagtgtgagctcccaagaattggtgactactttgtttactataaagagcgaaatcttgactttgaatgtcggaatgggtattcatattcctgtggtaattgcctcgttccaattgtaaaatctcctgattacatagaggtcccttatgagatactcttcaaaataaaccatttggttcagaatgggacactcagtgggccaacagttgatcacagtttcttctgtcatgttagcccagaatttgaacctattgatcatataaagcgagcacttttaaagatgtcatatttgaaaagcacctgcttgaatccaacaaattggttatctgtacaatactcaagaatacggagatcgcgccatgcatcacaaagatcatctaatatatctctggatgatggcttggtctatgtccacagggttcaagttacccctgctaaagtgtatttttatggacctgagataaatgtctccaatcgtgttgtgcggaatttctctgctgacatagataacttccttcggatttcatttgttgatgaggactgtgagaagctccgttcacttgatttgtcacctcgttctacttctggaaatgatgcaaggagaactgctctatataatagagttttgtcagtcctttcaaatggcattaatattggtgacaagcactttgagtttcttgctttttcttcaagccagcttcgagataactctgcatggatgtttgcttctcggcagggattgactgcgagtgacataaggaagtggatgggagactttcgagatatcagaaatgtggcaaagtatgctgcaagacttgggcaatcttttagttcctcaacagaaactttaatagtacgcaagcatgaggtggaacaaattcctgatattaaaaatggcacaaactacatattctctgatggagttggaaagatctcagctaattttgcaaaggaggtggctatgaagtgcaaattgagacgctttgccccttcggttttccagataaggtatggtggttacaaaggtgttgtcgctgtagatccaagatcaaatcgtaagctttcattgagaagaagcatgttaaagttccagtcagaaaatatcactcttgatgtccttgcgtacagcaagtaccaaccgtgcttcctgaatcggcagttgattactcttctctcaacacttggggttggtgataatgtctttgaactaaagcagaaggaagccattaagcagttgaacagaatggtaactgaaccacaggctgctcgtgaagcagttgaacttatgcccatgggagaagtaaccaatgtagttaaagaattgttgtcatgtggctaccagcctgatcatgagccgtatctttccatgctgctacaaacttttagagcatccaagcttctagaattgaaaacaaagtcaaggatattcatcacacaagggcgagcaatgatgggttgcttggatgaaacccgcacactaaagtatggccaggtattcatccaagcttcttactgtgcagatgaccatcacaagatcgttgtaactggaaaagtagttgttgccaaaaatccttgtctccaccctggtgacatacgggttctccaggctgtagatgttccttctctgcaccacatgtttgattgtgttgtctttccacagcagggaccaaggccgcatcctaatgagtgttcagggagcgatcttgatggggacatatattttgtttcttgggatcccgatcttattccaagtcatatggaggatcctatggactacactccagctccagcagaaacattagatcatgatgttactattgaggaaatacaggagtacttcacaaactacatagttaatgagagtcttggcattatcgccaatgcgcatgtggtctatgcagataaggaagatctgaaggctaagagtcgaccatgccttgaactggccaagctcttctctatagctgttgatttcccaaagactggagtgccggctctgattccacctgaattacatgtcaaggagtatcctgattttatggagaagctcgacaaagcaacctatgaatcaaagggtgtgatcgggaagctctacagggaaataaagaagcacacaccgcacataaggcactttacgagggaagtggcaaagcggtcttatgacaccgatttgattgttgatggctatgaagactacattactgaggctatagagttcaaggaagagtacgatttcaggctgggtaatcttatggatcactatggaataaaaagtgaagcggagataataagtggatgttttctgaagatggcaaagaatttcaccaagagtagtgatgctgatgcaattagaatggcggtgagatctttgaggaaagaagctaggtcatggttcaatgagatgagcacaagcgaggatgaccaagatgccacagaggccaaggcgtctgcttggtaccatgttacttatgatccacagtactggggcaactacaatgaaggatatgatcggccgcatcttattagctttccatggtgcgtatatgacaagcttgtgatcattaagcagaggaggaatttcttcacgcagatggatcctaatctggtgtctcccatgaataacatgagattgcatgagcattgccagcagtcagcactgccagcaggtgtgcatgaatga

SEQ ID NO: 8026 - protein, 1129 aa, Sorghum bicolor
  misc_feature: Ceres ANNOT ID no. 6086422
  misc_feature (529)..(900): Pfam Id: RdRP Pfam Desc: RNA dependent RNA polymerase
  misc_feature (1)..(1101): NCBI GI: 40794965 NCBI Desc: rna-directed rna polymerase 1 [hordeum vulgare subsp. vulgare]
  misc_feature (1)..(1113): NCBI GI: 40794967 NCBI Desc: rna-directed rna polymerase 2 [hordeum vulgare subsp. vulgare]
  misc_feature (2)..(1093): NCBI GI: 24935275 NCBI Desc: rna-dependent rna polymerase 1 [arabidopsis thaliana]
  misc_feature (2)..(1093): NCBI GI: 4038592 NCBI Desc: rna-directed rna polymerase [lycopersicon esculentum]
  misc_feature (178)..(1095): NCBI GI: 113205271 NCBI Desc: rna dependent rna polymerase family protein [solanum demissum]
  misc_feature: The sequence is a functional homolog of SEQ ID NO 6 in US patent 7060813
  misc_feature: Down-regulated in shoot tissues in response to salicylic acid treatment
MVGRTIQVHGFALTDSAESVKEFLERISGAGTIYALKLRHPRNISANSRAFAIVQFQSQESASLVEDVVQRNAPRIGRFYLKTRPADRDIVPRPRIPMFSLEDTVLHLGCLVKENILSALFTASNVSVQFGFDMKKIYFYLSYNFIKYKLELSYESIWEIQLHRPPAYRSRTKFLLIQVQAAPKIYELLPRRPGLMYEDPFFNWFMDDTDEQWTRTIDFTPSVSIGQSSIFCLEVPQQCELPRIGDYFVYYKERNLDFECRNGYSYSCGNCLVPIVKSPDYIEVPYEILFKINHLVQNGTLSGPTVDHSFFCHVSPEFEPIDHIKRALLKMSYLKSTCLNPTNWLSVQYSRIRRSRHASQRSSNISLDDGLVYVHRVQVTPAKVYFYGPEINVSNRVVRNFSADIDNFLRISFVDEDCEKLRSLDLSPRSTSGNDARRTALYNRVLSVLSNGINIGDKHFEFLAFSSSQLRDNSAWMFASRQGLTASDIRKWMGDFRDIRNVAKYAARLGQSFSSSTETLIVRKHEVEQIPDIKNGTNYIFSDGVGKISANFAKEVAMKCKLRRFAPSVFQIRYGGYKGVVAVDPRSNRKLSLRRSMLKFQSENITLDVLAYSKYQPCFLNRQLITLLSTLGVGDNVFELKQKEAIKQLNRMVTEPQAAREAVELMPMGEVTNVVKELLSCGYQPDHEPYLSMLLQTFRASKLLELKTKSRIFITQGRAMMGCLDETRTLKYGQVFIQASYCADDHHKIVVTGKVVVAKNPCLHPGDIRVLQAVDVPSLHHMFDCVVFPQQGPRPHPNECSGSDLDGDIYFVSWDPDLIPSHMEDPMDYTPAPAETLDHDVTIEEIQEYFTNYIVNESLGIIANAHVVYADKEDLKAKSRPCLELAKLFSIAVDFPKTGVPALIPPELHVKEYPDFMEKLDKATYESKGVIGKLYREIKKHTPHIRHFTREVAKRSYDTDLIVDGYEDYITEAIEFKEEYDFRLGNLMDHYGIKSEAEIISGCFLKMAKNFTKSSDADAIRMAVRSLRKEARSWFNEMSTSEDDQDATEAKASAWYHVTYDPQYWGNYNEGYDRPHLISFPWCVYDKLVIIKQRRNFFTQMDPNLVSPMNNMRLHEHCQQSALPAGVHE

SEQ ID NO: 8027 - DNA, 1263 bp, Sorghum bicolor
  misc_feature: Ceres ANNOT ID no. 6086424
  misc_feature: Encodes the peptide sequence at SEQ ID NO 8028
atggaatcgctgacgcttcgcgcctcgtctgcggcggcggccgcctcgccgctgcagcaacgccggctcccggggcggcagcgcgcgacgtacgtccgcgccacggcctccgcgtccgccgccggcgagccggacctctcggtgcgcgtgaacgggctgcagatgcccaacccgttcgtgatcgggtcggggccaccgggcaccaactacaccgtcatgaagcgcgccttcgacgagggctggggcggcgtcatcgccaagaccgtgtctttggatgctgaaaaagttatcaatgttactcctcgttatgcaaagcttcgggcagacccaaatggggctgccatggggcgcatcattggatggcagaacattgaactcatcagtgacaggcctctggagaccatgctgaatgagttcaagcagttgaagaaagagtatcctgacaggatactcatcggctcaattatggaggagtacaacaaagctgcatggcatgagcttatcgaacgtgttgaagagtctggagtggatgctcttgagattaatttctcatgtccacatggcatgccagagagaaaaatgggtgctgctgtggggcaagactgtgatttgctagaggaagtttgtggttggattaatgagaaggccactgtccctgtttgggcaaagatgactcctaacattacagatattacacagcctgcaagaatatctcttaagtctggatgtgaaggagtttctgcaattaacacaattatgagcgtaatggggattaatctcaaaacattgcgtccagaaccttgcgtggaagggtattctacacctgggggttattctgcaagagctgtgcaccctatagcgcttgctaaagtcatgcagatagcgaggatgatgaaagaagaatttgctgatggacagtctctctcagccattggtggtgtggagactggcaatgatgctgctgagtttattcttcttggtgctgatacagtacaggtatgtaccggtgtgatgatgcatggttatccccttgtgaagaagctttgtgcagagttacaggatttcatgagagagcacaacttttcatcgatcgaagagtttcgaggggcctcgcttccatacttcacgactcacacagatttggttcaccggcaacaagaggcgatcaagcaaaggaaggccatcaagaagggtcttcaatcagacaaggactggacaggcgatgggtttgtcaaggagaccgaaagcatggtatccaactga

SEQ ID NO: 8028 - protein, 420 aa, Sorghum bicolor
  misc_feature: Ceres ANNOT ID no. 6086424
  misc_feature (45)..(356): Pfam Id: DHO_dh Pfam Desc: Dihydroorotate dehydrogenase
  misc_feature (1)..(420): NCBI GI: 92898884 NCBI Desc: dihydroorotate dehydrogenase 1 [medicago truncatula]
  misc_feature (17)..(420): NCBI GI: 6177796 NCBI Desc: senescencs-related protein [pyrus pyrifolia]
  misc_feature (15)..(271): NCBI GI: 83584365 NCBI Desc: plastid dihydroorotate dehydrogenase [prototheca wickerhamii]
  misc_feature (45)..(398): NCBI GI: 84514681 NCBI Desc: dihydropyrimidine dehydrogenase [loktanella vestfoldensis ska53]
  misc_feature (45)..(407): NCBI GI: 116229850 NCBI Desc: dihydroorotate dehydrogenase family protein [solibacter usitatus ellin6076]
MESLTLRASSAAAAASPLQQRRLPGRQRATYVRATASASAAGEPDLSVRVNGLQMPNPFVIGSGPPGTNYTVMKRAFDEGWGGVIAKTVSLDAEKVINVTPRYAKLRADPNGAAMGRIIGWQNIELISDRPLETMLNEFKQLKKEYPDRILIGSIMEEYNKAAWHELIERVEESGVDALEINFSCPHGMPERKMGAAVGQDCDLLEEVCGWINEKATVPVWAKMTPNITDITQPARISLKSGCEGVSAINTIMSVMGINLKTLRPEPCVEGYSTPGGYSARAVHPIALAKVMQIARMMKEEFADGQSLSAIGGVETGNDAAEFILLGADTVQVCTGVMMHGYPLVKKLCAELQDFMREHNFSSIEEFRGASLPYFTTHTDLVHRQQEAIKQRKAIKKGLQSDKDWTGDGFVKETESMVSN

SEQ ID NO: 8029 - DNA, 2922 bp, Sorghum bicolor
  misc_feature: Ceres ANNOT ID no. 6086444
  misc_feature: Encodes the peptide sequence at SEQ ID NO 8030
atggcgggcaagtactccggggcgaggacgaacaggaggtggagggggctggcagcggccgcgtgggtgctaatcgcggtggccggcgccgcggtgatgcactggacccagcgccggcagagcatggaccgcgccgaggagcgcctcgtcagcatgtgcgaggagagggccaggatgctgcaggagcagtttggagtcaccgtcaaccacgtccacgcgatcgccattctcatcgccaccttcaactacgagaagtcccctccagccatcgacccggacacttttgcaacatacacggcaaggacatcatttgagcgacccctgctgaatggggtggcatacgcacagcgtgtcttccatcatgagagggaaatgtttgaaagccagcagggatggattatgaatacgatgcagcgggagcctgcacctccccgggatgaatacgccccagtgattttctctcaggatacagtttcctaccttgcacgcattgacatgatgtctggggaggaggaccaagaaaacattttgcgggccaggactactggcaaagctgtgttaacaaacccattccgtttgcttggatcaaaccacttgggagtagttctcacttttgctgtgtaccgccctgatctccctgctgatgcatcagttgagcaacgtgtggaagcaactattggatatcttggtggaggattcgatgtggagtcacttgtggaaaatttgctaagcaaacttgctggcaatcaggatattgtggttaatgtctatgatgtcacaaatgcttcagagcctatggctttgtatggaccttcaattttggatgaacaagtgcctttgcatgttagcatgttggattttggagatccatttaggaggcatgaaatgaggtgcaggtatagacaaaagcctcctataccgtggtctaccataaccaatcctttaggcttatttgtcatatggatgcttctggggtatagcattgccgctgcatattctagatatgacaaagttacagaagattgtagaaagatggaagagctaaaaactcaggcagaagctgctgatgttgcaaagtctcagttcctggcaactgtctcacatgagatcagaacacctatgaatggcgtccttggaatgctggatatgcttttaggaacagatttaactatgacacagaaggattatgctcaaactgctcaaatgtgtggcagagcattgataacactgataaatgatgtgcttgatcgagcaaagattgaagctggaaagttagagcttgaagcggtgccttttgacctgcgttctctcatggatgatgttatttccttgttttcttcaaagtcacgagagaagtgcattgagcttgcagtatttgtatgtgacgatgttccgaaggttgttcttggagatccttggaggtttcgacagatactgacaaatttggtcgggaatgcagtcaaattcacggaaagaggtcatgtatttgtgcgggtctgtttggctgagaactcaaatatggaagctaatcaggtcctacatggaaccatgaatgggaaagatggtaaagttgagtcaacaactaatggcgccttcaatactttgagtgggtttgaagcggcagacagacggaatagttggcaatattttaagctgctcctctctaataaggagtcacttttggatgatcttgagggcgaaaattctaatctaagtgattcagaccatgtcacactagcgataagtattgaggacacaggtgttgggataccattgcaagcacaggatcgtgtgtttacaccttttatgcaggctgatagttcaacttcaaggaattatggtggtactggcattggtctaagtatcagcaagtgtctagctgaacttatgggtgggcagataagtttcaccagccgtccttttgttggaagcacattcacattctcagccacgctgaagcgctcatacaaagatatttcagttgattcaagtaggagcttgtcagaggcactaccaactgcttttaagggaatgaaggccatcttgatagatgggagacctgtacgtagtgctgttacaaaatatcacctcaagaggttgggaataattgttcaagttgtgaacaatatgagtacagtagtaaaagctttccctggacaaaatggagcgaccgtttctagggaaaaggcaaccatgctttttattgagagtgacttctggaggcctgaaacagatgttcaattattgaaccatctacgcgagcacaagaatggtctgttgtctgatgcgcctaaggtagttcttttggtcacctctgaagctgacaaggacaattatggatctatatttgatattgtgatgtgtaagcctataagggcaagcacaattgcttcatctattcaacaactgctcaaagtagagatgcccaaaagaaaagaaaatcaaaatcggccatcgtttcttcgtagcttgctggttgggaagaacatattggtcgtagatgataataaagtcaatctcagagttgctgcagctgcactaaagaagtacggtgctaatgttagctgtgttgaaagtggcaaggatgctatcagtctacttcaacccccacattcctttcatgcatgttttatggatgttcagatgccagagatggatgggtttgaggcaaccagacaaataaggcaaatggagatgaaagctaatgaggaaaggaagaacaagttgtctttgactgaagcctcgacatttgttgagtaccgtttgcctgttctggcaatgacagccgatgttatccaggcaacttatgaagagtgtataaaatcgggtatggatggatatgtatctaaacccttcgacgaggagcagctatgccaagtagtctccagattagtagtggaaacgacggattcagctgtttaa

SEQ ID NO: 8030 - protein, 973 aa, Sorghum bicolor
  misc_feature: Ceres ANNOT ID no. 6086444
  misc_feature (86)..(297): Pfam Id: CHASE Pfam Desc: CHASE domain
  misc_feature (470)..(653): Pfam Id: HATPase_c Pfam Desc: Histidine kinase-, DNA gyrase B-, and HSP90-like ATPase
  misc_feature (828)..(962): Pfam Id: Response_reg Pfam Desc: Response regulator receiver domain
  misc_feature (358)..(423): Pfam Id: HisKA Pfam Desc: His Kinase A (phosphoacceptor) domain
  misc_feature (1)..(973): NCBI GI: 89242031 NCBI Desc: histidine kinase [zea mays]
  misc_feature (1)..(973): NCBI GI: 12060392 NCBI Desc: histidine kinase 1 [zea mays]
  misc_feature (14)..(973): NCBI GI: 118790708 NCBI Desc: tpa: histidine kinase [oryza sativa (japonica cultivar-group)]
  misc_feature (299)..(973): NCBI GI: 115448563 NCBI Desc: os02g0738400 [oryza sativa (japonica cultivar-group)]
  misc_feature (17)..(965): NCBI GI: 118790698 NCBI Desc: tpa: histidine kinase [oryza sativa (japonica cultivar-group)]
  misc_feature: The plant flowers significantly late compared to wild-type.
  misc_feature: The plant is abnormally large.
  misc_feature: The plant is abnormally small.
  misc_feature: Useful for making plants with modulated biomass
  misc_feature: Useful for making plants with modulated flowering time
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13269
  misc_feature: The sequence is a functional homolog of SEQ ID NO 5 in US patent 7026530
MAGKYSGARTNRRWRGLAAAAWVLIAVAGAAVMHWTQRRQSMDRAEERLVSMCEERARMLQEQFGVTVNHVHAIAILIATFNYEKSPPAIDPDTFATYTARTSFERPLLNGVAYAQRVFHHEREMFESQQGWIMNTMQREPAPPRDEYAPVIFSQDTVSYLARIDMMSGEEDQENILRARTTGKAVLTNPFRLLGSNHLGVVLTFAVYRPDLPADASVEQRVEATIGYLGGGFDVESLVENLLSKLAGNQDIVVNVYDVTNASEPMALYGPSILDEQVPLHVSMLDFGDPFRRHEMRCRYRQKPPIPWSTITNPLGLFVIWMLLGYSIAAAYSRYDKVTEDCRKMEELKTQAEAADVAKSQFLATVSHEIRTPMNGVLGMLDMLLGTDLTMTQKDYAQTAQMCGRALITLINDVLDRAKIEAGKLELEAVPFDLRSLMDDVISLFSSKSREKCIELAVFVCDDVPKVVLGDPWRFRQILTNLVGNAVKFTERGHVFVRVCLAENSNMEANQVLHGTMNGKDGKVESTTNGAFNTLSGFEAADRRNSWQYFKLLLSNKESLLDDLEGENSNLSDSDHVTLAISIEDTGVGIPLQAQDRVFTPFMQADSSTSRNYGGTGIGLSISKCLAELMGGQISFTSRPFVGSTFTFSATLKRSYKDISVDSSRSLSEALPTAFKGMKAILIDGRPVRSAVTKYHLKRLGIIVQVVNNMSTVVKAFPGQNGATVSREKATMLFIESDFWRPETDVQLLNHLREHKNGLLSDAPKVVLLVTSEADKDNYGSIFDIVMCKPIRASTIASSIQQLLKVEMPKRKENQNRPSFLRSLLVGKNILVVDDNKVNLRVAAAALKKYGANVSCVESGKDAISLLQPPHSFHACFMDVQMPEMDGFEATRQIRQMEMKANEERKNKLSLTEASTFVEYRLPVLAMTADVIQATYEECIKSGMDGYVSKPFDEEQLCQVVSRLVVETTDSAV

SEQ ID NO: 8031 - DNA, 3522 bp, Sorghum bicolor
  misc_feature: Ceres ANNOT ID no. 6086453
  misc_feature: Encodes the peptide sequence at SEQ ID NO 8032
atgcactgcatcgccccccgcctgctcctcctcccactcccgaccgtctcccgccacgcgctatcgccaacccagacgctacctcttcctctcctcctcccctcccgcgcagtctgtaggctccacctcgcctccgcgcgctcgccgtcccgcgccgccgcttcggtttccgatgacgacgaggatgaggaggttgacgtggatgacgacgacgacgagataggcatccgcgacgtagacgatgaagactacgacgatttcgaggacggggatgagggagatgaggaggcggtggacgaggagagcgttggtgagtacgaggaagaggcggagcaggacgaggacgagcgggaggataccgcagcgcggaggcgggagtcggaggagtataagtcgcggcgggtggtgaagctggtcgctgaggtgcgggagttcggggaggacatcatcgactacaacgagctcgccgggatctacgacttccccatcgacaagtttcagcgcttggctatacaagcatttttaagaggttcatctgttgtagtttctgcacctacaagtagtgggaagacattaatagcagaagctgcagcagtcgcaacagtagctagaggaaggcgtctcttctacacaacaccattaaaggccttgtcaaaccagaagttccgtgatttccgggatacttttggtgatcataatgttggccttcttacaggagattctgctatcaacaaagatgctcagatcttaattatgacaacagagattttacgtaacatgctgtaccaaagtgttggcatgacagcttctgaaggtagattatttcaagttgatgtcattgttttggacgaagtccattatttgagtgatatctcacgtggcactgtttgggaagaaactgtcatatattgtccaaaggaagtccagcttatatgtctgtcagctactgttgcaaatcctgatgaattagctggctggataagtcagattcatggtaaaacagagcttgtaacatcgaacaaacgtccagttccgcttacttggcacttctcgaagaaatactcattacaaccacttcttgatggaaaggggaaaaaaatgaataggaaactgcggatgtctaactttcaaaacttagcatctccaaagagtgagttctattatgtcaaaggaaagaggagatttagaacaaataaaattgagcaaggtaatagcagctcttttgacatatcaaaacaggttcagttatcaaagcatgaactcagcaatatgcgccgttcccaagttccactaatacgtgacactttatcacaactatgggaaaatgacatgcttccagctatttggtttatttttagtagaagagggtgtgatgcagctgttgagtaccttgaggattgcagactgttacatgactgtgaggctagtgaagttgaactggaacttaggaggttcaagatgcaatatcctgatgctgttcgagaaagcgctgtgaaaggactcttgcgaggagttgcggcccatcatgctggttgcttgccactgtggaaatcattcattgaagaattatttcagcgtggccttgttaaagtagtttttgcgacggaaacccttgcagctgggattaatatgcctgctaggacggctgtgatttcttctctcagtaaaagaatagatgctgggcgccagctattaaccccaaatgaactatttcaaatggcaggtcgtgctggaaggagagggattgatacagttgggcatactgttcttgttcagactccatatgaagggcctgaagagtgctgtgacatcatctttgctggacttgagccacttgtctcacaattcactgcatcatatgggatggttttgaatcttcttgccggttcaaaagttacacataatcagaaagaatcggatgatgttaataaggtgaagcgctctggaagaaccttagaagaagctcgaaagctcgtggagcaaagctttgggaattatgttgggagcaatgtaatggttgctgccaaagaagagattgaaagaatacagcaagaaatacaatatctctcttcagaaattactgatgaatctactgaccgaaaatgcagggaagaattatcagaggaagactatgctgagatttcccttctacagaagagactaaaggaagagaagcagatcagaaatgagctgaaaaaaaagatggaactggagagaatggctgcatggaaaaatcggttagaagagtttgaaaatggccatcttcctttcatgtgcctgcaatacaaagataaggattcaattcagcacacgatccctgctgtatttattggaaacctcaactcatttgctgatcaaaagatcacgaacatggtggaagatgattcacttgtttccggcaagcagaaacttgatagtggggaacaactctattgcccatcttactatgtagctttaagttcagataattcgtggtatttgttcacagaaaaatggataaaaactgtttacaagacaggtctacctgctgtcgcttctattgaagggggcgcgctacctagagaaaccctgaagcagctcctcctgcgtgaagagttgatgtgggataaagttgcaaaatcagaatatggctctttgttaagcatggatggttctttagacacatggtcgtggagtctcaatgttcctgtgcttaatagcctttcagaagacgatgaggtagaacgattctcccaggaacatcgagatgctgtagaatgctacaagcaacagaggaggaaggtttcacatttgaagaaaacaataaggagtactaagggtttcaaagaattccaaaagatcatcgacataagaaattttacaaaagagaagattgagcgtttggaagctagatcccgtcgcttgactcgacggataagacaaattgaaccgaccggttggaaagaatttctccagattagcaaagtcatacaagaggctagagcattagatatcaatactcaggtaatctatcctttgggtgagacggcagcggctatacgaggggaaaacgagctctggcttgctatggttctaaggaacaaggttctcttggatctaaagccatctcaactggcagcagtttgtggaagtttagtctcggaagggatcaaatttcgtccttggaaaaatagcagctatgtatatgaaccttcttctgttgttattggtgttataagttatttagaagagcagagaaattcactaattgatctccaagagagacatggtgttaagataccttgcgaaatagatgcccagtttgctgggatggttgaagcctgggcttcggggttgacctggagggagataatgatggactctgcaatggacgatggagatttagcccgtctactcaggcgctcaatagatttactagctcagattccaaaacttccagacattgatccagttctccaaaagaatgcacaaattgcttgcagcgtcatggaccgagtaccgattagtgagcttgccggttga

SEQ ID NO: 8032 - protein, 1173 aa, Sorghum bicolor
  misc_feature: Ceres ANNOT ID no. 6086453
  misc_feature (164)..(323): Pfam Id: DEAD Pfam Desc: DEAD/DEAH box helicase
  misc_feature (986)..(1171): Pfam Id: DSHCT Pfam Desc: DSHCT (NUC185) domain
  misc_feature (499)..(581): Pfam Id: Helicase_C Pfam Desc: Helicase conserved C-terminal domain
  misc_feature (160)..(319): Pfam Id: ResIII Pfam Desc: Type III restriction enzyme, res subunit
  misc_feature (321)..(1173): NCBI GI: 2194131 NCBI Desc: similar to synechocystis antiviral protein (gbd90917). [arabidopsis thaliana]
  misc_feature (14)..(917): NCBI GI: 14423540 NCBI Desc: similar to synechocystis antiviral protein [arabidopsis thaliana]
  misc_feature (154)..(371): NCBI GI: 23126945 NCBI Desc: cog4581: superfamily ii rna helicase [nostoc punctiforme pcc 73102]
  misc_feature (385)..(627): NCBI GI: 119513661 NCBI Desc: type iii restriction enzyme, res subunit [nodularia spumigena ccy9414]
  misc_feature (154)..(371): NCBI GI: 75909112 NCBI Desc: type iii restriction enzyme, res subunit [anabaena variabilis atcc 29413]
MHCIAPRLLLLPLPTVSRHALSPTQTLPLPLLLPSRAVCRLHLASARSPSRAAASVSDDDEDEEVDVDDDDDEIGIRDVDDEDYDDFEDGDEGDEEAVDEESVGEYEEEAEQDEDEREDTAARRRESEEYKSRRVVKLVAEVREFGEDIIDYNELAGIYDFPIDKFQRLAIQAFLRGSSVVVSAPTSSGKTLIAEAAAVATVARGRRLFYTTPLKALSNQKFRDFRDTFGDHNVGLLTGDSAINKDAQILIMTTEILRNMLYQSVGMTASEGRLFQVDVIVLDEVHYLSDISRGTVWEETVIYCPKEVQLICLSATVANPDELAGWISQIHGKTELVTSNKRPVPLTWHFSKKYSLQPLLDGKGKKMNRKLRMSNFQNLASPKSEFYYVKGKRRFRTNKIEQGNSSSFDISKQVQLSKHELSNMRRSQVPLIRDTLSQLWENDMLPAIWFIFSRRGCDAAVEYLEDCRLLHDCEASEVELELRRFKMQYPDAVRESAVKGLLRGVAAHHAGCLPLWKSFIEELFQRGLVKVVFATETLAAGINMPARTAVISSLSKRIDAGRQLLTPNELFQMAGRAGRRGIDTVGHTVLVQTPYEGPEECCDIIFAGLEPLVSQFTASYGMVLNLLAGSKVTHNQKESDDVNKVKRSGRTLEEARKLVEQSFGNYVGSNVMVAAKEEIERIQQEIQYLSSEITDESTDRKCREELSEEDYAEISLLQKRLKEEKQIRNELKKKMELERMAAWKNRLEEFENGHLPFMCLQYKDKDSIQHTIPAVFIGNLNSFADQKITNMVEDDSLVSGKQKLDSGEQLYCPSYYVALSSDNSWYLFTEKWIKTVYKTGLPAVASIEGGALPRETLKQLLLREELMWDKVAKSEYGSLLSMDGSLDTWSWSLNVPVLNSLSEDDEVERFSQEHRDAVECYKQQRRKVSHLKKTIRSTKGFKEFQKIIDIRNFTKEKIERLEARSRRLTRRIRQIEPTGWKEFLQISKVIQEARALDINTQVIYPLGETAAAIRGENELWLAMVLRNKVLLDLKPSQLAAVCGSLVSEGIKFRPWKNSSYVYEPSSVVIGVISYLEEQRNSLIDLQERHGVKIPCEIDAQFAGMVEAWASGLTWREIMMDSAMDDGDLARLLRRSIDLLAQIPKLPDIDPVLQKNAQIACSVMDRVPISELAG

SEQ ID NO: 8033 - DNA, 1107 bp, Sorghum bicolor
  misc_feature: Ceres ANNOT ID no. 6086460
  misc_feature: Encodes the peptide sequence at SEQ ID NO 8034
atgggtgcgccctccccggcgatgtgggccgggctggtgctggtggcgttattggccgcatcggggccggcggcgacagcggcggcggggctgccgaggttcgccgaggcgcccgagtacaggaacggggaggggtgcccggccccggtggcgggcgcgggggtctgcgacccgggcctggtgcacatcgccatgacgctcgacgcgcactacctcaggggctccatggcggccatctactcgctgctcaagcacgcctcctgcccggagtcgctcttcttccacttcctcgccgcggagggcggcggcgcgccggccgtcgccgacctccgggccgccgtgtccgcctccttcccgtccctgcgcttcgagatctacccgttccgcgccgacgcggtcgccgggctcatctccgcgtccgtgcgcgccgcgctcgaggcgccgctcaactacgcgcggaaccacctcgccgacctgctcccgcgctgcgtcccgcgcgcgatatacctcgactccgacgtgctcgccgtcgacgacgtgcggaggctctgggagacgcgcctgcccgcagccgcggtcgtcgccgcgcccgagtactgccacgccaacttctcccgctacttcaccgaggccttctggaacgaccccgtcctcggcgccagagtctttgctggccgccgccgcgcgccctgctacttcaatacgggcgtcatggtcatcgacctccggagatggcgcgttggcaactaccgccagcgcatcgagcgctggatggagatgcagaaggagaaaagaatctacgagcttggctccttgccccccttcttgctcgtcttcgccggcgagattgaggctgtcgaccaccggtggaaccagcacggcttgggcggcgacaacgtcttcggcagctgccgccctctccataacgggcccgtcagcctgatgcactggtccgggaagggcaagccatgggaccgtctcgacgccggcaagccttgcccgctcgaccacacctggaggtcgtacgacctctacattggcgagaatgattcatcatcagcatcagggccgtcccggtcagccttgtcatcatcggcggcatggtag

SEQ ID NO: 8034 - protein, 368 aa, Sorghum bicolor
  misc_feature: Ceres ANNOT ID no. 6086460
  misc_feature (62)..(328): Pfam Id: Glyco_transf_8 Pfam Desc: Glycosyl transferase family 8
  misc_feature (12)..(344): NCBI GI: 90399377 NCBI Desc: b1011h02.5 [oryza sativa (indica cultivar-group)]
  misc_feature (12)..(344): NCBI GI: 38346761 NCBI Desc: osjnba0081c01.12 [oryza sativa (japonica cultivar-group)]
  misc_feature (12)..(344): NCBI GI: 115459586 NCBI Desc: os04g0530900 [oryza sativa (japonica cultivar-group)]
  misc_feature (30)..(345): NCBI GI: 12003394 NCBI Desc: avr9/cf-9 rapidly elicited protein 231 [nicotiana tabacum]
  misc_feature (33)..(346): NCBI GI: 92883439 NCBI Desc: glycosyl transferase, family 8 [medicago truncatula]
  misc_feature: Useful for making plants with altered cell wall content and/or composition
  misc_feature: GREAT-hit functional homolog of the protein sequence encoded by LOCUS at1g24170
  misc_feature: GREAT-hit functional homolog of the protein sequence encoded by LOCUS at1g70090
  misc_feature: Useful for making plants with altered cell wall content and/or composition
  misc_feature: Functional homolog of the protein sequence given in SEQ ID NO 14009
  misc_feature: Useful for making plants with altered carbohydrate content
  misc_feature: Functional homolog of the protein sequence given in SEQ ID NO 14010
MGAPSPAMWAGLVLVALLAASGPAATAAAGLPRFAEAPEYRNGEGCPAPVAGAGVCDPGLVHIAMTLDAHYLRGSMAAIYSLLKHASCPESLFFHFLAAEGGGAPAVADLRAAVSASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWRSYDLYIGENDSSSASGPSRSALSSSAAW

SEQ ID NO: 8035 - DNA, 1764 bp, Sorghum bicolor
  misc_feature: Ceres ANNOT ID no. 6086469
  misc_feature: Encodes the peptide sequence at SEQ ID NO 8036
atggccatgctcctccgccgccgactcccgctgctccgcctcctccggctgctgcacactgaatcggcggcttcgacctccttgtcctccacacctcccccgcctctccagaagcctcacgccgccgtcgtggggctaggatcacgccgcctgcggttccccaatgccacacccgccgagtcggtgtcgcgggcctcgaaatcgtcctccgctgccgcctatctcgctatcggcgccgccgccgcgctcgcgtcgctgccggtggcctacgcagacagcaatgagcagggcgcggtcgacaaagtagcgagtgctgatcccgcggagggggaggatttggcccgcaaggagaggaagaggatattggagcttgtccagagccgagggatgcagcgcgggtcatacccgcagtttgatgttgcagtgaagggccaaaagttggttgttaaattcaacatgccatctacttgcaatgtatcacaccttatcgttgatctcgtaacacatatcggacatgaggcagaacaacttggtggtggctcagaggttctagtgcgtgcttgggacagtccagcagcacgtcaaatcacactgaatcctcccaagaagactagcaccggagatcacggtgaagatggtctctgtgttctgatatttgagccacttgtcggatcagattattctgaaattgaattcatcaagcgtgggagttttagtttgaaagaacttgaggctttggtcagtgctttaaaaatagctggtgagaaaaatgttaaggggtcatcagggaaaaacacaccaagaaaaggaaatggtcagagatctaagcatgtaccctctttggagaaaactgtatctgatttagatgctatgggtgttagagtctatggatttgatgaaacatctagtgttccaatggatggcactgtaatctgggagaaccttgcaggatatgaacctcagaaaagggaaatagaggataccatactcttagctttacagagtcctgaagtgtatgatgacattgctcgcggtacgcgctgcaaatttgagacaaatagacctcgagctgttctttttgagggcccacctgggacaggcaagacatcttcagctcgagttattgctaaacaagcaggagttccactactatatgtgccacttgaagttgttatgtcaaaatattatggtgaaagcgagcgtctattgggatctgttttttcacttgcaaatgatcttcctgaaggaggtattatattcttagatgaggtggattcttttgctattgctcgagacagcgaaatgcatgaagctacacgaagaatcttgtcagtaattctgcgacagatcgatgggtttgagcaggatagacgggtggtagtcattgctgcaacaaatagaaaggaggaccttgatccagctctcatcagccgttttgattcaatcatctgttttggcttaccagatcagcaaactcgtgcggaaatagctgcacagtatgccaagcacttgactagatcagaattggttcaattttcattggccactgaagagatgtcaggaagagatatcagggatgtgtgccaacaagctgaaagacactgggcgtcaaagttaataagggggcaggttccaaaagatgagaagggggagccgagtcttcccccaattgacgaatacctttcctgtgctgaacagagacggaagtccttgcctgatagaacaaaacggacatccaggtcccctgcccttaagttagcatga

SEQ ID NO: 8036 - protein, 587 aa, Sorghum bicolor
  misc_feature: Ceres ANNOT ID no. 6086469
  misc_feature (357)..(537): Pfam Id: AAA Pfam Desc: ATPase family associated with various cellular activities(AAA)
  misc_feature (357)..(487): Pfam Id: AAA_5 Pfam Desc: ATPase family associated with various cellular activities(AAA)
  misc_feature (16)..(585): NCBI GI: 42566294 NCBI Desc: aaa-type atpase family protein [arabidopsis thaliana]
  misc_feature (129)..(533): NCBI GI: 89306649 NCBI Desc: atpase, aaa family protein [tetrahymena thermophila sb210]
  misc_feature (288)..(569): NCBI GI: 24214767 NCBI Desc: atpases of the aaa+ class [leptospira interrogans serovar lai str. 56601]
  misc_feature (288)..(569): NCBI GI: 45657710 NCBI Desc: aaa family atpase [leptospira interrogans serovar copenhageni str. fiocruz l1-130]
  misc_feature (288)..(561): NCBI GI: 116120794 NCBI Desc: aaa family atpase [leptospira borgpetersenii serovar hardjo-bovis l550]
  misc_feature: The sequence is a functional homolog of SEQ ID NO. 471 in the 11/188,298 US application
  misc_feature: The sequence is a functional homolog of SEQ ID NO. 462 in the 11/188,298 US application
MAMLLRRRLPLLRLLRLLHTESAASTSLSSTPPPPLQKPHAAVVGLGSRRLRFPNATPAESVSRASKSSSAAAYLAIGAAAALASLPVAYADSNEQGAVDKVASADPAEGEDLARKERKRILELVQSRGMQRGSYPQFDVAVKGQKLVVKFNMPSTCNVSHLIVDLVTHIGHEAEQLGGGSEVLVRAWDSPAARQITLNPPKKTSTGDHGEDGLCVLIFEPLVGSDYSEIEFIKRGSFSLKELEALVSALKIAGEKNVKGSSGKNTPRKGNGQRSKHVPSLEKTVSDLDAMGVRVYGFDETSSVPMDGTVIWENLAGYEPQKREIEDTILLALQSPEVYDDIARGTRCKFETNRPRAVLFEGPPGTGKTSSARVIAKQAGVPLLYVPLEVVMSKYYGESERLLGSVFSLANDLPEGGIIFLDEVDSFAIARDSEMHEATRRILSVILRQIDGFEQDRRVVVIAATNRKEDLDPALISRFDSIICFGLPDQQTRAEIAAQYAKHLTRSELVQFSLATEEMSGRDIRDVCQQAERHWASKLIRGQVPKDEKGEPSLPPIDEYLSCAEQRRKSLPDRTKRTSRSPALKLA

SEQ ID NO: 8037 - DNA, 2091 bp, Sorghum bicolor
  misc_feature: Ceres ANNOT ID no. 6086471
  misc_feature: Encodes the peptide sequence at SEQ ID NO 8038
atgacgatgcttgctgtcctcgccgtcctcttggtgtccacggcggtggcagcagcatcctcccactcccatccccacccgctggacccactctccgccgcagagctcacggctgtccgcgcagccgtgcttgcctctccgttcgtccccgcccgcccgctccacttccactacgtcggcctcgacgagcccgagaagccggaggtcctctcctactcctacgcctccgccacagccctcctcccgcggcgcgcgctcgtcatcgctcgagccgatggccagtcccacgagctcctcgtcgacgtcaccgacgcctccgcgccgtccgtcctctcgcacgccgtccaccgcggcgcgggcttcccgatgatgacgacggaggaccaggtcgcggcaatggcgctgccgcccacgtaccctcccttcgtggactccgtgcggcggcgcgggctcaacgtcagcgacgtcggctgcggggtgatctccagggggtggttcggcgctagccagccggcctacggcggcggcagggtggcgaagatgcagtgcttcgtcaccgccgggtcggccaacttctacgcgcggccgctggagggcgtcacgctggtggtggacctcgaccgggtggccatcgtcgggtaccgggacagggtggtggagccggtgcccaaggccgacggcaccgactaccgggcggagaagctcgggccgccgttcaccgggccggccacggcgcccggcgtcgtcgtgcagccggagggcaggggattccacattgatggccgtgttgtcagatgggccaactgggagttccacgttggcttcgacatgcgcgccggcatggtcatctcgctcgcctccatccaagacgccgacgatgccgccccagggggccagcggcgccgacgggtgctctaccgcggcttcgtatcagaggtgttcgtgccctacatggacccggcggaggagtggtacttccacaccttcattgacgccggcgactacggcctgggcgtctcggcgtcgccgctgcttcgcggcgctgactgccccacgaacgccgcctacttcggcgggtactatgccgacgcggacggcaagcccgtcgaggccatggacgtgatatgcctgttcgagaggtacgccggcgacgtagcgtggcgtcacaccgagtttggaacgcgtggccgcgtggagacggaggtgagaccggacgtgacattggtggcgagaacggtggtgacagtgggcaactacgactacactttggactgggagttcaagaccatgggctccatcaagtgtgtggtgtcactcagcggcatccttgagatgaaggcgacgtcgtatacacacgtcgagcagatcaagtccgacgcgcacggcacgctggtggccgagaacacggtgggcgtctaccacgaccatttcatcacgtaccacctggacctcgacgtggacggcaccaacaactcgttcgtcaagaacaccatggtccccgagcgcaataccggggaccccgccacgggcggcgctgacacgccaaggaggagctactggacggtgcgccgcgacgtggccgagacggaggccgacggccaggtgaacgtcgacggcggcggcccaccggcagatctgctgttcgtcaacccgagcaaggaaaccaaggtcggcaacgaggtcgggtaccggctcgtcccggcgggggcgaccggcgcgtcgctgctggcggacgacgactacccgcagcgccgcgccagctacaccaagcggcaggtgtgggtgacgccctacgataggtcggagaagtgggcgacggggctgtacgcggagcagggcaccggagaggatagcttgggtgcctggagcaagaggaacagaggcatcagggacagggacatcgtgctgtggtacaccgtgggactccatcacatcccctaccaggaggacttcccggtgatgcccacgctcagcggtggcttccagctgcgtccggccaacttcttcgacaggaatccgttgattcggaccaggccaccggctgatcacaataactacccaaactgctcatgtggcgtcgcgtccatgtga

SEQ ID NO: 8038 - protein, 696 aa, Sorghum bicolor
  misc_feature: Ceres ANNOT ID no. 6086471
  misc_feature (242)..(682): Pfam Id: Cu_amine_oxid Pfam Desc: Copper amine oxidase, enzyme domain
  misc_feature (122)..(223): Pfam Id: Cu_amine_oxidN3 Pfam Desc: Copper amine oxidase, N3 domain
  misc_feature (26)..(113): Pfam Id: Cu_amine_oxidN2 Pfam Desc: Copper amine oxidase, N2 domain
  misc_feature (26)..(695): NCBI GI: 115457476 NCBI Desc: os04g0269600 [oryza sativa (japonica cultivar-group)]
  misc_feature (14)..(690): NCBI GI: 18378770 NCBI Desc: amine oxidase precursor [euphorbia characias]
  misc_feature (26)..(696): NCBI GI: 22654995 NCBI Desc: at4g12290/t4c9_130 [arabidopsis thaliana]
  misc_feature (26)..(696): NCBI GI: 7267930 NCBI Desc: copper amine oxidase-like protein [arabidopsis thaliana]
  misc_feature (26)..(689): NCBI GI: 5733089 NCBI Desc: amine oxidase [canavalia lineata]
MTMLAVLAVLLVSTAVAAASSHSHPHPLDPLSAAELTAVRAAVLASPFVPARPLHFHYVGLDEPEKPEVLSYSYASATALLPRRALVIARADGQSHELLVDVTDASAPSVLSHAVHRGAGFPMMTTEDQVAAMALPPTYPPFVDSVRRRGLNVSDVGCGVISRGWFGASQPAYGGGRVAKMQCFVTAGSANFYARPLEGVTLVVDLDRVAIVGYRDRVVEPVPKADGTDYRAEKLGPPFTGPATAPGVVVQPEGRGFHIDGRVVRWANWEFHVGFDMRAGMVISLASIQDADDAAPGGQRRRRVLYRGFVSEVFVPYMDPAEEWYFHTFIDAGDYGLGVSASPLLRGADCPTNAAYFGGYYADADGKPVEAMDVICLFERYAGDVAWRHTEFGTRGRVETEVRPDVTLVARTVVTVGNYDYTLDWEFKTMGSIKCVVSLSGILEMKATSYTHVEQIKSDAHGTLVAENTVGVYHDHFITYHLDLDVDGTNNSFVKNTMVPERNTGDPATGGADTPRRSYWTVRRDVAETEADGQVNVDGGGPPADLLFVNPSKETKVGNEVGYRLVPAGATGASLLADDDYPQRRASYTKRQVWVTPYDRSEKWATGLYAEQGTGEDSLGAWSKRNRGIRDRDIVLWYTVGLHHIPYQEDFPVMPTLSGGFQLRPANFFDRNPLIRTRPPADHNNYPNCSCGVASM

SEQ ID NO: 8039 - DNA, 1251 bp, Sorghum bicolor
  misc_feature: Ceres ANNOT ID no. 6086478
  misc_feature: Encodes the peptide sequence at SEQ ID NO 8040
atgctctctcaggccgtgtcgctctcgtcgcaaccaagccttccttccctgccatcgttaggtccccgcgacctaaacgtcagcccttgccaccaccggtgcgtcgccaccctcagagaccacgcctcctacgtctcggccctcgccttcgacggccactcgctgtacagcgcctcgtcggacggccgcatcagggtgtgcccattgggcgacgcgagcgggaggcaggaacagcaacgggacgacgacgacggttgcagggctacggtggtcgttgcggcgtgcgacagctccgtgaagtgtcttctcgccacgggcagcaacggtctcctcctcagctcccaccaagacggcaagatcatggcgtggcggaccggaagcaggaaggatgggaccccgcgcctcgttctgcgcgccgtcctgccgacctgcgtggaccggctgctgacgttcctgctcccgtggagctacgtgcaggtccggcggcaccggtggcgcacctgggtgcaccacgtggacgcggtcaccgcgctcgcggtgtccccggacggcgcgctcctgtactcggcgtcatgggaccggagcgtcaaggtgtggcggctaccggggttccgatgcgtggagtccatcgcggccgcgcacgacgacgccatcaacgcgctggaggtgtcgcccgacgggcacgtgtacaccggctccgccgacaagaagatcaaggcgtggaggcgccacccggagcggaggaacaagcacgtgctcgtgcagacgatggagcgccacaggtcggcggtgaacgcgctcgctctaggagccgacgggaaggtgctctactccggcgcgtgcgaccggtcggtggtggtgtgggagcgggccgacggcggcgccgggcgcatggaggccactggcacgctcagaggacacgccaaggcgatcctgtgcctggcggcggccggggacgtggtgtgcagcggctccgcggacaggacggtgagggtgtggaggaggggagcggagaataatacggggtacactcgcctggccgtcctggaaggccacggcgcgcctgtgaagagcctagctttggtgtacggacgtgaccgcggcttgttcagcggttggggcgatccagaagagggatcgtccggtggtggtggtggcgccggcgccggcggccattgtgctattgtttgcagtggcgcgttggacggcgaggtgaagatttggagcgtattgtttccggttctcttgtag

SEQ ID NO: 8040 - protein, 416 aa, Sorghum bicolor
  misc_feature: Ceres ANNOT ID no. 6086478
  misc_feature (162)..(200): Pfam Id: WD40 Pfam Desc: WD domain, G-beta repeat
  misc_feature (205)..(242): Pfam Id: WD40 Pfam Desc: WD domain, G-beta repeat
  misc_feature (251)..(289): Pfam Id: WD40 Pfam Desc: WD domain, G-beta repeat
  misc_feature (298)..(334): Pfam Id: WD40 Pfam Desc: WD domain, G-beta repeat
  misc_feature (343)..(409): Pfam Id: WD40 Pfam Desc: WD domain, G-beta repeat
  misc_feature (1)..(415): NCBI GI: 46390314 NCBI Desc: transducin family protein / wd-40 repeat family protein-like [oryza sativa (japonica cultivar-group)]
  misc_feature (28)..(410): NCBI GI: 115467314 NCBI Desc: os06g0238700 [oryza sativa (japonica cultivar-group)]
  misc_feature (32)..(410): NCBI GI: 51535819 NCBI Desc: transducin family protein-like [oryza sativa (japonica cultivar-group)]
  misc_feature (2)..(363): NCBI GI: 92893598 NCBI Desc: wd40-like [medicago truncatula]
  misc_feature (2)..(410): NCBI GI: 38345251 NCBI Desc: osjnbb0011n17.12 [oryza sativa (japonica cultivar-group)]
  misc_feature: The sequence is a functional homolog of SEQ ID NO. 502 in the 11/188,298 US application
MLSQAVSLSSQPSLPSLPSLGPRDLNVSPCHHRCVATLRDHASYVSALAFDGHSLYSASSDGRIRVCPLGDASGRQEQQRDDDDGCRATVVVAACDSSVKCLLATGSNGLLLSSHQDGKIMAWRTGSRKDGTPRLVLRAVLPTCVDRLLTFLLPWSYVQVRRHRWRTWVHHVDAVTALAVSPDGALLYSASWDRSVKVWRLPGFRCVESIAAAHDDAINALEVSPDGHVYTGSADKKIKAWRRHPERRNKHVLVQTMERHRSAVNALALGADGKVLYSGACDRSVVVWERADGGAGRMEATGTLRGHAKAILCLAAAGDVVCSGSADRTVRVWRRGAENNTGYTRLAVLEGHGAPVKSLALVYGRDRGLFSGWGDPEEGSSGGGGGAGAGGHCAIVCSGALDGEVKIWSVLFPVLL

SEQ ID NO: 8041 - DNA, 1329 bp, Sorghum bicolor
  misc_feature: Ceres ANNOT ID no. 6086479
  misc_feature: Encodes the peptide sequence at SEQ ID NO 8042
atggcggggcccaagttcgggtcgttcaaggcagaaaagggggactccgcggcggctgccggcgccgcggtgcagaggagggacccatacgaggtgctcggggtggggcgtaatgctacggagcaggagatcaagagtgccttccgccgcatggcactcaagtaccatccagataagaattcagacgaccctgttgcctcagagaagtttcaagaagccacattctcctataacatcctgtcagatccagataagaggcgccagtatgatgcatcagggtttgaggccattgaagcagatagtcaggaactggagctcgacctatcaagtcttaatactgtaaatacagtgtttgctgctctgtttagcaaactaggtgtaccaatcaagaccactgtctcagcaacagttttagaagaggcattgaacggatcagtagagatttctcagcttcagctgggcaaatctctatgtaggaaggtagaaaagcagtcagctcacttttattctgtggacataacagataaagaagccaaaatgggcttagtttgtagagttcattcaacttctaaaagtaaatttaagctgttgtattttgagcttgaggacaatggtggattaagccttgctttacaggaagatagtgcaaaaactggaaaagttacttctgcggggatgttctttctaggctttcctgtgtatcgatttgaacaaaataattcagctgctgctgctgcgaaggatcctgatagtgctttctttaaaagattggatggctttcaaccttgtgaagtaaatgaactgaaagcaggaacccattattttgctgtatatggtgacaatttcttcaaaagtgcgagctatactattgaagttgtatgtgctgaacccttctctgatcaaaaggagaagctacgaagcgtggaggcaaagataattgcaaaacgatctgagctgtctaaatttgagtctgagtatcgggaggttttggcaaagttcaccgagatgactagcagatatgctcaagaaatgcaaacgatcgatgagcttctaaaggaaaggaatgcaattcatgcatcctataccaacaatccaactctgcagcggagttccagtagcagcaaagggaaatcaccctctaaagggtccaaaagtgaggatgaccaaactgtaaagaaggaaaagaaatcaaagagccagccaatggagggatccaaaagcgacgatgagggtcccaaaaataaaaaagaaaaaaagcctaaagatcggattcgaaggaagaagtggttcaacattcatttgaaagtggacaagagaagggcctgctga

SEQ ID NO: 8042 - protein, 442 aa, Sorghum bicolor
  misc_feature: Ceres ANNOT ID no. 6086479
  misc_feature (28)..(90): Pfam Id: DnaJ Pfam Desc: DnaJ domain
  misc_feature (1)..(442): NCBI GI: 51535811 NCBI Desc: arg1-like protein [oryza sativa (japonica cultivar-group)]
  misc_feature (8)..(398): NCBI GI: 34583424 NCBI Desc: arg1-like protein 2 [arabidopsis thaliana]
  misc_feature (20)..(400): NCBI GI: 4249662 NCBI Desc: altered response to gravity [arabidopsis thaliana]
  misc_feature (20)..(400): NCBI GI: 110737915 NCBI Desc: arg1 protein [arabidopsis thaliana]
  misc_feature (83)..(347): NCBI GI: 115467306 NCBI Desc: os06g0237800 [oryza sativa (japonica cultivar-group)]
MAGPKFGSFKAEKGDSAAAAGAAVQRRDPYEVLGVGRNATEQEIKSAFRRMALKYHPDKNSDDPVASEKFQEATFSYNILSDPDKRRQYDASGFEAIEADSQELELDLSSLNTVNTVFAALFSKLGVPIKTTVSATVLEEALNGSVEISQLQLGKSLCRKVEKQSAHFYSVDITDKEAKMGLVCRVHSTSKSKFKLLYFELEDNGGLSLALQEDSAKTGKVTSAGMFFLGFPVYRFEQNNSAAAAAKDPDSAFFKRLDGFQPCEVNELKAGTHYFAVYGDNFFKSASYTIEVVCAEPFSDQKEKLRSVEAKIIAKRSELSKFESEYREVLAKFTEMTSRYAQEMQTIDELLKERNAIHASYTNNPTLQRSSSSSKGKSPSKGSKSEDDQTVKKEKKSKSQPMEGSKSDDEGPKNKKEKKPKDRIRRKKWFNIHLKVDKRRAC

SEQ ID NO: 8043 - DNA, 1728 bp, Sorghum bicolor
  misc_feature: Ceres ANNOT ID no. 6086480
  misc_feature: Encodes the peptide sequence at SEQ ID NO 8044
  misc_feature: Up-regulated in shoot tissues in response to salicylic acid treatment
atgcgatcccctgggccgcgcctcccagcgccggcgcggctcgccgtggctgccctcctcctcgcggctctcaccgggctcgccgtcggcgccgatgggtacgggcgggcgaggaggttttaccatgcctatgacaactacatgacttatgcattccctcatgatgaattgaagcctcttactaaaagtttcacggactcgcttagtgagcttggcaacttaaatcttgaacacttgccacaggattatagtggatccgcattgacactggttgagtcattatccagtcttgttgtcttaggtaacctcacagagtttgagagaggagttctctggctttcagaaaatctgacatttgatgttgatgctcggattaatctttttgagtgtaacataagacttcttggggggcttatttctgctcatattcttgcaaaagactacaacagccagtttaaacatggactgtatcaggatcaattactacatcttgctgaaagtttaggcaatcgttttctaccggcatttgagacacctactggattgccatatgcatggattaatcttaagtatggagtgatggaaaatgaaacaactgaaacaagcacatcagggtgtggttcccttatacttgaaatgggtgtattgtcacgtttgactggtgattctagatatgaagctgcagctcttcgtgctctccgcaagttatggagcatgagaagttcactgaatctagtaggcacaacacttgatgttttaactggcaagtggattgagtattcatctggaattggtgctggtgttgactcattttatgagtatctgattaaagcatatattcttttcggaagcgatgattactgggatatgtttcattcagcttatcttgcagtgcagaagtacttccgacatggtccatggtatcatgaggctgatatgaggactggagaagcaacacactggcagctaactagccttcaggccttctggccaggtcttcagttctactataatgaacagacactgttgggagacgtaactgctgcaaatctatcacaccgtgagttttacaatatatggcaaagatttggtgtgttacctgaaagatatcttttggactatggaatgttgcatcctacagagaagtactatcccttgcgtcctgagtttgctgagtcaacattttatctttatcaagctactaaagatccttggtacctagaagtgggtgaagctattgttggatcacttaattactatactaaagtggatggaggttttgctagtgtcagagatgtttcaacaatgaaacttgaagatcatcagcacagcttctttctttcagaaacgtgcaaatatctttttcttctgtacgacgattcattcttgaggaatcaaaattacatatttacaacagagggacacccccttccaataagaagcacatggcatgagaaatttccagcagcatatgttcccagcaattggacatttgttaaggatgagatccaaccaattcgcgtgagcgcattatcgtctcaagtttgtccggagacaattttccggaaaagcgttggcaccccatgggagagtgcgtgtcatgtaccagatgcacacgctagccacagatgcaggactgatgatgactgtggtatagaagcaataacatgcaagaagaggacctgcagtatggctggctactgcggcttatggctggtgatttattag

SEQ ID NO: 8044 - protein, 575 aa, Sorghum bicolor
  misc_feature: Ceres ANNOT ID no. 6086480
  misc_feature (39)..(479): Pfam Id: Glyco_hydro_47 Pfam Desc: Glycosyl hydrolase family 47
  misc_feature (40)..(574): NCBI GI: 92893614 NCBI Desc: glycoside hydrolase, family 47 [medicago truncatula]
  misc_feature (40)..(571): NCBI GI: 15912209 NCBI Desc: at1g27520/t17h3_2 [arabidopsis thaliana]
  misc_feature (17)..(478): NCBI GI: 115440243 NCBI Desc: os01g0773600 [oryza sativa (japonica cultivar-group)]
  misc_feature (40)..(479): NCBI GI: 37359844 NCBI Desc: mkiaa0212 protein [mus musculus]
  misc_feature (40)..(475): NCBI GI: 7662002 NCBI Desc: er degradation enhancer, mannosidase alpha-like 1 [homo sapiens]
  misc_feature: Useful for making plants with altered carbohydrate content
  misc_feature: Functional homolog of the protein sequence given in SEQ ID NO 14011
  misc_feature: Up-regulated in shoot tissues in response to salicylic acid treatment
MRSPGPRLPAPARLAVAALLLAALTGLAVGADGYGRARRFYHAYDNYMTYAFPHDELKPLTKSFTDSLSELGNLNLEHLPQDYSGSALTLVESLSSLVVLGNLTEFERGVLWLSENLTFDVDARINLFECNIRLLGGLISAHILAKDYNSQFKHGLYQDQLLHLAESLGNRFLPAFETPTGLPYAWINLKYGVMENETTETSTSGCGSLILEMGVLSRLTGDSRYEAAALRALRKLWSMRSSLNLVGTTLDVLTGKWIEYSSGIGAGVDSFYEYLIKAYILFGSDDYWDMFHSAYLAVQKYFRHGPWYHEADMRTGEATHWQLTSLQAFWPGLQFYYNEQTLLGDVTAANLSHREFYNIWQRFGVLPERYLLDYGMLHPTEKYYPLRPEFAESTFYLYQATKDPWYLEVGEAIVGSLNYYTKVDGGFASVRDVSTMKLEDHQHSFFLSETCKYLFLLYDDSFLRNQNYIFTTEGHPLPIRSTWHEKFPAAYVPSNWTFVKDEIQPIRVSALSSQVCPETIFRKSVGTPWESACHVPDAHASHRCRTDDDCGIEAITCKKRTCSMAGYCGLWLVIY

SEQ ID NO: 8045 - DNA, 1614 bp, Sorghum bicolor
  misc_feature: Ceres ANNOT ID no. 6086486
  misc_feature: Encodes the peptide sequence at SEQ ID NO 8046
atggccgggggtggaggcggcggcggcggcggcggcgggccgaagcatgatgacctcacgccgcaccccgtcaaggaccagctcccgggggtctcctactgcatcaccagtcctccgccgtggcctgaagccgttcttcttgggttccaacattatctggtcatgctgggtaccagtgtgatcataccaactgcactagttccacaaatgggaggaaacaatgaggacaaggcagtggttatccagacattgttgttcgttgcaggcatcaacaccctcctgcagagtttcttcggtaccaggttgcctgcagtggttggggggtcatacacctttgttctgcctaccatctcaatcatccttgctggacgttatgctaatgaacccaatccacacattaaatttctccgcatcatgcgagggacacaaggtgcattaattgtggcttcagccttacagattatagttgggttcagtggcctttggcgtaatgttgccaggtatctgagtccactttcagctgctcctttggtggcactagttggatttggactgtatgagctaggatttccctcggttgccaaatgtgttgagattggtctacctgaactaatccttctggtgatctttgcaatgtacctgccaaatactgttcacatgctgaagtctatctttgaccgatttgctgtattgttcactatccccatagtgtggctctatgcataccttctcactgttggaggagcatacaggaatgcaccaccaaagactcaatttcattgccgcactgaccgttctggattaattggtggcgcaccctggatcagagttccatatcccttccagtggggtgctccaactttcgatgcgggtgaagcttttgcaatgatggcagcatcatttgttgctctcgtggagtccactggggccttcattgctgtctctaggtatgctagtgctacaccaatccctccctctgttcttagccgtggtattggctggcagggcatcggtattcttctggatgggctatttgggactggaaatgggtcttctgtatcagttgaaaatgctggtttgctagctttgacacgtgttggtagccgaagggtagtgcagatatcagctggtttcatgatattcttctctattctggggaaatttggagctgtgttcgcctcaattcctgcacccatctttgcagctctatattgtatcttctttgcttatgctggttctgctgggtttggcttcctccagttctgtaacctcaacagctttaggaccaagttcatccttgggttctcagttttcatgggcctttcaattcctcaatactttaatgagtacacatctgttgctggttatggccctgttcacacacattcaagatggttcaatgacatagtaaatgtgatattctcgtccaaggcgtttgttgctggcttcgttgcatatctgctggacaacactattcacagacatgaaagttctgtcaggaaagaccgaggctatcattggtgggacaagttccggtcatacaggactgatacaagaagtgaggagttctattccctgccattcaacctgaacaagttcttcccttccgtctga

SEQ ID NO: 8046 - protein, 537 aa, Sorghum bicolor
  misc_feature: Ceres ANNOT ID no. 6086486
  misc_feature (42)..(449): Pfam Id: Xan_ur_permease Pfam Desc: Permease family
  misc_feature (1)..(537): NCBI GI: 89330191 NCBI Desc: leaf permease 1 [oryza sativa (japonica cultivar-group)]
  misc_feature (1)..(537): NCBI GI: 30696385 NCBI Desc: xanthine/uracil permease family protein [arabidopsis thaliana]
  misc_feature (1)..(537): NCBI GI: 144923095 NCBI Desc: xanthine/uracil/vitamin c permease [medicago truncatula]
  misc_feature (14)..(537): NCBI GI: 31711940 NCBI Desc: at5g49990 [arabidopsis thaliana]
  misc_feature (43)..(274): NCBI GI: 113205157 NCBI Desc: xanthine/uracil permease family protein [lycopersicon esculentum]
MAGGGGGGGGGGGPKHDDLTPHPVKDQLPGVSYCITSPPPWPEAVLLGFQHYLVMLGTSVIIPTALVPQMGGNNEDKAVVIQTLLFVAGINTLLQSFFGTRLPAVVGGSYTFVLPTISIILAGRYANEPNPHIKFLRIMRGTQGALIVASALQIIVGFSGLWRNVARYLSPLSAAPLVALVGFGLYELGFPSVAKCVEIGLPELILLVIFAMYLPNTVHMLKSIFDRFAVLFTIPIVWLYAYLLTVGGAYRNAPPKTQFHCRTDRSGLIGGAPWIRVPYPFQWGAPTFDAGEAFAMMAASFVALVESTGAFIAVSRYASATPIPPSVLSRGIGWQGIGILLDGLFGTGNGSSVSVENAGLLALTRVGSRRVVQISAGFMIFFSILGKFGAVFASIPAPIFAALYCIFFAYAGSAGFGFLQFCNLNSFRTKFILGFSVFMGLSIPQYFNEYTSVAGYGPVHTHSRWFNDIVNVIFSSKAFVAGFVAYLLDNTIHRHESSVRKDRGYHWWDKFRSYRTDTRSEEFYSLPFNLNKFFPSV

SEQ ID NO: 8047 - DNA, 645 bp, Sorghum bicolor
  misc_feature: Ceres ANNOT ID no. 6086488
  misc_feature: Encodes the peptide sequence at SEQ ID NO 8048
atggcgtccagcgcctctcggttcatcaagtgcgtcacggtcggcgacggcgccgtgggcaagacctgtatgcttatctgctacaccagcaacaagttccccactgactacatacctacggtgttcgacaatttcagtgcaaatgtagttgtggatggcaccacggtgaatttgggcctttgggataccgctgggcaggaagattacaaccggctgaggcctctaagctaccgaggtgccgatgttttcgtgcttgcattctcacttgtgagccgagctagctatgagaatatcatgaagaagtggataccggagcttcagcattatgcacctggtgtgcctgttgtgttggtaggcacaaaattggatcttcgtgaagacaagcactacttgatggaccatcctgggttggtgcctgttaccacagcacagggtgaggaacttcgtagacaaattggtgctatgtattacgtcgaatgcagttcaaagacacagcagaatgtcaaagctgtgttcgatgctgccatcaaggtagtaatccagcctccaactaaactaagagaaaagaagaaaaagaaatcacgcaagggatgttcaatggtgaacctcttctgtggaagaaaaatgctatgcttcaagtcctga

SEQ ID NO: 8048 - protein, 214 aa, Sorghum bicolor
  misc_feature: Ceres ANNOT ID no. 6086488
  misc_feature (10)..(181): Pfam Id: Ras Pfam Desc: Ras family
  misc_feature (10)..(123): Pfam Id: Miro Pfam Desc: Miro-like protein
  misc_feature (1)..(214): NCBI GI: 4959459 NCBI Desc: rop1 small gtp binding protein [zea mays]
  misc_feature (1)..(214): NCBI GI: 38502276 NCBI Desc: rac-rop-like g-protein [hordeum vulgare subsp. vulgare]
  misc_feature (1)..(214): NCBI GI: 5902930 NCBI Desc: small gtp-binding protein osrac3 [oryza sativa]
  misc_feature (1)..(214): NCBI GI: 46390285 NCBI Desc: small gtp-binding protein osrac3 [oryza sativa (japonica cultivar-group)]
  misc_feature (1)..(213): NCBI GI: 7262647 NCBI Desc: rac-like protein rop1 [tradescantia virginiana]
  misc_feature: Useful for making plants with modulated nitrogen use efficiency
  misc_feature: GREAT-hit functional homolog of the protein sequence given in SEQ ID NO 13110
  misc_feature: Useful for making plants with modulated nitrogen use efficiency
  misc_feature: Functional homolog of the protein sequence given in SEQ ID NO 13110
  misc_feature: The sequence is a functional homolog of SEQ ID NO. 400 in the 11/188,298 US application
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLVGTKLDLREDKHYLMDHPGLVPVTTAQGEELRRQIGAMYYVECSSKTQQNVKAVFDAAIKVVIQPPTKLREKKKKKSRKGCSMVNLFCGRKMLCFKS

SEQ ID NO: 8049 - DNA, 1698 bp, Sorghum bicolor
  misc_feature: Ceres ANNOT ID no. 6086489
  misc_feature: Encodes the peptide sequence at SEQ ID NO 8050
atggacgatccctcctccgcctccaacaagcggaagcgcaagcgggggcgcaagcgcaaggcgtccccgccctcccccgaccgttcctccccctcaccggcggccgcacccgctccggctgggcgccgtggccgcaagccgcgccgtaatgaggcccccgcggacgcggacgccgcgcgtccgccgtccccgccccgccgcggggagccgaaaccggtggcgaatggaggcgatgcggtggcagtggcggtggcggaggcaggccccgcgagctgggatgaggtggtcagggtggtgccgtgcatggacgccgtggtcaaggtgttctgcgtgcacacggagcccaacttctcgctgccgtggcagcggaagcggcagtacagctctagcagcagcgggtttatcatcagcggccgccgtgtcctcaccaatgcccactccgtggagcaccatacccaggttaagctcaagaagcgcggctccgacaccaagtaccttgccaccgtcctggccatcggcacagagtgtgacattgcactcttaactgtcaatgacgatgaattctgggaaggagtttcacctgtcgagtttggaacattaccggctcttcaggatgcagtcactgttgtcggttatccaattggaggagataccatatctgtgacaagcggagtggtctctaggatagaaatactttcgtatgttcatggttctacagaacttctaggattgcagatagacgcagctattaattcgggaaattcaggtggcccagcttttaatgataggggcaaatgtgttggtatagcttttcaatctcttaggcatgaagatgcagagaatataggttatgtgataccaactccggttattacacatttcattgaggactacaaaaaatctggagaatacacaggctttcctatacttggagttgaatggcagaaaatggagaatcctgatctccgcaaagcaatgggaatgaaaccagatcaaaagggtgttcgtgttaggagggtggagcccacggctcccgaatctggatgcctacaaccatctgatattattcttagctttgatggtgttgacattgctaatgatggaacagtccctttcaggcatggcgagcgcattggcttcagttatctggtttctcagaaatatactggcgagaaagcccttgttaaggttctgcgtgattcaaaagttcatgaatttaaaataaggctagcaactcacaagcgactcgttgcggctcatgtgaagggcaggccaccttcatattacatagttgctggctttgtttttgcagctgtctctgttccatatcttcgatccgagtacggaaaagattatgaatatgatgcacctgtcaagttgttggtgaagcatttgcatgcaatggcagaatcacctgatgaacagcttgtggtggtatcacaggtgcttgtatcagatatcaatataggttatgaagaaatagtcaatacccaggttcttgctttcaatggtcagcctgtaaaaaatttaaagaacttagcgaccatggtggaaaattgcaaagatgaatttttgaagtttgatctggagtatgaccagattgtcgtcctcgagacgaaaactgcaaaggcggctacccaggacattctgacgacgcactgtataccttctgcaatgtcggatgaccttaaggcctag

SEQ ID NO: 8050 - protein, 565 aa, Sorghum bicolor
  misc_feature: Ceres ANNOT ID no. 6086489
  misc_feature (108)..(295): Pfam Id: Trypsin Pfam Desc: Trypsin
  misc_feature (104)..(560): NCBI GI: 84999382 NCBI Desc: serine protease [theileria annulata strain ankara]
  misc_feature (102)..(446): NCBI GI: 2190549 NCBI Desc: f5i14.17 gene product [arabidopsis thaliana]
  misc_feature (102)..(480): NCBI GI: 91806029 NCBI Desc: degp protease [arabidopsis thaliana]
  misc_feature (105)..(329): NCBI GI: 33332321 NCBI Desc: degp-like serine protease 1 precursor [plasmodium falciparum]
  misc_feature (275)..(563): NCBI GI: 115462085 NCBI Desc: os05g0147500 [oryza sativa (japonica cultivar-group)]
MDDPSSASNKRKRKRGRKRKASPPSPDRSSPSPAAAPAPAGRRGRKPRRNEAPADADAARPPSPPRRGEPKPVANGGDAVAVAVAEAGPASWDEVVRVVPCMDAVVKVFCVHTEPNFSLPWQRKRQYSSSSSGFIISGRRVLTNAHSVEHHTQVKLKKRGSDTKYLATVLAIGTECDIALLTVNDDEFWEGVSPVEFGTLPALQDAVTVVGYPIGGDTISVTSGVVSRIEILSYVHGSTELLGLQIDAAINSGNSGGPAFNDRGKCVGIAFQSLRHEDAENIGYVIPTPVITHFIEDYKKSGEYTGFPILGVEWQKMENPDLRKAMGMKPDQKGVRVRRVEPTAPESGCLQPSDIILSFDGVDIANDGTVPFRHGERIGFSYLVSQKYTGEKALVKVLRDSKVHEFKIRLATHKRLVAAHVKGRPPSYYIVAGFVFAAVSVPYLRSEYGKDYEYDAPVKLLVKHLHAMAESPDEQLVVVSQVLVSDINIGYEEIVNTQVLAFNGQPVKNLKNLATMVENCKDEFLKFDLEYDQIVVLETKTAKAATQDILTTHCIPSAMSDDLKA

SEQ ID NO: 8051 - DNA, 711 bp, Sorghum bicolor
  misc_feature: Ceres ANNOT ID no. 6086492
  misc_feature: Encodes the peptide sequence at SEQ ID NO 8052
atggcgaccagcgacgagctcgcccagatcgacatctccaaggaggagaaggacaagctggtggcggaggtgatgcgctacgtgctcttcaagacgcaccagaactccgactgccccatcaagcgggaggagctcaccgggatcgtcaccaagaactaccgccagcgcgccctgcccacgctcgtcatcaacgaggccaaggacaggctcgccgccaccttcgggtacgagatgagggagctgcagaggacccgcgcgccggccacgcgctctggccggccgtcacagtcgcagcttaacgtggaggccaagagctatgttctggtcagcaacttagaccctgaggtgtacagcaagtatgttgaggacaaaggcgctgcccatctgtctggctttgctttcgctgtcattagcactattcatcttgctggtggcaaaatgcctgaagaggacctctggcatcagttgaagcgggtgggtttgaatgagaatgatgaaactcaccctgttcttggtaacaataagcagaagctcgaacacctagtgcagcaaaggttcctgctgaaggagaaagttgctggaccagaaggccatttcatgatgtatgaacttgctgagagggcattggatgaatccatcagtgcgaagattaaagatcatatttcacagtgttgttcagtatttcatggtcctgggtgttggacgggatga

SEQ ID NO: 8052 - protein, 236 aa, Sorghum bicolor
  misc_feature: Ceres ANNOT ID no. 6086492
  misc_feature (24)..(217): Pfam Id: MAGE Pfam Desc: MAGE family
  misc_feature (5)..(223): NCBI GI: 5668778 NCBI Desc: f21h2.2 [arabidopsis thaliana]
  misc_feature (20)..(217): NCBI GI: 7208583 NCBI Desc: mage [arabidopsis thaliana]
  misc_feature (98)..(204): NCBI GI: 47847470 NCBI Desc: mflj00211 protein [mus musculus]
  misc_feature (105)..(221): NCBI GI: 60655193 NCBI Desc: melanoma antigen family a 8 [synthetic construct]
  misc_feature (105)..(221): NCBI GI: 30583519 NCBI Desc: melanoma antigen, family a, 8 [homo sapiens]
MATSDELAQIDISKEEKDKLVAEVMRYVLFKTHQNSDCPIKREELTGIVTKNYRQRALPTLVINEAKDRLAATFGYEMRELQRTRAPATRSGRPSQSQLNVEAKSYVLVSNLDPEVYSKYVEDKGAAHLSGFAFAVISTIHLAGGKMPEEDLWHQLKRVGLNENDETHPVLGNNKQKLEHLVQQRFLLKEKVAGPEGHFMMYELAERALDESISAKIKDHISQCCSVFHGPGCWTG

SEQ ID NO: 8053 - DNA, 753 bp, Sorghum bicolor
  misc_feature: Ceres ANNOT ID no. 6086494
  misc_feature: Encodes the peptide sequence at SEQ ID NO 8054
atgcataagcttggtagaggaagccgggataaggtgcagcaattcatggcaataaccggcgcaagtgagaaggctgcgcttcaggctcttaaagctagtgattggcacttggaaggagcttttgatgttttctacagccaaccacaaattgctgttgctaatactcgacatctggaagagctctacaacagatataaagaaccggatgctgatatgataatggtggaaggcatatcacagctctgcaatgatttacaggtggatcctcaggatattgttatgcttgtcatatcgtggcatatgaaagcttccactatgtgtgagttcactcgccaggagttcattggtggactgcagtcaataggagtggattcaatagagaagcttcgcgagaagttaccttcattgcgagctgagcttaaagatgatcagaagttccgtgaaatatacaactttgcatttgcctgggcaagggaaaagggccagaaatctctcgcattggagactgctattggcatgtggcggttgctaattgctgaaaggaactggtctctgattgaccactggtgccagtttctacaggtaaggcacaataaagcaatctccagggatacatggacgcagttattggagtttgtgaagacaatcgatcctcagctaaccaactatgacgaagaaggtgcttggccctacctaatcgatgaatttgtggactacttgaaagagaaagggcttgtccagcatagaaggtga

SEQ ID NO: 8054 - protein, 250 aa, Sorghum bicolor
  misc_feature: Ceres ANNOT ID no. 6086494
  misc_feature (1)..(247): NCBI GI: 113967811 NCBI Desc: sm10 [nicotiana tabacum]
  misc_feature (1)..(241): NCBI GI: 73919225 NCBI Desc: dcn1-like protein 2 (defective in cullin neddylation protein 2-like protein 2) (dcun1-domain protein 2)
  misc_feature (1)..(241): NCBI GI: 62858725 NCBI Desc: loc549069 [xenopus tropicalis]
  misc_feature (1)..(241): NCBI GI: 119598748 NCBI Desc: dcn1, defective in cullin neddylation 1, domain containing 1 (s. cerevisiae), isoform cra_b [homo sapiens]
  misc_feature (1)..(241): NCBI GI: 18700658 NCBI Desc: leucine zipper protein [homo sapiens]
  misc_feature: Useful for making plants with altered Lignin content
  misc_feature: GREAT-hit functional homolog of the protein sequence given in SEQ ID NO 13194
  misc_feature: Useful for making plants with altered lignin content
  misc_feature: Functional homolog of the protein sequence given in SEQ ID NO 13194
MHKLGRGSRDKVQQFMAITGASEKAALQALKASDWHLEGAFDVFYSQPQIAVANTRHLEELYNRYKEPDADMIMVEGISQLCNDLQVDPQDIVMLVISWHMKASTMCEFTRQEFIGGLQSIGVDSIEKLREKLPSLRAELKDDQKFREIYNFAFAWAREKGQKSLALETAIGMWRLLIAERNWSLIDHWCQFLQVRHNKAISRDTWTQLLEFVKTIDPQLTNYDEEGAWPYLIDEFVDYLKEKGLVQHRR

SEQ ID NO: 8055 - DNA, 1200 bp, Sorghum bicolor
  misc_feature: Ceres ANNOT ID no. 6086497
  misc_feature: Encodes the peptide sequence at SEQ ID NO 8056
atggttgtagcagtagcttcgtcccaatcttcttccacgcccctgtcaccttactcgtcttcgcccagcctccgcagcttcatcagggacgccccgccttacagcacccagaccccgccgcaggtgcagacggctggtgtcggtggtggcggcggcaatgggaagatcagccctgcggtgctgttcatcatagtgatccttgcggttatcttcttcatctccgggctgctccacctccttgtgaggatactgatgaagaagcagcacggccgtggtgccgccatgggggagtctgcgccgtcgccgcaccggacaggcgcgcgggacgcggcaatggaccggcagctgcagcagctgttccatctgcacgactctgggctcgaccaggcgttcatcgatgcgctgcctgtgttcgcgtaccgtgaaattatcggtggcagcaaagagccgttcgactgtgcggtgtgcttgtgtgaatttgatggggaggacaggctcaggctgttgccggtgtgcgggcatgccttccatctgcagtgtatagatacatggctgctgtccaattcgacgtgcccactttgccgtggcacactctttgtccccgggatgactattgataacatgctgtttgatgattttgatgagaggttggaggaggagcctctaccggaggagtgtgaggatggacaccaagtttccaggcacaaacccatggatgaggagcagccagtggccgagaagagggtgtttccagtaaggcttgggaagttcaagaatgttggaaatcagggcgccatcggtggtgtggctggcaatggcaatgaagctggtatagtgagtagggaggcaggggagagtagcagtagcagcttggatgcaaggcgatgcttctccatgggcacttaccagtatgttcttggggcttctgaacttcgagtggctctccagacaggtcgtggcggaaacggtgcaagcagcaggtttaaaggaagagttgctggcttatgtcctgtcaatgctgacattatggagggcaagaggatttgtgcgaggagcaaaggcgagagcttctctgtgtcgaagatttggcagtggtctagtgtgaagggcaagttgccagctcctccagacacttgctcagatactgggagcctaccatggatgaaaataaatgctgctggagataagtctaatatgtga

SEQ ID NO: 8056 - protein, 399 aa, Sorghum bicolor
  misc_feature: Ceres ANNOT ID no. 6086497
  misc_feature (153)..(194): Pfam Id: zf-C3HC4 Pfam Desc: Zinc finger, C3HC4 type (RING finger)
  misc_feature (27)..(319): NCBI GI: 68565290 NCBI Desc: ring-h2 finger protein atl5i
  misc_feature (22)..(198): NCBI GI: 21655299 NCBI Desc: at4g30400/f17i23_260 [arabidopsis thaliana]
  misc_feature (22)..(198): NCBI GI: 18417587 NCBI Desc: zinc finger (c3hc4-type ring finger) family protein [arabidopsis thaliana]
  misc_feature (76)..(275): NCBI GI: 9369405 NCBI Desc: t23e23.15 [arabidopsis thaliana]
  misc_feature (55)..(397): NCBI GI: 49389042 NCBI Desc: ring finger 1 [oryza sativa (japonica cultivar-group)]
  misc_feature: The sequence is a functional homolog of SEQ ID NO 1134 in the 10/666,642US patent application
  misc_feature: The sequence is a functional homolog of SEQ ID NO 1939 in the 11/479,226US patent application
  misc_feature: Useful for making plants with modulated growth and phenotype characteristics
  misc_feature: The sequence is a functional homolog of SEQ ID NO 1939 in the 20070022495 US patent application
  misc_feature: The sequence is a functional homolog of SEQ ID NO 1134 in the 20070033671 US patent application
  misc_feature: The sequence is a functional homolog of SEQ ID NO 1939 in the 11/479,226 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MVVAVASSQSSSTPLSPYSSSPSLRSFIRDAPPYSTQTPPQVQTAGVGGGGGNGKISPAVLFIIVILAVIFFISGLLHLLVRILMKKQHGRGAAMGESAPSPHRTGARDAAMDRQLQQLFHLHDSGLDQAFIDALPVFAYREIIGGSKEPFDCAVCLCEFDGEDRLRLLPVCGHAFHLQCIDTWLLSNSTCPLCRGTLFVPGMTIDNMLFDDFDERLEEEPLPEECEDGHQVSRHKPMDEEQPVAEKRVFPVRLGKFKNVGNQGAIGGVAGNGNEAGIVSREAGESSSSSLDARRCFSMGTYQYVLGASELRVALQTGRGGNGASSRFKGRVAGLCPVNADIMEGKRICARSKGESFSVSKIWQWSSVKGKLPAPPDTCSDTGSLPWMKINAAGDKSNM

SEQ ID NO: 8057 - DNA, 471 bp, Sorghum bicolor
  misc_feature: Ceres ANNOT ID no. 6086523
  misc_feature: Encodes the peptide sequence at SEQ ID NO 8058
atgtacccctgtacccccttgatcaattatctaatcccgaggctaattgctctcacttgtaacacagattacttcccgattaaaataggacttcatcaaggttcagccttgagtccatatctctttgccttggtaatggatgaggtgacaaggagcattcaagagtggcgtcaagcatctgtcattctctctgacaagagggtaccacaaaagctcaaaggcaagttttgtagaacggcgatcagacctgctatgttgtatggagctgaatgttggcctacaaaaagaaggcatgtccaacaactgagtgttgcagaaatgcatatgttgtgctggatttgtggtcacacaaggatggaccaagtttggaacgatgatatacgtgatcatctaggggtagcaccaattgaagaaaagcttgtccaacatcggttcaggtggtttggccatgtacaatgctccagatcatga

SEQ ID NO: 8058 - protein, 156 aa, Sorghum bicolor
  misc_feature: Ceres ANNOT ID no. 6086523
  misc_feature (53)..(152): NCBI GI: 92888521 NCBI Desc: hmg-i and hmg-y, dna-binding [medicago truncatula]
  misc_feature (55)..(148): NCBI GI: 140063881 NCBI Desc: rna-directed dna polymerase (reverse transcriptase) [medicago truncatula]
  misc_feature (27)..(152): NCBI GI: 77563563 NCBI Desc: reverse transcriptase family member [glycine max]
  misc_feature (55)..(148): NCBI GI: 140042175 NCBI Desc: rna-directed dna polymerase (reverse transcriptase) [medicago truncatula]
  misc_feature (75)..(152): NCBI GI: 140055117 NCBI Desc: rna-binding region rnp-1 (rna recognition motif); calcium-binding ef-hand [medicago truncatula]
MYPCTPLINYLIPRLIALTCNTDYFPIKIGLHQGSALSPYLFALVMDEVTRSIQEWRQASVILSDKRVPQKLKGKFCRTAIRPAMLYGAECWPTKRRHVQQLSVAEMHMLCWICGHTRMDQVWNDDIRDHLGVAPIEEKLVQHRFRWFGHVQCSRS

SEQ ID NO: 8059 - DNA, 684 bp, Sorghum bicolor
  misc_feature: Ceres ANNOT ID no. 6086536
  misc_feature: Encodes the peptide sequence at SEQ ID NO 8060
atggaggtcgccgaggcgcccgcgcccgcgcccgacgaggacgcgctggacgaacgcggcgtcgcgctgcacctcccgaggctgctcgccggcgtcgtctccggcgccctcactggcctcttcgctctcgctggggctctgactggggcagtcaccggcgcggtggcgggcagagcttccgacagcggcggcgttctgcggggagctggattgggggccgtcgccggagctgtcctctccattgaggttcttgaggcttctcgcgcttattggtgctccgaccggctgggctcgcacggcgcatcgtccatggccgatttcattgagcagcttcttcgtgcccggtttgtgcaagagcaatttacagcttcaggatatgcatcatatcgctggcaggtcagcatatcagattttggtcacgatgacctatatgacatctttggagatatttcatctaaagggctctcacaagagtcactgaagaaactaccacattatgtggtcactgaccaaatgcgggactcatttggggaaatcctgtcttgccctatctgtctacaggacattgtagccggcgagacagcgaggaggttgcccaattgctctcacactttccaccagccttgcgtggacaaatggctcgtcgatcatggctcatgccccgtttgcaggcaagatgtgtaa

SEQ ID NO: 8060 - protein, 227 aa, Sorghum bicolor
  misc_feature: Ceres ANNOT ID no. 6086536
  misc_feature (182)..(223): Pfam Id: zf-C3HC4 Pfam Desc: Zinc finger, C3HC4 type (RING finger)
  misc_feature (8)..(227): NCBI GI: 20147407 NCBI Desc: at1g74410/f1m20_9 [arabidopsis thaliana]
  misc_feature (28)..(227): NCBI GI: 27524904 NCBI Desc: nep1-interacting protein 2 [arabidopsis thaliana]
  misc_feature (25)..(227): NCBI GI: 27524902 NCBI Desc: nep1-interacting protein [arabidopsis thaliana]
  misc_feature (40)..(227): NCBI GI: 115472067 NCBI Desc: os07g0479100 [oryza sativa (japonica cultivar-group)]
  misc_feature (111)..(227): NCBI GI: 38228693 NCBI Desc: zinc finger protein [fagus sylvatica]
  misc_feature: Useful for making plants with altered alkaloid content
  misc_feature: GREAT-hit functional homolog of the protein sequence given in SEQ ID NO 13112
  misc_feature: Useful for making plants with altered carbohydrate content
  misc_feature: Functional homolog of the protein sequence given in SEQ ID NO 13797
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
  misc_feature: The sequence is a functional homolog of SEQ ID NO. 468 in the 11/188,298 US application
MEVAEAPAPAPDEDALDERGVALHLPRLLAGVVSGALTGLFALAGALTGAVTGAVAGRASDSGGVLRGAGLGAVAGAVLSIEVLEASRAYWCSDRLGSHGASSMADFIEQLLRARFVQEQFTASGYASYRWQVSISDFGHDDLYDIFGDISSKGLSQESLKKLPHYVVTDQMRDSFGEILSCPICLQDIVAGETARRLPNCSHTFHQPCVDKWLVDHGSCPVCRQDV

SEQ ID NO: 8061 - DNA, 870 bp, Sorghum bicolor
  misc_feature: Ceres ANNOT ID no. 6086543
  misc_feature: Encodes the peptide sequence at SEQ ID NO 8062
atgctctgcctggtcgcgctaccaccgatggcccgcgccggccggcggcgcccttcgacttctgtacgccgccgcggccgaaccctcgctgccctcccgtgccgctgtggacggcggcacgtcatcggtgcctcctcggctgcggctctcctccccttcctcgcccctccttctccggccgctccgcccatcgaccccgacgtgatgctccagcgagtgcacccgtcgaggccggactggtatgaggagttctatgcctcggccatggatcagggaatgaagtcatacgaagcagagattgcaggatacaaagcaaatctcttttctcaactgtcgcctgcaggaaagaacattttggagcttggtgttgggacagggcctaacttcaaatactatgcaagtgaagatggggttaatgtaattggagtggatcctaacaagcacatggagaattatgccaggacagctgctgtgtctgctggacttccgtcatcaagcttcacattcagaagaggggttgctgaagccttgccagcagaagacaattccatggatgcagtgatcggcacacttgtattgtgctctgtcgataacatcgacatggcactgagagaaataaagcgagtcttaaagcccgacggtctctatgtgttcattgaacatgttgcggcaccagatggtacgttgctccaatttgttcaaggcgcgcttgatcccttgcagcaatttgtagccgacggatgccacctcacgaggaaaaccggacaaagcatcagggatgttgggttctcgagcctgagcctggatagtgtccggctgtcaaatgcctacatcattagccctcatgtttatggcgtagcctgcaagtga

SEQ ID NO: 8062 - protein, 289 aa, Sorghum bicolor
  misc_feature: Ceres ANNOT ID no. 6086543
  misc_feature (119)..(218): Pfam Id: Methyltransf_11 Pfam Desc: Methyltransferase domain
  misc_feature (119)..(216): Pfam Id: Methyltransf_12 Pfam Desc: Methyltransferase domain
  misc_feature (6)..(289): NCBI GI: 46390636 NCBI Desc: ubie/coq5 methyltransferase-like [oryza sativa (japonica cultivar-group)]
  misc_feature (34)..(287): NCBI GI: 20466111 NCBI Desc: at1g69520/f10d13_17 [arabidopsis thaliana]
  misc_feature (34)..(289): NCBI GI: 79320934 NCBI Desc: s-adenosylmethionine-dependent methyltransferase/ methyltransferase [arabidopsis thaliana]
  misc_feature (99)..(287): NCBI GI: 18409297 NCBI Desc: methyltransferase-related [arabidopsis thaliana]
  misc_feature (82)..(287): NCBI GI: 23128367 NCBI Desc: cog0500: sam-dependent methyltransferases [nostoc punctiforme pcc 73102]
MLCLVALPPMARAGRRRPSTSVRRRGRTLAALPCRCGRRHVIGASSAAALLPFLAPPSPAAPPIDPDVMLQRVHPSRPDWYEEFYASAMDQGMKSYEAEIAGYKANLFSQLSPAGKNILELGVGTGPNFKYYASEDGVNVIGVDPNKHMENYARTAAVSAGLPSSSFTFRRGVAEALPAEDNSMDAVIGTLVLCSVDNIDMALREIKRVLKPDGLYVFIEHVAAPDGTLLQFVQGALDPLQQFVADGCHLTRKTGQSIRDVGFSSLSLDSVRLSNAYIISPHVYGVACK

SEQ ID NO: 8063 - DNA, 879 bp, Sorghum bicolor
  misc_feature: Ceres ANNOT ID no. 6086544
  misc_feature: Encodes the peptide sequence at SEQ ID NO 8064
atggcgcctcgccaagccgtcctggcggccgtggtcctcgccgcgctgttcccgctcgccctctctcgcgggctgggcctggtgcacgggcatgtgcggccgcacgcgcacgggctggggcttggccaccaccaccccaggccgcacccccagcagcagccgcacggccacgcaccgctcggaggtggcgcgtggtcctcggctcacgccaccttctacggcggcggcgacgcgtccggcaccatgggcggggcgtgtgggtacggcaacctctacagccaggggtacggcaccaacacggcggcgctgagcacggcgctcttcaacagcggcctcagctgcggcgcctgcttcgaggtgcgctgcgacgcggcgggcggcgggagccactcgtgcctgccgggctccgtcgtggtgacggccaccaacttctgccctcccaacaacgcgctcccctccgacgacggcggctggtgcaacccgccccgcgcccacttcgacatgtcgcagcccgtgttccagcgcatcgcgctctacagggccggcattgtccccgtctcctaccgcagggtcgcgtgcaacaagaagggcggcatccggttcacaatcaacggccattcctacttcaacctggtgctggtgaccaacgtgggcggcgccggcgacgtgcacgcggtggccgtgaagggcgagcgctccgcggggtggcaggcgctgtcgcgcaactggggccagaactggcagagcaacacgctcctggacgggcaagcgctctcgttccgcgtcaccaccagcgacggccgctccgtggtctccaacaacgccgccccccgcggctgggccttcggccagaccttcagcggcgcccagttcaactga

SEQ ID NO: 8064 - protein, 292 aa, Sorghum bicolor
  misc_feature: Ceres ANNOT ID no. 6086544
  misc_feature (199)..(277): Pfam Id: Pollen_allerg_1 Pfam Desc: Pollen allergen
  misc_feature (100)..(188): Pfam Id: DPBB_1 Pfam Desc: Rare lipoprotein A (RlpA)-like double-psi beta-barrel
  misc_feature (1)..(292): NCBI GI: 14193753 NCBI Desc: alpha-expansin 2 [zea mays]
  misc_feature (1)..(292): NCBI GI: 7407659 NCBI Desc: alpha-expansin osexpa5 [oryza sativa]
  misc_feature (1)..(292): NCBI GI: 75225621 NCBI Desc: expansin-a5 precursor (osexpa5) (alpha-expansin-5) (osexp5) (osaexpa1.20)
  misc_feature (61)..(291): NCBI GI: 129561849 NCBI Desc: alpha expansin protein 14 [calotropis procera]
  misc_feature (61)..(291): NCBI GI: 38046730 NCBI Desc: alpha-expansin 3 [populus tremula x populus tremuloides]
  misc_feature: Useful for making plants with altered cell wall content and/or composition
  misc_feature: GREAT-hit functional homolog of the protein sequence encoded by LOCUS at1g26770
  misc_feature: GREAT-hit functional homolog of the protein sequence encoded by LOCUS at1g69530
  misc_feature: GREAT-hit functional homolog of the protein sequence encoded by LOCUS at2g03090
  misc_feature: Functional homolog of the protein sequence encoded by LOCUS at3g29030
  misc_feature: Useful for making plants with altered carbohydrate content
  misc_feature: Functional homolog of the protein sequence given in SEQ ID NO 14012
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
MAPRQAVLAAVVLAALFPLALSRGLGLVHGHVRPHAHGLGLGHHHPRPHPQQQPHGHAPLGGGAWSSAHATFYGGGDASGTMGGACGYGNLYSQGYGTNTAALSTALFNSGLSCGACFEVRCDAAGGGSHSCLPGSVVVTATNFCPPNNALPSDDGGWCNPPRAHFDMSQPVFQRIALYRAGIVPVSYRRVACNKKGGIRFTINGHSYFNLVLVTNVGGAGDVHAVAVKGERSAGWQALSRNWGQNWQSNTLLDGQALSFRVTTSDGRSVVSNNAAPRGWAFGQTFSGAQFN

SEQ ID NO: 8065 - DNA, 1212 bp, Sorghum bicolor
  misc_feature: Ceres ANNOT ID no. 6086553
  misc_feature: Encodes the peptide sequence at SEQ ID NO 8066
atgctcgcgaccgcctcgccgcacctgcaggcggcggccgcgcgccgcctctctttagcggtgcccgtgaatcagggctgcagcagcgtccgcctcccgcgccgacggcccggccggtacgcgtcggtgcgcgcggcgtcggcgtcggcgtcggcgtcggcttcggcggccgccccgccagcgaaggagggggcggaggacctggggttccaggagatgtcgtccgggacgcggcggcggtactacatgctcgggggcaaaggtggggtcgggaagacgagctgcgcggcgtcgctggccgtgcggttcgccaacaacggccacccgaccctcgtcgtctccaccgaccccgcgcactcgctcagcgattccttcgcacaggatttgagtggtgggacgctcgtgcaggtcgacggccctgattcacctctgtttgcgcttgagataaatcctgagaaggcccgggaggagtttcggacagcaaatcaaaaaaatggagggactggggtaaaagatttcatggatagcatgggccttggtgtgcttgctgagcagcttggagagctgaaattgggggaattgttggacacaccaccacctggcctggatgaagcaattgcaatttctaaggttatgcaatttctcgaagcacaagaatacagcatgtttagccgcattgtatttgacactgcccctacgggccatacactccggttactgtccttgccagatttcttggatgcatccattgggaaaatcttgaagctaaggagccagattgcttctgcaacatcagctattaaatcagtatttggacaagaggtccaacagcaggatgcagcgaacaaattagagcagctcagagaaaggatgctcaaagtgcgagagctttttcgcgacacggaatcaacagagtttataattgtgacaatcccaacggtgatggcaatcagtgagtcatcaagacttcattcttcgctgcaaaaggaaagtgttcctgtaaggagactcattgtgaaccaagttcttccgccatcaacatctgactgtaaattctgtgctataaaaagaaaggatcaaacacgtgcactggatatgataaggagcgacccagagttgatggatttgaacatcatccaagcacctcttgtggacatggagattagaggtgttccggctctcaagtttttgggtgatatagtttggaagtaa

SEQ ID NO: 8066 - protein, 403 aa, Sorghum bicolor
  misc_feature: Ceres ANNOT ID no. 6086553
  misc_feature (79)..(403): Pfam Id: ArsA_ATPase Pfam Desc: Anion-transporting ATPase
  misc_feature (42)..(403): NCBI GI: 30681260 NCBI Desc: anion-transporting atpase family protein [arabidopsis thaliana]
  misc_feature (65)..(376): NCBI GI: 5824321 NCBI Desc: atpase [solanum tuberosum]
  misc_feature (140)..(403): NCBI GI: 115448655 NCBI Desc: os02g0745000 [oryza sativa (japonica cultivar-group)]
  misc_feature (63)..(403): NCBI GI: 55167898 NCBI Desc: at5g60730 [arabidopsis thaliana]
  misc_feature (63)..(403): NCBI GI: 9759337 NCBI Desc: arsenite translocating atpase-like protein [arabidopsis thaliana]
MLATASPHLQAAAARRLSLAVPVNQGCSSVRLPRRRPGRYASVRAASASASASASAAAPPAKEGAEDLGFQEMSSGTRRRYYMLGGKGGVGKTSCAASLAVRFANNGHPTLVVSTDPAHSLSDSFAQDLSGGTLVQVDGPDSPLFALEINPEKAREEFRTANQKNGGTGVKDFMDSMGLGVLAEQLGELKLGELLDTPPPGLDEAIAISKVMQFLEAQEYSMFSRIVFDTAPTGHTLRLLSLPDFLDASIGKILKLRSQIASATSAIKSVFGQEVQQQDAANKLEQLRERMLKVRELFRDTESTEFIIVTIPTVMAISESSRLHSSLQKESVPVRRLIVNQVLPPSTSDCKFCAIKRKDQTRALDMIRSDPELMDLNIIQAPLVDMEIRGVPALKFLGDIVWK

SEQ ID NO: 8067 - DNA, 1239 bp, Sorghum bicolor
  misc_feature: Ceres ANNOT ID no. 6086558
  misc_feature: Encodes the peptide sequence at SEQ ID NO 8068
atggagaccctacgtgagttacaacagtttagtgcacacaagggtgcaaaaagttggccaaatagtaggaagggaaaccctacaaaaagtgatgacatagagaagcaagatgaagttatgttacctggattcaggtttcatccaacagatgaagagcttgtcaggttttaccttaaaagaaaaatccagcagaagtctctccccattgagctcatcaggcagctagacatctacaaatatgatccatgggatctcccaaaactagcgagtactggagagaaggaatggtatttctactgtccaagggataggaagtaccggaacagcacaagaccaaacagggtaactggagcaggcttctggaaggccactggaactgacaggccaatctactcttctgatgggagcaagtgcataggcttgaagaaatctctcgtcttctacaaaggtagagcagccaaaggtgtcaaaaccgactggatgatgcatgaattcaggttgccatcactcactgacccatcactgccgcagaagaagccactggagaagaccattccaccaaatgattcctgggcgatctgcaggattttcaagaaaaccaattcaacagcacagagagctctctcacactcctgggtatctcctccgttatccagaacaaatgaaaactacattcggccttcctcacaggctacacagagaagtcatcacagctcagagaacacatcctctacgatgacagacatcatctcctccatccagttcactggcagcagttacatgccttcaatagtttcctcttgccgcaaccctgcaagcatcattgacagcagcagcaggccggctgcgtcacttgtgctcccctcatctggtgcagaacatcacaccatgagtgtcctctcagcaatcccgcttgatcttccagctgggatggacattgcatcaatggtcctcaatgcatcaccaactacactccagaacctagataggatccccacaaacattgagtttggtcaactacaccaccccagcaacagcagcagcagcatggccaacagatgcacggttgatttgcctgacattggcaacagtgtcaccgccgctccacgatcaatcaacttcccattcaacctgcaaggagcactgccagatgactggaggatgaccttgccttgggactctctcccttgcacaaccgaggtctcaacaaattaccagtcgactaagtgctatacttag

SEQ ID NO: 8068 - protein, 412 aa, Sorghum bicolor
  misc_feature: Ceres ANNOT ID no. 6086558
  misc_feature (40)..(168): Pfam Id: NAM Pfam Desc: No apical meristem (NAM) protein
  misc_feature (37)..(412): NCBI GI: 142942397 NCBI Desc: no apical meristem (nam)-like protein [solanum tuberosum]
  misc_feature (22)..(321): NCBI GI: 15223376 NCBI Desc: no apical meristem (nam) family protein [arabidopsis thaliana]
  misc_feature (37)..(125): NCBI GI: 113205272 NCBI Desc: no apical meristem, identical [solanum demissum]
  misc_feature (29)..(287): NCBI GI: 15242479 NCBI Desc: no apical meristem (nam) family protein [arabidopsis thaliana]
  misc_feature (42)..(210): NCBI GI: 4325286 NCBI Desc: nac domain protein nam [arabidopsis thaliana]
  misc_feature: The sequence is a functional homolog of SEQ ID NO 2592 in the 10/374,780US patent application
  misc_feature: The sequence is a functional homolog of SEQ ID NO 288 in the 10/225,066US patent application
  misc_feature: The sequence is a functional homolog of SEQ ID NO 320 in the 10/374,780US patent application
  misc_feature: The sequence is a functional homolog of SEQ ID NO 850 in the 10/225,066US patent application
  misc_feature: The sequence is a functional homolog of SEQ ID NO 853 in the 10/374,780US patent application
  misc_feature: Useful for making plants with modulated growth and phenotype characteristics
  misc_feature: The sequence is a functional homolog of SEQ ID NO 288 in the 20050160493 US patent application
  misc_feature: The sequence is a functional homolog of SEQ ID NO 850 in the 20050160493 US patent application
  misc_feature: The sequence is a functional homolog of SEQ ID NO 853 in the 20060162006 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 310 in the 10/666,642 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 890 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 745 in the 11/479,226 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
METLRELQQFSAHKGAKSWPNSRKGNPTKSDDIEKQDEVMLPGFRFHPTDEELVRFYLKRKIQQKSLPIELIRQLDIYKYDPWDLPKLASTGEKEWYFYCPRDRKYRNSTRPNRVTGAGFWKATGTDRPIYSSDGSKCIGLKKSLVFYKGRAAKGVKTDWMMHEFRLPSLTDPSLPQKKPLEKTIPPNDSWAICRIFKKTNSTAQRALSHSWVSPPLSRTNENYIRPSSQATQRSHHSSENTSSTMTDIISSIQFTGSSYMPSIVSSCRNPASIIDSSSRPAASLVLPSSGAEHHTMSVLSAIPLDLPAGMDIASMVLNASPTTLQNLDRIPTNIEFGQLHHPSNSSSSMANRCTVDLPDIGNSVTAAPRSINFPFNLQGALPDDWRMTLPWDSLPCTTEVSTNYQSTKCYT

SEQ ID NO: 8069 - DNA, 579 bp, Sorghum bicolor
  misc_feature: Ceres ANNOT ID no. 6086571
  misc_feature: Encodes the peptide sequence at SEQ ID NO 8070
atggggggcggatccggatctttcctcaaggtcttggtcaacaacatggatgttctcgcggggcctttagtttcacttgcatatcctctgtatgcctctgttagagcaattgaaacaaaatctgctgtggatgatcagcaatggctcacatactgggtgctgtactcatttatcactctattcgagctcacctttgctccagtactcgaatggctcccattctggtcttatgcgaaactgtttttcaattgctggttagtattgccacagttcaatggagctgcacatgtatatgagcattttgtgaggccaatgattgtaaatcagcaagttgtaaacatctggtatattccaaagaaggatgaatcaggcaggcctgatgatgtaatttcagctgcacagagatacattgagcaaaatggatcaaaagcgtttgagaatcttgttaacaagtttaagagttcaaacccaaagcgctcaattctggaggaggtagaggttgaaaggagagccaggattcaacgagaatctgaagcaagggaggtgaatcctttcttcaatccagaatatcaatactag

SEQ ID NO: 8070 - protein, 192 aa, Sorghum bicolor
  misc_feature: Ceres ANNOT ID no. 6086571
  misc_feature (9)..(106): Pfam Id: TB2_DP1_HVA22 Pfam Desc: TB2/DP1, HVA22 family
  misc_feature (2)..(155): NCBI GI: 92892431 NCBI Desc: athva22a, 65476-64429 [imported] - arabidopsis thaliana [medicago truncatula]
  misc_feature (1)..(155): NCBI GI: 4884934 NCBI Desc: athva22b [arabidopsis thaliana]
  misc_feature (9)..(149): NCBI GI: 57899745 NCBI Desc: abscisic acid-induced protein-like [oryza sativa (japonica cultivar-group)]
  misc_feature (19)..(103): NCBI GI: 57012614 NCBI Desc: hva22-like protein e (athva22e)
  misc_feature (12)..(106): NCBI GI: 404589 NCBI Desc: a22
MGGGSGSFLKVLVNNMDVLAGPLVSLAYPLYASVRAIETKSAVDDQQWLTYWVLYSFITLFELTFAPVLEWLPFWSYAKLFFNCWLVLPQFNGAAHVYEHFVRPMIVNQQVVNIWYIPKKDESGRPDDVISAAQRYIEQNGSKAFENLVNKFKSSNPKRSILEEVEVERRARIQRESEAREVNPFFNPEYQY

SEQ ID NO: 8071 - DNA, 1104 bp, Sorghum bicolor
  misc_feature: Ceres ANNOT ID no. 6086572
  misc_feature: Encodes the peptide sequence at SEQ ID NO 8072
atggaggaatcggacgtaggagttaatcctgggaagcaaatggaagaggataaggctgcgggagtatcgggagatgagggtaagattgagaggagtcactctatcaatctgaatagggcgcccacagttgctgtggaggcgaggagcactcaggggaatgttgagacgcacggcgcagtggtgtcgggaactaaggatgcaggcaccggaaaggcagagcaatccagtggtgatggtcaggagaagttacccaagtgtgagcaagtcgactacgaaagtgagattgaaggctgtgtagatgatgagaaccctgtcaagaaggctgctttagttactttggttggaaatgaatattgtggtggtgatgatgatgagagagttcaagtgctcaccattgtcaagaaggatgaacctgcagatgacattggcgactgtattaatcctgggacagttgcagggtacagtgaagtgaagggtgctgtaggtgcttctgccgccacttctgcagtgcgacctgctggctcccgatcatccagtttccacggtgtgaccaggcatagatggagtgggaaatatgaagctcatttgtgggacagttcttgcagagtagagggacgtagaaggaaagggaaacaaggaagttatgatactgaggaaaaagctgccagggcctatgatgttgctgctattaaatactggggcggaaataccagactaaactttccggcaaaattgttccagattgaacaatatggaaaggaattggaggacataagggatttgtctcgagaggaatgtgtaacatacttgagaaggaggagcagctgcttttcaagaggagcttctatttacagaggagtgacaagaaggcagaaagatgggagatggcaagcacgcataggactggttgctggaactagagacatttacctgggaacattcaaaacggaggaagaagctgcagaggcttatgatattgctgcaattgagatacgtggcaaaaatgctgtgactaattttgaccgaagcaactatgtcgacaagggtatgcactgtatagaaggagaaggcttgaggctgctcgcatccaagccagaagaatga

SEQ ID NO: 8072 - protein, 367 aa, Sorghum bicolor
  misc_feature: Ceres ANNOT ID no. 6086572
  misc_feature (178)..(235): Pfam Id: AP2 Pfam Desc: AP2 domain
  misc_feature (282)..(334): Pfam Id: AP2 Pfam Desc: AP2 domain
  misc_feature (14)..(366): NCBI GI: 58432844 NCBI Desc: transcription factor ap2d8 [oryza sativa (japonica cultivar-group)]
  misc_feature (136)..(345): NCBI GI: 21304227 NCBI Desc: ovule development aintegumenta-like protein bnm3 [oryza sativa]
  misc_feature (136)..(345): NCBI GI: 115441647 NCBI Desc: os01g0899800 [oryza sativa (japonica cultivar-group)]
  misc_feature (169)..(345): NCBI GI: 38343964 NCBI Desc: osjnbb0022f16.3 [oryza sativa (japonica cultivar-group)]
  misc_feature (169)..(345): NCBI GI: 21304225 NCBI Desc: aintegumenta-like protein [oryza sativa]
  misc_feature: Useful for biocontainment applications
  misc_feature: Functional homolog of the protein sequence given in SEQ ID NO 13650
  misc_feature: The sequence is a functional homolog of SEQ ID NO. 274 in the 11/188,298 US application
MEESDVGVNPGKQMEEDKAAGVSGDEGKIERSHSINLNRAPTVAVEARSTQGNVETHGAVVSGTKDAGTGKAEQSSGDGQEKLPKCEQVDYESEIEGCVDDENPVKKAALVTLVGNEYCGGDDDERVQVLTIVKKDEPADDIGDCINPGTVAGYSEVKGAVGASAATSAVRPAGSRSSSFHGVTRHRWSGKYEAHLWDSSCRVEGRRRKGKQGSYDTEEKAARAYDVAAIKYWGGNTRLNFPAKLFQIEQYGKELEDIRDLSREECVTYLRRRSSCFSRGASIYRGVTRRQKDGRWQARIGLVAGTRDIYLGTFKTEEEAAEAYDIAAIEIRGKNAVTNFDRSNYVDKGMHCIEGEGLRLLASKPEE

SEQ ID NO: 8073 - DNA, 2361 bp, Sorghum bicolor
  misc_feature: Ceres ANNOT ID no. 6086575
  misc_feature: Encodes the peptide sequence at SEQ ID NO 8074
atggaagcagcagctcaatctcatccgcttccgcttctccaaaacatcgaccccggggtccgccgtttcctcgacggccgattccgctcggcggccgacctcgcgacggcctccgacgttgaggccgagatccgcgggcactgtgcggagctagaggcctccatctccaacctgtacgtaagcctacaggaagctgccgctgcgtactcatcttgccgcgaggtcgctggttcggccctccgtggcgtccgcggcgggcttagtgccctcaaagcatacgagtcaacaggggctggagaagagatggaagcgagaacggagcagatgcagttcgagcaactccctgctctggcctccgaggtggcgagagtggagatggtcagagagtacgccgaaatggctctcaaacttgacagtttggtgggtgatatagaagatgccgtttcttcttctgtaactggaaaacttaaatctcctgtagacaattcggagaaaacacatcatgttgctattggatatcttaaaaacatagaagatcttttagcttctgtaactacgactagaccacaatggactcgccttctatcttccgtggatcacagagtggaccgatctttagctatactaagaccacaagccattgttgatcatcgatctcttctttcttcccttggctggcctccttcacttgctggctcaaaattttcgagtattgattcaaggaaacaagcagagattgtgaacccattattttcgatgcggggtgatctgaaaagcaagtattctgagagctttcttgcactatgcaatttgcaggaattgcagaaacgtagaaaagctagacaactgaaagggcatgatgtgggaaatcaactacgtcaaccattatgggtaattgaagtgctagtaaatccaatatctacagcagcacaacaccatttctcaaaatgggctgaaaagcctgaatttgtttttgctcttgcttataagataattagagattttgttgattccatggatgagattctacagccccttgtggataaggccaaccttattgggtatagttgtagggaggagtggatttcaggaatggtcattgcattgtcaacatacttggcaaaagagatatttcctaagcagattgaacttcttcaggaaagtagtaactcaagtgatgcaggcagcacagcatatcaggctagagtctcgtggctcagccttgttgatctaatgatatcttttgacaagcggattcaagatttaatctcgagtactggactgctacttactgtaaaggatgatgacagttggcagaggatctcagtcctctgtgtcttctgtgatcgcccagactggcttcaagtatgggcagagattgagagacaggagagtcttaataagctgcaatcagcaatggatttagagaaaaattggagcacaaggattcaaggaacaatgcttgagtatgactcagatgattacaagtctccagtaatcaccagtgccgttcatcagaccttgtctttgctaattgatcgtgctcgtcctatccctagcatcatgcttagggcagaatttattaggacgtctgctgcacccatcatatcggaattccttggttacatgcttcggaggtctcaagaagcggaggggctaactgctctggctgatgataatgctgtgctcaaggtgtcacagtctatcaatgcagctcgatattttgaatccacattgacagaatggtgtgaggatgttttctttcttgagatggaaaatttacctgtaaatggtgagggtgggtgtatctttcagcaagaaataaatcatctgaaagagttcagagtggaatgggccgataagatttccactgtcattttgcgtggattcagcgctcgttctcgggattatctaaaaaataagaggcagtggctggacaaatcagagggacctgctgtatcaagaaccttcatagaatctttagactacatgcaagggcaactatctaagcttcaaggtggcctaaataccgttgattttgtgacggtttggagaaatgtggcaagtggggtagaccagctgcttttcgccggcattttcacaagcggcgtaaagattagcagtgatggagtggaaaggctacagagcgacctgagcgttctgtttgctattttttcagcgtggtgtctgagacctgaaggcttcttccctcgactgtccgagggattgaggatactgaagattgatgaacagcagctcagagatggggcgtttacagataagaattggctgagggaatatggcattaggcatctgacagctgctgacactgagaagataataaaaaatcgggtatattga

SEQ ID NO: 8074 - protein, 786 aa, Sorghum bicolor
  misc_feature: Ceres ANNOT ID no. 6086575
  misc_feature (297)..(787): Pfam Id: RINT1_TIP1 Pfam Desc: RINT-1 / TIP-1 family
  misc_feature (1)..(786): NCBI GI: 46390939 NCBI Desc: chromosome structural maintenance protein-like [oryza sativa (japonica cultivar-group)]
  misc_feature (8)..(644): NCBI GI: 6664321 NCBI Desc: t27g7.8 [arabidopsis thaliana]
  misc_feature (455)..(784): NCBI GI: 11967435 NCBI Desc: rad50-interacting protein 1 [homo sapiens]
  misc_feature (455)..(784): NCBI GI: 119603773 NCBI Desc: rad50 interactor 1, isoform cra_b [homo sapiens]
  misc_feature (455)..(736): NCBI GI: 119603772 NCBI Desc: rad50 interactor 1, isoform cra_a [homo sapiens]
MEAAAQSHPLPLLQNIDPGVRRFLDGRFRSAADLATASDVEAEIRGHCAELEASISNLYVSLQEAAAAYSSCREVAGSALRGVRGGLSALKAYESTGAGEEMEARTEQMQFEQLPALASEVARVEMVREYAEMALKLDSLVGDIEDAVSSSVTGKLKSPVDNSEKTHHVAIGYLKNIEDLLASVTTTRPQWTRLLSSVDHRVDRSLAILRPQAIVDHRSLLSSLGWPPSLAGSKFSSIDSRKQAEIVNPLFSMRGDLKSKYSESFLALCNLQELQKRRKARQLKGHDVGNQLRQPLWVIEVLVNPISTAAQHHFSKWAEKPEFVFALAYKIIRDFVDSMDEILQPLVDKANLIGYSCREEWISGMVIALSTYLAKEIFPKQIELLQESSNSSDAGSTAYQARVSWLSLVDLMISFDKRIQDLISSTGLLLTVKDDDSWQRISVLCVFCDRPDWLQVWAEIERQESLNKLQSAMDLEKNWSTRIQGTMLEYDSDDYKSPVITSAVHQTLSLLIDRARPIPSIMLRAEFIRTSAAPIISEFLGYMLRRSQEAEGLTALADDNAVLKVSQSINAARYFESTLTEWCEDVFFLEMENLPVNGEGGCIFQQEINHLKEFRVEWADKISTVILRGFSARSRDYLKNKRQWLDKSEGPAVSRTFIESLDYMQGQLSKLQGGLNTVDFVTVWRNVASGVDQLLFAGIFTSGVKISSDGVERLQSDLSVLFAIFSAWCLRPEGFFPRLSEGLRILKIDEQQLRDGAFTDKNWLREYGIRHLTAADTEKIIKNRVY

SEQ ID NO: 8075 - DNA, 1278 bp, Sorghum bicolor
  misc_feature: Ceres ANNOT ID no. 6086576
  misc_feature: Encodes the peptide sequence at SEQ ID NO 8076
atgttggagggtcaatcttggctgatatcaaggtcgctgccgagttcctgtgagcaggaatccagactagcttacatgacttaccacctacttgagatcacaaggagtaagcgccctcctgggaccctgtctattgagcacgacgttgctgcggtggctgcattgactaaacggatcaagtccgctgaggaccaaaacggtgaggcactggattgtcaaggaagtaatgatcagggcgactcagattcaagcaccctgataagttctattggacgggacaactcaatcaactgccttgctcgttgttctcgttctgattatggttctatcgcatcactcaaccggagcttccgatcagttgtccgcagcggtgaactgtacaaggagcgtcgacagctggggatttcagaacactgggtctacttctcttgcaatgtgcaggagtgggaggcgtatgacccctaccgttcacggtggatgacgcttccaaggatgccccataatgaatgtttcatgtgctctgacaaggagtcacttgctgtgggcactgaacttctggtgtttggaaaggagattcaaacacatattattctgagctatagcattctgacaaattcatggtcgcggggtgttgaaatgaatgcccctagatgtttgtttggatcagctagttttggagagaaagcaattatagctggaggcttcggtgctgatggaagggtgcttcgttctgttgagctgtataactcggaaactaagagatggataacacttccaagcatgaataaagccaggcgaatgtgttctggtgtctttatggatggcaagttctatgtaattggtggaatggccagtgacacagaagtgcttacttgtggagaagagtatgatttagatagaggtacctggcgggtgatagagaacatgtctgaggggctcaatggtgcaagtggtgctcctccacttgtcgctgttgttgaaaatgagttatatgcagcacaatatgccggaaagttagtaagaaagtataataaaacggataactcatggacaacattgggggagttaccagagcggccagaagctgtgaatggctggggtattgcattccggggctgtggagagcggcttttggtaatcggtggaccaagagtgttgggtggtgggatgatcgagctccattcttggatcccaagtgaggggccattgcaatggaacatgatcggaagcaaaccttcaggtaactttgtttataactgtgctgtcatggggtgctga

SEQ ID NO: 8076 - protein, 425 aa, Sorghum bicolor
  misc_feature: Ceres ANNOT ID no. 6086576
  misc_feature (216)..(262): Pfam Id: Kelch_1 Pfam Desc: Kelch motif
  misc_feature (264)..(310): Pfam Id: Kelch_1 Pfam Desc: Kelch motif
  misc_feature (216)..(262): Pfam Id: Kelch_2 Pfam Desc: Kelch motif
  misc_feature (1)..(425): NCBI GI: 46390943 NCBI Desc: kelch repeat-containing f-box-like [oryza sativa (japonica cultivar-group)]
  misc_feature (73)..(425): NCBI GI: 4262182
  misc_feature (71)..(425): NCBI GI: 92899179 NCBI Desc: cyclin-like f-box [medicago truncatula]
  misc_feature (75)..(425): NCBI GI: 38344328 NCBI Desc: osjnba0058k23.10 [oryza sativa (japonica cultivar-group)]
  misc_feature (75)..(425): NCBI GI: 90399335 NCBI Desc: h0313f03.20 [oryza sativa (indica cultivar-group)]
  misc_feature: The sequence is a functional homolog of SEQ ID NO. 440 in the 11/188,298 US application
  misc_feature: The sequence is a functional homolog of SEQ ID NO. 315 in the 11/188,298 US application
MLEGQSWLISRSLPSSCEQESRLAYMTYHLLEITRSKRPPGTLSIEHDVAAVAALTKRIKSAEDQNGEALDCQGSNDQGDSDSSTLISSIGRDNSINCLARCSRSDYGSIASLNRSFRSVVRSGELYKERRQLGISEHWVYFSCNVQEWEAYDPYRSRWMTLPRMPHNECFMCSDKESLAVGTELLVFGKEIQTHIILSYSILTNSWSRGVEMNAPRCLFGSASFGEKAIIAGGFGADGRVLRSVELYNSETKRWITLPSMNKARRMCSGVFMDGKFYVIGGMASDTEVLTCGEEYDLDRGTWRVIENMSEGLNGASGAPPLVAVVENELYAAQYAGKLVRKYNKTDNSWTTLGELPERPEAVNGWGIAFRGCGERLLVIGGPRVLGGGMIELHSWIPSEGPLQWNMIGSKPSGNFVYNCAVMGC

SEQ ID NO: 8077 - DNA, 1098 bp, Sorghum bicolor
  misc_feature: Ceres ANNOT ID no. 6086588
  misc_feature: Encodes the peptide sequence at SEQ ID NO 8078
atgacggggtgcctgtggccgtgcgtgggagcggcggtggccggggatggggccgaccaccgggggttgttccgctccaagcccaggacccccgtggaggtggtacagcacgtcagggacctggtcacctacgtcctcaacaacaaggacggctgcgccggcggcaggcgcgacgccaagcttgagcacaggatgttagaactaagcaaagggatcaaagagatgaaaggcattctctatggcaatggtgaagacgatccttgtgaagaagcttgcaagcaattgactaaggagttcttcaagaagaacacagacacctttcgtcaatttattgtttgccttcaatacgtgaacttggatacacaaaaggatgtcactcaagtgattgcaaatttgcaaaggcaaaaggttgattcaagattggttgcctctgattacttggaagctaacttggatcttttggaaattttgatgtctgggtacgaaaacttggacatcgcaatacattatagtactctattgagagactgcatacgccaccaagttgctgcaaggtacgtattggaatctccacacttcaggacattctttgatcatatacagtttccagacttcaatatacaatccgatgtgtttaaaacttttaaggagctcatgacacggcataaatcaactgttgctgagttcttttccaagaattatgattgggcaaaattcaactcgaagctgatattatcggcttccaactacttcatccgaaggcaagctgttcaactcttgcgagacattcttttggaaaggtcaaacagtgcagtgatgatgtgctatgtcagttcgaaagagcacctcatgattcatatgaaccttctaagggatgacagcatagctattcaggtagaggctttccatgtcttcaagctgttcgtcgctaacaaggagcagccacctgagatcaccagcatactgcgcaccaacagaagcaagctcctgaggttcttgaaagacttcaccgccgtggagaaagacgataagaagttcgaggccgataaagctacggtcatctcggagatcctagcgctagctggcgctgaaaattag

SEQ ID NO: 8078 - protein, 365 aa, Sorghum bicolor
  misc_feature: Ceres ANNOT ID no. 6086588
  misc_feature (20)..(362): Pfam Id: Mo25 Pfam Desc: Mo25-like
  misc_feature (21)..(360): NCBI GI: 115473049 NCBI Desc: os07g0585100 [oryza sativa (japonica cultivar-group)]
  misc_feature (21)..(360): NCBI GI: 15238126 NCBI Desc: mo25 family protein [arabidopsis thaliana]
  misc_feature (21)..(360): NCBI GI: 140064512 NCBI Desc: calcium-binding protein 39-like , related [medicago truncatula]
  misc_feature (21)..(360): NCBI GI: 89257483 NCBI Desc: mo25 protein -related [brassica oleracea]
  misc_feature (21)..(343): NCBI GI: 89257511 NCBI Desc: mo25 family protein [brassica oleracea]
MTGCLWPCVGAAVAGDGADHRGLFRSKPRTPVEVVQHVRDLVTYVLNNKDGCAGGRRDAKLEHRMLELSKGIKEMKGILYGNGEDDPCEEACKQLTKEFFKKNTDTFRQFIVCLQYVNLDTQKDVTQVIANLQRQKVDSRLVASDYLEANLDLLEILMSGYENLDIAIHYSTLLRDCIRHQVAARYVLESPHFRTFFDHIQFPDFNIQSDVFKTFKELMTRHKSTVAEFFSKNYDWAKFNSKLILSASNYFIRRQAVQLLRDILLERSNSAVMMCYVSSKEHLMIHMNLLRDDSIAIQVEAFHVFKLFVANKEQPPEITSILRTNRSKLLRFLKDFTAVEKDDKKFEADKATVISEILALAGAEN

SEQ ID NO: 8079 - DNA, 1173 bp, Sorghum bicolor
  misc_feature: Ceres ANNOT ID no. 6086591
  misc_feature: Encodes the peptide sequence at SEQ ID NO 8080
atgcctctcatcatcttctccgccgccgctcccgtcgccgtcgtctccctgctccgcacccgcacccgctccagcctccgcctcaccgtcacacgcgcagccgccacgagcacaaccgccaccccggctccggctccggcgagcaccttcgccgtcgaggactacctcgtcgccagctgccacctcaccccaccgcaggcgctcaaggcatccaagagcctcgcgcacctcaagtccgcctccaacgcggacgccgtgctcgccttcctcgaggacctcgggctctcccccaaggaggtggccgccgtggtggcctccaacccgcgcgtcctctgcgctcgcatcgaccgctccctggctcctatctccggggagctccgcgcgctcggcctctccccgtcccagatcgcgcgcctcgcgcagatcgctggccgctacttcctctgccgcagcttcgtctccaaggtacggttctggctcccgctcttcggctcccccgagcggctgctccaggccagcgactggaactactggctcctcagctccgacctcgagaaggtggtcgagcccaacgtcgccttcctcaagaagtgcggcctcagcgcgggcgacatcgccaagctgctcgtggccgcgccgcggctcgtcaccatgcccccggagtacgtccaggacgccgtgcggcgcgccacgcagctcggcgtggcgccgggctcccagatgttccgccacgcgctctccaccgcgggatgtatcggccaggagaaagttgactccaaggtcgccgtcctcaaggagacgctcggttggtcgcaggaggaggtgaacctggccatcagtaaggcaccgcggatcctggttgcatccgaggagaggctgcgccggaacgcggagttcctgctcaacgaggtcgggctgccgccgcagtacatcgcccgccgttcggtccttctcatgtacagcctcgagaggcggatagtgccccggcacgtcgtgctgacggttctcaaagagaaggggttggttgagcaagaccggtgcttcttcaacgtggtggcgccaacagaagagaaattctttgagaaattcgttgctccttatgaggaatccatccctggtcttgctgatacttatgattctgcttgtatggggaaagtgacccggggtctatga

SEQ ID NO: 8080 - protein, 390 aa, Sorghum bicolor
  misc_feature: Ceres ANNOT ID no. 6086591
  misc_feature (54)..(361): Pfam Id: mTERF Pfam Desc: mTERF
  misc_feature (4)..(388): NCBI GI: 115467190 NCBI Desc: os06g0225100 [oryza sativa (japonica cultivar-group)]
  misc_feature (37)..(384): NCBI GI: 51536063 NCBI Desc: mitochondrial transcription termination factor-like [oryza sativa (japonica cultivar-group)]
  misc_feature (40)..(390): NCBI GI: 51536066 NCBI Desc: mitochondrial transcription termination factor-like [oryza sativa (japonica cultivar-group)]
  misc_feature (37)..(382): NCBI GI: 51536067 NCBI Desc: mitochondrial transcription termination factor-like [oryza sativa (japonica cultivar-group)]
  misc_feature (37)..(362): NCBI GI: 115467184 NCBI Desc: os06g0224700 [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: Functional homolog of the protein sequence given in SEQ ID NO 13214
MPLIIFSAAAPVAVVSLLRTRTRSSLRLTVTRAAATSTTATPAPAPASTFAVEDYLVASCHLTPPQALKASKSLAHLKSASNADAVLAFLEDLGLSPKEVAAVVASNPRVLCARIDRSLAPISGELRALGLSPSQIARLAQIAGRYFLCRSFVSKVRFWLPLFGSPERLLQASDWNYWLLSSDLEKVVEPNVAFLKKCGLSAGDIAKLLVAAPRLVTMPPEYVQDAVRRATQLGVAPGSQMFRHALSTAGCIGQEKVDSKVAVLKETLGWSQEEVNLAISKAPRILVASEERLRRNAEFLLNEVGLPPQYIARRSVLLMYSLERRIVPRHVVLTVLKEKGLVEQDRCFFNVVAPTEEKFFEKFVAPYEESIPGLADTYDSACMGKVTRGL

SEQ ID NO: 8081 - DNA, 1143 bp, Sorghum bicolor
  misc_feature: Ceres ANNOT ID no. 6086594
  misc_feature: Encodes the peptide sequence at SEQ ID NO 8082
atgctccacctcaaacggcgcctcttctcggctctccgcgccgcggttccactccctcccgcctccctccaccgcatctgcctctccaccaccgcctccgccacaccaccggccggattcctcgccgaggactacctcgtcgccagctgcggcctcacgctagcgcaagcccggaaggcatccaagtacatgaaccacctcagttcccccgtcaggccggacgctgtgcgcgccttcctcgtcagcatcggccttaccgaagccgatgtcgttgccgcagtcgtgagctacccgattctcctctgctccaaggtagacgaaaccctaaccccgcgcgttgcccagctacgcgaaatcggcctctcacctccccagatctcccgtctcattaccgttgcccctgaaatcttggctagctccgtcaagatgtctcgtctcgccttttacatctcgtttttgggatcctacgacaaggtgcactccgccctaaagaactgctactacctgctccgtcaagaccttgagactgtggtcaggcccaacatagcattcctgcgccagtgcggcctaactaactatgatattggccatcactgtttgctgcgctcgaggatcctcctagcagagccacagcgtgtgaaggaaattgctgtgcgtgctgaggagcttggggtgtcatgcaactctatggcgttcaagcatgccctggtcaccgtctacagcttaagcgcagggaggctgaatgcaaagctcagtttcctgaagaatgttattggatgctctgaggctgagctgggcaatctggtgtgcaaggcgcctgcaattctagcacattcagagagtaagctaggtcgcactttggagtttctgaagatggaggttggattggagccgtcatatgtactgaacagaccggcacttatcagttatagcattgagagacggctaatgccccggcattatgtaataaggattctgaaggcaaagggattgttgagcaaagagattgacttttacggcgcggtctgtataacagaggagaaatttttggaaaagttcattctcccttataacaagagttttccagggctaatagatgcttatgctgctgcttgcagaggccgagtaaccctcgaactataa

SEQ ID NO: 8082 - protein, 380 aa, Sorghum bicolor
  misc_feature: Ceres ANNOT ID no. 6086594
  misc_feature (44)..(351): Pfam Id: mTERF Pfam Desc: mTERF
  misc_feature (29)..(370): NCBI GI: 115467190 NCBI Desc: os06g0225100 [oryza sativa (japonica cultivar-group)]
  misc_feature (1)..(374): NCBI GI: 51536063 NCBI Desc: mitochondrial transcription termination factor-like [oryza sativa (japonica cultivar-group)]
  misc_feature (1)..(372): NCBI GI: 51536067 NCBI Desc: mitochondrial transcription termination factor-like [oryza sativa (japonica cultivar-group)]
  misc_feature (3)..(376): NCBI GI: 51536066 NCBI Desc: mitochondrial transcription termination factor-like [oryza sativa (japonica cultivar-group)]
  misc_feature (1)..(376): NCBI GI: 115467186 NCBI Desc: os06g0224900 [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: Functional homolog of the protein sequence given in SEQ ID NO 13214
MLHLKRRLFSALRAAVPLPPASLHRICLSTTASATPPAGFLAEDYLVASCGLTLAQARKASKYMNHLSSPVRPDAVRAFLVSIGLTEADVVAAVVSYPILLCSKVDETLTPRVAQLREIGLSPPQISRLITVAPEILASSVKMSRLAFYISFLGSYDKVHSALKNCYYLLRQDLETVVRPNIAFLRQCGLTNYDIGHHCLLRSRILLAEPQRVKEIAVRAEELGVSCNSMAFKHALVTVYSLSAGRLNAKLSFLKNVIGCSEAELGNLVCKAPAILAHSESKLGRTLEFLKMEVGLEPSYVLNRPALISYSIERRLMPRHYVIRILKAKGLLSKEIDFYGAVCITEEKFLEKFILPYNKSFPGLIDAYAAACRGRVTLEL

SEQ ID NO: 8083 - DNA, 360 bp, Sorghum bicolor
  misc_feature: Ceres ANNOT ID no. 6086598
  misc_feature: Encodes the peptide sequence at SEQ ID NO 8084
atggccggcgggaaggagccgatcgaggtcaggttccggctcttcgacggcacggacatcgggcctaccaagtacgatccctccaccacagtctcctcgctcaaggagttcatcctcgctcggtggccacaagataaggatgtagctccaaaaactgttaacgacttgaagcttatcaatgctggaaggatattggagaataaccggacacttgcagagtcccgtgttccagtaggagaggtcccaggaggtgtaattacaatgcatgtggtagtgcgacctccacaagctgacaaaaatagtgagaagcagcttgccaactctcccaagcagaacagatgtggatgcaccattctctga

SEQ ID NO: 8084 - protein, 119 aa, Sorghum bicolor
  misc_feature: Ceres ANNOT ID no. 6086598
  misc_feature (1)..(119): NCBI GI: 75134491 NCBI Desc: membrane-anchored ubiquitin-fold protein 3 precursor (membrane-anchored ub-fold protein 3) (osmub3)
  misc_feature (5)..(119): NCBI GI: 4097587 NCBI Desc: ntgp5 [nicotiana tabacum]
  misc_feature (1)..(119): NCBI GI: 75137427 NCBI Desc: membrane-anchored ubiquitin-fold protein 1 precursor (membrane-anchored ub-fold protein 1) (osmub1)
  misc_feature (3)..(119): NCBI GI: 75116001 NCBI Desc: membrane-anchored ubiquitin-fold protein 2 precursor (membrane-anchored ub-fold protein 2) (osmub2)
  misc_feature (1)..(101): NCBI GI: 9280680 NCBI Desc: f2e2.12 [arabidopsis thaliana]
MAGGKEPIEVRFRLFDGTDIGPTKYDPSTTVSSLKEFILARWPQDKDVAPKTVNDLKLINAGRILENNRTLAESRVPVGEVPGGVITMHVVVRPPQADKNSEKQLANSPKQNRCGCTIL

SEQ ID NO: 8085 - DNA, 1560 bp, Sorghum bicolor
  misc_feature: Ceres ANNOT ID no. 6086605
  misc_feature: Encodes the peptide sequence at SEQ ID NO 8086
atgcgcctcccggtccttttcgccctccagctggtcgccgtggcggcggcagcatcggtggccgaggccgcggcgacgctctcttcgaggatggtgcaccgtctgtccgacgaggcccggctggaggcgggcccgcgtgcggggtggtggccgcagcgcggaagtggggagtactaccgcgcgctggtgaggagcgatctccagcggcagaagcggcggctcgcgggcaagtaccagcttctctcgctctcaaagggcggcagcaccttctcccccggcaacgacttaggctggttatattacgcttgggtggatgttgggacgcctactacctcctttttggttgcattggatactggaagtgacctgttctgggtaccctgtgactgtatcgagtgtgcccctttggctggctaccgtggaaatctggatagagatctaggaatatacaagcctgctgaatcaacaacaagtcggcatcttccttgcagccatgagctatgcaaatcaggttcaggctgcacaagcccaaagcagccttgcccatacagcattgaatacttttcagaaaataccaccagctctggtttgctaattgaggatacgctacacttgaactccagggagggccatgtaccagtgaacgcttcagttattattggctgtggtcgaaagcaaagcggtgactatctagatggtattgcaccggatggactccttggccttggaatggcagatatttcagttcctagtttccttgcaagagctggactagttcggaattccttctcgatgtgctttaaggaagatagttctgggagaattttctttggagatcaaggagtgtcctctcaacagtctacaccgtttgttcctctgtatggcaaacttcaaacttatgctgttaatgtcgacaagtcttgtattggacataaatgtcttgagggtactagcttccaggccttagtcgatagtggaacatcatttacttctcttcctccagacgtttacaaggctttcacaatggagtttgacaaacaaatgaatgcttcaaaggtgccttatgaagacagtacttggaaatattgctacagtgctagtcctcttgagatgcctgatgtgccaaccataaccctggcatttgctgcaaacaagagcttccaggctgttaatcctatcttgccatttaatgacaaacagggagcacttgccgggttctgcttagctgtgctgccatcaacagaacctattggaattattgcccagaatttcttggttggataccatgttgtcttcgacagagaaagcatggagctgggctggtaccgctctgaatgccgcgacgttgacaacagcacgacggtgccattgggcccatcgcagcgcgacagtccagaggacccgttgccgtcgaacgagcagcagacttccccggccgtgacgcctgcaacggcaggcacggctccgctctccagtgcgacgacgaatctacagatgctcctagctagctcttactcattgctgttactgacaatgtccactgtgttcttcatctcatga

SEQ ID NO: 8086 - protein, 519 aa, Sorghum bicolor
  misc_feature: Ceres ANNOT ID no. 6086605
  misc_feature (99)..(444): Pfam Id: Asp Pfam Desc: Eukaryotic aspartyl protease
  misc_feature (1)..(519): NCBI GI: 46390211 NCBI Desc: aspartyl protease-like [oryza sativa (japonica cultivar-group)]
  misc_feature (8)..(509): NCBI GI: 72384474 NCBI Desc: 80a08_5 [brassica rapa subsp. pekinensis]
  misc_feature (18)..(468): NCBI GI: 32526671 NCBI Desc: chloroplast nucleoid dna-binding protein -like protein [oryza sativa (japonica cultivar-group)]
  misc_feature (94)..(509): NCBI GI: 52076082 NCBI Desc: aspartic proteinase nepenthesin ii -like [oryza sativa (japonica cultivar-group)]
  misc_feature (94)..(509): NCBI GI: 115480451 NCBI Desc: os09g0542100 [oryza sativa (japonica cultivar-group)]
MRLPVLFALQLVAVAAAASVAEAAATLSSRMVHRLSDEARLEAGPRAGWWPQRGSGEYYRALVRSDLQRQKRRLAGKYQLLSLSKGGSTFSPGNDLGWLYYAWVDVGTPTTSFLVALDTGSDLFWVPCDCIECAPLAGYRGNLDRDLGIYKPAESTTSRHLPCSHELCKSGSGCTSPKQPCPYSIEYFSENTTSSGLLIEDTLHLNSREGHVPVNASVIIGCGRKQSGDYLDGIAPDGLLGLGMADISVPSFLARAGLVRNSFSMCFKEDSSGRIFFGDQGVSSQQSTPFVPLYGKLQTYAVNVDKSCIGHKCLEGTSFQALVDSGTSFTSLPPDVYKAFTMEFDKQMNASKVPYEDSTWKYCYSASPLEMPDVPTITLAFAANKSFQAVNPILPFNDKQGALAGFCLAVLPSTEPIGIIAQNFLVGYHVVFDRESMELGWYRSECRDVDNSTTVPLGPSQRDSPEDPLPSNEQQTSPAVTPATAGTAPLSSATTNLQMLLASSYSLLLLTMSTVFFIS

SEQ ID NO: 8087 - DNA, 534 bp, Sorghum bicolor
  misc_feature: Ceres ANNOT ID no. 6086606
  misc_feature: Encodes the peptide sequence at SEQ ID NO 8088
atgggaggcgccatgaggcagctgcttagctttctgagagcgatcaatggccgccccagggagaagaagaggaagacgacgacgacgacgctgcggcggcgccgcctggtgcagacggtggtggagctgagggtcaggatggactgcgagcgctgcgagcgcgaggtcaagaaagcgctctccggcatcagaggagtgcagcatgtggaggtgaacaggctacagcagaaggtgacggtgactggcgaggtggacccggccgcggtgctgcggagggcccagtccacggggaagaaggcggagccgtggcccgggccggggccccagagcactgccggctactacggcccgtcagccgcagccctctacggcttcggggcggcccagcttcaggcccacgacgggaggtgggccaacccggctggctactactacccgtactacccggccccggtgatggaggcggccatcggcgccgagcagatcaccagcctgttcagcgacgacaaccccaacgcctgctccgtcatgtga

SEQ ID NO: 8088 - protein, 177 aa, Sorghum bicolor
  misc_feature: Ceres ANNOT ID no. 6086606
  misc_feature (42)..(102): Pfam Id: HMA Pfam Desc: Heavy-metal-associated domain
  misc_feature (32)..(177): NCBI GI: 92899055 NCBI Desc: heavy metal transport/detoxification protein [medicago truncatula]
  misc_feature (27)..(177): NCBI GI: 23304411 NCBI Desc: farnesylated protein 1 [hordeum vulgare subsp. vulgare]
  misc_feature (28)..(177): NCBI GI: 92894085 NCBI Desc: heavy metal transport/detoxification protein [medicago truncatula]
  misc_feature (33)..(177): NCBI GI: 9755769 NCBI Desc: farnesylated protein atfp6-like protein [arabidopsis thaliana]
  misc_feature (37)..(177): NCBI GI: 15221451 NCBI Desc: copper-binding family protein [arabidopsis thaliana]
MGGAMRQLLSFLRAINGRPREKKRKTTTTTLRRRRLVQTVVELRVRMDCERCEREVKKALSGIRGVQHVEVNRLQQKVTVTGEVDPAAVLRRAQSTGKKAEPWPGPGPQSTAGYYGPSAAALYGFGAAQLQAHDGRWANPAGYYYPYYPAPVMEAAIGAEQITSLFSDDNPNACSVM

SEQ ID NO: 8089 - DNA, 978 bp, Sorghum bicolor
  misc_feature: Ceres ANNOT ID no. 6086609
  misc_feature: Encodes the peptide sequence at SEQ ID NO 8090
atggccagttccacaactcagcatgtgctttcgtccatcaaattgctgcccacaggctgcttccatcatgataggagaaatagctgcgtgctttctgtctcagtagggcgtcgctgccgcagtgcccgcaatttgggtttagtttgtgcttcaaacacccaatcttcagtgattgagccggttcagctaccggggagccctaaaagtggagcaactccaaagaaatcaggtgaaagcgcactcattctgatacggcatggagaatcgttgtggaatgagaagaacctgtttactggatgtgtcgatgttcccctgacccctaagggtgttgacgaggcgattgaggcggggaaaaggatatgcaacatcccggttgatgtaatatacacttcgtcgctgattcgggctcagatgaccgctatgcttgccatgatgcagcatcgccgtaagaaggttccaatcattgtgcacaatgagagtgaacaagctcacaagtggagtcagatatacagtgaagagacaaagaagcagtccattcctgtcataacagcttggtatggtgagcttcaaggtcttaacaagcaagaaaccgctgatcgatttggtaaagaacaagttcatgaatggcgtcgcagttatgatattcctcccccaaatggagagagccttgagatgtgtgcagagagagcagttgcttatttcaaggaccaaattattcctaaacttgtggctggaaagcatgtaatgattgctgcccatgggaattcacttcgttcgattataatgcatttggacaagttgacttctcaagaggttatcagccttgagttgtctactggcattcctatgctgtatatatttaaggaagggaaatttatcaggcgaggaagtcccgcaggaccttctgaagcaggtgtctatgcttataccaagaatttggctcagtacagacagaagcttgatggcatgtttcagtag

SEQ ID NO: 8090 - protein, 325 aa, Sorghum bicolor
  misc_feature: Ceres ANNOT ID no. 6086609
  misc_feature (80)..(260): Pfam Id: PGAM Pfam Desc: Phosphoglycerate mutase family
  misc_feature (74)..(321): NCBI GI: 56381947 NCBI Desc: at1g22170 [arabidopsis thaliana]
  misc_feature (50)..(321): NCBI GI: 42563306 NCBI Desc: phosphoglycerate/bisphosphoglycerate mutase family protein [arabidopsis thaliana]
  misc_feature (50)..(321): NCBI GI: 6573769 NCBI Desc: f28k19.26 [arabidopsis thaliana]
  misc_feature (81)..(300): NCBI GI: 89331289 NCBI Desc: phosphoglycerate mutase [chlamydophila felis fe/c-56]
  misc_feature (81)..(300): NCBI GI: 33301145 NCBI Desc: 2,3-bisphosphoglycerate-dependent phosphoglycerate mutase (phosphoglyceromutase) (pgam) (bpg-dependent pgam) (dpgm)
  misc_feature (81)..(295): SWISSPROT Homolog: EC 5.4.2.1 2,3-bisphosphoglycerate-dependent phosphoglycerate mutase
MASSTTQHVLSSIKLLPTGCFHHDRRNSCVLSVSVGRRCRSARNLGLVCASNTQSSVIEPVQLPGSPKSGATPKKSGESALILIRHGESLWNEKNLFTGCVDVPLTPKGVDEAIEAGKRICNIPVDVIYTSSLIRAQMTAMLAMMQHRRKKVPIIVHNESEQAHKWSQIYSEETKKQSIPVITAWYGELQGLNKQETADRFGKEQVHEWRRSYDIPPPNGESLEMCAERAVAYFKDQIIPKLVAGKHVMIAAHGNSLRSIIMHLDKLTSQEVISLELSTGIPMLYIFKEGKFIRRGSPAGPSEAGVYAYTKNLAQYRQKLDGMFQ

SEQ ID NO: 8091 - DNA, 1737 bp, Sorghum bicolor
  misc_feature: Ceres ANNOT ID no. 6086610
  misc_feature: Encodes the peptide sequence at SEQ ID NO 8092
atgtcaaatcacaacgcgccctgtgacatccccaagccggcctccgtcgacgagttcctcgtcaagaatggcaagaagaagaagtccttcatgtcgggcctcttccgcaagaaagggaggggcatggacaagaagctgctctcgcggcgggacatcgtcttcgatttggagggcaaaagcggcgacaggatggacctcttggaggcgtcccccgctgtccgcaagagcttctcagatcggcactgcacgacgcggatcgaaaacctgactctgagctgcctggattctcccattagacccaacgtcgacacccgggagtaccgggtgtttgtaggcacatggaatgtgggagggaagcctcctgacagcagcattaaccttgaagagtttctgcagattgaaggactgcccgatatatacgtcttggggtttcaggagatcgtgcctctgaacgcgggcaacgttctggtcgtggaggacaacgagccggcgggcaagtggatggagctcatctaccaggccctgaacaagccgccggcccaggacgggcagtcctccggcgacgagctctcgccgccggagtccaccacctcccactacgcccagccgtcccaggtccgcgtaggcggccgcgaccccagcagcaccgccatccccaagtcctccagcggcggccagctcttcgcgcagaataataagccgccgccgctcaaggttgtcaacaagagctaccgcgtcgacaacgcgctggtcaagacgtgcacctgcatgtccgacccgtccaccatgcagcgccgggcacgggagatgcgcgagttcctctaccgcgtcgaggccgccgcagcctcgccgaaccgcggcgccgtcgacgacgacgacgcgctgccttccatcgaaggcagcgaccagaggggcgccggcatgaactattgcctcatcgcgaggaagcagatggtcgggatcttcctgtcggtgtgggtgcggcgggagctcgtgcagtacgtcggccacctccgggtcgactgcgtcggccggggcatcatgggccgcctcgggaacaagggatgcatcgccatgagcatgacgctgcaccacacgagcatctgcttcgtgtgctgccacctggcgtccggcgagaaggaaggcgacgaggtgcggaggaactccgacgtcgccgagatcctcaagaacgcgcagttccagcgcatctgcaaggtgcccggccagcgcgttcctgagaagatcattgaccacgaccggatcatatggcttggggatttgaattaccgagtctcgttgagctacgaggaaactaaggcgctgctggaggagaatgagtgggacatcttattggagaaagatcagctcgcgatggagagacaagccgggagagtgttcaaagggtggaaggagggcaagatctacttcgcccctacatacaagtacaagcagaactccgactcatatgtatgggagaccgcgaaatcgaagaagaaacggcgaacgccagcatggtgtgaccggatactgtggcacggccagggcatcgagcagctgcagtacatcaggggcgagttcaggctctccgatcacaggcctgtctgcagcgtgttcgttgtcgaagccgatgtagatagtgggagcaagatcagaaagggctactcaactctggacgctaggatccattgcgactcctccgcgatacccaagagacacagcttctatgatgacttctga

SEQ ID NO: 8092 - protein, 578 aa, Sorghum bicolor
  misc_feature: Ceres ANNOT ID no. 6086610
  misc_feature (109)..(538): Pfam Id: Exo_endo_phos Pfam Desc: Endonuclease/Exonuclease/phosphatase family
  misc_feature (40)..(576): NCBI GI: 53793645 NCBI Desc: at5g65090 [arabidopsis thaliana]
  misc_feature (53)..(576): NCBI GI: 10178171 NCBI Desc: inositol-1, 4, 5-trisphosphate 5-phosphatase-like protein [arabidopsis thaliana]
  misc_feature (209)..(547): NCBI GI: 145334295 NCBI Desc: endonuclease/exonuclease/phosphatase family protein [arabidopsis thaliana]
  misc_feature (209)..(547): NCBI GI: 30680735 NCBI Desc: endonuclease/exonuclease/phosphatase family protein [arabidopsis thaliana]
  misc_feature (297)..(577): NCBI GI: 92883941 NCBI Desc: inositol polyphosphate related phosphatase [medicago truncatula]
MSNHNAPCDIPKPASVDEFLVKNGKKKKSFMSGLFRKKGRGMDKKLLSRRDIVFDLEGKSGDRMDLLEASPAVRKSFSDRHCTTRIENLTLSCLDSPIRPNVDTREYRVFVGTWNVGGKPPDSSINLEEFLQIEGLPDIYVLGFQEIVPLNAGNVLVVEDNEPAGKWMELIYQALNKPPAQDGQSSGDELSPPESTTSHYAQPSQVRVGGRDPSSTAIPKSSSGGQLFAQNNKPPPLKVVNKSYRVDNALVKTCTCMSDPSTMQRRAREMREFLYRVEAAAASPNRGAVDDDDALPSIEGSDQRGAGMNYCLIARKQMVGIFLSVWVRRELVQYVGHLRVDCVGRGIMGRLGNKGCIAMSMTLHHTSICFVCCHLASGEKEGDEVRRNSDVAEILKNAQFQRICKVPGQRVPEKIIDHDRIIWLGDLNYRVSLSYEETKALLEENEWDILLEKDQLAMERQAGRVFKGWKEGKIYFAPTYKYKQNSDSYVWETAKSKKKRRTPAWCDRILWHGQGIEQLQYIRGEFRLSDHRPVCSVFVVEADVDSGSKIRKGYSTLDARIHCDSSAIPKRHSFYDDF

SEQ ID NO: 8093 - DNA, 1092 bp, Sorghum bicolor
  misc_feature: Ceres ANNOT ID no. 6086636
  misc_feature: Encodes the peptide sequence at SEQ ID NO 8094
atggggtacctgccgtccctgagcagcaaggcggcgcacttcgtgtccgacctcaccaccgtcatcctcaaccccgtctccgagcgcgagacctcccacctccccgaggttgacgaagtgcaagaaaatttggaggatgataaagattctgagcacaattctgacagccttgatggacctgacacatcttcctttagagcattcttgatctcatttttgtcatcatcgagctctaataacgattcaatggagataattcctgagcagaatggggacatgggttaccctactttaacacccatggggaagggaagcaagggaagaacaggtctgataagtaggggaaagcattccatcggaaaaatcattaacaaggcgacaaggattggtggtttcaaacaaacaactgcagagcctaaaattgacagggagacaataactcatactgaaccagttgcacctgtattggagcgccaggaaccaaaggaagttgtttcctttagtagtttgccaactatgtcggaaccatctgttcttttgtcagaacggatgcaatcaattctttatgcatctctccctgttcttgcccagggaaggaactgggtcttgctatacagtacatggaggcatggcatatctttatctactttatatagaaggagcatgctttgccctggtttctcactcttggttgtcggggataaagaaggtacaatttttggtggtttagttgaggccccattacagccatccagttcaaagaagtatcaggggaccaataattcctttgttttcactaatttgcataatcgccctgtcatatatcgaccgacaggtgcaaataactattttacggtgtgctccactgactatatggctttggggggaggaggtcattttgcactttatcttgattctgaccttttgactggttcaagttcaaattcagagacttttaacaacgggtgtttatcgcattcttcagacttctcagtgaaagatgttgagctttggggcttcgtctacccttccaaatacgaggagatgctgacaatctgcaggactgagaaaccaggaatctgtcgatggtga

SEQ ID NO: 8094 - protein, 363 aa, Sorghum bicolor
  misc_feature: Ceres ANNOT ID no. 6086636
  misc_feature (203)..(341): Pfam Id: TLD Pfam Desc: TLD
  misc_feature (1)..(363): NCBI GI: 46805939 NCBI Desc: oxidation protection protein-like [oryza sativa (japonica cultivar-group)]
  misc_feature (1)..(360): NCBI GI: 51535088 NCBI Desc: nucleolar protein-like [oryza sativa (japonica cultivar-group)]
  misc_feature (143)..(340): NCBI GI: 13540300 NCBI Desc: nucleolar protein c7b [mus musculus]
  misc_feature (143)..(340): NCBI GI: 91207266 NCBI Desc: oxidation resistance protein 1 (protein c7)
  misc_feature (143)..(340): NCBI GI: 91207267 NCBI Desc: oxidation resistance protein 1 (protein c7)
  misc_feature: Useful for making plants with altered protein content
  misc_feature: Functional homolog of the protein sequence given in SEQ ID NO 13487
MGYLPSLSSKAAHFVSDLTTVILNPVSERETSHLPEVDEVQENLEDDKDSEHNSDSLDGPDTSSFRAFLISFLSSSSSNNDSMEIIPEQNGDMGYPTLTPMGKGSKGRTGLISRGKHSIGKIINKATRIGGFKQTTAEPKIDRETITHTEPVAPVLERQEPKEVVSFSSLPTMSEPSVLLSERMQSILYASLPVLAQGRNWVLLYSTWRHGISLSTLYRRSMLCPGFSLLVVGDKEGTIFGGLVEAPLQPSSSKKYQGTNNSFVFTNLHNRPVIYRPTGANNYFTVCSTDYMALGGGGHFALYLDSDLLTGSSSNSETFNNGCLSHSSDFSVKDVELWGFVYPSKYEEMLTICRTEKPGICRW

SEQ ID NO: 8095 - DNA, 3153 bp, Sorghum bicolor
  misc_feature: Ceres ANNOT ID no. 6086637
  misc_feature: Encodes the peptide sequence at SEQ ID NO 8096
atgagggccaccggggagcacacagctgcggtgcccatcctcgtcccgccgccgcctgctgctgctgctgctgctgcggcctctgcgaccgaggaagccgagaagaagaagaaccgccgccgcccctcgcggcgctccaagcaggcggccgtcgccgcgccgcagggcccgcacgcggacgcggcggggccgaggtcggtcagatcgatgccgcccatgcacgttggcagcggcggcgccggtgtcgacgccgaggcagaggcgtccgcggcgggaacgagccagtcctgccccctgctgcccacgccgagtcctacggaggcgcctgcgtcgagggtggacgggggagctccggcgatgcggtacttccagcctcactggcctcagcgggccgtggaggacgccatcaaggcgtactgcacgattgatggcatccccgtggatgttctcattacaggattggcacaaaaccgagcggttgaaggtgatcatgttgctatcacactggaccctgttgctcactggaccagaatgaaaggtccgaatgttgcatgcaaccctgcgataggaggagattctgtggtccgtgagtttagtgaaaccaatgggaatcatagttggaagaaaggacatgcagatgttggctgcaggtttgaaaattgcagtaacgctgtacctgttttggataggatgcatccccctcacaagaacagtggttttagtcaagctgttaattgtggaaatgggaatgctactgtccctgaaaggaatgtgaaagacttgaatgatggaaagagtgaggctgcgagagcattacaaaggatctgtgccatgatatgctctcatccaagcagacgtcctactgggaaagtattatcagtcactaagaagtctccgcgccgtgatgccattgtaggtttccttgcttctttctcagagttccctgatggagagcagcagaaaaatcagatgggtctaaagaggatgaacaacgtagcatcatcagttacaggcttgtttcatctcttgcctactgaccccaaattccctccgatggttgtgagttttagcactttgccagatagtgtcatacagagcctaaggggtgatgcagcttttgagaaggaattggttgctgcacgaattgatgaatggaatgaggaaaatatctatccctatgcccatgttatacggttcttggggaagggtggtcatgttaaaacacacatggatgctatattatttgagaatgcgatatctgatgctgagttttcccctgagtccttggcatgtcttcctgacaattgttggaagattcctcaaaaagaacttgaagcaagaaaagatttgagggaggtcttgtcttttacaatagaccctccaactgcatcggatcttgatgatgctatatcaattcaaatactttcaggaggaactgtccgtgttggggttcacattgcagatgtttcctactttgtacatccagagactgcgttagatgctgaagctcaaagccgatctactagtgtttacaccctgaaacgcaaaatctcgatgttgccttcaagactttcagaagtggtttcgcttaatccaggtacagacaggcttgccttttcaattatttgggatattgatcctcatggtaacataattagtcgctggattggtcgaagcgtcatcttttcatgctgcaagctgtcatatgaacttgtgcaggatttgatctgtaatgaagccagtcaggctagatctgctatttcttcttttgaagtacatggtaaatttgagagagatgatgttatcaagtcacttagaggcctttatgaagtcacgaaaaatctgaaggaagttaggttcaagggtggggctctttctcttgacactgcaaagcttatgatcttgtttgatgaggatggggctccatgtgatagctatcgctatgtgaggaacaatgcatgcttcattgttgaggagctaatgttgttggcaaatatgtcagctgcagaaatcatatctaatgcatttcctgattgtgccttacttcgtaggcaccctgaacctaatttgcggaggttcagagagttcgaggcattttgtgctaagaatggttttgaattggatgcttcatcatctggtcaactacacctttcactctctagaataaaggaaaagttgcaagaggatcctgttatgtttgatatcctcatgttttatgcttcaaagcaaatgcagtcagcagaatacttttgcacaggggacctgataagcaagaaagatgattgggcacattatgcgctgtctgtccctttgtatacacacttcacttcaccacttcgaagatatcctgatataattgttcacaggactctgaatgcggtgattgaggctgaacaagtgtatataaagcaaaagaaattttccacaggccggaatggagtcaaagcctcttgtgaattgatggatagatgttttacaggcctccagttgtgcaaggatgctactgaatctgaagaaggaaaaaaagtactttctgctgcagctaagaaatttaaggttccttactctgaaaatctcggggagatcgctgaacactgtaatgaaagaaagtgggctggtcgccgtgcagaagatgctggacagaagctctacatgtgggctctgataaagaacaaagaggtcgtggtctgcaatgctagagttctggggcttggacccagattcatgtcagtttatgtgcccaagcttgcgatggaacgaaggatatattatgatgaagttgagggcttgtcagttgaatggttagaagccactggaacgttagtgcttgatgcatgctggaacaagcctgctcaaaggaggggaacttatcagatgaagtgcaggccaattgaggaagttgcgatggtggtgaacccttcagagttgtctgaagaagatgaggaatcaggggcagcagaagctagcggctgcactgccaagtctgttttgttgagtggcgatgcagtgaaaactcagaccgctccagctgttctgcccttggtgatacattacctgagtgacatccctgtggttcttcatgcaattggtggtgaggattgtgcggtggacattggagtaagactgtacatggcgtcatacttcgagttatag

SEQ ID NO: 8096 - protein, 1050 aa, Sorghum bicolor
  misc_feature: Ceres ANNOT ID no. 6086637
  misc_feature (447)..(797): Pfam Id: RNB Pfam Desc: RNB domain
  misc_feature (344)..(795): NCBI GI: 134288890 NCBI Desc: dis3 mitotic control homolog (s. cerevisiae)-like 2 [homo sapiens]
  misc_feature (344)..(795): NCBI GI: 24233556 NCBI Desc: riken cdna 4930429a22 [mus musculus]
  misc_feature (344)..(795): NCBI GI: 119591396 NCBI Desc: hcg2013107, isoform cra_e [homo sapiens]
  misc_feature (253)..(808): NCBI GI: 19115422 NCBI Desc: ribonuclease ii rnb family protein; dis3-like [schizosaccharomyces pombe]
  misc_feature (253)..(808): NCBI GI: 2414618 NCBI Desc: spac2c4.07c [schizosaccharomyces pombe]
MRATGEHTAAVPILVPPPPAAAAAAAASATEEAEKKKNRRRPSRRSKQAAVAAPQGPHADAAGPRSVRSMPPMHVGSGGAGVDAEAEASAAGTSQSCPLLPTPSPTEAPASRVDGGAPAMRYFQPHWPQRAVEDAIKAYCTIDGIPVDVLITGLAQNRAVEGDHVAITLDPVAHWTRMKGPNVACNPAIGGDSVVREFSETNGNHSWKKGHADVGCRFENCSNAVPVLDRMHPPHKNSGFSQAVNCGNGNATVPERNVKDLNDGKSEAARALQRICAMICSHPSRRPTGKVLSVTKKSPRRDAIVGFLASFSEFPDGEQQKNQMGLKRMNNVASSVTGLFHLLPTDPKFPPMVVSFSTLPDSVIQSLRGDAAFEKELVAARIDEWNEENIYPYAHVIRFLGKGGHVKTHMDAILFENAISDAEFSPESLACLPDNCWKIPQKELEARKDLREVLSFTIDPPTASDLDDAISIQILSGGTVRVGVHIADVSYFVHPETALDAEAQSRSTSVYTLKRKISMLPSRLSEVVSLNPGTDRLAFSIIWDIDPHGNIISRWIGRSVIFSCCKLSYELVQDLICNEASQARSAISSFEVHGKFERDDVIKSLRGLYEVTKNLKEVRFKGGALSLDTAKLMILFDEDGAPCDSYRYVRNNACFIVEELMLLANMSAAEIISNAFPDCALLRRHPEPNLRRFREFEAFCAKNGFELDASSSGQLHLSLSRIKEKLQEDPVMFDILMFYASKQMQSAEYFCTGDLISKKDDWAHYALSVPLYTHFTSPLRRYPDIIVHRTLNAVIEAEQVYIKQKKFSTGRNGVKASCELMDRCFTGLQLCKDATESEEGKKVLSAAAKKFKVPYSENLGEIAEHCNERKWAGRRAEDAGQKLYMWALIKNKEVVVCNARVLGLGPRFMSVYVPKLAMERRIYYDEVEGLSVEWLEATGTLVLDACWNKPAQRRGTYQMKCRPIEEVAMVVNPSELSEEDEESGAAEASGCTAKSVLLSGDAVKTQTAPAVLPLVIHYLSDIPVVLHAIGGEDCAVDIGVRLYMASYFEL

SEQ ID NO: 8097 - DNA, 969 bp, Sorghum bicolor
  misc_feature: Ceres ANNOT ID no. 6086645
  misc_feature: Encodes the peptide sequence at SEQ ID NO 8098
atggcgcggcggctgccgtgttggacagcgctgctcctccccttcctcctcgtcggcgttggtccctacgccgccgccgaatccctgccccacgatgcgtgcctggtgcctactatcgtggaatccgtccttgggactcccggcacgtgctcgacgctggatcgccgccctggcgacccggtcggcgtcatcgagggagatgaggtcacgttggcaagggcagttaatcttcttcatgcaaacaaggatgactatattgctgtacttttctatgcgacgtggtgcccattctcacaagaatgcaaaccaaattttgagacactggcttccttattcccaactattcgacattttgcatttgaggaatctgcaattaggccaagcataatttcgaggtatggcattcatggtttcccaacactctttctcttgaattcaaccatgagagtacggtatcatggaccaaggactgttaaatcacttgcagctttctacactgacgtctcaggtatcaatgcttcggtgaagtcaactgcaggggaggccatggtacatcccttggatgatattgagcctaaaaaggaagccgaacaggaaaattgtccattctggtgggctcggtcaccagagaaaatacttcagcaggatacttatctagcattggcgacagcatttgttattttgagattgctgtatcatctttatccaaagataaattcctttgctagatgggcatggaggaggcataatctgttttcaaacttgatgggggcacatgaatatttcctcacctaccttgagcaagcaagacagaagtttcataggctgtacccttcaagttcaaagcgaggaaatttgcaggagggggcaatgaacgcgactgcttgggcttccaaatcattagcatctgtttcgattggagaaccaagtgctattggaaggacaaactctacaagtgagctaagatga

SEQ ID NO: 8098 - protein, 322 aa, Sorghum bicolor
  misc_feature: Ceres ANNOT ID no. 6086645
  misc_feature (1)..(322): NCBI GI: 58014104 NCBI Desc: adenosine 5'-phosphosulfate reductase 3 [zea mays]
  misc_feature (1)..(322): NCBI GI: 58014106 NCBI Desc: adenosine 5'-phosphosulfate reductase 4 [zea mays]
  misc_feature (8)..(265): NCBI GI: 60202582 NCBI Desc: adenosine 5'-phosphosulfate reductase-like [oryza sativa (japonica cultivar-group)]
  misc_feature (56)..(320): NCBI GI: 42566351 NCBI Desc: thioredoxin-related [arabidopsis thaliana]
  misc_feature (15)..(247): NCBI GI: 60202584 NCBI Desc: adenosine 5'-phosphosulfate reductase-like [oryza sativa (japonica cultivar-group)]
MARRLPCWTALLLPFLLVGVGPYAAAESLPHDACLVPTIVESVLGTPGTCSTLDRRPGDPVGVIEGDEVTLARAVNLLHANKDDYIAVLFYATWCPFSQECKPNFETLASLFPTIRHFAFEESAIRPSIISRYGIHGFPTLFLLNSTMRVRYHGPRTVKSLAAFYTDVSGINASVKSTAGEAMVHPLDDIEPKKEAEQENCPFWWARSPEKILQQDTYLALATAFVILRLLYHLYPKINSFARWAWRRHNLFSNLMGAHEYFLTYLEQARQKFHRLYPSSSKRGNLQEGAMNATAWASKSLASVSIGEPSAIGRTNSTSELR

SEQ ID NO: 8099 - DNA, 1971 bp, Sorghum bicolor
  misc_feature: Ceres ANNOT ID no. 6086649
  misc_feature: Encodes the peptide sequence at SEQ ID NO 8100
atgtcgcggccgctgtacaggggcgtctcggggatcggcggcaagctggcggcggcggacgaggcgtactacgaccccaaggagcccagcgagaacggcattggcggcggcggccggggcggcgcgcggaagcggcacctcgcggccgcggcggtgaagatcggggtcctgctgctggccgcggcggcgctcgtgggctcggtcgcgtgggcggggacgctctacgcggggcgcggcgccgcggcgcgcgcagccgccgccgccgcgcaccgcgggtaccgccggctgcaggagcagctggtcacggacctgctcgacatcggcgagctcgcgggcggcggcgtccgcgccaaggaggcggaggtgtgcccgcccgagtacgagaactacgtgccctgctactacaacgtcacggacgccgtcgacgtctcggatctgggcgccggcgtcctcataagctacgaccgccagtgcacgcgcgacggcagggtcacttgcctcgtcgcgccaccaaggagctaccggattcccgtgcgatggcccagcggcaagggcttcatctggaaggacaacgtgcggattagcgggcaggagttctcgtccgggagcctgttcaagaggatgatggtggaggaggaccagatctcgttcccgtcggacgcccacatggccgacggtgtggaggattatgcccatcaaattgccgagatgattgggttgcggaatgaattcaatttcaatgaggctggggttaggacagtccttgacatagaatgtggatttggtacctttggggcacatctttttgagagagatctcttgaccatgtgcattgctaactatgaagcatcaggcagccaagtgcaaattacactggagagaggcattcctgcaatgattggttcatttgcaacaaagcagcttccatatccctatctttcctttgatatggtgcattgtgcaaaatgcaatatcgaatggtacaaaaatgatggcattttcttggttgaagtgaacaggcttttgaggcctgatggatattttgtatggacatcgaatttgaatacacatagggccttgcgtgacaaagaaaaccaaaagaaatggacggccattcgtgacttcgctgagggcctttgttgggagatgctgtcacaacaagatgagacaattgtatggaaaaagacaaataaaagggagtgttacaattcaagaaaatctgggcctgagctatgtggccatgatccagaatcaccatactaccaaccactaagcccctgcatatcaggcacaagaagccagcgttggatccccattgaacatcgttccacctggccatctcagtctagacaaaactcaacagaactggacatacatggtgtgcattcagaagtctttgctgatgatacttcaagctgggactccatggtgcgaaactactggtctttgctatctccacttatattttcagaccatccaaagagacctggtgatgaagacccccagccaccatttaacatgctaaggaatgttttagatatgaatgctcactttggtggatttaatgctgctttactgaaggctggaaagtctgtatgggtgatgaatgttgttcctacaaatgccccaaattatctaccactaatatttgaccgtggttttattggggttcaacatgattggtgcgacgcatttccaacttacccaagaacatatgatatggtgcatgctgatggctttctatcacttgagaagaaccacaagcatagatgttctactcttgacatattcttggaagttgatcgcatcctacgaccagagggctgggtcataatccgtgacaccgcccctcttattgaagcagcaagatctgttgttactcaactcagatgggatgcccgtattttagatcttgacatagctagtgatgaaaagctactcgtctgtcagaagccttttatcagaaaataa

SEQ ID NO: 8100 - protein, 656 aa, Sorghum bicolor
  misc_feature: Ceres ANNOT ID no. 6086649
  misc_feature (35)..(656): NCBI GI: 42563316 NCBI Desc: dehydration-responsive protein-related [arabidopsis thaliana]
  misc_feature (35)..(405): NCBI GI: 8052540 NCBI Desc: f3f9.21 [arabidopsis thaliana]
  misc_feature (80)..(656): NCBI GI: 42571457 NCBI Desc: dehydration-responsive protein-related [arabidopsis thaliana]
  misc_feature (90)..(656): NCBI GI: 42568908 NCBI Desc: dehydration-responsive protein-related [arabidopsis thaliana]
  misc_feature (80)..(638): NCBI GI: 8778408 NCBI Desc: f16a14.7 [arabidopsis thaliana]
  misc_feature: The sequence is a functional homolog of SEQ ID NO 2738 in the 10/374,780US patent application
  misc_feature: The sequence is a functional homolog of SEQ ID NO 386 in the 10/225,066US patent application
  misc_feature: The sequence is a functional homolog of SEQ ID NO 4 in the 10/286,264US patent application
  misc_feature: The sequence is a functional homolog of SEQ ID NO 44 in the 10/286,264US patent application
  misc_feature: The sequence is a functional homolog of SEQ ID NO 564 in the 10/412,699US patent application
  misc_feature: Useful for making plants with modulated growth and phenotype characteristics
  misc_feature: The sequence is a functional homolog of SEQ ID NO 4 in the 20030093837 US patent application
  misc_feature: The sequence is a functional homolog of SEQ ID NO 44 in the 20030093837 US patent application
  misc_feature: The sequence is a functional homolog of SEQ ID NO 386 in the 20050160493 US patent application
  misc_feature: The sequence is a functional homolog of SEQ ID NO 44 in the 10/286,264 US patent application
  misc_feature: The sequence is a functional homolog of SEQ ID NO 564 in the 10/412,699 US patent application
  misc_feature: The sequence is a functional homolog of SEQ ID NO 2738 in the 10/374,780 US patent application
  misc_feature: The sequence is a functional homolog of SEQ ID NO 386 in the 10/225,066 US patent application
MSRPLYRGVSGIGGKLAAADEAYYDPKEPSENGIGGGGRGGARKRHLAAAAVKIGVLLLAAAALVGSVAWAGTLYAGRGAAARAAAAAAHRGYRRLQEQLVTDLLDIGELAGGGVRAKEAEVCPPEYENYVPCYYNVTDAVDVSDLGAGVLISYDRQCTRDGRVTCLVAPPRSYRIPVRWPSGKGFIWKDNVRISGQEFSSGSLFKRMMVEEDQISFPSDAHMADGVEDYAHQIAEMIGLRNEFNFNEAGVRTVLDIECGFGTFGAHLFERDLLTMCIANYEASGSQVQITLERGIPAMIGSFATKQLPYPYLSFDMVHCAKCNIEWYKNDGIFLVEVNRLLRPDGYFVWTSNLNTHRALRDKENQKKWTAIRDFAEGLCWEMLSQQDETIVWKKTNKRECYNSRKSGPELCGHDPESPYYQPLSPCISGTRSQRWIPIEHRSTWPSQSRQNSTELDIHGVHSEVFADDTSSWDSMVRNYWSLLSPLIFSDHPKRPGDEDPQPPFNMLRNVLDMNAHFGGFNAALLKAGKSVWVMNVVPTNAPNYLPLIFDRGFIGVQHDWCDAFPTYPRTYDMVHADGFLSLEKNHKHRCSTLDIFLEVDRILRPEGWVIIRDTAPLIEAARSVVTQLRWDARILDLDIASDEKLLVCQKPFIRK

SEQ ID NO: 8101 - DNA, 2553 bp, Sorghum bicolor
  misc_feature: Ceres ANNOT ID no. 6086650
  misc_feature: Encodes the peptide sequence at SEQ ID NO 8102
atggaggagggcagcaaggcgcaactgccgtccccatctcacactgaagccatggagcagctggcacccgtcccaatggaccaagatgagggccgggaagccgcggaaaccatggaggaagaagaagccacggccgcagatgtctccgatgccgcggatcccatggaagacggggaggcggcaggagactccgcggcagccgcggagcccatggaggacgacgcgcccacgtcctccccgactccctccgcgccgtcggccaccgcggccgtcgacgactccaccatcgcgcggaagcgccgccgccgtaagaagcagttccccggtatgatccccacggccggcgtccgcgtcctgcgcggctcctcctcctcttcctcccataccgcggcgcatctgaccggcgtccctcgacgccggggacggccccccacctcatcctctctccgccttgcccgggagctcgattctgaggccctcatcgctctcgctgcggggttccccgcggactccctctccgaggacgagatcgtggccgccgtgctcccacgcattggcggcgctgagcaggccaactaccttgtcgtccgcaatcacattgtggcgctctggcgttctaatcccctctcccccgttgccgccaacgccgcgctcgcatccattcgagccgagcacgctccccttgttgctgcggcgcattccttcctgtctgagcacgcatacatcaatttcggtctcgcccccgccgtcctctcgcttcccccacagcctcctccctcttctcctaccccatccatcctcattgttggcgccggacttgctggtctggctgccgcaagacacctgattgcgtttggattcaaggtggccgtcattgaaggccggttccgacctggtggccgtgtgtttaccaagacaatgcgttcttctgctgtagagtatcccgacactgttgctgctgctgaccttggaggcagcgttctcaccggtatcaatggtaatccccttggtgtcattgctcgtcagcttggattcccgctccacaaggtgcgggataaatgcccgctgtatcttccagatggccgcccagttgaccctgacatggatgctcgtgttgaagctgcctttaaccagcttctggacaaggtttgccagttgagacaggtgattgcagatggtgtaccacatggtgttgatttgtcattgggcatggcgcttgaggcgttccgggcagcgcatggtgttgcagctgagcatgaagaaaggatgcttctggactggcatctggcaaacctggagtacgctaatgctgcccctcttgctgatctctcgatggccttctgggatcaggacgatccatatgaaatgggcggagaccactgctttattcctggtggaaattcccagtttgtccgtgcattcgctgatggcatcccgatattctatgggcagaacgtgaaaaggatacagtatggacgtgatggcgtgatggttcacactgataaacaggcattttgtggtgatatggtgctgtgtacagttcctcttggcgtgctaaagaagggcgacatcaagtttgtgcctgagctgccagctcagaagaaagaggccatacaaagattgggttttggtctgcttaacaaggttgtgatgctgttcccacatgatttctgggatggcacgattgatacatttggtcacttgacagaagactctggccagcgtggtgagttcttcttgttttacagctattcttctgtctcaggagggccattgctcattgctcttgttgctggggaatctgcagtcaagtttgagcaggcttcacctatggaaaatgtcgagaaggtactggaaacacttaggaaaatcttttcacccaaggggattgacgttccaaatccgttgcaagcaatatgcactcgatggggcacagacaggtttacttatggatcatactcatatgtggctattggggcttctggtgatgactatgacattttggctgagagtgtgcatgatagagttttctttgctggggaggcaacaaataggcggtaccccgctacaatgcatggagccctgcttagtgggtatagagaggctgctaacatcttaagagcagttagaaggagagcaaaaaatgttaactctcctgagaaaatggatattaatgttgaagtaaaagtgggtgttaatggtgaagtcaaagacactgataaagatagctgcattgatttggacgatctattccgttctcctgatgctgcttttggggggttctcagttctccatgacccatctacctttgaaccagattcagtttctttgctgcgtgttggaattggtgctagaaagttaggctctggttcacttttcctctatggattaataatgagaaagcatgtagttgtgttggctgcaatagagggtgatgaacagcggttgagtacaatgtaccgagattttgggacaaaactggtgggattggatagcttgggtgatgctggggaaagccttatttctcggataaaggctgccgctaggaaataa

SEQ ID NO: 8102 - protein, 850 aa, Sorghum bicolor
  misc_feature: Ceres ANNOT ID no. 6086650
  misc_feature (273)..(706): Pfam Id: Amino_oxidase Pfam Desc: Flavin containing amine oxidoreductase
  misc_feature (152)..(244): Pfam Id: SWIRM Pfam Desc: SWIRM domain
  misc_feature (265)..(705): Pfam Id: DAO Pfam Desc: FAD dependent oxidoreductase
  misc_feature (24)..(847): NCBI GI: 23505983 NCBI Desc: at1g62830/f23n19_19 [arabidopsis thaliana]
  misc_feature (24)..(815): NCBI GI: 6630454 NCBI Desc: f23n19.18 [arabidopsis thaliana]
  misc_feature (98)..(846): NCBI GI: 61661322 NCBI Desc: flowering locus d [arabidopsis thaliana]
  misc_feature (107)..(846): NCBI GI: 38345842 NCBI Desc: osjnba0084k11.6 [oryza sativa (japonica cultivar-group)]
  misc_feature (509)..(847): NCBI GI: 62321362 NCBI Desc: flavin-containing amine oxidase [arabidopsis thaliana]
  misc_feature: Useful for making plants with modulated flowering time
  misc_feature: Functional homolog of the protein sequence given in SEQ ID NO 13356
MEEGSKAQLPSPSHTEAMEQLAPVPMDQDEGREAAETMEEEEATAADVSDAADPMEDGEAAGDSAAAAEPMEDDAPTSSPTPSAPSATAAVDDSTIARKRRRRKKQFPGMIPTAGVRVLRGSSSSSSHTAAHLTGVPRRRGRPPTSSSLRLARELDSEALIALAAGFPADSLSEDEIVAAVLPRIGGAEQANYLVVRNHIVALWRSNPLSPVAANAALASIRAEHAPLVAAAHSFLSEHAYINFGLAPAVLSLPPQPPPSSPTPSILIVGAGLAGLAAARHLIAFGFKVAVIEGRFRPGGRVFTKTMRSSAVEYPDTVAAADLGGSVLTGINGNPLGVIARQLGFPLHKVRDKCPLYLPDGRPVDPDMDARVEAAFNQLLDKVCQLRQVIADGVPHGVDLSLGMALEAFRAAHGVAAEHEERMLLDWHLANLEYANAAPLADLSMAFWDQDDPYEMGGDHCFIPGGNSQFVRAFADGIPIFYGQNVKRIQYGRDGVMVHTDKQAFCGDMVLCTVPLGVLKKGDIKFVPELPAQKKEAIQRLGFGLLNKVVMLFPHDFWDGTIDTFGHLTEDSGQRGEFFLFYSYSSVSGGPLLIALVAGESAVKFEQASPMENVEKVLETLRKIFSPKGIDVPNPLQAICTRWGTDRFTYGSYSYVAIGASGDDYDILAESVHDRVFFAGEATNRRYPATMHGALLSGYREAANILRAVRRRAKNVNSPEKMDINVEVKVGVNGEVKDTDKDSCIDLDDLFRSPDAAFGGFSVLHDPSTFEPDSVSLLRVGIGARKLGSGSLFLYGLIMRKHVVVLAAIEGDEQRLSTMYRDFGTKLVGLDSLGDAGESLISRIKAAARK

SEQ ID NO: 8103 - DNA, 1383 bp, Sorghum bicolor
  misc_feature: Ceres ANNOT ID no. 6086697
  misc_feature: Encodes the peptide sequence at SEQ ID NO 8104
atgcgccgctactccgcgctccccaacgggggacgccaggagacgctggccgaccgcgcgcaccgctaccggggcgtcctactcgtcgtcctcgcaccgctcgcgctcgtctccctcgtcctcctcctcatgcctcgctcgccctccggcgccacgggtgtcgccaggaggtccgggcccgcgggggctgacaagtacgccgtcatcttcgacgccgggagctccggcagccgcgtccacgtcttccgcttcgactctaacctggatctcgtccacattggcagcgagatcgagctcttcgtccagaaaaaaccgggacttagcgcctacggcaacgacccccgggaagctgccgagtcgctcgtctctctccttgatgaagccaagcgagtggtgcccgtggaattgcgcgatcaaacgcctgtcagagtcggggccaccgcagggctgagaaatttgggcgcacaaaagtccgaggcgatattgcaagcggttagggaccttctccgcgaaaagagttcctttaaaaacaaagaggattgggttacagttcttgatggaacgcaggaaggcgcatacgagtgggttactatcaattatctgttgggaaacttgggaaagacttatgcagacacggttggagtagttgatcttggtggtggatctgtccaaatggcatatgctattgcagagaaggatgcagaaaaggctcctaaaccatccgatggagaagatgcatatgtgaagaaactgttcctcaaaggaaccacatattatctttatgttcatagttatttgcattacgggttgctggcagctagagcagaggtcttaaaagctggcaatggcaatggttacagcaactggcaatacaaatatggtgatgattcatttgaagcatctgcttcaccttctggtgctagttattcaaaatgcaaggatgatgcagtgaaagctcttaaagttgatgaagcatgcacccacatgaagtgttcttttggtggcatttggaatggtggtggtggtgctggacaaaagaatctctttgtagcatcctttttctttgatagggctgctgaggctggatttgtgaacgccaatgcagctgttgctaaagttaaaccctcggacttcagacaagctgccgagcgtgcttgttcgttgagcgtcaagaatgccgaggctaccttccctggtgttccaaaggataacattccatatatctgcatggaccttgtttatcaatacacgttacttgttgatggattcggcgttgatccaaaccatgagatgaccttggtaaagaaggtcccttacagtgatgcatatgttgaagctgcatggccacttggcagtgccatcgaggtggcatcttcatcatag

SEQ ID NO: 8104 - protein, 460 aa, Sorghum bicolor
  misc_feature: Ceres ANNOT ID no. 6086697
  misc_feature (57)..(461): Pfam Id: GDA1_CD39 Pfam Desc: GDA1/CD39 (nucleoside phosphatase) family
  misc_feature (11)..(459): NCBI GI: 117622284 NCBI Desc: apyrase-like protein [nicotiana tabacum]
  misc_feature (11)..(460): NCBI GI: 56692309 NCBI Desc: apyrase [vigna sinensis]
  misc_feature (12)..(460): NCBI GI: 27804684 NCBI Desc: apyrase-like protein [medicago truncatula]
  misc_feature (7)..(460): NCBI GI: 19352177 NCBI Desc: psapy2 [pisum sativum]
  misc_feature (11)..(459): NCBI GI: 23198242 NCBI Desc: apyrase [arabidopsis thaliana]
  misc_feature (66)..(459): SWISSPROT Homolog: EC 3.6.1.15 Nucleoside-triphosphatase
MRRYSALPNGGRQETLADRAHRYRGVLLVVLAPLALVSLVLLLMPRSPSGATGVARRSGPAGADKYAVIFDAGSSGSRVHVFRFDSNLDLVHIGSEIELFVQKKPGLSAYGNDPREAAESLVSLLDEAKRVVPVELRDQTPVRVGATAGLRNLGAQKSEAILQAVRDLLREKSSFKNKEDWVTVLDGTQEGAYEWVTINYLLGNLGKTYADTVGVVDLGGGSVQMAYAIAEKDAEKAPKPSDGEDAYVKKLFLKGTTYYLYVHSYLHYGLLAARAEVLKAGNGNGYSNWQYKYGDDSFEASASPSGASYSKCKDDAVKALKVDEACTHMKCSFGGIWNGGGGAGQKNLFVASFFFDRAAEAGFVNANAAVAKVKPSDFRQAAERACSLSVKNAEATFPGVPKDNIPYICMDLVYQYTLLVDGFGVDPNHEMTLVKKVPYSDAYVEAAWPLGSAIEVASSS

SEQ ID NO: 8105 - DNA, 1884 bp, Sorghum bicolor
  misc_feature: Ceres ANNOT ID no. 6086702
  misc_feature: Encodes the peptide sequence at SEQ ID NO 8106
atgaaggcgcagccgctgctaccggcggcgctcaagaggcggaggggcccgcgcgtggcggtgctggcgctcgtcctctgctccctgctcgtgcccttggccttcctcttcgaccgcgccccctcagggtacgtgacgacggaggagcggcaccggcaggaggtcgttctgcctaagttcgatcacgaggagaagaggcgtcctactggcgctgacagcggaaagcgacaggaggcgctggagaagatcatccctagaagtagatcaggagtcattcatcaacagacacccgagaagaacatttccaaaggcagtacaggtgtcattcatcaccaaacaccggagaagaacatctccaaagttcttccagcaccaaaagttgaaccatcaaaggatgtgacggattcaactaaagttgcaaaagatgctagccaagaaggtgaaaaggctgatgaagtggaaaaggcgaagtcttgtcaacttgaatttgggagttattgtctctggtccattgagcacaaagaaataatgaaagatcatatagtgaaaaggctaaaagatcaactcttcgtagcacgctcatactatccaagcattgcaaaacttcaaggacaggaagctctgactcaggaaatgaagcaaaacattcaagaccatgagaggattcttagtgtatcaacagttgatgctgatcttccatcctttatcagcaaaaggatgaagcagatggagcgaacaatagtgagagctaaatcttgcacagtagattgtaagaatgttgacaggaagcttcgccagatacttgatatgactgaggatgaagctcattttcatatgaagcagagtgcattcctctacaatctcggtgcccagacattgccgaaaagtcatcattgcctatctatgaggttgacactagaatatttcaaatcatcttcattggattctgatgattctcctggcaagttcagtagtccagaatacaggcactatgttatactatctaggaacgttcttgcggcttctgtagtgatcaactcaactgtgagcagttctaaggagccaggccaccttgcttttcatatcctaactgatgctcagaactactatgctatgaaacactggtttgccaggaattcatataaaaatgcagctacccaagtcataaactacgaagcaattattttggagaaacttccaaagtatactatccggcagctgtatttgccagaggagttccgtgttctcattaggagcattaagcagcctactgaaaacacaagaatgaaatacctgtcactgtttagccactcacatttcgttattccagaaatattcaagtatctaaacaaggtggttgtgttggatgacgatgtagttgttcagcgtgatctgtctttcttgtggaatattgatatgggggacaaggtaaatggcgctgttgaattatgtggtctgaaactgggtgaaatgaaaaatgtcttgggtaaaacagcgtatgatcccaatttgtgtgcatggatgtcaggggtgaatttgattaatttggataaatggagggagcataatgtcacagagaactatctgttgctcatgaaaaagttcaaattcaaggatgaactgtccctgcgagcagcagcatttcctctaagcttgctatccttccaacatctaatatatcccctagatgaaaaattgactctggctgggcttggatatgattatggaattgatgaagtggttgcgcggagatctgcatcattgcactacaatggcaacatgaaaccttggcttgaattaggtataccggactacaagaagtactggaagaggtttcttgtccgaggagatcgatttatggacgagtgcaacgtaaatccgtga

SEQ ID NO: 8106 - protein, 627 aa, Sorghum bicolor
  misc_feature: Ceres ANNOT ID no. 6086702
  misc_feature (299)..(601): Pfam Id: Glyco_transf_8 Pfam Desc: Glycosyl transferase family 8
  misc_feature (7)..(626): NCBI GI: 124360299 NCBI Desc: glycosyl transferase, family 8 [medicago truncatula]
  misc_feature (170)..(627): NCBI GI: 86439693 NCBI Desc: glycosyl transferase-like protein [triticum aestivum]
  misc_feature (55)..(627): NCBI GI: 124360882 NCBI Desc: glycosyl transferase, family 8 [medicago truncatula]
  misc_feature (84)..(625): NCBI GI: 52077221 NCBI Desc: glycosyl transferase family 8 protein-like [oryza sativa (japonica cultivar-group)]
  misc_feature (170)..(627): NCBI GI: 86438644 NCBI Desc: glycosyl transferase-like protein [brachypodium sylvaticum]
  misc_feature: Useful for making plants with altered cell wall content and/or composition
  misc_feature: GREAT-hit functional homolog of the protein sequence encoded by LOCUS at2g38650
  misc_feature: Useful for making plants with altered carbohydrate content
  misc_feature: Functional homolog of the protein sequence given in SEQ ID NO 13776
MKAQPLLPAALKRRRGPRVAVLALVLCSLLVPLAFLFDRAPSGYVTTEERHRQEVVLPKFDHEEKRRPTGADSGKRQEALEKIIPRSRSGVIHQQTPEKNISKGSTGVIHHQTPEKNISKVLPAPKVEPSKDVTDSTKVAKDASQEGEKADEVEKAKSCQLEFGSYCLWSIEHKEIMKDHIVKRLKDQLFVARSYYPSIAKLQGQEALTQEMKQNIQDHERILSVSTVDADLPSFISKRMKQMERTIVRAKSCTVDCKNVDRKLRQILDMTEDEAHFHMKQSAFLYNLGAQTLPKSHHCLSMRLTLEYFKSSSLDSDDSPGKFSSPEYRHYVILSRNVLAASVVINSTVSSSKEPGHLAFHILTDAQNYYAMKHWFARNSYKNAATQVINYEAIILEKLPKYTIRQLYLPEEFRVLIRSIKQPTENTRMKYLSLFSHSHFVIPEIFKYLNKVVVLDDDVVVQRDLSFLWNIDMGDKVNGAVELCGLKLGEMKNVLGKTAYDPNLCAWMSGVNLINLDKWREHNVTENYLLLMKKFKFKDELSLRAAAFPLSLLSFQHLIYPLDEKLTLAGLGYDYGIDEVVARRSASLHYNGNMKPWLELGIPDYKKYWKRFLVRGDRFMDECNVNP

SEQ ID NO: 8107 - DNA, 2706 bp, Sorghum bicolor
  misc_feature: Ceres ANNOT ID no. 6086703
  misc_feature: Encodes the peptide sequence at SEQ ID NO 8108
atggaggcggcgctgaagggctatttcggatactcaacattccggccgtaccagagggagatcattcagaaggtcctggatgggcgggattgcctcgccgtcatggccaccggtagcggcaagtccatctgctatcaaattcccccactggttacaaagaagacagctgttgttgtaagccctcttctgtccctgatgcaagaccaggttatgagtttaaaacaaaaaggtgtgaaatctgagtaccttggcagcacccaaatgaatagctctgtcagcaatgaggcggaaaagggtgcgtttgatgtgctgtatatgacaccagagaaagctatttcacttccttcaaggttttggagtaacttgcaggctgctggaatctgcttgttagctgtcgatgaagctcattgcatatcagaatggggccatgatttcaggatagagtataagcagctgcattcattgcgtgaccttcttgtggatgttccctttgttgctttaaccgccactgccacagaaagggtacgccaagatatttctacttccttggttctacgcagtcctcacgtggtggttggctcatttgatcgtcataaccttttctatggtgtgaaaacatgcaaccgatctatgtcctttgtaagtgaacttgtgaaagatgtttcaaagaagagtgctgcaggtgagtcaacaataatatattgtacgaccatccgggacacagaacaggttcatgaggctttagttacttctggaatcaaggctggaatttatcatggtcaaatgggcagcagagctagagaggaatcccatagatccttcattagggatgaagttcttgtgatggtggcaactatagcttttggaatgggtattgacaagcctgatgttagatgcgtaatacactatggatgtccaaagagcctagagtcctactaccaggaaagtggccgttgtggaagagatggactgccttcaatctgctggctatattaccaaagaagtgattttacaaaagctgatttctattgttctgaggcaaaaaatggaacccagagaaaagcaatcatggattccttcatggcagcacaaaaatattgcctccttgctacatgccgtagaaggttcttattgcagtattttggtgaagaacgcaacactgactgtggcaattgtgataattgcacagcagtgaaaaacgagagggatttgtcaaaagaagcctttttgttgctgtcctgcatcaaatcttgcggaggacgctggggcctcaatttacctattgatgttctccgtggatcacgggccaagaagattgttgacaagaattatgataaactacaaatgcatgggcgtggtaaagattattcgtcaaactggtggaaagcacttggtggtctccttatagcatacgattatttgaaggagactgttcatgatacatttagatttgtcagtgtcagtccaaaaggggtcaagtttctctctactgctgataaaatggatggagcaccactggtatttcagctgactgcagagatgattgaactagaggagcatggtagttcacaccataaagaaggtggtggtttaaatcctgtgccaacattagaagctgaaaaattttctgaggatgaatcaaaactctatcaaatgctcctgaatgttaggatgaagcttgctcaagatattggcactgctccgtatgctatatgtggtgatcagacgataagaaactttgcaaagatgagaccttctactggagctagacttgctaatatcgatggtgtcaaccagcattttatctcacgtttcagtaacattttcatccaaaatatcgcgcaattgtcgaaggagttaaacctcccattggataattcaccgttaccagcaccaccaacaaatccagctgtagaaaatattgctggtttaccaaaacccttacaaaacaatcttcctgggatcttgggtgatgcaaagctgactgcatgggaattgtggcataagcaggagtactcattcctgaaaattgcttatttccgcagagcagtgccaataaaagagcaaacggttattgcatacatacttgatgctgctcgagaaggatgtgagatggactggagtaggttttgcagggaggtagggctgacacctgatatagccaccgcgatccgtcttgccatctcaaaggttggatcacatgacaagctgaagccaatcaaagaggagctcccagagaatgtaacttatgaaatgatcaagacattcctgactattgaggggcatggattgtcagagcaagtctttggtagcggtactgctgatggggttcctagtagaagagcagagcccccaatatcttcctcccatgcaagtgaagctggcagagatgatatgggagatggtgtcccagcagcagaggctagtgatgcaaacccttcagcaaagagaggccaaaatgtttccgccgaggagccagcaacgaaactgcaaaggatagacgagcatggggcagagtcaactggcacagcgactgccactgaagagtccgtgctagctctggttgcgagctgcaatggggtatcactggaggatgttgccaagcacttcaagggatccaagagagaatcggtcttggagatattggagggcctcgaatctgaatttacaatttacaagaaaaacgggaactacatgatcctgtga

SEQ ID NO: 8108 - protein, 901 aa, Sorghum bicolor
  misc_feature: Ceres ANNOT ID no. 6086703
  misc_feature (15)..(179): Pfam Id: DEAD Pfam Desc: DEAD/DEAH box helicase
  misc_feature (247)..(323): Pfam Id: Helicase_C Pfam Desc: Helicase conserved C-terminal domain
  misc_feature (546)..(615): Pfam Id: HRDC Pfam Desc: HRDC domain
  misc_feature (11)..(173): Pfam Id: ResIII Pfam Desc: Type III restriction enzyme, res subunit
  misc_feature (1)..(477): NCBI GI: 113476788 NCBI Desc: atp-dependent dna helicase recq [trichodesmium erythraeum ims101]
  misc_feature (1)..(489): NCBI GI: 23126871 NCBI Desc: cog0514: superfamily ii dna helicase [nostoc punctiforme pcc 73102]
  misc_feature (5)..(495): NCBI GI: 52142697 NCBI Desc: atp-dependent dna helicase q [bacillus cereus zk]
  misc_feature (5)..(495): NCBI GI: 49479115 NCBI Desc: atp-dependent dna helicase (recq) [bacillus thuringiensis serovar konkukian str. 97-27]
  misc_feature (5)..(495): NCBI GI: 118478170 NCBI Desc: atp-dependent dna helicase q [bacillus thuringiensis str. al hakam]
MEAALKGYFGYSTFRPYQREIIQKVLDGRDCLAVMATGSGKSICYQIPPLVTKKTAVVVSPLLSLMQDQVMSLKQKGVKSEYLGSTQMNSSVSNEAEKGAFDVLYMTPEKAISLPSRFWSNLQAAGICLLAVDEAHCISEWGHDFRIEYKQLHSLRDLLVDVPFVALTATATERVRQDISTSLVLRSPHVVVGSFDRHNLFYGVKTCNRSMSFVSELVKDVSKKSAAGESTIIYCTTIRDTEQVHEALVTSGIKAGIYHGQMGSRAREESHRSFIRDEVLVMVATIAFGMGIDKPDVRCVIHYGCPKSLESYYQESGRCGRDGLPSICWLYYQRSDFTKADFYCSEAKNGTQRKAIMDSFMAAQKYCLLATCRRRFLLQYFGEERNTDCGNCDNCTAVKNERDLSKEAFLLLSCIKSCGGRWGLNLPIDVLRGSRAKKIVDKNYDKLQMHGRGKDYSSNWWKALGGLLIAYDYLKETVHDTFRFVSVSPKGVKFLSTADKMDGAPLVFQLTAEMIELEEHGSSHHKEGGGLNPVPTLEAEKFSEDESKLYQMLLNVRMKLAQDIGTAPYAICGDQTIRNFAKMRPSTGARLANIDGVNQHFISRFSNIFIQNIAQLSKELNLPLDNSPLPAPPTNPAVENIAGLPKPLQNNLPGILGDAKLTAWELWHKQEYSFLKIAYFRRAVPIKEQTVIAYILDAAREGCEMDWSRFCREVGLTPDIATAIRLAISKVGSHDKLKPIKEELPENVTYEMIKTFLTIEGHGLSEQVFGSGTADGVPSRRAEPPISSSHASEAGRDDMGDGVPAAEASDANPSAKRGQNVSAEEPATKLQRIDEHGAESTGTATATEESVLALVASCNGVSLEDVAKHFKGSKRESVLEILEGLESEFTIYKKNGNYMIL

SEQ ID NO: 8109 - DNA, 1911 bp, Sorghum bicolor
  misc_feature: Ceres ANNOT ID no. 6086718
  misc_feature: Encodes the peptide sequence at SEQ ID NO 8110
atggagacgacgacggcggccaggcggcggcggcggctgctgctgctcctggtcctgctggcgctcgcggcgcaccgtgcggcggcgcggttcgtggtggagaagaacagcctgcgggtcacgtccccggccgcgctccggggcgtctacgagtgcgccatcggcaacttcggcatgccgcagtacggcggcaccatgcacggcgtcgtcgtctaccccaaggtcgatgccaaggcctgcaggcccttcgacgcctccggcctctccttcaagcccaagtccggcggtctgcccgtctttctactcgtcgatcgcggagactgctacttcacaaccaagggatggaatgcacaaaatgctggagctgcagcagttcttgttgccgacgacaaagtcgagcctttgatcacaatggattctccagaatccagtggcacagagcacattgagaacatcacaattccttcggcacttgtgaccaagagatttggagacgacctcaggaaagcactgcaaaatggagaaatggtgaatgttcttctggactggagggaatctctgccccatcctgatgagcgtgtggagtatgagttctggacaaacagcaatgatgaatgcggtgctaaatgtgacatgcaaatgaacttcgtgaggagcttcagaggaatagctcaggcccttgagaaaaggggttacacccagttcacccctcactatatcacatggtattgtccagaagcttttatcctgagcaaacagtgcaagtcacaatgtatcaatcatggcagatattgcgcaccagatccagagcaggatttcagcattggatatgacggcaaagatgttgtggttcagaacctgattcaaatttgcgtgttcagagttgccaatgaaactcgcaggccgtggatgtggtgggattatgtgcacgactttgctgttaggtgcccaatgaaggagaagaaatacacacgtgaatgtgcacatggtgttatcaattcacttggattggacattgagaaaatcaacaagtgtgttggagatcctgacgccgataaagaaaatccagtcctcaaagcagaacaggatgctcaaattgggcatggttctcgcggcgatgtaactatactgccaactcttgtcgtcaataacagacaatacagaggcaaactggaaaaaagatctgtgctgaaagcagtatgctcgggatttgaggagacaaccgaacctgatgtctgtttgcgcgaagatattgagacaaatgaatgtttggagaacaatggaggttgctggttagacaaggctaccaatgtttctgcgtgcaaggataccttccgtggtcgtgtttgtgaatgccctactgtcaatggtgtaaagtttataggtgatgggtacagccactgtgaagcttctggtctcggtaggtgccagatcaacaatgggggctgctggaacgagactaggaacgggaagactgtctctgcctgctcaaatcaagaagctaaaggctgcaaatgcccatcaggtttcaggggtgacggaatgaacagttgcgaagatgtcgatgaatgcaaagagaagcttttctgccagtgcaaggattgcgcttgtgagaacacatggggaagctacgagtgcagctgcggtggcagcaattcgctatacatcagagagcatgatacctgtatcagcaaacagtctagttcgtccctgggctggggcttcctatgggtgattttcatcggccttgccttggctggagcaggagcatacgccgtgtacaaatacaggctacggagctacatggattcagagatccgtgcgatcatggcccagtacatgcccctggagagccaagagatgccgaaccaacatcgctctgtcgtccccgtcgaccacgcagacatctga

SEQ ID NO: 8110 - protein, 636 aa, Sorghum bicolor
  misc_feature: Ceres ANNOT ID no. 6086718
  misc_feature (61)..(171): Pfam Id: PA Pfam Desc: PA domain
  misc_feature (16)..(628): NCBI GI: 8886326 NCBI Desc: vacuolar targeting receptor bp-80 [triticum aestivum]
  misc_feature (30)..(620): NCBI GI: 83284015 NCBI Desc: vacuolar sorting receptor protein pv72-like protein [solanum tuberosum]
  misc_feature (30)..(625): NCBI GI: 7484768 NCBI Desc: vacuolar sorting receptor protein homolog pv72 - cucurbit
  misc_feature (30)..(625): NCBI GI: 2943792 NCBI Desc: pv72 [cucurbita cv. kurokawa amakuri]
  misc_feature (12)..(623): NCBI GI: 1737218 NCBI Desc: vacuolar sorting receptor homolog [arabidopsis thaliana]
METTTAARRRRRLLLLLVLLALAAHRAAARFVVEKNSLRVTSPAALRGVYECAIGNFGMPQYGGTMHGVVVYPKVDAKACRPFDASGLSFKPKSGGLPVFLLVDRGDCYFTTKGWNAQNAGAAAVLVADDKVEPLITMDSPESSGTEHIENITIPSALVTKRFGDDLRKALQNGEMVNVLLDWRESLPHPDERVEYEFWTNSNDECGAKCDMQMNFVRSFRGIAQALEKRGYTQFTPHYITWYCPEAFILSKQCKSQCINHGRYCAPDPEQDFSIGYDGKDVVVQNLIQICVFRVANETRRPWMWWDYVHDFAVRCPMKEKKYTRECAHGVINSLGLDIEKINKCVGDPDADKENPVLKAEQDAQIGHGSRGDVTILPTLVVNNRQYRGKLEKRSVLKAVCSGFEETTEPDVCLREDIETNECLENNGGCWLDKATNVSACKDTFRGRVCECPTVNGVKFIGDGYSHCEASGLGRCQINNGGCWNETRNGKTVSACSNQEAKGCKCPSGFRGDGMNSCEDVDECKEKLFCQCKDCACENTWGSYECSCGGSNSLYIREHDTCISKQSSSSLGWGFLWVIFIGLALAGAGAYAVYKYRLRSYMDSEIRAIMAQYMPLESQEMPNQHRSVVPVDHADI

SEQ ID NO: 8111 - DNA, 2874 bp, Sorghum bicolor
  misc_feature: Ceres ANNOT ID no. 6086720
  misc_feature: Encodes the peptide sequence at SEQ ID NO 8112
atggctatgccgggtggcggcgcggtggcggccaagaggtgcatgaacccggcctgcggtgggccggcgtcgtccgtggtcggggcgggaggggactggaggaagggctggccgctgcgatccggaggcttcgccttgctctgcgacaagtgcgggttggcatatgaacagtttgtgttttgtgatatatttcaccaaaaggaatcaggatggagagactgctcattttgtgggaagcgcctccattgtggatgtgttgcctcaaagaactcatatgatctacttgacagtggaggagttcaatgtgtcacttgcatgaaaaattcagcagctcagtctgcttctggccaagtggttccaaagcttttccaatgtccaaataatctgcggtttttgggtaaaaccgatgagttattgtcaagtagaaaatttgaacaaccaccctctcttatgttggattccagaaatgatgatattgctattgtaaataagagcaatcacctgttcatggtaagaggcatagaggctggacaaagcagtaacatcttgagacaaaaagagatagagaatggttcaaggcagattaaatgggaacaaccaacccttagtattggggacatgggaaggcctttcctaactaggtctcaaagtgcattagagtcacctcaatgtactcgaagagatgacaataaggatccaactacagatagcacaagtgaatcgttttcagaggcatgtctgagcatgagcctaggtattgcaagcaatggaaacaggatggaggctacttcaacagcggaaagacctatgctatcgccaacaacagccattgctgaaggaagagaacttgccactacactatctccctatcagcacgcacaaagggctcggcatttcttgaccagaccaccaagggttggtgaaggtgctgcttttgatccaacgagagacatgtttccgcatcttcgtgttgctagaccgcctgctgagggaaggggccgcaatcaattacttcctcggtattggccaagaataacagaccaagagctgcaacaaatatctggagattcaaattccacaatcgttccattgttcgagaaggtcctgagtgcgagtgatgcaggccgcatagggcgccttgttcttccaaaagcttgtgctgaggcatatttccccccaatttctcaaccagaaggtcgccccttgacaatccaagatgcaagaggaaaagaatggcattttcagtttaggttttggccaaataataacagcagaatgtacgtcttggagggtgttacaccatgcatacagtctttgcaactacaagctggcgatacagtgacctttagtcgtatagatcctggagggaaacttgttatgggctttcggaaggccacaaatactgttagtctgccagactcacagatttcggctattgcaaatggttccattctcagtgagacactcttttctactgcaaatgagaacataggagtagtaagtggttatcctggatttcttcactcaataaagggagctgcagatctccatccaagctctctatatgatcatcatatgaactcagctgatggggatgtcagttggaataaggcagataaatttggcggcaggccagatgaggggtctttgcaatttttacaaaaacgtagtcgcaatattggttccaaaagcaggaggttcttaatcgatgctgaagatgccatggaactaaagcttacctgggaagaggctcaagagttgttgcgccctgctcccactgcaaagccaactgttgtgatgattgaggactatgaatttgaagaatatgatgaaccccctgtctttgcaaagagatcaattttcaccatccgtgcaacaggggaacaagatcagtggattcaatgtgatgagtgctcaaaatggcgtcggttgcctcttaatgttattgttgcatccaaatggacatgcaccgacaactcatgggacccaaaaagctgctcctgctctgcgcctgaagagttgaccccgaaagagttgcaaagtgttatgcagcagtatgaagaaatgaggaggcgaaagggcagctatggtctgaagctgaatgtcgctgaaatggatgcatccagccttgacgccttggccactgctgcagtatttggtgaagtcgggaaccaaggcaccgcttcagtcgcgacaaccacaaagcacccccggcatcgccctggctgcacatgcattgtgtgcatccagccgcccagtggcaagggcccgaagcacaacccttcgtgcacctgcaacgtgtgcatgacagtcaggcgtcggttcaagacactgatgatgaggaagaagcagcggcagtcggagcgagaggaggcagaggcgagcaagaagatcacatgggtgaacagagaagagcctgaggggagcaacctgtcaagatccccgcagacgctggacaccacccgagacaacagtgatgtgaccatgtttgacaaggtggccgacatgaacaaggggcacatcgacctcaacttccaccctgcccctgccgcccgtggcgatcatggacagcatggcgtgcagcagccccggccggtgagcatgatgggcctcttggaagtggcgagccggccccttgataactatatgaagcagaacggcctgacgagcctggtgggggagcaaggaggtggcagctccagcacggccacggtcccgccaggtccggtggagagtgaggagcggacgtccaacgagggccgcgtcacatcagcatcagcagagcgggaaccggacgccatggccattgacgaggctggcgagaaccagcaggacaaggctgccgacgatgctgctgctcctgctgctacttga

SEQ ID NO: 8112 - protein, 957 aa, Sorghum bicolor
  misc_feature: Ceres ANNOT ID no. 6086720
  misc_feature (364)..(467): Pfam Id: B3 Pfam Desc: B3 DNA binding domain
  misc_feature (630)..(675): Pfam Id: zf-CW Pfam Desc: CW-type Zinc Finger
  misc_feature (1)..(956): NCBI GI: 34394741 NCBI Desc: vp1/abi3 family regulatory protein-like [oryza sativa (japonica cultivar-group)]
  misc_feature (511)..(807): NCBI GI: 42567319 NCBI Desc: transcriptional factor b3 family protein [arabidopsis thaliana]
  misc_feature (262)..(617): NCBI GI: 140054214 NCBI Desc: transcriptional factor b3 [medicago truncatula]
  misc_feature (4)..(847): NCBI GI: 23617202 NCBI Desc: vp1/abi3 family regulatory protein-like protein [oryza sativa (japonica cultivar-group)]
  misc_feature (346)..(653): NCBI GI: 115472793 NCBI Desc: os07g0563300 [oryza sativa (japonica cultivar-group)]
  misc_feature: Abnormal phyllotaxy, leaf number higher than wild-type
  misc_feature: The plant flowers significantly late compared to wild-type.
  misc_feature: The plant is abnormally small.
  misc_feature: The sequence is a functional homolog of SEQ ID NO 2384 in the 10/374,780US patent application
  misc_feature: The sequence is a functional homolog of SEQ ID NO 42 in the 10/838,616US patent application
  misc_feature: The sequence is a functional homolog of SEQ ID NO 44 in the 10/838,616US patent application
  misc_feature: The sequence is a functional homolog of SEQ ID NO 46 in the 10/838,616US patent application
  misc_feature: The sequence is a functional homolog of SEQ ID NO 810 in the 10/225,066US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12891
  misc_feature: The sequence is a functional homolog of SEQ ID NO 810 in the 20050160493 US patent application
  misc_feature: The sequence is a functional homolog of SEQ ID NO 42 in the 20060008874 US patent application
  misc_feature: The sequence is a functional homolog of SEQ ID NO 44 in the 20060008874 US patent application
  misc_feature: The sequence is a functional homolog of SEQ ID NO 46 in the 20060008874 US patent application
MAMPGGGAVAAKRCMNPACGGPASSVVGAGGDWRKGWPLRSGGFALLCDKCGLAYEQFVFCDIFHQKESGWRDCSFCGKRLHCGCVASKNSYDLLDSGGVQCVTCMKNSAAQSASGQVVPKLFQCPNNLRFLGKTDELLSSRKFEQPPSLMLDSRNDDIAIVNKSNHLFMVRGIEAGQSSNILRQKEIENGSRQIKWEQPTLSIGDMGRPFLTRSQSALESPQCTRRDDNKDPTTDSTSESFSEACLSMSLGIASNGNRMEATSTAERPMLSPTTAIAEGRELATTLSPYQHAQRARHFLTRPPRVGEGAAFDPTRDMFPHLRVARPPAEGRGRNQLLPRYWPRITDQELQQISGDSNSTIVPLFEKVLSASDAGRIGRLVLPKACAEAYFPPISQPEGRPLTIQDARGKEWHFQFRFWPNNNSRMYVLEGVTPCIQSLQLQAGDTVTFSRIDPGGKLVMGFRKATNTVSLPDSQISAIANGSILSETLFSTANENIGVVSGYPGFLHSIKGAADLHPSSLYDHHMNSADGDVSWNKADKFGGRPDEGSLQFLQKRSRNIGSKSRRFLIDAEDAMELKLTWEEAQELLRPAPTAKPTVVMIEDYEFEEYDEPPVFAKRSIFTIRATGEQDQWIQCDECSKWRRLPLNVIVASKWTCTDNSWDPKSCSCSAPEELTPKELQSVMQQYEEMRRRKGSYGLKLNVAEMDASSLDALATAAVFGEVGNQGTASVATTTKHPRHRPGCTCIVCIQPPSGKGPKHNPSCTCNVCMTVRRRFKTLMMRKKQRQSEREEAEASKKITWVNREEPEGSNLSRSPQTLDTTRDNSDVTMFDKVADMNKGHIDLNFHPAPAARGDHGQHGVQQPRPVSMMGLLEVASRPLDNYMKQNGLTSLVGEQGGGSSSTATVPPGPVESEERTSNEGRVTSASAEREPDAMAIDEAGENQQDKAADDAAAPAAT

SEQ ID NO: 8113 - DNA, 1125 bp, Sorghum bicolor
  misc_feature: Ceres ANNOT ID no. 6086721
  misc_feature: Encodes the peptide sequence at SEQ ID NO 8114
atggcgatgccgccgaagcccggcgacccgccgcagcgctcgccggggcggagccccaacctcaacctgccctgcccgctgccgccggtcccgggcggggcgcttgcgccgccgccgcagcaccagccgggcgccgggctgcccccgccgcgcgtgggccaccaccgccgtgccagatctgaggtggccttccgcttcccggacgacctggccggcgccggggccggcggcttcgatgagatcggctccgaggacgacctcttctccaccttcatggacatggacaagatcgccggtgccgaccgcgaccgcgccgccgagacctcctcgccgccgcgcccagccaagcaccgccacagcgcctccttcgacggcttcgggatgggggccggcgccggcggcccgggcgggcagcaggacggcggcggaggcgtgttcggagaggtcatggaggccaagaaggccatgtcatccgagcagctcgctgagctcgctgctatcgaccccaagcgcgccaaaagaattattgcaaatagacaatctgcagcacggtcaaaggaaagaaaagctcgatatataacagaattggagcggaaggttcaaactcttcagacagaggctactactctttcagcgcagctaacactgttccagagagacacaactggactttcggcggaaaatgctgagctcaagataaggttgcaggccatggagcagcaggctcaactgcgtgatgctctaaatgatgcactgaagcaggaagtggagaggcttaagatagcaacaggtgagatgtcgaagtccaatgaacaatttaatatgggaatgcagcacatctcgtacagcccttcattcttccagctctcagagcaacacacagttcagcagcatggaaatattcagctgccacatcatttccaacagccgccaccgaatgtcccgagtcaccagatgctatcccaccccaattccctctcggatatgatgcagcaagactcgcttgggcggctccaggggctggacatcggaaaaggttcgatggctgtgaagtcagaggcagaggtcgtggtgaagtcggagggtagctctatatctgcaggtgaaagcaataccaccttctag

SEQ ID NO: 8114 - protein, 374 aa, Sorghum bicolor
  misc_feature: Ceres ANNOT ID no. 6086721
  misc_feature (166)..(229): Pfam Id: bZIP_1 Pfam Desc: bZIP transcription factor
  misc_feature (166)..(220): Pfam Id: bZIP_2 Pfam Desc: Basic region leucine zipper
  misc_feature (56)..(374): NCBI GI: 115474085 NCBI Desc: os07g0679500 [oryza sativa (japonica cultivar-group)]
  misc_feature (39)..(374): NCBI GI: 68565757 NCBI Desc: transcription factor rf2b
  misc_feature (39)..(374): NCBI GI: 39579226 NCBI Desc: bzip transcription factor rf2b [oryza sativa (japonica cultivar-group)]
  misc_feature (3)..(374): NCBI GI: 92898302 NCBI Desc: camp response element binding (creb) protein [medicago truncatula]
  misc_feature (7)..(374): NCBI GI: 56384580 NCBI Desc: at-rich element binding factor 1 [pisum sativum]
  misc_feature: Useful for making plants with altered cell wall content and/or composition
  misc_feature: Functional homolog of the protein sequence encoded by LOCUS at1g06850
  misc_feature: The sequence is a functional homolog of SEQ ID NO 1046 in the 10/225,066 US patent application
  misc_feature: The sequence is a functional homolog of SEQ ID NO 2388 in the 10/374,780 US patent application
  misc_feature: The sequence is a functional homolog of SEQ ID NO 412 in the 10/412,699 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MAMPPKPGDPPQRSPGRSPNLNLPCPLPPVPGGALAPPPQHQPGAGLPPPRVGHHRRARSEVAFRFPDDLAGAGAGGFDEIGSEDDLFSTFMDMDKIAGADRDRAAETSSPPRPAKHRHSASFDGFGMGAGAGGPGGQQDGGGGVFGEVMEAKKAMSSEQLAELAAIDPKRAKRIIANRQSAARSKERKARYITELERKVQTLQTEATTLSAQLTLFQRDTTGLSAENAELKIRLQAMEQQAQLRDALNDALKQEVERLKIATGEMSKSNEQFNMGMQHISYSPSFFQLSEQHTVQQHGNIQLPHHFQQPPPNVPSHQMLSHPNSLSDMMQQDSLGRLQGLDIGKGSMAVKSEAEVVVKSEGSSISAGESNTTF

SEQ ID NO: 8115 - DNA, 1239 bp, Sorghum bicolor
  misc_feature: Ceres ANNOT ID no. 6086730
  misc_feature: Encodes the peptide sequence at SEQ ID NO 8116
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
atggaggcgccggctcgcctccccatctccctcctcgtcgtctccgccctcctcctcctcctctcggctcagggaccggcgggagcggcggcggcggccgtgccgccgcgaatccagccgctcgctaccgccgcgctgcgccgcctctacgacacctccaactacggcaggctgcagctcaacaacggcctcgcgctcactccgcagatggggtggaacagctggaatttcttcgcttgcaacatcaatgagacggtcatccgcgagacagatgattgctggtcatacgtgaaacgaggaaagcaggaccaattgctgcctgatccgaagactttcccttcaggcatcaaagcccttgcagattatgtgcatggaaaaggtctgaaacttggtatatactctgatgctgggaaatttacttgccaagttcgacctggatcactcgatcatgaaagtgacgatgctgcgatctttgcttcatggggtgttgattacctgaagtatgacaactgctacaatttgggaataaagccacagaaaagatatcctcctatgcgagatgctcttaactcaactgggcgccaaatcttctactctttgtgtgaatggggccaggatgatccagccttatgggctggcaaagtgggcaatagttggcgtacaactgatgacataacggatacatggcaaagcatgacagacattgctgataagaacaacaagtgggcgtcatatgctggacctggtggttggaatgacccagatatgttggaagtaggcaatggtggcatgacctcagcagagtatcgctcacattttagcatctgggctctcatgaaggcccctttattaattggctgtgatgtcagaaacatgacttctgaaacaatggaaatattgagcaacaaagaagtaattcaagtaaaccaagatcctcttggagttcaaggaagaaaaattttaggagaaggaaaatatggatgccgtgaggtgtgggctggtcccctgtctggaaatcggcttgttattgctctatggaaccgttgttctgagactgctaatattacaatgaaactgccagcggtaggccttgatggatcagctgcctattctgttagggatctgtggaagcatgaaacgctatcagaaaatgtggtaggaacttttggcgctcaagttgacgtgcatgacaccaagatgtacatcttttctcctgcaaccagtgtcgcttcaatttga

SEQ ID NO: 8116 - protein, 412 aa, Sorghum bicolor
  misc_feature: Ceres ANNOT ID no. 6086730
  misc_feature (40)..(349): Pfam Id: Melibiase Pfam Desc: Melibiase
  misc_feature (91)..(407): NCBI GI: 7572929 NCBI Desc: alpha-galactosidase-like protein [arabidopsis thaliana]
  misc_feature (91)..(411): NCBI GI: 52699549 NCBI Desc: glycosyl hydrolase family-like protein [salvia miltiorrhiza]
  misc_feature (91)..(405): NCBI GI: 504489 NCBI Desc: alpha-galactosidase
  misc_feature (91)..(405): NCBI GI: 86278368 NCBI Desc: acid alpha galactosidase 2 [cucumis sativus]
  misc_feature (91)..(405): NCBI GI: 60417424 NCBI Desc: alpha galactosidase [coffea arabica]
  misc_feature (91)..(405): SWISSPROT Homolog: EC 3.2.1.22 Alpha-galactosidase precursor
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MEAPARLPISLLVVSALLLLLSAQGPAGAAAAAVPPRIQPLATAALRRLYDTSNYGRLQLNNGLALTPQMGWNSWNFFACNINETVIRETDDCWSYVKRGKQDQLLPDPKTFPSGIKALADYVHGKGLKLGIYSDAGKFTCQVRPGSLDHESDDAAIFASWGVDYLKYDNCYNLGIKPQKRYPPMRDALNSTGRQIFYSLCEWGQDDPALWAGKVGNSWRTTDDITDTWQSMTDIADKNNKWASYAGPGGWNDPDMLEVGNGGMTSAEYRSHFSIWALMKAPLLIGCDVRNMTSETMEILSNKEVIQVNQDPLGVQGRKILGEGKYGCREVWAGPLSGNRLVIALWNRCSETANITMKLPAVGLDGSAAYSVRDLWKHETLSENVVGTFGAQVDVHDTKMYIFSPATSVASI

SEQ ID NO: 8117 - DNA, 2379 bp, Sorghum bicolor
  misc_feature: Ceres ANNOT ID no. 6086737
  misc_feature: Encodes the peptide sequence at SEQ ID NO 8118
atggatcccgagttcggcgtcggcacggcgccacgaaagagggaggcatggcggacgacgctgctgctggcgtaccagagccttggcgtggtgtacggcgacctcagcatctcgccgctgtacgtgtacaagagcaccttcgccgaggacatcacgcactcggagggcaacgaggagatctacggcgccctctccttcgtcttctggacgctcaccctcatcccgctcctcaagtacgtcaccatcgtcctgcgcgcccacgacaacggcgaaggtggcaccttcgccctctactccctcatctgccgccacgccaatgtctgcctcctccccaaccgccagctcgccgaccaggacctctccacctacagcctccagcgcccgcacgacgccgccgggacctgtgcaccctcaccagtcaaggcctggctcgagaaccacaccaaactgcacaccgcgctgctcgtcatggtcatgatcggaacatgcatggtcatcggcgacggcgtcctcacccccgccatctccgtcttctccgccgtctcagggctcgagctctccttgtccaaggatcagcatgaatatgccgtcattccgataacatgcgccatactagtattcctgtttgcgctccagcactacggcacccaccgcgtagggttcctcttcgcgcccatcatcctcgcctggctgctctgcatgagcaccatcggcctgtacaacatcatccgctggaatccccagatctacacggcgctcaacccctcctacatgatccgattcctcaggaagaccaagaagtctggctggatgtccctgggaggaattctgctgtgcatgacaggatccgaagcaatgttcgccgatcttggacacttctcctacagctcgatccagcttgccttcacttctttagtgtacccttcactgatcctgggatacatgggccaagctgcttatttgtcccagcaccataaccttgacgcaagctaccaaatcggattctacattgcagttcctgagagtgtaaggtggcctgtgctagtgctggcgatcttggcatctgtggtcggcagccaagcgatcatcagcggcacgttctccatcatcaaccagagccagtctctgagttgcttccccagggtgaaagttgtgcacacgtctgacaaagttcatggccagatatacatcccggaggtcaactggatcctcatgatcctctgcgttgctgtcactgttggtttccgtaacaccaagcacatgggaaatgcatctggcctggccgtgatcacggtgatgctggtgacgacgtgcctcatgtccctggtgatcatgctgtgctgggaccgatccccatggctggcgctcgccttcttcctcttcttcggctccatcgaggcgctctacttctcggcgtcgctgatcaagttcctggaaggcgcgtggctgccgatcttcctggcactcatcctgctcgccatcatgttcgtgtggcactacaccacgatcaggaagtacgagtacgacatgcacaacaaggtgaccctggagtggctgctggcgctgggcgacaagctaggcatggtgcgcgtcccgggcatcggcctcgtctacaccgacctcacctccggcgtgccggccaacttctcccgcttcgtcaccaacctgccggcgttccaccgggtgctggtctttgtctgcgtcaagtccgtgacggtgccgcacgtgctccccgccgagcgctacctggtcggccgcgtcggcccgccgggccaccgctcctaccgctgcatcgtgcgctacggctaccgcgacgtgcaccaggacgtggactccttcgagacggagctcgtcgagagcctcgccacgttcatcaagctggacgcgctgttccgctgcagcgacgccggcggcgagcagcgggacagcagctactacgagcgcgagaacgcgctgacggtcatcgggagcaacccgctgcggcgccacatgagcctgggctacgacgactcccactcccacgacgacggcgcgtcgtctgactctgacagcgtggacggcatagagctcgcggcgtcggcgccggctccggcggccgtcaagaagcaggtgaggttcgcggtgccgccgcccaggagccccggggtggacgagagcgtgctggaggagctgcacgagctgtgcgaggcgcgggaggccggcacggcgttcatcctggggcactcgcacgtgaagaccaagcccgggtcgtcgttgctcaagaggctggccgtcggcgtcggctacaacttcctgcgccggaactgccgcggcccggacgtggcgctgcgcgtgccgccggcgtcgctgctcgaggtgggcatggtgtacgtgctgtga

SEQ ID NO: 8118 - protein, 792 aa, Sorghum bicolor
  misc_feature: Ceres ANNOT ID no. 6086737
  misc_feature (22)..(792): Pfam Id: K_trans Pfam Desc: K+ potassium transporter
  misc_feature (1)..(792): NCBI GI: 91204712 NCBI Desc: potassium transporter [phragmites australis]
  misc_feature (1)..(792): NCBI GI: 91204708 NCBI Desc: potassium transporter [phragmites australis]
  misc_feature (1)..(792): NCBI GI: 91204710 NCBI Desc: potassium transporter [phragmites australis]
  misc_feature (1)..(792): NCBI GI: 75232649 NCBI Desc: probable potassium transporter 9 (oshak9)
  misc_feature (1)..(792): NCBI GI: 93115181 NCBI Desc: kup2 [vitis vinifera]
  misc_feature: Useful for making plants with modulated biomass
  misc_feature: Functional homolog of the protein sequence given in SEQ ID NO 13565
  misc_feature: The sequence is a functional homolog of SEQ ID NO. 279 in the 11/188,298 US application
MDPEFGVGTAPRKREAWRTTLLLAYQSLGVVYGDLSISPLYVYKSTFAEDITHSEGNEEIYGALSFVFWTLTLIPLLKYVTIVLRAHDNGEGGTFALYSLICRHANVCLLPNRQLADQDLSTYSLQRPHDAAGTCAPSPVKAWLENHTKLHTALLVMVMIGTCMVIGDGVLTPAISVFSAVSGLELSLSKDQHEYAVIPITCAILVFLFALQHYGTHRVGFLFAPIILAWLLCMSTIGLYNIIRWNPQIYTALNPSYMIRFLRKTKKSGWMSLGGILLCMTGSEAMFADLGHFSYSSIQLAFTSLVYPSLILGYMGQAAYLSQHHNLDASYQIGFYIAVPESVRWPVLVLAILASVVGSQAIISGTFSIINQSQSLSCFPRVKVVHTSDKVHGQIYIPEVNWILMILCVAVTVGFRNTKHMGNASGLAVITVMLVTTCLMSLVIMLCWDRSPWLALAFFLFFGSIEALYFSASLIKFLEGAWLPIFLALILLAIMFVWHYTTIRKYEYDMHNKVTLEWLLALGDKLGMVRVPGIGLVYTDLTSGVPANFSRFVTNLPAFHRVLVFVCVKSVTVPHVLPAERYLVGRVGPPGHRSYRCIVRYGYRDVHQDVDSFETELVESLATFIKLDALFRCSDAGGEQRDSSYYERENALTVIGSNPLRRHMSLGYDDSHSHDDGASSDSDSVDGIELAASAPAPAAVKKQVRFAVPPPRSPGVDESVLEELHELCEAREAGTAFILGHSHVKTKPGSSLLKRLAVGVGYNFLRRNCRGPDVALRVPPASLLEVGMVYVL

SEQ ID NO: 8119 - DNA, 960 bp, Sorghum bicolor
  misc_feature: Ceres ANNOT ID no. 6086750
  misc_feature: Encodes the peptide sequence at SEQ ID NO 8120
atggcgtcttcttcggtgtcagccttgctgctctttctgtgcttggccgcggtggcgtcagcgcagctctcgccgacgttttacgacacgtcgtgccccaacgcgctgtccaccatcaagagcgccgtgaacgccgccgtgcagaaggagaaccgcatgggggcctccttgctcaggctgcacttccacgactgctttgtccaggggtgcgacgcgtcggtgctgctggccgacaacgccgccacgggcttcaccggcgagcagggggcgttacccaacgcggggtctctgaggggcttcgacgtcatcgccaacatcaagacgcaggtggaggccatctgcaagcagaccgtctcctgtgccgacatcctcgccgtcgccgcccgggactctgtcgtcgcgttgggagggccgtcatggacggttcctctgggtcggagagactcgacgacggcgagcctgtccctggcgaacagcgacctgccgccgccctccttcaacctcgaacagctcataaaagcgttcggcaacaagggtttcaccgcgacggagatggccacgctctctggcgcgcacaccatcgggcaggcgcagtgccagttcttcagggatcacatctacaacgacaccaacatcaactccgcgttcgcgacctcgctcaaggccaactgcccccgttccaccggctccggcgacggcaacctggcgccgctcgacaccaccacgccgtacaagttcgacaacgcctactacagcaacctactgaaccagaaggggctcctgcactcggaccaagagctcttcaatggcggcagcaccgacaacaccgtcaggaacttcgcgtccaactcggcggccttcagcagcgccttcgccgcggccatggtgaagatgggcaacctcagcccgctcaccggctcccagggccagatcagactcacctgctccaaagtgaactaa

SEQ ID NO: 8120 - protein, 319 aa, Sorghum bicolor
  misc_feature: Ceres ANNOT ID no. 6086750
  misc_feature (39)..(283): Pfam Id: peroxidase Pfam Desc: Peroxidase
  misc_feature (3)..(319): NCBI GI: 520570 NCBI Desc: peroxidase
  misc_feature (3)..(319): NCBI GI: 34393250 NCBI Desc: peroxidase [oryza sativa (japonica cultivar-group)]
  misc_feature (3)..(319): NCBI GI: 2429288 NCBI Desc: peroxidase [oryza sativa]
  misc_feature (1)..(319): NCBI GI: 57635153 NCBI Desc: peroxidase 4 [triticum monococcum]
  misc_feature (3)..(319): NCBI GI: 55701087 NCBI Desc: tpa: class iii peroxidase 110 precursor [oryza sativa (japonica cultivar-group)]
  misc_feature (1)..(319): SWISSPROT Homolog: EC 1.11.1.7 Peroxidase 2 precursor
  misc_feature: Useful for making plants with altered cell wall content and/or composition
  misc_feature: Functional homolog of the protein sequence encoded by LOCUS at5g05340
  misc_feature: Useful for making plants with altered carbohydrate content
  misc_feature: Functional homolog of the protein sequence given in SEQ ID NO 13662
  misc_feature: Useful for making plants with altered cell wall content and/or composition
  misc_feature: Functional homolog of the protein sequence given in SEQ ID NO 13605
MASSSVSALLLFLCLAAVASAQLSPTFYDTSCPNALSTIKSAVNAAVQKENRMGASLLRLHFHDCFVQGCDASVLLADNAATGFTGEQGALPNAGSLRGFDVIANIKTQVEAICKQTVSCADILAVAARDSVVALGGPSWTVPLGRRDSTTASLSLANSDLPPPSFNLEQLIKAFGNKGFTATEMATLSGAHTIGQAQCQFFRDHIYNDTNINSAFATSLKANCPRSTGSGDGNLAPLDTTTPYKFDNAYYSNLLNQKGLLHSDQELFNGGSTDNTVRNFASNSAAFSSAFAAAMVKMGNLSPLTGSQGQIRLTCSKVN

SEQ ID NO: 8121 - DNA, 957 bp, Sorghum bicolor
  misc_feature: Ceres ANNOT ID no. 6086754
  misc_feature: Encodes the peptide sequence at SEQ ID NO 8122
atggcggctgcttcttccttgtcagtgctggtgctcttgtgcctagcagcggtggcctcggcgcaactgtcggcgacattctactccaggtcgtgtcccagagctctggctaccatcaagtccgccgtgacggccgcggttgcacaggagcctcgcatgggggcctccctgctcaggctccacttccatgactgctttgtccaaggctgcgatgcgtcggtgctgctgaacgacacggccaccttcaccggcgagcagaccgctaacccgaacgtcgggtccatcagaggcttcggcgtcgtcgacaacatcaaggcgcaggtggaggccgtgtgcccgggggtcgtctcctgcgccgacatccttgccgtcgccgcccgagactccgtcgtcgcgctgggagggccttcgtggagggtacttctggggcggagggactcgacgacggcgagcttagctctggccaacagcgacctgccagcgccgtccctggacctcgccaacctcaccgccgcgttcgccaagaagcggctcagcaggacggacctggttgctctctcaggggcgcacacgatcgggctgtcgcagtgcaagaacttccgggcgcacatatacaacgacaccaacgtgaacgtggcgttcgcgacgctgcgcaaggtcagctgccccgcggcggccggcgacggcgacggcaacctgacgccgctggacaccgcaacgtccaccgcgttcgacaacgcctactacaccaacctgctgtcccggagcgggttgctgcactccgaccagcagctgttcaacggcggcggcgccacggacggactggtccgcacgtacgcgtccacgccgacgaggttcaacagggacttcacggcggccatgatcaggatgggcaacatcagcccgctcactgggaggcagggccagatcaggcgcgcctgctccagggtcaactag

SEQ ID NO: 8122 - protein, 318 aa, Sorghum bicolor
  misc_feature: Ceres ANNOT ID no. 6086754
  misc_feature (39)..(282): Pfam Id: peroxidase Pfam Desc: Peroxidase
  misc_feature (1)..(318): NCBI GI: 125657560 NCBI Desc: plasma membrane-bound peroxidase 2b [zea mays]
  misc_feature (1)..(318): NCBI GI: 115474055 NCBI Desc: os07g0676900 [oryza sativa (japonica cultivar-group)]
  misc_feature (4)..(318): NCBI GI: 55701085 NCBI Desc: tpa: class iii peroxidase 109 precursor [oryza sativa (japonica cultivar-group)]
  misc_feature (1)..(318): NCBI GI: 732976 NCBI Desc: peroxidase [triticum aestivum]
  misc_feature (4)..(318): NCBI GI: 34393250 NCBI Desc: peroxidase [oryza sativa (japonica cultivar-group)]
  misc_feature (1)..(318): SWISSPROT Homolog: EC 1.11.1.7 Peroxidase 2 precursor
  misc_feature: Useful for making plants with altered cell wall content and/or composition
  misc_feature: Functional homolog of the protein sequence encoded by LOCUS at5g05340
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
MAAASSLSVLVLLCLAAVASAQLSATFYSRSCPRALATIKSAVTAAVAQEPRMGASLLRLHFHDCFVQGCDASVLLNDTATFTGEQTANPNVGSIRGFGVVDNIKAQVEAVCPGVVSCADILAVAARDSVVALGGPSWRVLLGRRDSTTASLALANSDLPAPSLDLANLTAAFAKKRLSRTDLVALSGAHTIGLSQCKNFRAHIYNDTNVNVAFATLRKVSCPAAAGDGDGNLTPLDTATSTAFDNAYYTNLLSRSGLLHSDQQLFNGGGATDGLVRTYASTPTRFNRDFTAAMIRMGNISPLTGRQGQIRRACSRVN

SEQ ID NO: 8123 - DNA, 705 bp, Sorghum bicolor
  misc_feature: Ceres ANNOT ID no. 6086771
  misc_feature: Encodes the peptide sequence at SEQ ID NO 8124
atgtgtggcggcgccatcatctccgagttcatcccgcagcgcgacagcgccgctgcccgcgccggccacggcaagcgcggcctcgtctgcgccgacgacttctggccgccgcacgccgccgacttcgacgacttcgccgccgccgccgccgcctccttccatcccgaccaagagccgccggccaggaagcgggagcgcaagaccatgtaccgcggcatccggcgccggccctggggcaagtgggcggcggagatccgtgaccccgccaagggcgcccgcgtctggctcggcaccttcgccaccgccgaggccgccgcgcgcgcctacgaccgcgccgcgcggcgcatccgcggggccaaggccaaggtcaacttccccaacgaggacccgccgcccgactacgacgacgacgaccacgccggcgccgcgcaggggatgctcgccatgtcctgcgccggcggcggcggtggcagggaccacctcgtcgactacgacgtcgacgtcatgggcatgggcatggggacgacgttcttccagcaccacccgcagccgtcgtacgtgtccgacgccgtcaccgtggcgcagcaggagcaggtgcccacggtcgcgtacgtgcaccaccaccagctgccgccgccgcaggacgacgccgcggggatggacatgtggacgttcgacggcatcaacacagccgtgcccatgtga

SEQ ID NO: 8124 - protein, 234 aa, Sorghum bicolor
  misc_feature: Ceres ANNOT ID no. 6086771
  misc_feature (68)..(119): Pfam Id: AP2 Pfam Desc: AP2 domain
  misc_feature (1)..(143): NCBI GI: 50509812 NCBI Desc: ap2 domain transcription factor erebp [oryza sativa (japonica cultivar-group)]
  misc_feature (1)..(143): NCBI GI: 31745667 NCBI Desc: ap2 domain transcription factor erebp [oryza sativa (japonica cultivar-group)]
  misc_feature (1)..(136): NCBI GI: 42561972 NCBI Desc: ethylene-responsive factor-like protein 1 [capsicum annuum]
  misc_feature (59)..(129): NCBI GI: 41353548 NCBI Desc: erf-like transcription factor [coffea canephora]
  misc_feature (47)..(130): NCBI GI: 62526569 NCBI Desc: ethylene response factor [manihot esculenta]
  misc_feature: The sequence is a functional homolog of SEQ ID NO 503 in the 10/374,780US patent application
  misc_feature: The sequence is a functional homolog of SEQ ID NO 780 in the 11/435,388US patent application
  misc_feature: Useful for making plants with altered Lignin content
  misc_feature: Useful for making plants with altered alkaloid content
  misc_feature: Useful for making plants with altered terpenoid content
  misc_feature: Useful for making plants with modulated growth and phenotype characteristics
  misc_feature: Functional homolog of the protein sequence given in SEQ ID NO 12955
  misc_feature: Functional homolog of the protein sequence given in SEQ ID NO 12996
  misc_feature: Functional homolog of the protein sequence given in SEQ ID NO 13188
  misc_feature: The sequence is a functional homolog of SEQ ID NO 503 in the 20060162006 US patent application
  misc_feature: The sequence is a functional homolog of SEQ ID NO 780 in the 20060272060 US patent application
MCGGAIISEFIPQRDSAAARAGHGKRGLVCADDFWPPHAADFDDFAAAAAASFHPDQEPPARKRERKTMYRGIRRRPWGKWAAEIRDPAKGARVWLGTFATAEAAARAYDRAARRIRGAKAKVNFPNEDPPPDYDDDDHAGAAQGMLAMSCAGGGGGRDHLVDYDVDVMGMGMGTTFFQHHPQPSYVSDAVTVAQQEQVPTVAYVHHHQLPPPQDDAAGMDMWTFDGINTAVPM

SEQ ID NO: 8125 - DNA, 921 bp, Sorghum bicolor
  misc_feature: Ceres ANNOT ID no. 6086802
  misc_feature: Encodes the peptide sequence at SEQ ID NO 8126
atgtcggtcgaaggcggcgccggcgagccgctcagtgaccgccagaagcgggagatcgccgtttggttcctctccaacgcgcccgccggcgagatccactacgtcgccaaagatgtgcgcgcgctgctgggggacgacgcggtgtacgaggccgccgccgcggaggccttcccggagtacaacaaggcccgcctcgtctacttcgagctccccgaccgcagtggcgacataatcatctcaacttatggggagattgacaagaataattatctggaccccaggactgcacaagttgctactatagatcatttgaaacagacctgtacaaaactgaggcctgctgaagatgaggagcttccatcagcttacattgaagagtttaggtgtgctttagatgttgaattgtcaaaatacgttgttgaagcttatcccaaaggggcctgtgccatttattgtactagtggaaaggatatagagggaccaggatcagatttcagtttcacagcagttatttctgcggctaagcgtagcccacagaacttttgcaatggcagctggcgttcaatttggaccatggaattcaattatgagttgcagtttgttaatattaaaggaaatatacaggtagatgctcactattttgaagagggaaatgtccagctggatactaatattgatcgcaaggactccaccataatgcagtcacctgatgattgcgcggtttcaattactaacatcattcgacatcatgagtctgaatatttgtcatctctcgaggaatcatacttaaatttgtctgatgcaactttcaaggatcttaggcgaaaacttccagttacccggacccttttcccatggcataacacattggcattcagtcttacgagagaccttgccaaagaattagcacttggaaaatga

SEQ ID NO: 8126 - protein, 306 aa, Sorghum bicolor
  misc_feature: Ceres ANNOT ID no. 6086802
  misc_feature (15)..(297): Pfam Id: F-actin_cap_A Pfam Desc: F-actin capping protein alpha subunit
  misc_feature (11)..(306): NCBI GI: 92895839 NCBI Desc: f-actin capping protein, alpha subunit [medicago truncatula]
  misc_feature (11)..(306): NCBI GI: 3702368 NCBI Desc: alpha subunit of f-actin capping protein [arabidopsis thaliana]
  misc_feature (92)..(306): NCBI GI: 115471719 NCBI Desc: os07g0414800 [oryza sativa (japonica cultivar-group)]
  misc_feature (9)..(298): NCBI GI: 45767805 NCBI Desc: zgc:101755 protein [danio rerio]
  misc_feature (9)..(298): NCBI GI: 68270997 NCBI Desc: capping protein (actin filament) muscle z-line, alpha 2 [oryctolagus cuniculus]
MSVEGGAGEPLSDRQKREIAVWFLSNAPAGEIHYVAKDVRALLGDDAVYEAAAAEAFPEYNKARLVYFELPDRSGDIIISTYGEIDKNNYLDPRTAQVATIDHLKQTCTKLRPAEDEELPSAYIEEFRCALDVELSKYVVEAYPKGACAIYCTSGKDIEGPGSDFSFTAVISAAKRSPQNFCNGSWRSIWTMEFNYELQFVNIKGNIQVDAHYFEEGNVQLDTNIDRKDSTIMQSPDDCAVSITNIIRHHESEYLSSLEESYLNLSDATFKDLRRKLPVTRTLFPWHNTLAFSLTRDLAKELALGK

SEQ ID NO: 8127 - DNA, 1020 bp, Sorghum bicolor
  misc_feature: Ceres ANNOT ID no. 6086804
  misc_feature: Encodes the peptide sequence at SEQ ID NO 8128
atgctacgcctgcggttccggccagctcacctgtcgctgaagctggccttcaccctctccctcgccgtctccttctccgtctcctgctgcgcctcctcctcctcttcctcgccccgcacatcagccagctccccggagggcgtagccgcggacctcctctccgtgctcggcggcccgcgcgctgcggcgcgggtgccggcggcggaggcctcgcggctccgcgcctgcctccggttcctcgccccggccaaccccaccacggccccaaaggtctcgtcttggagccgcggaggccctcggaagttccttctggaacgttgcgatgcggggacggcggaggcggacgagatggtgatgtggccgccggccccggtcttggagctggcccggctggccgtcgactccggaggcgatcccggtgccatccaccgtgcgctcgacccaacgatgctgccggtgccagatgttgaggcggcccagaagaataaatgcgaactcacaagaacaccatatgggaggcgctttgccaatgaggagatcaattcatattttgccttcttgttcgaattgattgtggcacggggaccttcagttggattaaatgtatccctgaatcgctatgatttgttccatgggcatcttttccttgcatctggaacaggacggcttggaattctgttccatgctaaagaatacccagcatttaataaggaattgtttccatattatttgggatattgccaagcagaatctagtgtaccatatgatgattctatgaatttgcgcaatgtcctttggttagcacctttgccatcaaatgagacaaaagcttggttagcaccaggagcattagttgtcttggacgcacatcctgacggaattatctatcaagagatgatacgtgactatgttcaaattgtaagaacaatatacgaagatgatcttggggaggttgctgttgatgtcaattatctaaatgtggcaaatgcagctcctatagatagagttttcatttgctga

SEQ ID NO: 8128 - protein, 339 aa, Sorghum bicolor
  misc_feature: Ceres ANNOT ID no. 6086804
  misc_feature (72)..(339): NCBI GI: 115474011 NCBI Desc: os07g0673000 [oryza sativa (japonica cultivar-group)]
  misc_feature (17)..(339): NCBI GI: 92895842 NCBI Desc: at5g27710 [medicago truncatula]
  misc_feature: Useful for making plants with altered protein content
  misc_feature: Useful for making plants with modulated drought sensitivity
  misc_feature: Useful for making plants with modulated seed size
  misc_feature: Useful for making plants with modulated cold sensitivity
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13486
  misc_feature: GREAT-hit functional homolog of the protein sequence given in SEQ ID NO 13488
  misc_feature: Useful for making plants with altered protein content
  misc_feature: Functional homolog of the protein sequence given in SEQ ID NO 13488
MLRLRFRPAHLSLKLAFTLSLAVSFSVSCCASSSSSSPRTSASSPEGVAADLLSVLGGPRAAARVPAAEASRLRACLRFLAPANPTTAPKVSSWSRGGPRKFLLERCDAGTAEADEMVMWPPAPVLELARLAVDSGGDPGAIHRALDPTMLPVPDVEAAQKNKCELTRTPYGRRFANEEINSYFAFLFELIVARGPSVGLNVSLNRYDLFHGHLFLASGTGRLGILFHAKEYPAFNKELFPYYLGYCQAESSVPYDDSMNLRNVLWLAPLPSNETKAWLAPGALVVLDAHPDGIIYQEMIRDYVQIVRTIYEDDLGEVAVDVNYLNVANAAPIDRVFIC

SEQ ID NO: 8129 - DNA, 1623 bp, Sorghum bicolor
  misc_feature: Ceres ANNOT ID no. 6086808
  misc_feature: Encodes the peptide sequence at SEQ ID NO 8130
atggcgtcgtcgccggacttgttccccaacgtcgccttctccgacgtctccgcccccgccgacgtgcccgcggccgagggggccaccgccgcgttcggtctcggcgcggccactggggccccgcgccttagcctcgtgaaggccgggaaggccgaggcggagtccacggtcgagatcgacctcgccgacgcgcaggtattcaagttgggaccgagggagtggctgtgcgtgtgcgacgagtcggaggctaaggctggcgtggaagtgaagtcattttcaagagcaattaaggttgttcttaggacagaagctgagagcaaagccttctctttagcttttcaacgatggaaacaccaagttattagtggaaaagctggtgagcggctggagaatggatcaataattgcttcgaaaagcaaattcgataccaaaattgaggcatcatcagcaaagatgtatttccactactatggccagctattacatcagcaaaacatgttacaagattttgtgcggacaggaacatactatgctgctgtaatggaaaaccgatctgactttgagggtcgaattgtggttgatgttggggctggaagtggtattctttcgttgtttgctgcccaggctggtgccagacatgtatatgcggttgaggcgtctgaaatggctgaacatgctcaacgtctaatctccgggaacccgtctcttggacaacggatcacggtcatcaagggcaaggttgaggaagtagagcttccagagaaagctgacatcctgatttctgagcctatgggaacccttttggttaatgagaggatgctagagtcctatgtcatagctagagacagattccttgctccagatggtaaaatgtttccaacaacaggaaggattcacatggctcctttttctgatgaatacctttatgttgaaatggcaaacaaggctctcttttggcagcagcacaatttttttggtgttgatcttacacctttacatggttcagcattccagggatacttttcacagcctgttgtggatgcatttgacccaagattattaatttctccaccaacatatcatacacttgattttactagcatgaaggaagaggagctttacgagattgatattcctctgagttttgtagcatcagttggcactagagtacatggattagcttgttggtttgatgtattgtttaatgggagtactgtgcaaaggtggcttaccactgctccaggatcccctaccactcactggtaccaactgcgatgtgtgctttcacagccattgtatgtcatggctggtcaagaaataactggccgtcttcatctcgtagcccatagttctcagagctacacaatatacttgacaatgtcagctaaaatgtggggtgtgggtgcggagcaaggcggtatcctacagacatctaccggaaaacttgaactcaaggagccatactacaggttgtctcagccgcaatcctacatgttgccacaagatcagcagcagcagcaattgccatctttgcaggcacagggatcagagcagcagatgcaggaagggcttagcccaggcatcacgatagaccaagtagaccaagattgtggcctcaactag

SEQ ID NO: 8130 - protein, 540 aa, Sorghum bicolor
  misc_feature: Ceres ANNOT ID no. 6086808
  misc_feature (14)..(536): NCBI GI: 30680069 NCBI Desc: protein arginine n-methyltransferase family protein [arabidopsis thaliana]
  misc_feature (14)..(514): NCBI GI: 51536598 NCBI Desc: at3g06930 [arabidopsis thaliana]
  misc_feature (14)..(515): NCBI GI: 110736374 NCBI Desc: arginine methyltransferase like protein [arabidopsis thaliana]
  misc_feature (8)..(507): NCBI GI: 30695591 NCBI Desc: protein arginine n-methyltransferase family protein [arabidopsis thaliana]
  misc_feature (8)..(507): NCBI GI: 42573634 NCBI Desc: protein arginine n-methyltransferase family protein [arabidopsis thaliana]
MASSPDLFPNVAFSDVSAPADVPAAEGATAAFGLGAATGAPRLSLVKAGKAEAESTVEIDLADAQVFKLGPREWLCVCDESEAKAGVEVKSFSRAIKVVLRTEAESKAFSLAFQRWKHQVISGKAGERLENGSIIASKSKFDTKIEASSAKMYFHYYGQLLHQQNMLQDFVRTGTYYAAVMENRSDFEGRIVVDVGAGSGILSLFAAQAGARHVYAVEASEMAEHAQRLISGNPSLGQRITVIKGKVEEVELPEKADILISEPMGTLLVNERMLESYVIARDRFLAPDGKMFPTTGRIHMAPFSDEYLYVEMANKALFWQQHNFFGVDLTPLHGSAFQGYFSQPVVDAFDPRLLISPPTYHTLDFTSMKEEELYEIDIPLSFVASVGTRVHGLACWFDVLFNGSTVQRWLTTAPGSPTTHWYQLRCVLSQPLYVMAGQEITGRLHLVAHSSQSYTIYLTMSAKMWGVGAEQGGILQTSTGKLELKEPYYRLSQPQSYMLPQDQQQQQLPSLQAQGSEQQMQEGLSPGITIDQVDQDCGLN

SEQ ID NO: 8131 - DNA, 414 bp, Sorghum bicolor
  misc_feature: Ceres ANNOT ID no. 6086809
  misc_feature: Encodes the peptide sequence at SEQ ID NO 8132
atggcacggcacgcacgcgccccgctcctcctcgccctcgtcgccacgctcgcggtggccgcggcgtcggcgtcggcctacgcgcgcgccgccgaggacgacacggagcttctcaccggcggcgacgacgacgtgctcgggcttggcggcatgctccgcggccggcggcggctcgacgacgccaacgccacgggcctcgacggcgccaacgccacgagcgtcgacgacggcaacgccacgagcatcgacgccgccgtcacgttcacgtggacggggttcatcggctacgccgcgctgtccagggacatcgtgccgtgctcgctgccaggcgcgtcctactacaactgccgccccggcgcggaggccaacccctacagccgcggctgctccgccatcacgcggtgccgcggctga

SEQ ID NO: 8132 - protein, 137 aa, Sorghum bicolor
  misc_feature: Ceres ANNOT ID no. 6086809
  misc_feature (76)..(137): Pfam Id: RALF Pfam Desc: Rapid ALkalinization Factor (RALF)
  misc_feature (5)..(137): NCBI GI: 115447833 NCBI Desc: os02g0670500 [oryza sativa (japonica cultivar-group)]
  misc_feature (5)..(136): NCBI GI: 108708099 NCBI Desc: rapid alkalinization factor family protein [oryza sativa (japonica cultivar-group)]
  misc_feature (91)..(137): NCBI GI: 124360011 NCBI Desc: rapid alkalinization factor [medicago truncatula]
  misc_feature (92)..(137): NCBI GI: 15623891 NCBI Desc: p0506e04.27 [oryza sativa (japonica cultivar-group)]
  misc_feature (93)..(136): NCBI GI: 16566316 NCBI Desc: ralf precursor [nicotiana tabacum]
  misc_feature: The plant is abnormally small.
  misc_feature: Useful for making plants with modulated biomass
  misc_feature: Functional homolog of the protein sequence given in SEQ ID NO 13255
MARHARAPLLLALVATLAVAAASASAYARAAEDDTELLTGGDDDVLGLGGMLRGRRRLDDANATGLDGANATSVDDGNATSIDAAVTFTWTGFIGYAALSRDIVPCSLPGASYYNCRPGAEANPYSRGCSAITRCRG

SEQ ID NO: 8133 - DNA, 918 bp, Sorghum bicolor
  misc_feature: Ceres ANNOT ID no. 6086811
  misc_feature: Encodes the peptide sequence at SEQ ID NO 8134
atggcgtcaggggaagcagagccgctgcagtacacgaccacggcgttgcgagtgtccatccactgcgagggctgcaagaagaaggtcaagaaggtgctccacagcatcgaaggggtgtacaaggtgacggtggacgcagcgcagcacaaggtgacggtcaccggcaacgtggaagccgacgcgctcctccggcggcttcacaaggccggcaagcaggccgcgctctggccttcgccgccggcgccggcggcacccgtcgctgaggctaagaagcccgaggatgctgcgactgctgcgctgccagccgcagccggggacagcggcgccaaggacgcccaggacgcgaagcctaaggaggcggaggccaaggagaagccgcctgagaacagcgagggcaaggagaagaagccagctaaggacaagaaggctgagaaaggcgaggctgcggcgaaacccagcaaggacgaggctaccaaggaggccgaggtggtcaccgagtccaaggagacgaagaagggctcctctgagccggcgaagcaagacgccgccgaggaggcgggcgcggaggagcccagcggcggcggcccgtcgtcggtgccagcgccgtcgccgggcccggagcgccccctcggcggcgcgttcccgtactacgcggcgcagccggtgctgagctacaacatggcgcacccgagctccagcgtgtcgtactacgcgcccacgcccgcgatgcccatgcacccgatgccgccgccgccgccgccgcacatggtgccgtatgggtacccgccgtacccggccatggtgccggtgccggcggagttcttgtacggcccaccgggcatcaggtcatccccgccgcaggagtcgtacaacaatatgttcaacgaggataacgccaactcgtgcagcctcatgtga

SEQ ID NO: 8134 - protein, 305 aa, Sorghum bicolor
  misc_feature: Ceres ANNOT ID no. 6086811
  misc_feature (15)..(75): Pfam Id: HMA Pfam Desc: Heavy-metal-associated domain
  misc_feature (1)..(305): NCBI GI: 115473999 NCBI Desc: os07g0671400 [oryza sativa (japonica cultivar-group)]
  misc_feature (1)..(305): NCBI GI: 33146848 NCBI Desc: copper chaperone (cch)-related protein-like protein [oryza sativa (japonica cultivar-group)]
  misc_feature (1)..(185): NCBI GI: 92882241 NCBI Desc: heavy metal transport/detoxification protein [medicago truncatula]
  misc_feature (5)..(194): NCBI GI: 124360014 NCBI Desc: heavy metal transport/detoxification protein [medicago truncatula]
  misc_feature (12)..(188): NCBI GI: 92871489 NCBI Desc: heavy metal transport/detoxification protein [medicago truncatula]
MASGEAEPLQYTTTALRVSIHCEGCKKKVKKVLHSIEGVYKVTVDAAQHKVTVTGNVEADALLRRLHKAGKQAALWPSPPAPAAPVAEAKKPEDAATAALPAAAGDSGAKDAQDAKPKEAEAKEKPPENSEGKEKKPAKDKKAEKGEAAAKPSKDEATKEAEVVTESKETKKGSSEPAKQDAAEEAGAEEPSGGGPSSVPAPSPGPERPLGGAFPYYAAQPVLSYNMAHPSSSVSYYAPTPAMPMHPMPPPPPPHMVPYGYPPYPAMVPVPAEFLYGPPGIRSSPPQESYNNMFNEDNANSCSLM

SEQ ID NO: 8135 - DNA, 318 bp, Sorghum bicolor
  misc_feature: Ceres ANNOT ID no. 6086816
  misc_feature: Encodes the peptide sequence at SEQ ID NO 8136
atgtctgggtcgggcgccggcgtttgggtgttcaagaacggcgtgatgcagctggagcagccggcggcggcgagccggaaggcgctggtgtacgtgccgacgaacgaggtggtgcggtcggtggaggcgctggagcggcggctggggacgctggggtgggagcgctactacgagaaccgaagcatcgtgcagctccacaagcgcgacggcggcgccgacctcatcaccatcccgcgcgacttcgccaacctccgctccacccacatgtacgacgtcgtcgtcaagaaccgcgaccacttcaaggtcgtcgacgcctaa

SEQ ID NO: 8136 - protein, 105 aa, Sorghum bicolor
  misc_feature: Ceres ANNOT ID no. 6086816
  misc_feature (6)..(104): NCBI GI: 40949983 NCBI Desc: flowering promoting factor-like 1 [nicotiana tabacum]
  misc_feature (40)..(101): NCBI GI: 115452981 NCBI Desc: os03g0346200 [oryza sativa (japonica cultivar-group)]
  misc_feature (26)..(104): NCBI GI: 32141027 NCBI Desc: gravity and root development protein [oryza sativa (japonica cultivar-group)]
  misc_feature (6)..(105): NCBI GI: 2370459 NCBI Desc: fpf1 protein [sinapis alba]
  misc_feature (6)..(105): NCBI GI: 115457536 NCBI Desc: os04g0282400 [oryza sativa (japonica cultivar-group)]
  misc_feature: Useful for making plants with modulated flowering time
  misc_feature: Functional homolog of the protein sequence given in SEQ ID NO 13392
MSGSGAGVWVFKNGVMQLEQPAAASRKALVYVPTNEVVRSVEALERRLGTLGWERYYENRSIVQLHKRDGGADLITIPRDFANLRSTHMYDVVVKNRDHFKVVDA

SEQ ID NO: 8137 - DNA, 1806 bp, Sorghum bicolor
  misc_feature: Ceres ANNOT ID no. 6086819
  misc_feature: Encodes the peptide sequence at SEQ ID NO 8138
atgtcggcgtcttcctctgccgccgctgccgaggccgagctgctggtgcacgccgcgttcaacagcaccgccacccacttcgtcgcggccacggcgtcaggcatccgcgtattctcctgcaccccgctgaagcacgtgttcagcaagggcttcgtgccgtccccggacgccggttcccggtcccgggtgatcaccgccgacctggctccctccggcacgctcgccgccgtcgtgttcaggccggatccctcggccgccgcacccagcgacgccgacgacgagggcgacaggatcaggtactgcagcgtcggcctgcgcgggcacttgctgcgcgacgacgacataagcataaactcctccacgtcctcctcgtgccgcgtccgcgccgtccgccacgagggcggccacgtcctcgtcgccggcgacggcaaaacggcgctccacggcacgtcgtcggggcgcgccttgaagcagtgcctcgaggtggacacggggcctaacccgctcggggtgtgcgcgctggcggaggtgcgcggcggcaagcagacggtcgtgctcgcctccccgcgcccggccaaggggcaggtgcaggtctgccgccggggcagcggcggcggccgcggcgtcgacgtgcacgcgcatcgctccagcatcgtctgcgtcgcgctgtcccgcgacggcaggctgctcgccaccgccagctccaagggcaccgtcgtccgcatcttcaccgtcgccgacggcaacaaggtcaacgaggagagaggcgccagcagggccgtcgtcgccgcctgcggggacatgctcaacgagaaggcgtccacctgcgccgtcgtgacgacgatgacgcgcgccgccgccctccctgctggaggctccgagacgacgacgttcgccgtccggcgctggaggccaggctacctgaactaccactggcgctacgacgagtgggcgacggacatcgacgccggcgaggtgcaggcggttggcgtccacggcgacaagacgtttctcgtccacgacggccgcgtggacgtgtacgggccaggcggggaccgcggcgtgcatgtgcttctccaccgggtggagacgcggccgggcggcggcacacgcacacccctctgcgccgcgtcgcgcgtcgcgccggtggcgttcgcgtgcgctgccgcggaggccggcgaggtaagcgtggagcggtgggcggcggcggtggacgggttcgcgccgctgtcgtcgttccgtgcgcactcgtcgcggcttgggtgcgtggccgtgtcctgggacggccggttcgttgccacggccagcttcaagggcaccatcgtgcgcgtcttccatgccgccgatggcacgttgcttcgagagctacgaagaggcgctgacagggcagacatctgcagcatggcgttctctcacgagtccaagtggcttgccgtctccagcgacaaggggacgatccacgtcttcagcgtcaacgtgaatgtgccctcgccgtcgccggaacaggaggacagcaacaagcctgacagtcccaatgcaggctctgcactgaatctgaatgccaagcaaggctcgtcctggtctttcttcagcggtttcgtgccaggatatttcaggcaagatggctcgcttgccaaatttcgcttgcgtgaaggcgtcaagtacgtggtggccttcagccaccatgagccaaacaccatcctcgtcgtcggcatggatggaagcttctaccgctgtgaattcgatccggtgaaaggaggtgacatgaaacaattggagtacaggaacttcatgaagatgaaatga

SEQ ID NO: 8138 - protein, 601 aa, Sorghum bicolor
  misc_feature: Ceres ANNOT ID no. 6086819
  misc_feature (325)..(599): NCBI GI: 92882249 NCBI Desc: wd40-like [medicago truncatula]
  misc_feature (325)..(599): NCBI GI: 16323362 NCBI Desc: at3g62770/f26k9_200 [arabidopsis thaliana]
  misc_feature (325)..(599): NCBI GI: 115462321 NCBI Desc: os05g0169200 [oryza sativa (japonica cultivar-group)]
  misc_feature (325)..(596): NCBI GI: 89291191 NCBI Desc: riken cdna 0610008n23-related [tetrahymena thermophila sb210]
  misc_feature (318)..(499): NCBI GI: 62732620 NCBI Desc: ld32381p [drosophila melanogaster]
MSASSSAAAAEAELLVHAAFNSTATHFVAATASGIRVFSCTPLKHVFSKGFVPSPDAGSRSRVITADLAPSGTLAAVVFRPDPSAAAPSDADDEGDRIRYCSVGLRGHLLRDDDISINSSTSSSCRVRAVRHEGGHVLVAGDGKTALHGTSSGRALKQCLEVDTGPNPLGVCALAEVRGGKQTVVLASPRPAKGQVQVCRRGSGGGRGVDVHAHRSSIVCVALSRDGRLLATASSKGTVVRIFTVADGNKVNEERGASRAVVAACGDMLNEKASTCAVVTTMTRAAALPAGGSETTTFAVRRWRPGYLNYHWRYDEWATDIDAGEVQAVGVHGDKTFLVHDGRVDVYGPGGDRGVHVLLHRVETRPGGGTRTPLCAASRVAPVAFACAAAEAGEVSVERWAAAVDGFAPLSSFRAHSSRLGCVAVSWDGRFVATASFKGTIVRVFHAADGTLLRELRRGADRADICSMAFSHESKWLAVSSDKGTIHVFSVNVNVPSPSPEQEDSNKPDSPNAGSALNLNAKQGSSWSFFSGFVPGYFRQDGSLAKFRLREGVKYVVAFSHHEPNTILVVGMDGSFYRCEFDPVKGGDMKQLEYRNFMKMK

SEQ ID NO: 8139 - DNA, 2367 bp, Sorghum bicolor
  misc_feature: Ceres ANNOT ID no. 6086823
  misc_feature: Encodes the peptide sequence at SEQ ID NO 8140
atggacgaggaggtcggcgccgccgggcggcagcaggttcagtggaaaagttactgcagaactctctccctcctagcgttccagagcttcggtgtggtgtatggagacttgagtacatcgcctttgtatgtctacagaaactcattgtctgggagactgaacgattaccttgatgagacaaccatctttgggttgttttctctggtgttttggacctttacacttattccgttgctgaagtacgtcataattgtcttgagtgcggatgataatggggaaggtggaacctttgctttgtactcacttctttgcaggcatgcaaaattcagtctgctgccaaaccagcaagccgcagatgaagagctgtcaacttattatcacccaggcactgatcgaactgtggtttcctctccattcaaaaggtttctggagaagcacaggaagctgcggacctgcttacttctttttgttctgtttggtgcgtgcatggtgataggtgatggtgtccttacaccaactatatctgttttgtcagccatctctggattacaagatcctgccacaagtggactaggagatggatggatcgtactcattgcatgtgttgtgcttgttggcctctttgctctgcagcaccgaggtactcatagagtggcattcttgtttgctccgattgttgtgttctggctcttgagcattggtatcattggtctatataacatcattcactggaatcctagaatatttgttgctctttctccacactatattgtgaagtttttcaatagaactggaaaggatggttggatatctcttggcggagtacttctcgctatcacaggtactgaggctatgtttgctgatcttggccacttctccgctgcatctatcaggttggcttttgccggtgtcatatatccctgtcttgtactgcaatacatgggacaggctgcatttctgtctaaaaacataccagctgtacataacagtttttatctttctattccaagtgctttattttggcctatgtttgtcatagcaactcttgctgcaattgtgggcagccaagctattatatctgcaaccttttctatcgttaagcaatgccttgccttgggatgctttccacgagtaaaggttgtgcatacatcaaggtggatctatggccagatttacatacctgagataaattggattatgatggtcctctgtttagctgcgacacttggctttcgtgacataacagtgataggaaatgcttacggtctcgcctgcatcacagtgatgtttgtcaccacctgcctgatgtcattggtcatcatcttcgtgtggcagaagaatctcctcatctccttgctattcctcgtattctttggggcacttgaagccgcctacctgtctgcagcagtgatgaaggttccccagggaggctggggtccgatcgcgctgtccgccgtgttcatgtccatcatgtacgcgtggcactacggcacacggcggaaataccagttcgacctccagaacaaggtgtcgatgaaatggatcctgaacctggggccgagcctgggcatcatgcgcgtgcccgggatcggcctcatctacacggagctggtgacgggcgtgccggccatcttctcgcacttcgtcaccaacctgccggcgttccaccaggtgctggtcttcgtgtgcgtcaagtccgtgccggtgccgtacgtgcccatggacgagcggtacctcatcgggcggatcggccccagggagtaccgcatgtaccggtgcatcgtcaggtacgggtacaaggacgtgcagaaggacgacgagaacttcgagaaccacctggtgatgagcatcgcccggttcatccagatggaggccgaggagtcggcctcgtcggcggggagctacgagtcgtcgccggagggcaggatggcggtcgtgcacaccaccgacacgacggggaccgggctggtggtgagggactcatccgtcgacgcagcaggcacgtccctgcccctgaccaggagcagcaagtcagagacgctccggagcttgcagtccatctacgagctggagtccgtcggcggcgtcagccggcggcggagggtgcggttccagatcgacgaggaggagcggatcgacccgcaggtgagggacgagctgtccgacctccttgaggccaaggaggccggcgtggcctacatcatcggccactcgtacgtgaaggcgaggaagaactccaatttcctcaagacgttcgccatcaactacgcctactcgttcctccgcaagaactgcagggggccgtcggtgacgctgcacatcccccacatcagcctcatcgaggtcggcatgatctactacgtgtaa

SEQ ID NO: 8140 - protein, 788 aa, Sorghum bicolor
  misc_feature: Ceres ANNOT ID no. 6086823
  misc_feature (24)..(788): Pfam Id: K_trans Pfam Desc: K+ potassium transporter
  misc_feature (1)..(788): NCBI GI: 92019691 NCBI Desc: potassium transporter [phragmites australis]
  misc_feature (1)..(788): NCBI GI: 92019685 NCBI Desc: potassium transporter [phragmites australis]
  misc_feature (12)..(788): NCBI GI: 62900304 NCBI Desc: potassium transporter 7 (oshak7)
  misc_feature (12)..(788): NCBI GI: 7108599 NCBI Desc: hak2 [hordeum vulgare]
  misc_feature (95)..(788): NCBI GI: 92019697 NCBI Desc: potassium transporter [phragmites australis]
  misc_feature: Useful for making plants with modulated biomass
  misc_feature: Functional homolog of the protein sequence given in SEQ ID NO 13565
  misc_feature: The sequence is a functional homolog of SEQ ID NO. 279 in the 11/188,298 US application
MDEEVGAAGRQQVQWKSYCRTLSLLAFQSFGVVYGDLSTSPLYVYRNSLSGRLNDYLDETTIFGLFSLVFWTFTLIPLLKYVIIVLSADDNGEGGTFALYSLLCRHAKFSLLPNQQAADEELSTYYHPGTDRTVVSSPFKRFLEKHRKLRTCLLLFVLFGACMVIGDGVLTPTISVLSAISGLQDPATSGLGDGWIVLIACVVLVGLFALQHRGTHRVAFLFAPIVVFWLLSIGIIGLYNIIHWNPRIFVALSPHYIVKFFNRTGKDGWISLGGVLLAITGTEAMFADLGHFSAASIRLAFAGVIYPCLVLQYMGQAAFLSKNIPAVHNSFYLSIPSALFWPMFVIATLAAIVGSQAIISATFSIVKQCLALGCFPRVKVVHTSRWIYGQIYIPEINWIMMVLCLAATLGFRDITVIGNAYGLACITVMFVTTCLMSLVIIFVWQKNLLISLLFLVFFGALEAAYLSAAVMKVPQGGWGPIALSAVFMSIMYAWHYGTRRKYQFDLQNKVSMKWILNLGPSLGIMRVPGIGLIYTELVTGVPAIFSHFVTNLPAFHQVLVFVCVKSVPVPYVPMDERYLIGRIGPREYRMYRCIVRYGYKDVQKDDENFENHLVMSIARFIQMEAEESASSAGSYESSPEGRMAVVHTTDTTGTGLVVRDSSVDAAGTSLPLTRSSKSETLRSLQSIYELESVGGVSRRRRVRFQIDEEERIDPQVRDELSDLLEAKEAGVAYIIGHSYVKARKNSNFLKTFAINYAYSFLRKNCRGPSVTLHIPHISLIEVGMIYYV

SEQ ID NO: 8141 - DNA, 984 bp, Sorghum bicolor
  misc_feature: Ceres ANNOT ID no. 6086826
  misc_feature: Encodes the peptide sequence at SEQ ID NO 8142
atgatgaatacccgaggcagtggcagtggcagcagcagcggcagcaaccagaccatgatggccttctccgaccatcctccgaagccggcgacggcagcgtcaggcgggcagccgcagccgtccccgccgtcgtctccgagcgagcgtccgccagccggccgtgggcgccggcgcgcgcaggagcccgggcggttcctcggcgtgcgtcgccggccgtggggacggtacgcggcggagatacgcgaccccacgaccaaggagcggcattggctgggcacgttcgacaccgcgcaggaggcggcgctggcctacgaccgcgcggcgctgtccatgaagggcgcgcaggcgcgcaccaacttcgtctacacgcacgccgcgtacaactacccgcccttcctggcgccgttccaccacgggcagcagccgtcgtcgtacgcgcacgcgccgtcgtccgtgcagcaccagtacggcggcggagtgggcgccggcgcgccgcacattgcctcgtacgggcaccaccactaccaccaccaggccggctcggcgagcgctgcagcagctggcggcgcgtcgtcgggcgagtgctcgtcgacgatgccggtgcccgtggaacgcgccgacggcacgctgctgctggaccgcagcggcggcggtcaccaccaccaccacgagttcctgttcgcgagcgcggacgacaactccgggtacctgagcagcgtggtcccggagagctgcctccggccgaggagcagcgcggcggcggtggaggacctgcggcggtactcggacgcggacgcctacgggatgggcatggggctccgggaggacgtggacgaccttgcccagatggtggccgggttctggggcggcgctggcgacgcggaccagctgtgcgggttcccgtccggcggcgccggggacagcatggtggcgtcgtcgcagggctctgacggctactcgcccttcagcttcctctcccactga

SEQ ID NO: 8142 - protein, 327 aa, Sorghum bicolor
  misc_feature: Ceres ANNOT ID no. 6086826
  misc_feature (63)..(114): Pfam Id: AP2 Pfam Desc: AP2 domain
  misc_feature (2)..(327): NCBI GI: 28565613 NCBI Desc: branched silkless1 [zea mays]
  misc_feature (39)..(317): NCBI GI: 62466419 NCBI Desc: frizzy panicle [oryza glumipatula]
  misc_feature (39)..(317): NCBI GI: 62466421 NCBI Desc: frizzy panicle [oryza nivara]
  misc_feature (39)..(317): NCBI GI: 62466423 NCBI Desc: frizzy panicle [oryza sativa (japonica cultivar-group)]
  misc_feature (39)..(317): NCBI GI: 62466435 NCBI Desc: frizzy panicle [oryza sativa (indica cultivar-group)]
  misc_feature: The plant flowers significantly late compared to wild-type.
  misc_feature: The sequence is a functional homolog of SEQ ID NO 1028 in the 10/225,066US patent application
  misc_feature: The sequence is a functional homolog of SEQ ID NO 1157 in the 10/374,780US patent application
  misc_feature: The sequence is a functional homolog of SEQ ID NO 1195 in the 10/666,642US patent application
  misc_feature: The sequence is a functional homolog of SEQ ID NO 136 in the 10/412,699US patent application
  misc_feature: The sequence is a functional homolog of SEQ ID NO 1360 in the 10/412,699US patent application
  misc_feature: The sequence is a functional homolog of SEQ ID NO 1883 in the 10/374,780US patent application
  misc_feature: The sequence is a functional homolog of SEQ ID NO 2222 in the 10/374,780US patent application
  misc_feature: The sequence is a functional homolog of SEQ ID NO 325 in the 11/479,226US patent application
  misc_feature: The sequence is a functional homolog of SEQ ID NO 40 in the 10/412,699US patent application
  misc_feature: The sequence is a functional homolog of SEQ ID NO 452 in the 10/666,642US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12895
  misc_feature: GREAT-hit functional homolog of the protein sequence given in SEQ ID NO 13415
  misc_feature: The sequence is a functional homolog of SEQ ID NO 136 in the 20040045049 US patent application
  misc_feature: The sequence is a functional homolog of SEQ ID NO 1360 in the 20040045049 US patent application
  misc_feature: The sequence is a functional homolog of SEQ ID NO 40 in the 20040045049 US patent application
  misc_feature: The sequence is a functional homolog of SEQ ID NO 1883 in the 20060162006 US patent application
  misc_feature: The sequence is a functional homolog of SEQ ID NO 1195 in the 20070033671 US patent application
  misc_feature: The sequence is a functional homolog of SEQ ID NO 452 in the 20070033671 US patent application
  misc_feature: Useful for making plants with modulated biomass
  misc_feature: Functional homolog of the protein sequence given in SEQ ID NO 13415
  misc_feature: Useful for biocontainment applications
  misc_feature: Functional homolog of the protein sequence given in SEQ ID NO 14013
  misc_feature: The sequence is a functional homolog of SEQ ID NO 1195 in the 10/666,642 US patent application
  misc_feature: Useful for making plants with modulated flowering time
  misc_feature: Functional homolog of the protein sequence given in SEQ ID NO 13801
  misc_feature: Useful for making plants with altered lignin content
  misc_feature: Functional homolog of the protein sequence given in SEQ ID NO 13219
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO. 274 in the 11/188,298 US application
MMNTRGSGSGSSSGSNQTMMAFSDHPPKPATAASGGQPQPSPPSSPSERPPAGRGRRRAQEPGRFLGVRRRPWGRYAAEIRDPTTKERHWLGTFDTAQEAALAYDRAALSMKGAQARTNFVYTHAAYNYPPFLAPFHHGQQPSSYAHAPSSVQHQYGGGVGAGAPHIASYGHHHYHHQAGSASAAAAGGASSGECSSTMPVPVERADGTLLLDRSGGGHHHHHEFLFASADDNSGYLSSVVPESCLRPRSSAAAVEDLRRYSDADAYGMGMGLREDVDDLAQMVAGFWGGAGDADQLCGFPSGGAGDSMVASSQGSDGYSPFSFLSH

SEQ ID NO: 8143 - DNA, 2238 bp, Sorghum bicolor
  misc_feature: Ceres ANNOT ID no. 6086846
  misc_feature: Encodes the peptide sequence at SEQ ID NO 8144
atggcgccgcccgccgtcgccgcgtcggcgttcccattccgcctcttcaccgcggaggcgcgccgcaacactaagagcggccgaggcaagcggagcgccgccaggccgctcaagtcctcgcccccaccccgccctccctcctccgtcagcggcggcggcgtcgcggccaccacgttcacgcggctcccgctccgcgacgcgcctgagtcggtcgaggtcacgctcgaccgcttccccaccgccccggccaacccgggggcgcccgctctcacgcgcgggagtgtccagcggctggacggcgaggaggagttcgaggcggggttggggcccaactctgtcgcgcggattcctctgcgggactctacggacggggtggagctcaccattggccagttcgaggcccgcgcggccggcaggaaaagcactggcggtcgcggatttacgcggcaaatggtcgaacgccttggcgacggcagcgagggggaggagctcgtcgtcagcagcctcgacgtgttcgaggtcaaaaggggcaggagagctcgggctcttgttccggaagtgctcgacgacgatgacgacgtcgtggtgttcgacccggactacggcgtcgacagcgacgaggaggaggaggagttcgagatgttcccgttcgaccaaagacatcatgaagaagctggtgccgttccacgcgcggatctcggagaggtagagtacggcgagggggaagacgacgacgaggttgtagtgttccacccagactacgacgaggacgagggggacgttgacgacgacggctacgacgatgaggaagcggaggcaggggaaggggaggcgaaggagaagggcgtgccggctgtgatgcggtgcttcgacacggcgaagatattcgccaaggccggggacggcgggaacggcgtggtggcgttccgccgcgagaagtacgtgccgtacgggggcccgtcgggcggcgacggcggccgcgggggcgacgtgtacgtgcaggtggacggggagatgaactcgctgctgccgttccgcaagtccgtgcacttccgtgccggccgcggcgcgcacggcatgggacagcagcaggccggggccaagggcgaggacgtcgtggtgaaggtgccgccggggacggtggtgcggacctcggatggaggcgtggagctcctggagctgatgaggccggggcagcgcgcgttgctcctccccggtggccgcggtggccgtggcaatgcggcattcaagtccggggcaaataaggtgcccaggatcgcagagaagggggagaaaggcccagaaatgtggttagagttggagctaaagttggtcgctgatgtagggattgtaggtgctcctaatgctgggaagagcactctcttgagtgttattagtgctgccaaaccagctatagccaattatccatttaccacattgctaccaaaccttggtgtggtctcattagattttgatgctacaatggtagttgctgatcttcctggcttactggaaggcgctcatcgtggttacggtttgggtcatgagttcctaaggcatagtgagcgatgctctgtcttggtgcatgtcgttgatggttctgcacaacaaccagaatatgagtttgaggcagttcgcttggagctggagttatttagtccatctttggttgacaaaccctatgtggtggtgttcaataagatggaccttccagaggcatctgagagatggaatacatttagggaaaaggtacagtctgagggcattgaacctttctgcattagtgcaataaacaggcaaggcatgcaggatgtcattcatgctgcttacaagcttcttcagaaagagaggcagaggatgaaggaaactgaaggatggagtgggccagaaaatctgaaccacgtatctgatgcaataaaaaaggaaagacgtgcacccatgaatgagtttgaggttttccatgataagggtacaaatacatggaatgttgttggagctggaatcgagcgttttgttcagatgactaactggcagtactcggactccttgaaaaggtttcagcatgccctagaggcatgtggtgtcaacagagctcttagcaaacagggagttaaagaaggtgatacggtgataattggtgagatggaaatggtttggaacaacgaaacggatagggctcgtccgtcaaagacgatgaacacacaagatgatgctgtccggtggcctgaattcggctag

SEQ ID NO: 8144 - protein, 745 aa, Sorghum bicolor
  misc_feature: Ceres ANNOT ID no. 6086846
  misc_feature (291)..(444): Pfam Id: GTP1_OBG Pfam Desc: GTP1/OBG
  misc_feature (446)..(569): Pfam Id: MMR_HSR1 Pfam Desc: GTPase of unknown function
  misc_feature (1)..(745): NCBI GI: 115473975 NCBI Desc: os07g0669200 [oryza sativa (japonica cultivar-group)]
  misc_feature (237)..(744): NCBI GI: 30725516 NCBI Desc: at5g18570 [arabidopsis thaliana]
  misc_feature (291)..(716): NCBI GI: 51891570 NCBI Desc: gtp-binding protein [symbiobacterium thermophilum iam 14863]
  misc_feature (290)..(720): NCBI GI: 134300371 NCBI Desc: gtp1/obg sub domain protein [desulfotomaculum reducens mi-1]
  misc_feature (291)..(716): NCBI GI: 114567127 NCBI Desc: spo0b-associated gtp-binding protein [syntrophomonas wolfei subsp. wolfei str. goettingen]
MAPPAVAASAFPFRLFTAEARRNTKSGRGKRSAARPLKSSPPPRPPSSVSGGGVAATTFTRLPLRDAPESVEVTLDRFPTAPANPGAPALTRGSVQRLDGEEEFEAGLGPNSVARIPLRDSTDGVELTIGQFEARAAGRKSTGGRGFTRQMVERLGDGSEGEELVVSSLDVFEVKRGRRARALVPEVLDDDDDVVVFDPDYGVDSDEEEEEFEMFPFDQRHHEEAGAVPRADLGEVEYGEGEDDDEVVVFHPDYDEDEGDVDDDGYDDEEAEAGEGEAKEKGVPAVMRCFDTAKIFAKAGDGGNGVVAFRREKYVPYGGPSGGDGGRGGDVYVQVDGEMNSLLPFRKSVHFRAGRGAHGMGQQQAGAKGEDVVVKVPPGTVVRTSDGGVELLELMRPGQRALLLPGGRGGRGNAAFKSGANKVPRIAEKGEKGPEMWLELELKLVADVGIVGAPNAGKSTLLSVISAAKPAIANYPFTTLLPNLGVVSLDFDATMVVADLPGLLEGAHRGYGLGHEFLRHSERCSVLVHVVDGSAQQPEYEFEAVRLELELFSPSLVDKPYVVVFNKMDLPEASERWNTFREKVQSEGIEPFCISAINRQGMQDVIHAAYKLLQKERQRMKETEGWSGPENLNHVSDAIKKERRAPMNEFEVFHDKGTNTWNVVGAGIERFVQMTNWQYSDSLKRFQHALEACGVNRALSKQGVKEGDTVIIGEMEMVWNNETDRARPSKTMNTQDDAVRWPEFG

SEQ ID NO: 8145 - DNA, 1458 bp, Sorghum bicolor
  misc_feature: Ceres ANNOT ID no. 6086847
  misc_feature: Encodes the peptide sequence at SEQ ID NO 8146
atgaagagctcagagcgtttgctgctgctgctgctggtggtgctggtggtggcatcatcgtcgttactgtccgccgtgattgccgagcagcagacttgccctgctgacctcgacagcaaatgcgatggtggcgcgtctgatgattgggagggggagttcttccccggcgtcccgaaaatcaagtatgagggtccaaccagcaagaaccctcttgcttataagtggtataataaggaggaagtgattctcgggaagaagatgaaggattggatgcgcttcagtgttgcgttctggcacacattccgtggtactggcgccgatccttttggtgcccctacaaaggcttggccttgggaggatggcacaaattcgttggccatggctaagagaagaatgagagctcactttgagttcatggagaagctgggagttgacaaatggtgcttccatgatagggatattgcccctgatgggaaaactcttgaagaaacaaatgctaacttggatgagatagttaagctagcaaagcagctccagggtgagaccaacataaagccattgtggggtacggcacagctctttatgcatccacgttacatgcatggagctgctactagcccagaggttaaagtatatgcttatgcggctgcacaagttaagaaagctttggaggtcactcactacctaggtggtgaaaactatgtgttttggggtggaagagagggttaccaaactcttctgaatactgatatgaagagagaacttgaccatctggctaactttcttcaagctgctgttgaccacaagaagaagatcggattcaagggaacactgttgatagagcctaaaccacaggaacctacaaaacaccagtatgactgggatgttgcaactacgtttgcttttctacagaagtatggtcttacaggagagttcaagatcaatgttgagtgcaaccatgctactctatctggacatagctgccatcatgaactggagactgcacggattaatgggttgcttggaaatattgatgcaaacactggtgatcctcaagttggttgggacacagatcagttcatgacagacattgcagaggctaccttagttatgtcgagtgtagttaagaatggtggacttgcacctggtggtttcaactttgatgcaaaattgcggagggaaagtactgatgttgaggacatgtttcttgctcatatctctggaatggacaccctggctcgtggcctccgcaacgttgccaagctgattgaggatggttccctagatgatcttgtccgaaagaggtaccagagctttgacagtgagattggcgccttgattgaggctgggaaaggagactttgagacgctagaaaagaaggttctagagtggggtgagcccaccgttccatccggcaagcaggaactggcggagattctgttccagtctgctctatag

SEQ ID NO: 8146 - protein, 485 aa, Sorghum bicolor
  misc_feature: Ceres ANNOT ID no. 6086847
  misc_feature (136)..(351): Pfam Id: AP_endonuc_2 Pfam Desc: Xylose isomerase-like TIM barrel
  misc_feature (12)..(485): NCBI GI: 6175480 NCBI Desc: xylose isomerase
  misc_feature (12)..(485): NCBI GI: 1296809 NCBI Desc: xylose isomerase [hordeum vulgare subsp. vulgare]
  misc_feature (12)..(485): NCBI GI: 1588664 NCBI Desc: xylose isomerase
  misc_feature (12)..(485): NCBI GI: 1296807 NCBI Desc: xylose isomerase [hordeum vulgare subsp. vulgare]
  misc_feature (1)..(485): NCBI GI: 92875409 NCBI Desc: xylose isomerase [medicago truncatula]
  misc_feature (12)..(485): SWISSPROT Homolog: EC 5.3.1.5 Xylose isomerase
MKSSERLLLLLLVVLVVASSSLLSAVIAEQQTCPADLDSKCDGGASDDWEGEFFPGVPKIKYEGPTSKNPLAYKWYNKEEVILGKKMKDWMRFSVAFWHTFRGTGADPFGAPTKAWPWEDGTNSLAMAKRRMRAHFEFMEKLGVDKWCFHDRDIAPDGKTLEETNANLDEIVKLAKQLQGETNIKPLWGTAQLFMHPRYMHGAATSPEVKVYAYAAAQVKKALEVTHYLGGENYVFWGGREGYQTLLNTDMKRELDHLANFLQAAVDHKKKIGFKGTLLIEPKPQEPTKHQYDWDVATTFAFLQKYGLTGEFKINVECNHATLSGHSCHHELETARINGLLGNIDANTGDPQVGWDTDQFMTDIAEATLVMSSVVKNGGLAPGGFNFDAKLRRESTDVEDMFLAHISGMDTLARGLRNVAKLIEDGSLDDLVRKRYQSFDSEIGALIEAGKGDFETLEKKVLEWGEPTVPSGKQELAEILFQSAL

SEQ ID NO: 8147 - DNA, 1041 bp, Sorghum bicolor
  misc_feature: Ceres ANNOT ID no. 6086852
  misc_feature: Encodes the peptide sequence at SEQ ID NO 8148
atggagagatgcagcctgggtgccagcgtggtggctctcctactcttgctgtctggtgcttctcatggaagagagctgcctgtcgaggatagtgaccacagttttatctacaatcatactctcgcaaagactcttgtggaatatgcatcagcggtgtatatgacagatttaacttctctgtttacgtggacatgttcaagatgcaatgacttgactcaaggtttcgagatgaggtctctaattgttgatgtggagaactgcttgcaggcatttgttggtgtagctcataatctgaattcgataatcgttgcaatcaggggaactcaagagaacagtgtacagaattggttaaaagacttgatatggaagcagcttgatctaagttatccaggcatgccaaatgcaaaggtgcacagtggatttttctcctcatataacaatacaattttgcgtctagctatcacaagtgctgtgaacaaggcaagaaaatcatatggagacatcaatgtcatagtgacaggccactcgatgggaggagctatggcttctttttgcgcgctcgatcttgctatgaagcttggaagtgacagtgttcaactcatgactttcgggcagcctcgtgttggcaatgctgcattcgcctcatgctttgccaaatatgtacccaacacaattcgagtgacacacggacatgatatcgtgccacatttgccaccttatttctcctttcttccccatctgacataccaccacttccccagagaggtatgggtccaggattctgatggcaacataactgaaaagatttgtgacgacagcggtgaagacccagattgttgcagcttgaggattcaggatcatttcacttacctaggagtcgatatggaagcggacgattggagcacttgtagaatcattacagctcaaagcgttcggcaattccgacgggagctagccagcaacatcatcatgacaaagcatgatatcgacgtttccattgttgaacctagtgtacaaacagatcggagcagttctagttag

SEQ ID NO: 8148 - protein, 346 aa, Sorghum bicolor
  misc_feature: Ceres ANNOT ID no. 6086852
  misc_feature (102)..(242): Pfam Id: Lipase_3 Pfam Desc: Lipase (class 3)
  misc_feature (1)..(326): NCBI GI: 21425569 NCBI Desc: triacylglycerol lipase [triticum aestivum]
  misc_feature (1)..(326): NCBI GI: 21425571 NCBI Desc: triacylglycerol lipase [triticum aestivum]
  misc_feature (10)..(326): NCBI GI: 15238889 NCBI Desc: lipase class 3 family protein [arabidopsis thaliana]
  misc_feature (10)..(346): NCBI GI: 50198977 NCBI Desc: at5g18630 [arabidopsis thaliana]
  misc_feature (8)..(335): NCBI GI: 77552336 NCBI Desc: triacylglycerol lipase [oryza sativa (japonica cultivar-group)]
MERCSLGASVVALLLLLSGASHGRELPVEDSDHSFIYNHTLAKTLVEYASAVYMTDLTSLFTWTCSRCNDLTQGFEMRSLIVDVENCLQAFVGVAHNLNSIIVAIRGTQENSVQNWLKDLIWKQLDLSYPGMPNAKVHSGFFSSYNNTILRLAITSAVNKARKSYGDINVIVTGHSMGGAMASFCALDLAMKLGSDSVQLMTFGQPRVGNAAFASCFAKYVPNTIRVTHGHDIVPHLPPYFSFLPHLTYHHFPREVWVQDSDGNITEKICDDSGEDPDCCSLRIQDHFTYLGVDMEADDWSTCRIITAQSVRQFRRELASNIIMTKHDIDVSIVEPSVQTDRSSSS

SEQ ID NO: 8149 - DNA, 1128 bp, Sorghum bicolor
  misc_feature: Ceres ANNOT ID no. 6086856
  misc_feature: Encodes the peptide sequence at SEQ ID NO 8150
atgagtcgggcggcggcaatggccgccgtggcggcggcggtgctggtgtgcgccacggcgttgggagtagtaggagcggaggtggtggacgagttcggtggcggggcgtccttcatcttcggggactcactcgtagacgccggcaacaacaactacatcccgactctatcccgggccaacatgacgcccaacggcatcgacttcgcggcgacgggcggggcaccgacggggcggttcaccaacgggcggacgatcgcggacatcatcggcgagatgctgggtcaggcggactactcgccgccgttcctggctcccaacacgagcggcggcgcgatcctgaacggcgtcaactacgcctccggcgggggcgggatcctgaacggcacggggaaggtgttcgtgaaccggatcgggatggacctgcaggtggactacttcaacgtcacgcggcggcagctggacgcgctgctggggaaggagaaagcccgcgagtttctgaggaagaaggccatcttctccatcaccgttgggtctaacgacttcctcaacaactacctcatgcccgtgctgtctactggcaccaggatccgtcagtcgcctgacgccttcgtcgacgacctcatcttccacctccgggaccagctcacgaggctgcacacgctggacgcgcgcaagttcgtggtggccaacgtggggccgctggggtgcatcccgtaccagaagaccatcaacagggtgggggaggacgagtgcgtgaagctgcccaaccagctggcggcgcagtacaacgcccggctcagggagctcatcgtcgagctcaacggcaacctccccggcgccaggttctgcctcgccaacgtctacgacctcgtcatggagctcatcacaaactaccccaactacgggttcgagacggccagcgtggcgtgctgcggcaacggcgggtcgtacgacgggctggtgccgtgcgggccgacgacgagcctgtgcgacgaccgggacaagcacgtgttctgggacccctaccaccccagcgaggccgccaacgtgctgctcgccaagtacatcgtcgacggcgacaccaagtacatctcgcccatcaacctcaggaagctctactcactctga

SEQ ID NO: 8150 - protein, 375 aa, Sorghum bicolor
  misc_feature: Ceres ANNOT ID no. 6086856
  misc_feature (38)..(356): Pfam Id: Lipase_GDSL Pfam Desc: GDSL-like Lipase/Acylhydrolase
  misc_feature (36)..(373): NCBI GI: 144924855 NCBI Desc: lipolytic enzyme, g-d-s-l [medicago truncatula]
  misc_feature (3)..(216): NCBI GI: 115473961 NCBI Desc: os07g0668300 [oryza sativa (japonica cultivar-group)]
  misc_feature (38)..(373): NCBI GI: 116309680 NCBI Desc: h0404f02.4 [oryza sativa (indica cultivar-group)]
  misc_feature (42)..(373): NCBI GI: 115460062 NCBI Desc: os04g0577300 [oryza sativa (japonica cultivar-group)]
  misc_feature (37)..(375): NCBI GI: 10177373 NCBI Desc: gdsl-motif lipase/hydrolase-like protein [arabidopsis thaliana]
MSRAAAMAAVAAAVLVCATALGVVGAEVVDEFGGGASFIFGDSLVDAGNNNYIPTLSRANMTPNGIDFAATGGAPTGRFTNGRTIADIIGEMLGQADYSPPFLAPNTSGGAILNGVNYASGGGGILNGTGKVFVNRIGMDLQVDYFNVTRRQLDALLGKEKAREFLRKKAIFSITVGSNDFLNNYLMPVLSTGTRIRQSPDAFVDDLIFHLRDQLTRLHTLDARKFVVANVGPLGCIPYQKTINRVGEDECVKLPNQLAAQYNARLRELIVELNGNLPGARFCLANVYDLVMELITNYPNYGFETASVACCGNGGSYDGLVPCGPTTSLCDDRDKHVFWDPYHPSEAANVLLAKYIVDGDTKYISPINLRKLYSL

SEQ ID NO: 8151 - DNA, 1200 bp, Sorghum bicolor
  misc_feature: Ceres ANNOT ID no. 6086863
  misc_feature: Encodes the peptide sequence at SEQ ID NO 8152
  misc_feature: Up-regulated in shoot tissues in response to salicylic acid treatment
atgcctttcagcagcatgatccatgagatgaagggcgagatcggcgccatctcgtcgcgcggcctgctgcggttccggtcggggggtcacgccgccgctgccgggcgagcgtcggcagccgccgagccggacgaggcgctgcgggagagctgctgggcgcgggtgccccccgagctcttgcggatggtgctggccagggtcgagcacgaggaggcgcgctggcccggccgcagcgccgtcgtggcttccgccggcgtctgccgctgctggagggccgtcgtcaaggagatggtgcgcgtgccggaggtgtctgggaaaatcaccttccccatctctctcaagcagcctggtccaagggatgccccaatgaaatgtttcattaggaggaaccgggcgactcagtcatattctctgtgcattggaatcactgatgcgttagctgatgatgggaaatttctacttgctgcacgcagaagtcgtaggcccgcaggcactgaatacctgatctcgcttgatgcaaagaatacatcaaaaggtacctgcattggcaagctaagatcaaacttcttgggaacaaaatttactgtctatgatgcccatccaccttgtaccggggctgtggtttcaaagggtccgtctgcacacatgatcggttcagcccaagtttctcctggggtgcctgctgggaattatccaatttcgcacatttcttatgaagcgacttttggttctaggtatccaagaaagatgaactgtgtcatggattccatccctttatcagcaattaaagaaggagggactgctcccacgcagactgaatttccatcaattaactccaactcttttgcttcagttccattcttcaggaaatcaggtcgtctggatagttcaggtgttcagctagccactcagaatgaagctaagatggtgctgaagaacaagtcccccaactggcatgaaccactgcagtgttggtgcctgaatttccatgggcgggtcacggttgcatctgttaagaacttccagttggtggcttcaggagagagtgatctgaataaccagggtgatgacgacgtgatactccagtttggcaaggtcgggaaggacttgttcaccatggactaccgttatccaatatctgcattccaggcatttgccatctgcctgagcagctttgataccaaaattactcgcgaatga

SEQ ID NO: 8152 - protein, 399 aa, Sorghum bicolor
  misc_feature: Ceres ANNOT ID no. 6086863
  misc_feature (116)..(393): Pfam Id: Tub Pfam Desc: Tub family
  misc_feature (115)..(399): NCBI GI: 115453033 NCBI Desc: os03g0351400 [oryza sativa (japonica cultivar-group)]
  misc_feature (1)..(395): NCBI GI: 7635492 NCBI Desc: tubby-like protein [cicer arietinum]
  misc_feature (1)..(297): NCBI GI: 90399022 NCBI Desc: h0701f11.8 [oryza sativa (indica cultivar-group)]
  misc_feature (1)..(297): NCBI GI: 32480039 NCBI Desc: osjnba0039k24.2 [oryza sativa (japonica cultivar-group)]
  misc_feature (1)..(297): NCBI GI: 5777631 NCBI Desc: caa303719.1 protein [oryza sativa]
  misc_feature: The sequence is a functional homolog of SEQ ID NO 462 in the 10/666,642 US patent application
  misc_feature: Up-regulated in shoot tissues in response to salicylic acid treatment
MPFSSMIHEMKGEIGAISSRGLLRFRSGGHAAAAGRASAAAEPDEALRESCWARVPPELLRMVLARVEHEEARWPGRSAVVASAGVCRCWRAVVKEMVRVPEVSGKITFPISLKQPGPRDAPMKCFIRRNRATQSYSLCIGITDALADDGKFLLAARRSRRPAGTEYLISLDAKNTSKGTCIGKLRSNFLGTKFTVYDAHPPCTGAVVSKGPSAHMIGSAQVSPGVPAGNYPISHISYEATFGSRYPRKMNCVMDSIPLSAIKEGGTAPTQTEFPSINSNSFASVPFFRKSGRLDSSGVQLATQNEAKMVLKNKSPNWHEPLQCWCLNFHGRVTVASVKNFQLVASGESDLNNQGDDDVILQFGKVGKDLFTMDYRYPISAFQAFAICLSSFDTKITRE

SEQ ID NO: 8153 - DNA, 3159 bp, Sorghum bicolor
  misc_feature: Ceres ANNOT ID no. 6086864
  misc_feature: Encodes the peptide sequence at SEQ ID NO 8154
  misc_feature: Down-regulated in shoot tissues in response to aminocyclopropane carboxylic treatment
  misc_feature: Up-regulated in root tissues in response to salicylic acid treatment
atgagccgaggccgccggggcatcttcgatggcctccccatcccggccgacaaatcctacctcaaggaaggcctgttgcggatcgacgagagctgggcggccgcgcggttcgactcgctgccgcacgtcgtgcacatcctcacatccaaggaccgcgagggcgagatccagttcctcaaggagcagagcgatctcatcgaggatgtcgtcgacgaggtcgtccacgcctaccaccatggtttcaacaaggccatccagaattactcccagatcctgcggttgttcagtgagtctgcagacagcattaccggactcaagggggagatggaggaggccaaaaagctgcttggcaggaagaataagcaccttggccagctgtggtaccgctccctcacactgcgtcatgtgctctcccttttggatcaggtcgaggatgttgccaaggttcctgctcgaattgagaacttaatggcagagaagcagctgtatgctgcagtgcaattgcacgtccaatcagtgctgatactggaacgagaaggccttcaagcggtaggtgctcttcaagatgttcgttctgatctaacaaagctgcgaggagtactattttacaaaattttggaagagttgcatggccatttgtacaacaatggtgaatatagctctgcgactttaagtatggttgacagtgaggaagtactgactaatacagctgctgggcgcttggtaaatagcatgcaacctctttcaaggagaactagatcaattaaaggtgacaatcacattggtggcccagtagatgggtttccaaaagttagttctgttgatggaggctcttcatttgatggcccagatgataatagcttagacatgagtgaaagtgatggacacactcggaaggattcgaaaagtttttctcgtgaaatcccaatttttctttcctgtgctacaccagatgagtttcttgaatcaatgataaaggcagatgccccccttaatgtgaagtacctgagaacattggtacaatgcttatccatgcttggaaaggttgcagctgcaggagctgtgatatgccaacgagtacgccctacaatccatgatgttatcacttcaaagattaaagcatattctgaagaggcttcaaaatccagtatagacaaagctgcaaaaatgtatgatgtgttgcattcaaatggacccattccccagttccaaatgctcaaacagaaaacaaagagtggcgcatctgtaatggcagcacaactagttgtcagtcccatttcgccagctatggcacccacaggagatgctcagcgtgcagctactcaacttcttaaatcaatatttgaatgtcttgtggagatacttgagaaccatattattgttggagagcttcttgaacaaaaatcgacagaggttgataacgtaaacacacctcatattgcaaatggggatgcaagctggaatccagactccgaatcttcccaagctactgggggtttcagtgttgcattctctctatcagtcgtgcagagtgaatgccagcaacttctgtgtgaaattttgcgggcaactccagaagctgctactgctgatgcagctgtccagacagctaggcttgcaaataaggatccagtgaaggaaaagagggatggatctgaaggcctttctttcgctttccgcattactgatgcagcaaccccagtgccaaatgaaggtcaaggatggcgaagaaattccaatgtgcctcaagaagggtatggaacagcaagtgtcatacctgaccaaggaattttcctagctgcgtctgtttaccgtcctgtctttgagtttatgaataaaatagggttgatgttgcctcagaagtactcgcaacttgggagtgatgggttattggcttttgtgaataactttctgaaggagcacttcttgccagcaatatttgtagattaccgaaaatgtgttcagcaggccatatccagcccagcagcatttagaccacgtgtaaatgcaaccttagcgtatagttcatcggtggaacttggacgccctgtgcttcaagggcttcttgccgttgatataatagccaaagaggttcttggatgggttcaattgatgccaaactatgcgactgagctcgtggagtatgtacgcacatttttagaacgtgctcatgagagatgtcgtgcatcatatatggaggctgtccttgaaaagcaaagttatattctcctttcaaggaatgatgttgagagtttaatgcgcctggaaccagcaaacatttctttgcaaaattctactagtgaacatgataacaatgtaacagatgcagaggcagtcgaagtagagattgaactaagtgatctcttattagatatgtgcccaataaaacaggaaaacttgatccatgatgaccagaaactgatattgttggcttctcttagtgactcattggaatatttagctgattcagttgaaaggcttggggaatcattcataagtccaccaaccacttcagagagcataaatcacagccatggtcgacatgcccgctcatctagtgcaattccaaaaggtcttgcatctctggctaatgagtacagaaggctatctattgattgtgttagagtattgagattggaaatgcaactagaggcgatataccacatgcaggaaatgaccaaaagagaatacgtcgaagatcaagatgctgaagatcctgatgacttcattatctcccttacaactcagattgcacgacgggatgaagaaatggctccttatatcacggaatcaaaaaggaattacgtatttggtgggatttccagtgttgctgctaatgcatcaataaaggcacttgctcaaatgaagtcaatcaacttgttaggagtccagcaaatatgcaggaattcgatagctctagaacaggctcttgcagccataccttcaatagatagtgaagcagtccaacagagattggatcgcgttcgaacgttctacgagttattaaatttgccttttgagtctttgcttggattcatcgcagaacatgaatatttgttttctgctaaagaatacctgagtgttctaaaggtcaatgtgccgggtagagagatacctgtggatgctgaacgacgcatctcacagattttgggtcactag

SEQ ID NO: 8154 - protein, 1052 aa, Sorghum bicolor
  misc_feature: Ceres ANNOT ID no. 6086864
  misc_feature (16)..(156): Pfam Id: Sec8_exocyst Pfam Desc: Sec8 exocyst complex component specific domain
  misc_feature (1)..(1052): NCBI GI: 50508194 NCBI Desc: exocyst complex component sec8-like [oryza sativa (japonica cultivar-group)]
  misc_feature (836)..(1050): NCBI GI: 144924418 NCBI Desc: probable exocyst complex component 4 , related [medicago truncatula]
  misc_feature (738)..(1051): NCBI GI: 116116215 NCBI Desc: ensangp00000008527 [anopheles gambiae str. pest]
  misc_feature (584)..(1029): NCBI GI: 12697943 NCBI Desc: kiaa1699 protein [homo sapiens]
  misc_feature (584)..(1029): NCBI GI: 45595700 NCBI Desc: sec8 protein [homo sapiens]
  misc_feature: Down-regulated in shoot tissues in response to aminocyclopropane carboxylic treatment
  misc_feature: Up-regulated in root tissues in response to salicylic acid treatment
MSRGRRGIFDGLPIPADKSYLKEGLLRIDESWAAARFDSLPHVVHILTSKDREGEIQFLKEQSDLIEDVVDEVVHAYHHGFNKAIQNYSQILRLFSESADSITGLKGEMEEAKKLLGRKNKHLGQLWYRSLTLRHVLSLLDQVEDVAKVPARIENLMAEKQLYAAVQLHVQSVLILEREGLQAVGALQDVRSDLTKLRGVLFYKILEELHGHLYNNGEYSSATLSMVDSEEVLTNTAAGRLVNSMQPLSRRTRSIKGDNHIGGPVDGFPKVSSVDGGSSFDGPDDNSLDMSESDGHTRKDSKSFSREIPIFLSCATPDEFLESMIKADAPLNVKYLRTLVQCLSMLGKVAAAGAVICQRVRPTIHDVITSKIKAYSEEASKSSIDKAAKMYDVLHSNGPIPQFQMLKQKTKSGASVMAAQLVVSPISPAMAPTGDAQRAATQLLKSIFECLVEILENHIIVGELLEQKSTEVDNVNTPHIANGDASWNPDSESSQATGGFSVAFSLSVVQSECQQLLCEILRATPEAATADAAVQTARLANKDPVKEKRDGSEGLSFAFRITDAATPVPNEGQGWRRNSNVPQEGYGTASVIPDQGIFLAASVYRPVFEFMNKIGLMLPQKYSQLGSDGLLAFVNNFLKEHFLPAIFVDYRKCVQQAISSPAAFRPRVNATLAYSSSVELGRPVLQGLLAVDIIAKEVLGWVQLMPNYATELVEYVRTFLERAHERCRASYMEAVLEKQSYILLSRNDVESLMRLEPANISLQNSTSEHDNNVTDAEAVEVEIELSDLLLDMCPIKQENLIHDDQKLILLASLSDSLEYLADSVERLGESFISPPTTSESINHSHGRHARSSSAIPKGLASLANEYRRLSIDCVRVLRLEMQLEAIYHMQEMTKREYVEDQDAEDPDDFIISLTTQIARRDEEMAPYITESKRNYVFGGISSVAANASIKALAQMKSINLLGVQQICRNSIALEQALAAIPSIDSEAVQQRLDRVRTFYELLNLPFESLLGFIAEHEYLFSAKEYLSVLKVNVPGREIPVDAERRISQILGH

SEQ ID NO: 8155 - DNA, 1611 bp, Sorghum bicolor
  misc_feature: Ceres ANNOT ID no. 6086865
  misc_feature: Encodes the peptide sequence at SEQ ID NO 8156
atggggctcggcgtggtggcggaactggtgcggctgggcgtgctgagctcgacctcggaccactcgtcggtggtgtccatcaacctgttcgtcgcgctgctctgcgcctgcatcgtcctcggccatctcctggaggagaaccgctgggtcaacgagtccatcaccgcgctcatcatcgggttgtgcaccggcgtggtgatcctgctgaccaccaaggggaagagctcgcacatcctcgtcttcagcgaggacttcttcttcatctacctcctccctcccatcatcttcaatgccgggttccaggtgaagaagaaacaattcttccggaatttcatgacaatcacattatttggtgctgtagggacaatgatatccttcttcacaatctctctcggtgcaatagcgatattcagcagaatgaacattggaacgttagatgtcggggattttctcgctattggagctatcttttctgcaacagattctgtctgcacactgcaggtcctccatcaggacgagacgccccttttgtacagtcttgtgttcggtgaaggagttgtgaacgatgccacgtccgttgtgctcttcaacgcactccagaactttgatcttaaccacatcgatgtaaccgttgtgctgaacttcttgggaaacttctgttatttattcttgtcaagcaccttacttggagtgttttctggattgctcagtgcctacataattaagaagttatatataggaaggcattccactgaccgtgaggttgcacttatgatgctcatggcttacctctcatatatgttggccgagttgctagatctgagtggtattcttactgtattcttctgcggtattgtgatgtcccactacacttggcataatgtgacagagagctcaagagttacaaccaagcatgcctttgcaactttgtccttcattgctgagacttttctcttcctttatgttgggatggatgccctcgatattgagaagtgggaatttgccagtgacatcccgggcaaatccattggcataagctcgattttgttaggattggttctggtcgggagagctgcatttgttttcccattgtcgtttttgtccaacttgacaaagaagtctccattggagaaaataacattgagacaacaagttgtaatatggtgggctggactgatgagaggcgccgtgtccatcgctcttgcttacaacaagttcacaagatctggacacactcagctgcacggcaatgcgataatgatcaccagcacaatcactgtagtcctgtttagcactatggtgtttgggatgatgacgaagccattgatccacctactgctccctgcctcgagcaacacggcccactccgagccgtcgtcacccaagtccctgcactcccctctcctgacgagcatgcagggctccgacctcgaggtgccgtctgcgcagattgtcaggccgtccagcctccggatgctcctcagcaagccgacccacacggtgcactactactggcgcaagttcgatgacgcgctgatgcggcccatgtttggcggccgtgggttcgtgcccttctcccccggatcgcccactgatcatgccggacggtga

SEQ ID NO: 8156 - protein, 536 aa, Sorghum bicolor
  misc_feature: Ceres ANNOT ID no. 6086865
  misc_feature (26)..(445): Pfam Id: Na_H_Exchanger Pfam Desc: Sodium/hydrogen exchanger family
  misc_feature (1)..(536): NCBI GI: 56236985 NCBI Desc: na+/h+ antiporter [aeluropus littoralis]
  misc_feature (5)..(532): NCBI GI: 28201131 NCBI Desc: sodium/proton antiporter [hordeum vulgare]
  misc_feature (1)..(532): NCBI GI: 28575021 NCBI Desc: na+/h+ antiporter [triticum aestivum]
  misc_feature (5)..(532): NCBI GI: 42495691 NCBI Desc: na+/h+ antiporter precursor [hordeum vulgare]
  misc_feature (1)..(532): NCBI GI: 51243245 NCBI Desc: na+/h+ antiporter [thinopyrum elongatum]
  misc_feature: Useful for making plants with modulated drought sensitivity
  misc_feature: GREAT-hit functional homolog of the protein sequence given in SEQ ID NO 13374
  misc_feature: The sequence is a functional homolog of SEQ ID NO 2 in US patent 7250560
  misc_feature: Useful for making plants with modulated water use efficiency
  misc_feature: Functional homolog of the protein sequence given in SEQ ID NO 13934
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO. 319 in the 11/188,298 US application
MGLGVVAELVRLGVLSSTSDHSSVVSINLFVALLCACIVLGHLLEENRWVNESITALIIGLCTGVVILLTTKGKSSHILVFSEDFFFIYLLPPIIFNAGFQVKKKQFFRNFMTITLFGAVGTMISFFTISLGAIAIFSRMNIGTLDVGDFLAIGAIFSATDSVCTLQVLHQDETPLLYSLVFGEGVVNDATSVVLFNALQNFDLNHIDVTVVLNFLGNFCYLFLSSTLLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDIPGKSIGISSILLGLVLVGRAAFVFPLSFLSNLTKKSPLEKITLRQQVVIWWAGLMRGAVSIALAYNKFTRSGHTQLHGNAIMITSTITVVLFSTMVFGMMTKPLIHLLLPASSNTAHSEPSSPKSLHSPLLTSMQGSDLEVPSAQIVRPSSLRMLLSKPTHTVHYYWRKFDDALMRPMFGGRGFVPFSPGSPTDHAGR

SEQ ID NO: 8157 - DNA, 1698 bp, Sorghum bicolor
  misc_feature: Ceres ANNOT ID no. 6086883
  misc_feature: Encodes the peptide sequence at SEQ ID NO 8158
atggcgttgtacctgctcttcgaggtggcgtcggggtacgctctcttccacgcgtacggcatcgacgagattgggcagagcgtggacgccgtccgcgcgtccgtgctggacctgcagcgcttcggcaaggccatcagactcaccggcttctcccccttctcctccgccatggacgcgatcaaccagtgcaacgccatctccgaagggatcatgaccgacgagctgaggaacttcctggagctcaatctgcccaaggtgaaggagggaaagaaggccaagtacagtctcggtgtcacggagcccaaggtcgggtcccacatcactgaggccacggggatcccctgccagagcaatgagttcgtccaagagctgctccgaggagtgcggctgcacttcgatcagtttatcgaccaactcaagaaatctgacctggagaaggctcagctaggcctggggcatagttatagcagggccaaggtcaagttcaatgtgaaccgtgtggataatatggtgattcaagctatctttctgttggacacactcgataaggatatcaattccatctccatgagagtgagggagtggtattcgtggcattttccagagctagtcaaaattataaatgacaattacctctatgctaagattgccaagtttgtggtaaacaaatctgatttagcagaaaaagacattccagctttagcagatctaattggagatgaggacaaagcgaaagaaattgttgaagcggcaaaggcatctatgggccaggatctttcactagttgatttgatcaatgtacaactgtttgcccaagggatcatgaatctgtctgaataccgtaaaaagctctatgagtatctcgtaacaaagatgaacgatattgcacccaacctgacgtctttgattggtgaagttgttggagctcgactaatctctcatgctggcagtctttccaatcttgccaagtgtgctgcctccactcttcaaatacttggcgctgaaaaggcacttttcagagcgctgaaaactcgtggaaatacaccaaagtatggcctcatattccactcatcattcattggtcgtgcatcagctaagaacaagggtcgaatggctcgatacctggcaaacaagtgttccattgcttcacgcattgattgttattcagagttgaatacatccatttttggacagaagctgcgtgaccaagttgaggagagactagacttctatgacaagggtgttgcacctcggaagaaccttgatgtgatgaaagccgccattgagggtattagtgcggtttcggaggatgttgatggtaatgagaagaatgatgtgtctgctaagaaaggcaagaaaaagaagtctaaaactcagactgacggtgaagcaatggatgttgataagcttgccgatggagaagatgaacctcaaactgagaagaagaaaaagaagaagcacaagcgtgaggagccacaggatgaagagatggccactgagccactcagtgatgatgtcaaacaagatgagactccaaagaagaagaagaaaaagaaccatgaggcaactgaggatgttgagcctaagaagaagaagaaaaagaaccgtgaggcatatgaggttgttgagcctaagacagccactgaagggaagaagaagaaaaagaagaagtccaaaaccgaggacagtgatgagtag

SEQ ID NO: 8158 - protein, 565 aa, Sorghum bicolor
  misc_feature: Ceres ANNOT ID no. 6086883
  misc_feature (266)..(414): Pfam Id: Nop Pfam Desc: Putative snoRNA binding domain
  misc_feature (170)..(222): Pfam Id: NOSIC Pfam Desc: NOSIC (NUC001) domain
  misc_feature (3)..(69): Pfam Id: NOP5NT Pfam Desc: NOP5NT (NUC127) domain
  misc_feature (1)..(524): NCBI GI: 92873598 NCBI Desc: pre-mrna processing ribonucleoprotein, binding region [medicago truncatula]
  misc_feature (72)..(525): NCBI GI: 3860319 NCBI Desc: nucleolar protein [cicer arietinum]
  misc_feature (3)..(492): NCBI GI: 89273783 NCBI Desc: nucleolar protein 5a (56kda with kke/d repeat) [xenopus tropicalis]
  misc_feature (3)..(536): NCBI GI: 14799394 NCBI Desc: xnop56 protein [xenopus laevis]
  misc_feature (3)..(562): NCBI GI: 49619095 NCBI Desc: nop56 [danio rerio]
MALYLLFEVASGYALFHAYGIDEIGQSVDAVRASVLDLQRFGKAIRLTGFSPFSSAMDAINQCNAISEGIMTDELRNFLELNLPKVKEGKKAKYSLGVTEPKVGSHITEATGIPCQSNEFVQELLRGVRLHFDQFIDQLKKSDLEKAQLGLGHSYSRAKVKFNVNRVDNMVIQAIFLLDTLDKDINSISMRVREWYSWHFPELVKIINDNYLYAKIAKFVVNKSDLAEKDIPALADLIGDEDKAKEIVEAAKASMGQDLSLVDLINVQLFAQGIMNLSEYRKKLYEYLVTKMNDIAPNLTSLIGEVVGARLISHAGSLSNLAKCAASTLQILGAEKALFRALKTRGNTPKYGLIFHSSFIGRASAKNKGRMARYLANKCSIASRIDCYSELNTSIFGQKLRDQVEERLDFYDKGVAPRKNLDVMKAAIEGISAVSEDVDGNEKNDVSAKKGKKKKSKTQTDGEAMDVDKLADGEDEPQTEKKKKKKHKREEPQDEEMATEPLSDDVKQDETPKKKKKKNHEATEDVEPKKKKKKNREAYEVVEPKTATEGKKKKKKKSKTEDSDE

SEQ ID NO: 8159 - DNA, 714 bp, Sorghum bicolor
  misc_feature: Ceres ANNOT ID no. 6086887
  misc_feature: Encodes the peptide sequence at SEQ ID NO 8160
atggggaggtcgttcagggactcgctcaaggtgctcgaggccgacatccatgcttctgaatttcggagggaatatgatggcgcctgccttcagatgaggatggcatactgccctgctgcccactttttcctttttcttgtgcagtggacagactgcaatcttgctggtgcacttgggctgttgaggattctaatttataaggtttacgctgatgggacaaccaccatgtgtactcatgaaagaaaagcaagcatcagggaattttatgctgtcatatttccctctttgatgcaattacatgaaggaatcaatgaagttgaggataaaaaacagaaagcaatatgtctagagaggtatagaagacgagatgaggatcagaaaacagtaatatcagagattgatgataatatagaggaggaatgtggcatatgcatggaaataaacagcaaagttgttcttccaacttgtagccatgctatgtgcatcaaatgctaccgtgactggaggtcaagatcccagtcctgtccgttctgccgcgacagcctcaagagggtaaactctgctgacctgtggatatacacagataacaaggacatcatcgacgtggcgacagtccgaagagagaacctgaggcgactcttcatgtacatagacaagttgcccactgtcatcccagaatctgtgtttgacgtctacgactcccatgtaaagtga

SEQ ID NO: 8160 - protein, 237 aa, Sorghum bicolor
  misc_feature: Ceres ANNOT ID no. 6086887
  misc_feature (141)..(178): Pfam Id: zf-C3HC4 Pfam Desc: Zinc finger, C3HC4 type (RING finger)
  misc_feature (1)..(237): NCBI GI: 38175742 NCBI Desc: zinc finger protein family-like [oryza sativa (japonica cultivar-group)]
  misc_feature (1)..(237): NCBI GI: 124360609 NCBI Desc: zinc finger, ring-type [medicago truncatula]
  misc_feature (4)..(237): NCBI GI: 21618121 NCBI Desc: rna-binding protein-like protein [arabidopsis thaliana]
  misc_feature (1)..(227): NCBI GI: 140051168 NCBI Desc: zinc finger, ring-type [medicago truncatula]
  misc_feature (1)..(233): NCBI GI: 9294812 NCBI Desc: mtd2 [medicago truncatula]
  misc_feature: Useful for making plants with altered Lignin content
  misc_feature: Functional homolog of the protein sequence given in SEQ ID NO 13283
  misc_feature: Useful for making plants with altered lignin content
  misc_feature: Functional homolog of the protein sequence given in SEQ ID NO 13283
  misc_feature: The sequence is a functional homolog of SEQ ID NO. 271 in the 11/188,298 US application
  misc_feature: The sequence is a functional homolog of SEQ ID NO. 350 in the 11/188,298 US application
MGRSFRDSLKVLEADIHASEFRREYDGACLQMRMAYCPAAHFFLFLVQWTDCNLAGALGLLRILIYKVYADGTTTMCTHERKASIREFYAVIFPSLMQLHEGINEVEDKKQKAICLERYRRRDEDQKTVISEIDDNIEEECGICMEINSKVVLPTCSHAMCIKCYRDWRSRSQSCPFCRDSLKRVNSADLWIYTDNKDIIDVATVRRENLRRLFMYIDKLPTVIPESVFDVYDSHVK

SEQ ID NO: 8161 - DNA, 1266 bp, Sorghum bicolor
  misc_feature: Ceres ANNOT ID no. 6086897
  misc_feature: Encodes the peptide sequence at SEQ ID NO 8162
atggccgtccgccgcaggcccgcggcggccgctgccggggacccgcctccgcaggcgccaccggcagatgcggcggcggcggcgccagaggaaccggtcctccggccgccgaacctgcgcgtggccgctgtggcggtggtgatcttcctcgcgcccttctcgtacctcgcgttcgtgcactacccgctgggcgccgatctgcagcgatccatcctcaaatgcggcgccatgagcctcgttggcttctacgtcgcgctcaagctaatccctgtcgcggcccgctaccacctccgccgccggatgttcggctacgacatcaacaagaaaggcttgcccacgggccaaatcaaagtgcctgaggcactaggtcttgttgtggggattgtctacttggtcattgctattatatttcagcagtttcactatgccccagactccatttggcttgttgaatataatgcagcattgacatcagtctgctttatgattcttcttggatttgttgatgatgttcttgatgttccatggagagtgaaactggcgttgccaacttttgcagcactcccattgctgatggcatatgctggtggcacttccattatcattccaaagcctttaactccttatgttggactaacagttttggagctaggtttattttacaagctattcatgctcttgttagcagtcttttgtacaaactcgataaatatacacgctggtttaaatggacttgaagttgggcagacagttgttatatctgctgcggttttgatacataatgtaatgcgcatagcatcttctacagacattgaaactcagcaagctcatgaattctctatttatcttgtcttgcctttcctaaccatttcattagctttgctagcttttaactggtacccttcaattgtttttgttggtgatacctacacatattttgctggaatggctttggctgtgataggaattttggggcatttcagcgagacgttattgctcttctttttacctcaagttctaaatttcttgtgttcagtcccacagctctttcactttgttccttgcccaagacataggttgccgaggtttgatcctgaaactggtcttttgactggtacgaaagatgggaatctggttaatatattccttaggttatttggaaagtgttcagagaaggtcctttgcataaggctccttatttttcaggctctatgctgcgtattctgcttctggctaaggtacatgcttaccggatggtacaagtga

SEQ ID NO: 8162 - protein, 421 aa, Sorghum bicolor
  misc_feature: Ceres ANNOT ID no. 6086897
  misc_feature (152)..(331): Pfam Id: Glycos_transf_4 Pfam Desc: Glycosyl transferase family 4
  misc_feature (117)..(414): NCBI GI: 67615286 NCBI Desc: n-acetylglucosamine-1-phosphate transferase [cryptosporidium hominis]
  misc_feature (117)..(414): NCBI GI: 54658567 NCBI Desc: n-acetylglucosamine-1-phosphate transferase [cryptosporidium hominis]
  misc_feature (117)..(414): NCBI GI: 66357968 NCBI Desc: dpagt1 like n-acetylglucosamine-1-phosphate transferase [cryptosporidium parvum]
  misc_feature (117)..(414): NCBI GI: 46227006 NCBI Desc: dpagt1 like n-acetylglucosamine-1-phosphate transferase [cryptosporidium parvum]
  misc_feature (125)..(407): NCBI GI: 60463913 NCBI Desc: udp-n-acetylglucosamine-dolichyl-phosphate n-acetylglucosaminephosphotransferase [dictyostelium discoideum]
MAVRRRPAAAAAGDPPPQAPPADAAAAAPEEPVLRPPNLRVAAVAVVIFLAPFSYLAFVHYPLGADLQRSILKCGAMSLVGFYVALKLIPVAARYHLRRRMFGYDINKKGLPTGQIKVPEALGLVVGIVYLVIAIIFQQFHYAPDSIWLVEYNAALTSVCFMILLGFVDDVLDVPWRVKLALPTFAALPLLMAYAGGTSIIIPKPLTPYVGLTVLELGLFYKLFMLLLAVFCTNSINIHAGLNGLEVGQTVVISAAVLIHNVMRIASSTDIETQQAHEFSIYLVLPFLTISLALLAFNWYPSIVFVGDTYTYFAGMALAVIGILGHFSETLLLFFLPQVLNFLCSVPQLFHFVPCPRHRLPRFDPETGLLTGTKDGNLVNIFLRLFGKCSEKVLCIRLLIFQALCCVFCFWLRYMLTGWYK

SEQ ID NO: 8163 - DNA, 1155 bp, Sorghum bicolor
  misc_feature: Ceres ANNOT ID no. 6086898
  misc_feature: Encodes the peptide sequence at SEQ ID NO 8164
atggacactgagactgagaggaaggcgacggcggtcgaggagatgagggagtggtgcgtcgctcttcccaaggtggagctccacgcccacctcaacggctccgtccgcaactccaccctcctagaacttgcaaaacagctaggttgtgacaaaggagtcattgtctttgaagatgttaaggatgtgatcatgaaaagtgataggtctcttccagagtgtttcaagctttttgatctgtttcatatacttacaactgaccatgatacagtaacaaggatcgctaaggaggttgtggaagattttgctgcagagaatgttgtgtatttggaaataagaacaacacctaagaacaatgaagcaaaggggatgaccaagaggtcttacatggatgctgttattaaaggtctgaaagaagttgaagctgttgatgttgcattatttgattctaatttcagaaccaatgaaacattaaattctaagctgttggatggtgacgcaaagaaaaagaagatatatgttaggcttctccttagtattgatcgtcgcgaaacagcttcggctgcattggataccgttaatttagctatggagatgaaggaccaaggtgtcataggcattgatctttctggcaatccagttgtgggggaatgggaaacatacttgcctgccctacaacatgctaaaaatctgggaatccccattacaattcactgtggagaggtagcaaaccggaaggaaatccaagcagtgctggacttctgccctcagaggctgggtcatgtatgctgtctgaatgatgtagaatgggagaagctcaagtctcttatgattccggttgagatatgtttaacttcaaatgttatgacaggaggtgctcccttcctagagcttcatcactttgctgacctctacaatgcaaagcaccctctgtccctgtgcacagatgattctggactgttctcaacaagcctctcaaatgagtattacctcgttgcaacgactttcggtctcagcaagtccgagctgtttcagctagcccaggatgcagtgcagtttgtttttgctgatgatgtggtgaagaagtctctgaaggaggggttcaagcatgctgaaaagagactgctcgtgtgggatgaacttgctgcaccgaactaa

SEQ ID NO: 8164 - protein, 384 aa, Sorghum bicolor
  misc_feature: Ceres ANNOT ID no. 6086898
  misc_feature (21)..(366): Pfam Id: A_deaminase Pfam Desc: Adenosine/AMP deaminase
  misc_feature (17)..(374): NCBI GI: 140068133 NCBI Desc: adenosine/amp deaminase [medicago truncatula]
  misc_feature (171)..(365): NCBI GI: 49118653 NCBI Desc: loc443687 protein [xenopus laevis]
  misc_feature (168)..(364): NCBI GI: 116128292 NCBI Desc: ensangp00000015635 [anopheles gambiae str. pest]
  misc_feature (31)..(375): NCBI GI: 146286026 NCBI Desc: adenosine deaminase-like protein
  misc_feature (170)..(357): NCBI GI: 24645260 NCBI Desc: cg11994-pa [drosophila melanogaster]
MDTETERKATAVEEMREWCVALPKVELHAHLNGSVRNSTLLELAKQLGCDKGVIVFEDVKDVIMKSDRSLPECFKLFDLFHILTTDHDTVTRIAKEVVEDFAAENVVYLEIRTTPKNNEAKGMTKRSYMDAVIKGLKEVEAVDVALFDSNFRTNETLNSKLLDGDAKKKKIYVRLLLSIDRRETASAALDTVNLAMEMKDQGVIGIDLSGNPVVGEWETYLPALQHAKNLGIPITIHCGEVANRKEIQAVLDFCPQRLGHVCCLNDVEWEKLKSLMIPVEICLTSNVMTGGAPFLELHHFADLYNAKHPLSLCTDDSGLFSTSLSNEYYLVATTFGLSKSELFQLAQDAVQFVFADDVVKKSLKEGFKHAEKRLLVWDELAAPN

SEQ ID NO: 8165 - DNA, 4839 bp, Sorghum bicolor
  misc_feature: Ceres ANNOT ID no. 6086927
  misc_feature: Encodes the peptide sequence at SEQ ID NO 8166
atggccacgctcccgcgcgcggcgccgcccacgcccgccgcgctgctcccgctgccccgcgccgcaccgccgctgctgctcgccgggagggccgccgccgcgcgccgctcgcggctgcgcgcgcggggcccgtccgcggccgcgcgccggagctgggtcgtcgcctcctcctcctcctcatcatcatcacgggccgtgctcggcggcgtcgcccgccgggaggcccctcccgctgcggacctgaaccatatcttgtctgaacgcggagcttgtggtgttgggttcgtcgcaaacttgaaaaatgtgccttcgttcaacattgttcgtgatgctcttatggctcttgggtgcatggagcaccgtggtggttgtggagccgacaatgactctggtgatggcgcaggactgatgagtgccattccatgggacttgtttgatgactgggccaacaagcaaggacttgctccctttgacagaagaaatacaggtgtaggcatggtcttccttccacaagatgagaagtcaatggaagaagccaaagccgcaactgaaaaggtttttgtggatgaaggccttgaggttattggttggagacctgttccttttaatgtatcagttgtaggtcgcaatgcaaaagaaaccatgcctaatatacaacaaatatttgtgaaagttgcaaaagaagataatgctgatgacatagagagagaactatacatcagccgaaagctgatagagcgggctacaaaatcttttagttgggcagatgaactttatttctgctctttatcaaacagaactattgtctacaagggaatgcttcgatctgaggttcttgggcaattctatttagaccttcagaatgaactatataaatctcctttcgccatatatcatcggagatacagtacaaatacaagtcctcgatggcctcttgctcaacctatgaggttacttggacacaacggagagattaacacgatacaggggaacttgaactggatgcgatcgagggaaaccacgctacagtctcctgtatggcgaggtcgtgagcatgaaatttgcccgtttggtgatcctaaagcatctgattcagcgaatcttgacagcacagctgaattgctgctaagaagtggtagaagtcctgcagaagctcttatgattctcgtccctgaggcatataagaaccatccaacattatctataaaataccccgaggtaattgacttttatgactactacaaaggacaaatggaagcttgggatggacctgctttactcctatttagtgatggaaggactgtaggagcaactcttgataggaatgggctccgtccagcacgctattggagaacgtcagatgactttgtttatgtcgcatctgaggttggtgttataccaatggatgagtcaaaggtagtaatgaaaggacgattgggtcctggaatgatgataactgttgacctacaaactggacaggtgcttgaaaacacagaagtaaagaaaactgtggctttagcaagcccctatggaacttggttgcaagaacgcacacgttctataaagcctgtcaacttcctctcttcaactatcatggacaacgagactgttttgagacatcaacaggcatttggctattcaagtgaagatgtgcaaatggtgattgaatcaatggcttcacaaggaaaggaaccaacattttgtatgggtgatgacattccgttagctgtgttatcacaaagaccacacttgttatatgattatttcaagcagcggtttgcgcaggttacaaatcctgcaattgatcccctcagagaaggtttagttatgtctcttgaggttaatattgggaaaagaggcaacatcttggaggtcggccctgaaaatgctgatctggttgcgctatcaagccctgtgctgaatgaaggtgaactagaaactctattgaaggacccaaaactgaagcccaaagtactgtcaacatactttgatattcgtaaaggtctagatggttcacttgataagacaattcaggctctttgtgaagaagctgacgctgctgtgcggagtggctcacaacttcttgttctttccgatcgttctgaagcacctgaaccaactcgtcctgccataccgatacttctagctgttggtgccatccaccagcatttgattcagaatggtctccgtatgtctgcttctattgttgctgatacggctcagtgctttagcacacatcactttgcctgtctgattggatatggtgccagtgctgtgtgtccttatctggcactagaaacatgccggcaatggaggctgagcaacaaaactgttaatttgatgcggaatgggaagatgcccacagtgaccattgagcaggcacaaagaaactttaccaaggcagtaaaattaggtctgctaaaaattctttcaaaaatgggtatctcactgctctcaagctattgtggagctcagatctttgaaatttatggtcttggtcaagaagttgttgatcttgccttctgtggaagtgtatcaaaaattggaggtctcacacttgacgagctgggtagagagaccttatcattctgggtgaaagcattctctgaagatactgcgaagaggctagaaaactttggatttatccaatccagacctggaggtgaataccatgcgaataatcctgagatgaccaagctgctgcacaaagcaattcgtgagaaaagagataatgcgtacactgtctatcaacaacatcttgcaagccgtcctgtcaatgttcttcgagatcttcttgaattgaaaagtgatcgtgcacctattcctattggcaaagtggagcctgcaacctccattgttgaacgtttttgtactggtggaatgtccctaggagccatttcaagggagacacatgaagctattgcaattgcaatgaatagaataggtggaaaatctaactcaggagaaggtggtgaggatccaatccgttggaatcccctcacagatgttgtagatggttattctccaacacttcctcatctcaaaggtcttcagaatggtgacacagccacaagtgccattaagcaggttgcatctgggcgttttggagttacaccaacatttttagtaaatgctaaccaaattgagataaaaattgcgcaaggtgcaaagcctggtgaagggggtcaacttcctgggaaaaaagtcagtgcatacattgctcgtctgagaaactccaaacctggagttcctctgatctccccgcctccacaccacgacatttattctatagaggatcttgcgcagttgatttatgacctccatcagatcaatcctaaagctaaagtgtccgtaaagcttgtgtctgaagctgggattggaactgtagcttctggagtttcgaaaggaaatgcagacataattcagatatcaggtcatgatggtggtactggagctagcccaataagctccatcaaacatgctgggggtccttgggaacttggtcttacagaaacaaatcagacacttatacaaaatggattgagagagagggtagtacttagggtggatggtgggttcaggagtggtcgagatgttcttatggctgctgctatgggggctgatgaatatggctttggttctgtagctatgatagctactggatgtgtcatggcacgcatttgccacacaaataattgcccagttggagtggctagtcagagagaagagcttcgtgcaaggttccctggtgttcctggtgatcttgttaactacttcctctttgttgccgaggaggttcgagctacattagcccagttgggttatgagaagctggatgacgtcattgggcgaacagatttgcttaaaccaaagcatgtctcgttggtgaaaacacagcacatcgatcttggatacctcttatcaaatgctggattgcccaaatggagcagctcccagattaggagccaggacgtccacactaatggtcctgttcttgatgagacaatccttgcagatcctgagatagctgatgcgattgagaatgagaaggaagtttccaaggcatttcaaatctataatgtcgatagagctgtctgtggtcgggtagcaggtgtgattgccaagaagtatggagacacaggttttgcaggccagctcaacatcacgttcaatggaagtgcagggcagtcctttggttgtttcctgactcctggaatgaacattcggctagttggagaggccaatgattatgttggaaagggtatggctggtggagaactggtggtagttcctgtagacaaaacaggatttgttcctgaggatgctactatagttggaaacacttgtctgtatggagctacaggtggtcaggtatttgtgagaggcaaggcaggagaaagatttgcagttagaaactctctatgtcaggcagtggttgagggcaccggagatcattgctgtgagtacatgactggtggttgcgtagttgtacttggcaaggctgggaggaatgttgcagctggaatgactggtggccttgcctacattctagatgaggatgatacacttctccccaaggttaacaaggaaatcgtcaagatgcagagagtgaatgctccagctgggcagatgcagctaaagagcttgattgagtcctatgttgaaaaaacgggcagcgagaaaggagccacgattttgagggaatgggaggcatatttgccgctcttctggcaactggtaccgcccagtgaagaagactcgcctgaggcttgtgcagagtttgagagagtactcgccaagcaagcaaagcaagcaaccacccagctgtctgcgaagtga

SEQ ID NO: 8166 - protein, 1612 aa, Sorghum bicolor
  misc_feature: Ceres ANNOT ID no. 6086927
  misc_feature (891)..(1276): Pfam Id: Glu_synthase Pfam Desc: Conserved region in glutamate synthase
  misc_feature (91)..(463): Pfam Id: GATase_2 Pfam Desc: Glutamine amidotransferases class-II
  misc_feature (537)..(834): Pfam Id: Glu_syn_central Pfam Desc: Glutamate synthase central domain
  misc_feature (1354)..(1549): Pfam Id: GXGXG Pfam Desc: GXGXG motif
  misc_feature (1)..(1612): NCBI GI: 121446 NCBI Desc: ferredoxin-dependent glutamate synthase, chloroplast precursor (fd-gogat)
  misc_feature (1)..(1612): NCBI GI: 125860396 NCBI Desc: ferredoxin-dependent glutamate synthase precursor [oryza sativa]
  misc_feature (1)..(1612): NCBI GI: 125860398 NCBI Desc: ferredoxin-dependent glutamate synthase precursor [oryza sativa]
  misc_feature (1)..(1596): NCBI GI: 18414469 NCBI Desc: glutamate synthase (glu1) / ferredoxin-dependent glutamate synthase (fd-gogat 1) [arabidopsis thaliana]
  misc_feature (1)..(1596): NCBI GI: 3869251 NCBI Desc: ferredoxin-dependent glutamate synthase precursor [arabidopsis thaliana]
  misc_feature (1)..(1612): SWISSPROT Homolog: EC 1.4.7.1 Ferredoxin-dependent glutamate synthase, chloroplast precursor
MATLPRAAPPTPAALLPLPRAAPPLLLAGRAAAARRSRLRARGPSAAARRSWVVASSSSSSSSRAVLGGVARREAPPAADLNHILSERGACGVGFVANLKNVPSFNIVRDALMALGCMEHRGGCGADNDSGDGAGLMSAIPWDLFDDWANKQGLAPFDRRNTGVGMVFLPQDEKSMEEAKAATEKVFVDEGLEVIGWRPVPFNVSVVGRNAKETMPNIQQIFVKVAKEDNADDIERELYISRKLIERATKSFSWADELYFCSLSNRTIVYKGMLRSEVLGQFYLDLQNELYKSPFAIYHRRYSTNTSPRWPLAQPMRLLGHNGEINTIQGNLNWMRSRETTLQSPVWRGREHEICPFGDPKASDSANLDSTAELLLRSGRSPAEALMILVPEAYKNHPTLSIKYPEVIDFYDYYKGQMEAWDGPALLLFSDGRTVGATLDRNGLRPARYWRTSDDFVYVASEVGVIPMDESKVVMKGRLGPGMMITVDLQTGQVLENTEVKKTVALASPYGTWLQERTRSIKPVNFLSSTIMDNETVLRHQQAFGYSSEDVQMVIESMASQGKEPTFCMGDDIPLAVLSQRPHLLYDYFKQRFAQVTNPAIDPLREGLVMSLEVNIGKRGNILEVGPENADLVALSSPVLNEGELETLLKDPKLKPKVLSTYFDIRKGLDGSLDKTIQALCEEADAAVRSGSQLLVLSDRSEAPEPTRPAIPILLAVGAIHQHLIQNGLRMSASIVADTAQCFSTHHFACLIGYGASAVCPYLALETCRQWRLSNKTVNLMRNGKMPTVTIEQAQRNFTKAVKLGLLKILSKMGISLLSSYCGAQIFEIYGLGQEVVDLAFCGSVSKIGGLTLDELGRETLSFWVKAFSEDTAKRLENFGFIQSRPGGEYHANNPEMTKLLHKAIREKRDNAYTVYQQHLASRPVNVLRDLLELKSDRAPIPIGKVEPATSIVERFCTGGMSLGAISRETHEAIAIAMNRIGGKSNSGEGGEDPIRWNPLTDVVDGYSPTLPHLKGLQNGDTATSAIKQVASGRFGVTPTFLVNANQIEIKIAQGAKPGEGGQLPGKKVSAYIARLRNSKPGVPLISPPPHHDIYSIEDLAQLIYDLHQINPKAKVSVKLVSEAGIGTVASGVSKGNADIIQISGHDGGTGASPISSIKHAGGPWELGLTETNQTLIQNGLRERVVLRVDGGFRSGRDVLMAAAMGADEYGFGSVAMIATGCVMARICHTNNCPVGVASQREELRARFPGVPGDLVNYFLFVAEEVRATLAQLGYEKLDDVIGRTDLLKPKHVSLVKTQHIDLGYLLSNAGLPKWSSSQIRSQDVHTNGPVLDETILADPEIADAIENEKEVSKAFQIYNVDRAVCGRVAGVIAKKYGDTGFAGQLNITFNGSAGQSFGCFLTPGMNIRLVGEANDYVGKGMAGGELVVVPVDKTGFVPEDATIVGNTCLYGATGGQVFVRGKAGERFAVRNSLCQAVVEGTGDHCCEYMTGGCVVVLGKAGRNVAAGMTGGLAYILDEDDTLLPKVNKEIVKMQRVNAPAGQMQLKSLIESYVEKTGSEKGATILREWEAYLPLFWQLVPPSEEDSPEACAEFERVLAKQAKQATTQLSAK

SEQ ID NO: 8167 - DNA, 2583 bp, Sorghum bicolor
  misc_feature: Ceres ANNOT ID no. 6086928
  misc_feature: Encodes the peptide sequence at SEQ ID NO 8168
atggcggcttcggcgacgcctgggtcggctgagaggcaggcgcgcggcggcgcggcggcggcgaccggcaacgcggtatttaagagtggccctctcttcatatcatcgaaaggaattggatggaaatcatggaaaaagcgttggttcatcctcacacgaacgtcacttgttttcttcaagagtgatcctagtacgttaccgcagagaagtggtgaagtgaatcttacattggggggaattgaccttaataattctgggagcgtagtagtcagggaagacaaaaggctgctgactgtcctttttccagatggccgtgatggtcgtgccttcaccttgaaggcagaaagttctgaagatttattcgagtggaaaacagcactggaagaagctcttgcacaagctccaaatgcagctcttgtgatggggcataatggaatctttcgcaatgacacaacagatgtatatgaaggggctattccgaattgttggttcccttacaggagagagaagagacctatcaaatcactagttgttggcaggccaatactgcttgcactggaagatatagatggcagtccttcttttctggaaaaagctttgtgtttccttgagaaacatggaataaaggtggaaggaattttgcgtcaagctgcagatgtggaggaggttgacaggagattgcaagaatatgagcaaggaaggacagagtttgcaccagaagaggatgctcatgttgttggtgactgtgtaaagcatgttctccgggagcttccatcttctcctgttccagcttcctgctgtacggcattattggaagctttccgtctggaaatcaaggaatctcggatcaaatctatgcgtgcagcaatatctgaaacatttcccgagcctaataggcggctgctacagagaattttgaaaatgatgcataccattgcttctcataccgccgagaatagaatgactccatcagcggttgctgcatgtatggccccactcttgttgcgtccccttcttgctggtgaatgcgagatggaagatgactatgacatgagtggtgacagtgctgctcagcttattgccgctgcaaatgctgctaacagtgctcaaggcattgtaactactctattagaggaatacgagagtatattcaatgatgagcactttatgtgctccttatcacctgattctcaaacaggagatagtggaagtgaagaatcaactgatgatgaaactgtggatatcaaggataatggatttcatgatgcagaaaatgatgtagatcaagaattagatgatgccgagcgaataatgagtggaaaattgagtgaaaccagtgcaagtgcccgtgctgacctctatgactacaaggaagttaatggcaaaatttcagacgctgagctctctgttgaggataacacatttgaatcaaatgtagatttaaatgatgctcccctaagttgtttaacagaaaagggaaaggatccatcaaatctggtgtccactcatgaaactccattatcagttggagagattcttctgtctttggatgctggaattccattacctggttgtgcagctgaatattccaatgacagacgctctagcaaatccaatggaactcagcagcatgtgaagcgtactaacttatggggacggagcaatgcgagaaagggccaacggtcggagttagttgatccatcaggtgaagaagagcttgctatccaacgacttgaggtaatgaagaatgacttacagatcaggattgcaaaggaggctagaggtaatgcaatcctacaggcaagtttggaaagaagaaaacaagcactacatgagcggcgtgtggctctggaacaggatgtgtcaaggttgcaagagcaactacaggctgaaagggatcttagagctgcactggaggttggactaagcatgtcttcttcacaattttctagttcgcgctccatggactcaaagacaaaggcagagcttgaggaaattgctctcgcagaagctgatgttgcaagattaaaacagaaggttgcagagctgcatctccaactcaatcaacagcgccagcaccagtatagctcttcagcagatgcaaatggtcgtcctcaacaccttccaaatcatctctcgcagaacattgtccaaactggatttgataggagcgttgctttctgtaatcaagataagaagcaaagaaatgaggagagcttgccaagcacatcccactggagaagcataaagcaacatgtgctatctcatggttcttcaaggcctttatccctaaagcattccttggacacctccttgagtgattcaagggaggcatcaacaagtttgcctgcagagggcgggccaatgttggtgaacatccccagaacaacagaaggtgttgaatatgggagaccgccgtctgtgccatcatccactctggttgaactaacaaccaggctagatttcttcaaagaacggcggtcacaattgatggagcagctccacagcctcgatttagggcatggatccacatcccatggtttcccatacaaaccttcgtcaccctggaacagcccaaagtag

SEQ ID NO: 8168 - protein, 860 aa, Sorghum bicolor
  misc_feature: Ceres ANNOT ID no. 6086928
  misc_feature (193)..(340): Pfam Id: RhoGAP Pfam Desc: RhoGAP domain
  misc_feature (26)..(132): Pfam Id: PH Pfam Desc: PH domain
  misc_feature (1)..(860): NCBI GI: 50510139 NCBI Desc: pleckstrin homology (ph) domain-containing protein-like [oryza sativa (japonica cultivar-group)]
  misc_feature (1)..(860): NCBI GI: 115473841 NCBI Desc: os07g0658300 [oryza sativa (japonica cultivar-group)]
  misc_feature (1)..(739): NCBI GI: 56202382 NCBI Desc: pleckstrin homology (ph) domain-containing protein-like [oryza sativa (japonica cultivar-group)]
  misc_feature (26)..(701): NCBI GI: 115451999 NCBI Desc: os03g0256800 [oryza sativa (japonica cultivar-group)]
  misc_feature (5)..(859): NCBI GI: 42567107 NCBI Desc: pleckstrin homology (ph) domain-containing protein-related / rhogap domain-containing protein [arabidopsis thaliana]
MAASATPGSAERQARGGAAAATGNAVFKSGPLFISSKGIGWKSWKKRWFILTRTSLVFFKSDPSTLPQRSGEVNLTLGGIDLNNSGSVVVREDKRLLTVLFPDGRDGRAFTLKAESSEDLFEWKTALEEALAQAPNAALVMGHNGIFRNDTTDVYEGAIPNCWFPYRREKRPIKSLVVGRPILLALEDIDGSPSFLEKALCFLEKHGIKVEGILRQAADVEEVDRRLQEYEQGRTEFAPEEDAHVVGDCVKHVLRELPSSPVPASCCTALLEAFRLEIKESRIKSMRAAISETFPEPNRRLLQRILKMMHTIASHTAENRMTPSAVAACMAPLLLRPLLAGECEMEDDYDMSGDSAAQLIAAANAANSAQGIVTTLLEEYESIFNDEHFMCSLSPDSQTGDSGSEESTDDETVDIKDNGFHDAENDVDQELDDAERIMSGKLSETSASARADLYDYKEVNGKISDAELSVEDNTFESNVDLNDAPLSCLTEKGKDPSNLVSTHETPLSVGEILLSLDAGIPLPGCAAEYSNDRRSSKSNGTQQHVKRTNLWGRSNARKGQRSELVDPSGEEELAIQRLEVMKNDLQIRIAKEARGNAILQASLERRKQALHERRVALEQDVSRLQEQLQAERDLRAALEVGLSMSSSQFSSSRSMDSKTKAELEEIALAEADVARLKQKVAELHLQLNQQRQHQYSSSADANGRPQHLPNHLSQNIVQTGFDRSVAFCNQDKKQRNEESLPSTSHWRSIKQHVLSHGSSRPLSLKHSLDTSLSDSREASTSLPAEGGPMLVNIPRTTEGVEYGRPPSVPSSTLVELTTRLDFFKERRSQLMEQLHSLDLGHGSTSHGFPYKPSSPWNSPK

SEQ ID NO: 8169 - DNA, 1437 bp, Sorghum bicolor
  misc_feature: Ceres ANNOT ID no. 6086947
  misc_feature: Encodes the peptide sequence at SEQ ID NO 8170
atgcaaaccctcgtcctccccgacgccatggccgtggcagcggcggcggcggccgacgtgccatcgcgcacgcaaactcttccccgccgcgtgtcggtgtcgatggcgcgggcgccacggcgggagtcggacccaaagaagcgggtggtgatcacggggatgggcgtggtgtcggtgttcggcaacgacgtgggcgcgtactacgaccgcctcctcgccgggagcagcggggtcggcctcatcgaccgcttcgacgcctccgggttctccacccgcttcgccgcccagatccgcggattctcctgcgagggccacatcgacgacgagagtgaccgccgcctcgacgactgccagcgctacgccctcgtcgccgccaggaaggccctcgcgtccgccgggctcgccatcggctccagagcgatgtacaagcggcccccgcagatcgacaaggaacgcgccggcgtggtcgtgggctccggcatcggcggcgcgacggcgttcacggcgggggccgaggacctcatgaggaaggggccgaggggaatctccccctgcacgataccgttcgcgatgcccaacgcggcgtcggcgctggtctccatcgacgccgggatcggcttccttggccccaactactccatctccacggcctgcgccacgtccaaccactgcctccacagcgccgcggaccagatccggttgggccgcgcggacgtcatggtcgccggcggcgccgaggccgccgtcgcgcccgtctgcctcggcggtttcgcggctctgcgggcgctgtcgcggcggaacgaagaccccggcgcggcgtcccggccgtgggacagggaccgcgacggcttcgtcttgggcgaaggcgccgggatactggtgatggagagcctcgagcacgcgaggcggcgcggcgccccgatcttcgcggagtacctgggcggctcggcgacctgtgacgctcaccacctgatggacgcgaggcccgacggccgtggcgcggcggcgtgcatcaggcggagcctggaagacgccggcgtggcgccggaggaggtgaactacgtgaacgctcacgcgacgtcctcgcttgccggggacctggcagaggtgaaggcactgaagcaggtgtttaagaacccgtcccagatcaaaatgaacgcgaccaagtccatgatcgggcattgccttggcgcggccggcgggctggaagccattgctactgtcaaagccataaccaccggctgggtgcatccgactataaaccaatttaatcctgagccggcggttggtgaatttgacactgtgcgtggggtgaaacagctgcacgaggtacacgtcggtatctccaattcgtttggatttggtgggcacaactcggtggcagtgttcgcaccgttcaagcccatatcctggtgcttgactcatatacttgtttag

SEQ ID NO: 8170 - protein, 478 aa, Sorghum bicolor
  misc_feature: Ceres ANNOT ID no. 6086947
  misc_feature (47)..(300): Pfam Id: ketoacyl-synt Pfam Desc: Beta-ketoacyl synthase, N-terminal domain
  misc_feature (309)..(423): Pfam Id: Ketoacyl-synt_C Pfam Desc: Beta-ketoacyl synthase, C-terminal domain
  misc_feature (22)..(468): NCBI GI: 115458608 NCBI Desc: os04g0445700 [oryza sativa (japonica cultivar-group)]
  misc_feature (22)..(468): NCBI GI: 38344546 NCBI Desc: osjnba0027p08.14 [oryza sativa (japonica cultivar-group)]
  misc_feature (22)..(468): NCBI GI: 116310231 NCBI Desc: osigba0140o07.8 [oryza sativa (indica cultivar-group)]
  misc_feature (22)..(468): NCBI GI: 119784 NCBI Desc: 3-oxoacyl-[acyl-carrier-protein] synthase i, chloroplast precursor (beta-ketoacyl-acp synthase i) (kas i)
  misc_feature (21)..(468): NCBI GI: 121281796 NCBI Desc: plastid 3-keto-acyl-acp synthase i [helianthus annuus]
  misc_feature (22)..(468): SWISSPROT Homolog: EC 2.3.1.41 3-oxoacyl-[acyl-carrier-protein] synthase I, chloroplast precursor
MQTLVLPDAMAVAAAAAADVPSRTQTLPRRVSVSMARAPRRESDPKKRVVITGMGVVSVFGNDVGAYYDRLLAGSSGVGLIDRFDASGFSTRFAAQIRGFSCEGHIDDESDRRLDDCQRYALVAARKALASAGLAIGSRAMYKRPPQIDKERAGVVVGSGIGGATAFTAGAEDLMRKGPRGISPCTIPFAMPNAASALVSIDAGIGFLGPNYSISTACATSNHCLHSAADQIRLGRADVMVAGGAEAAVAPVCLGGFAALRALSRRNEDPGAASRPWDRDRDGFVLGEGAGILVMESLEHARRRGAPIFAEYLGGSATCDAHHLMDARPDGRGAAACIRRSLEDAGVAPEEVNYVNAHATSSLAGDLAEVKALKQVFKNPSQIKMNATKSMIGHCLGAAGGLEAIATVKAITTGWVHPTINQFNPEPAVGEFDTVRGVKQLHEVHVGISNSFGFGGHNSVAVFAPFKPISWCLTHILV

SEQ ID NO: 8171 - DNA, 2211 bp, Sorghum bicolor
  misc_feature: Ceres ANNOT ID no. 6086953
  misc_feature: Encodes the peptide sequence at SEQ ID NO 8172
atgccaccgaacgccttgcccactacctccagacccgcatctaggcgcgtcgtctacgtcctcctcgcggcgcttgccacggcgccgttcctgctgctcctcctctacggcggcgcctcgccctccgcgctctgccccgccgcctaccgcgcgccccgccgcctcccgtacccgtccgtgctctggtccaaggtgcccccgctccccgtcctcctctcctcgccgcacccggacctccgcggctctcgctggatcgtcttcatcgcgtcgccgcatgccccgcggcaccgcccgctgcgcgcggtccccgggtggcagctcctcgcggtcgccgacgaggcgacccccgcggattggtcccacccaggcgccgtcctgctcacgctcgccgaccaggatcacctcggattccgctccgtcgctttccttccagcccggggcccggcgcgcaaggccgcggcgtacctcttcgccgtgcagcgcggggcgcgggtcatctacgacgccgacgtgcgcaacgccgtcctgggcggcaacctcaccagtcacttcgatgtcgatctggaccagcgccagggaggcgccgtgctgctgcagtacagccatgccgatcctaaccggacggtcgtgaacccgttcgtgcactttgggcagccgtcggtctggccacgggggctgccgctggagaaggcaggggaactggatgctgaggagttctacactgagatattcagtggtggccaattcatgcagcaaggaatgtgtaatggccttccagatgttgactcagtgttctacttcacccggaagtcattggagatggaggcatttgatttccggtttgacgcggatgcacccaaggttgcgctaccacagggcacgatgacgccagtcaactctgttaacacattgttccactcgccggcgttctgggggcttgcattgccagtgtcagtgagtccaatggcatcggatgtcatacgcggatactgggcgcagaggatactatgggagattggagggtacctagttgtctacccaccaactgtgcaccgcatagataatgtgcgtgctcacacatttgatgaagagaaggatctccatgtcaatgtagggaagctgataaagttcctaatggagtggcgatccagtaagaggacactattcgagcggattcttgatctaagctatgcgatgacagaggagggattctggggtgaaaaggatttgcatttcatgacttcttggctccaagatcttgttgctatcgggtaccggcagccacggttgatgtcattggagattgaccggcctagggcaaccattggacatggggacaagaaggagtttgcaccaaagaagctgccttcagtgcatcttggggttgaagagattggggaagtaagcactgagattggcaatctaattaaatggaggaagcattttggtgatattgtgctcatagtgcattgcaccgaacttgtggaccgaactgcactagagtggaggctgctttacggtcggatatttcgagcagttgttattctttcagagcaaagcaattctgatcttgctgtggaattcagcaacttggcacaagcctacaagtacttgccgaaggtgtttgctcggtttggaggtgctcaaggatttttgttccttcaagatcacatggtcttcaattactggaacctcttgaatgctgataaagataagctctggataaccaaccaggtgaaggaatcttggtcggatgtgcctctccatggtaacaacatcgagtggtttgtgaaccaaggggatatggttaaaaagggagtcagcaattttccatctcagtatgaagctaactacaggagaaatgtaggtgaaaataatctaattcgttgcagcagtgagatattttacatacctcaacggtacatcggtgacttttcaaatcttgttaaagctattggaagcttagacattcatcacagttttgcagtccccatgttattccttgcaatggattcaccgagcaactttgaatccaaagctttgacaaaacttgtctatagggcagatctgccatcaaataccacactctcaacaatttatactgctgaagcccatgcagtgtacccggtgaaggttcagaatgagatggactttgtaaaactaatcagggttatgtcttcaggagatccatttcttatggaattggtctga

SEQ ID NO: 8172 - protein, 736 aa, Sorghum bicolor
  misc_feature: Ceres ANNOT ID no. 6086953
  misc_feature (13)..(736): NCBI GI: 115473809 NCBI Desc: os07g0656400 [oryza sativa (japonica cultivar-group)]
  misc_feature (282)..(736): NCBI GI: 115463687 NCBI Desc: os05g0391200 [oryza sativa (japonica cultivar-group)]
  misc_feature (280)..(433): NCBI GI: 25396324 NCBI Desc: protein f02c9.2 [imported] - caenorhabditis elegans
  misc_feature (142)..(372): NCBI GI: 109627132 NCBI Desc: protein transglucosylase [haloquadratum walsbyi]
  misc_feature: Useful for making plants with altered cell wall content and/or composition
  misc_feature: Functional homolog of the protein sequence encoded by LOCUS at2g41770
  misc_feature: Useful for making plants with altered cell wall content and/or composition
  misc_feature: Functional homolog of the protein sequence given in SEQ ID NO 14014
MPPNALPTTSRPASRRVVYVLLAALATAPFLLLLLYGGASPSALCPAAYRAPRRLPYPSVLWSKVPPLPVLLSSPHPDLRGSRWIVFIASPHAPRHRPLRAVPGWQLLAVADEATPADWSHPGAVLLTLADQDHLGFRSVAFLPARGPARKAAAYLFAVQRGARVIYDADVRNAVLGGNLTSHFDVDLDQRQGGAVLLQYSHADPNRTVVNPFVHFGQPSVWPRGLPLEKAGELDAEEFYTEIFSGGQFMQQGMCNGLPDVDSVFYFTRKSLEMEAFDFRFDADAPKVALPQGTMTPVNSVNTLFHSPAFWGLALPVSVSPMASDVIRGYWAQRILWEIGGYLVVYPPTVHRIDNVRAHTFDEEKDLHVNVGKLIKFLMEWRSSKRTLFERILDLSYAMTEEGFWGEKDLHFMTSWLQDLVAIGYRQPRLMSLEIDRPRATIGHGDKKEFAPKKLPSVHLGVEEIGEVSTEIGNLIKWRKHFGDIVLIVHCTELVDRTALEWRLLYGRIFRAVVILSEQSNSDLAVEFSNLAQAYKYLPKVFARFGGAQGFLFLQDHMVFNYWNLLNADKDKLWITNQVKESWSDVPLHGNNIEWFVNQGDMVKKGVSNFPSQYEANYRRNVGENNLIRCSSEIFYIPQRYIGDFSNLVKAIGSLDIHHSFAVPMLFLAMDSPSNFESKALTKLVYRADLPSNTTLSTIYTAEAHAVYPVKVQNEMDFVKLIRVMSSGDPFLMELV

SEQ ID NO: 8173 - DNA, 480 bp, Sorghum bicolor
  misc_feature: Ceres ANNOT ID no. 6086960
  misc_feature: Encodes the peptide sequence at SEQ ID NO 8174
atggcggagaacctggcccccgagaagcgccacaccttcgtgcacaacgggcagaaggtgttcgagtgggaccagacgctggaggaggtgaacatgtacatcgagctccccaagggcgtgtccaccaccaagctatttcactgcaccatccaggccagtcacgttgaggtcggcatccgcggcaacccgccatacctcaaccatgacctgacgcaccctgtgaagaccgactcgtcgttctggacaatagaggatggtgagatgcatatcacactgcaaaaaagggagaaggggaaaacatggtcatctccaatacaagggcaaggaattttggatccatatgctgcagatcaagagcaaaagcggcttatgctccaaaggtttcaagaagagaacccagggttcgacttttcacaggctcagttcagtggaacctgccctgacccaagaaccttcatgggaggaatacactccgagtga

SEQ ID NO: 8174 - protein, 159 aa, Sorghum bicolor
  misc_feature: Ceres ANNOT ID no. 6086960
  misc_feature (19)..(94): Pfam Id: CS Pfam Desc: CS domain
  misc_feature (1)..(159): NCBI GI: 18461297 NCBI Desc: nuclear movement protein-like [oryza sativa (japonica cultivar-group)]
  misc_feature (6)..(144): NCBI GI: 119581931 NCBI Desc: nudc domain containing 2 [homo sapiens]
  misc_feature (21)..(123): NCBI GI: 77999263 NCBI Desc: salt tolerance protein 5-like protein [solanum tuberosum]
  misc_feature (10)..(67): NCBI GI: 146161631 NCBI Desc: eukaryotic aspartyl protease family protein [tetrahymena thermophila sb210]
  misc_feature (62)..(153): NCBI GI: 85000143 NCBI Desc: spliceosome-associated protein [theileria annulata strain ankara]
MAENLAPEKRHTFVHNGQKVFEWDQTLEEVNMYIELPKGVSTTKLFHCTIQASHVEVGIRGNPPYLNHDLTHPVKTDSSFWTIEDGEMHITLQKREKGKTWSSPIQGQGILDPYAADQEQKRLMLQRFQEENPGFDFSQAQFSGTCPDPRTFMGGIHSE

SEQ ID NO: 8175 - DNA, 1458 bp, Sorghum bicolor
  misc_feature: Ceres ANNOT ID no. 6086961
  misc_feature: Encodes the peptide sequence at SEQ ID NO 8176
atggagttaaataatgtacacgttcagcaagttggggaagacatgataagcaagttaaatgatgatgttttgctcttaatcttagaaaatgtcgacctgacaatgtcagtgagggcaggtgccctatcaacacgatggagacaccttccatggttgcttggacaactcaccatagatatgatggacttccttcatgaaccatatgccgatcccacagtggatgatcacattgataaagcaatgtcatctcttgcagaagcaattagaagcatgttgtctccttcccgtagaaagacagtggtcaccagactttgtgtttcactagtgataaccaacagttactcgagtgaaattggtcatcttgttaatgaagtggttgaaaatggaatggtaaaagatatagagctcacaagtggggttgagaggatcccgggcactgtcagtgatgaagaaatggaaaaacatgcaaatggtgtgaatagtttctttagtaactatccaattatatcttgttgcctcacaagacttctcctttttaatgcaacctttgtggaatcagatctacataatctcattgcaaatgtatgcacggaacttcgttatctttatctcagccagtgtgatactggcttccaatcaacattcaagatagatgcaccaaactcaaaactcaacattctagaacttgtccactgtcattttgcgcaagttgagttacattgccttccaatggtagagaaagtcatttttggcttttggctaactagatgtgtgcccttgacttgggaatacatcccatgcctcaaggaagtggaaatcttttcagccatgccccctcctcaggaaccattcaagttaagtgactttctacgtggtacgacatgtataaatactttatcattggatttcctcgggcaaaagatttggctactacctgaaaaacatcaactttcctcagtatttagcaatttgaggaaattgtgtatatatgatgtctttgttggatttggccttttgtggacaacagctcttcttgaagctgcgccatccctcgagatacttgaagttgaggtgtatgaccatcgatgcgaggaggacgagaaagtaactgagaagtgtgctgaaagaactaatgggccatggcaagtgtcagagtttgcatacccaaagcattcgccactgaaagagcttgaaatcattggtttcaatgcatcagaagaacatatagtgtttataggagcagtgatggagcgggcttctaacttacagtcggttgttttgaaagacaagtgttgtaaggaatgcgaagcaaccagtacagcgtcagtaaaacgtaaatttccagagggtgaagatgaacaggagctggtagtcaataagctcagaaaccggttcttctcccgtgctcagataattttcagtgaccgtaaggttgtcaacgaatgtgtgtttgtctga

SEQ ID NO: 8176 - protein, 485 aa, Sorghum bicolor
  misc_feature: Ceres ANNOT ID no. 6086961
  misc_feature (4)..(457): NCBI GI: 115449901 NCBI Desc: os02g0825100 [oryza sativa (japonica cultivar-group)]
  misc_feature (16)..(444): NCBI GI: 116310473 NCBI Desc: h0805a05.6 [oryza sativa (indica cultivar-group)]
  misc_feature (113)..(471): NCBI GI: 115479949 NCBI Desc: os09g0498700 [oryza sativa (japonica cultivar-group)]
  misc_feature (12)..(444): NCBI GI: 38345336 NCBI Desc: osjnba0081l15.9 [oryza sativa (japonica cultivar-group)]
  misc_feature (48)..(461): NCBI GI: 115449917 NCBI Desc: os02g0826000 [oryza sativa (japonica cultivar-group)]
MELNNVHVQQVGEDMISKLNDDVLLLILENVDLTMSVRAGALSTRWRHLPWLLGQLTIDMMDFLHEPYADPTVDDHIDKAMSSLAEAIRSMLSPSRRKTVVTRLCVSLVITNSYSSEIGHLVNEVVENGMVKDIELTSGVERIPGTVSDEEMEKHANGVNSFFSNYPIISCCLTRLLLFNATFVESDLHNLIANVCTELRYLYLSQCDTGFQSTFKIDAPNSKLNILELVHCHFAQVELHCLPMVEKVIFGFWLTRCVPLTWEYIPCLKEVEIFSAMPPPQEPFKLSDFLRGTTCINTLSLDFLGQKIWLLPEKHQLSSVFSNLRKLCIYDVFVGFGLLWTTALLEAAPSLEILEVEVYDHRCEEDEKVTEKCAERTNGPWQVSEFAYPKHSPLKELEIIGFNASEEHIVFIGAVMERASNLQSVVLKDKCCKECEATSTASVKRKFPEGEDEQELVVNKLRNRFFSRAQIIFSDRKVVNECVFV

SEQ ID NO: 8177 - DNA, 897 bp, Sorghum bicolor
  misc_feature: Ceres ANNOT ID no. 6086968
  misc_feature: Encodes the peptide sequence at SEQ ID NO 8178
atggctgccccggcgctccgcgtggcgatcctcgccgcggtcctgctgctcccattcctcagcgtgccgggcgccaaggcgcagaccaagaagttctgcctcacgcagttcgccatcgccagccaggcctgcgccatcctgccgcccaccagccccgagcaccgccaccacgatcacgacgacgaggaagaggatgagaacgaagacgaggagagcgacgatgaagacgaagacgaagacgaagacgaggacagtgacgacagcggcggcggcggcggcgggggtgatggcggcggcggtgatggcggtggcggcggcggtggtggaggcggtggcgatcgccgccaccgtgaccagcacgacaagaagagcggcgtcgttagtaaacccgccgcgtcagccactaaacccgccgtcgcgtcctccatgatcaccgtcgaggcagcggaggtggacgcctccaccgacgacgacgaccgcaacggcaccagccactccgtggtgagagacggaaaccacacccgcagcggaggcggcggcagcagcagcgcgcgacgccgccacggctccagcagcaggcgccgccgccgccgccgacaccgccgtggccgtctccgtgacggagaagacgccgaggacgaggacgaagacgaagacgaagatgaggaaaacgaagaggatgaggacgaggatgaagacgaggacgacgacgacgacgacgacgaggacgaccaccgcgcgtacagggactgctgccggtggctgaaggaggtggagccggactgcgtgtgcgaggcgctgctccgcctgccgcccttcctcgtcaggccgcagcacaagtacaccgtcaaggtgggcaactcctgcaagttcagctacaggtgcggcggcgtctga

SEQ ID NO: 8178 - protein, 298 aa, Sorghum bicolor
  misc_feature: Ceres ANNOT ID no. 6086968
  misc_feature (3)..(297): NCBI GI: 115473801 NCBI Desc: os07g0655800 [oryza sativa (japonica cultivar-group)]
  misc_feature (207)..(250): NCBI GI: 35210494 NCBI Desc: aspartic acid-rich protein aspolin2 [theragra chalcogramma]
  misc_feature (58)..(243): NCBI GI: 37991666 NCBI Desc: shell matrix protein [pinctada fucata]
  misc_feature (58)..(125): NCBI GI: 124248392 NCBI Desc: ip16861p [drosophila melanogaster]
  misc_feature (171)..(244): NCBI GI: 118465085 NCBI Desc: rne protein [mycobacterium avium 104]
MAAPALRVAILAAVLLLPFLSVPGAKAQTKKFCLTQFAIASQACAILPPTSPEHRHHDHDDEEEDENEDEESDDEDEDEDEDEDSDDSGGGGGGGDGGGGDGGGGGGGGGGGDRRHRDQHDKKSGVVSKPAASATKPAVASSMITVEAAEVDASTDDDDRNGTSHSVVRDGNHTRSGGGGSSSARRRHGSSSRRRRRRRHRRGRLRDGEDAEDEDEDEDEDEENEEDEDEDEDEDDDDDDDEDDHRAYRDCCRWLKEVEPDCVCEALLRLPPFLVRPQHKYTVKVGNSCKFSYRCGGV

SEQ ID NO: 8179 - DNA, 816 bp, Sorghum bicolor
  misc_feature: Ceres ANNOT ID no. 6086969
  misc_feature: Encodes the peptide sequence at SEQ ID NO 8180
atggcgctctcgtggccctcggccgtccgcctcgccgtcgccgccgtcctgctcgtcgccgtcggcgtcgcgctcttcacgctccccgtcgagaagattctaaaggactttctggtttggatcaaggagaacttgggtccatggggtcctttggtgttggccctcgcttacatccctctgacagtcttagctgttccagcatcaattcttacacttggagggggctatttatttggattgccagtagggtttgttgctgattccattggagcaacaattggtgcaactgctgcatttctgcttggcaggacgattgggaggccttatgttctctcaaaatgcaaagattaccctaagtttcaagcagtagccattgccatccaaagatctggcttcaagatcgtgttgctactaaggcttgtacctttacttccattcaacatgttgaactacctgttatctgtcactcctgttggtgttggagaatacatgttggcttcttggttgggaatgatgccaatcactcttgctttggtgtacgttggaacaacactgaaagatctatcagatgtgacacatgggtggagcgagatctcgactactcgatggattttgataatatctggctttgtattatctgtggtcttgattatctgcatcacaaaaattgcaaaatcatctctggagaaggcattggccgagaatggagagctggatgtaggaacatcgcagcttcctgtggtagcctctccctcggatctgcaacaacctcttgtaatcaagattgacacatcaaatgaagatcacgagaagtaa

SEQ ID NO: 8180 - protein, 271 aa, Sorghum bicolor
  misc_feature: Ceres ANNOT ID no. 6086969
  misc_feature (65)..(184): Pfam Id: SNARE_assoc Pfam Desc: SNARE associated Golgi protein
  misc_feature (6)..(266): NCBI GI: 3850582 NCBI Desc: f15k9.14 [arabidopsis thaliana]
  misc_feature (11)..(232): NCBI GI: 67922563 NCBI Desc: deda [crocosphaera watsonii wh 8501]
  misc_feature (7)..(233): NCBI GI: 53688163 NCBI Desc: cog0398: uncharacterized conserved protein [nostoc punctiforme pcc 73102]
  misc_feature (10)..(232): NCBI GI: 93450536 NCBI Desc: deda [delta proteobacterium mlms-1]
  misc_feature (31)..(232): NCBI GI: 23128177 NCBI Desc: cog0398: uncharacterized conserved protein [nostoc punctiforme pcc 73102]
MALSWPSAVRLAVAAVLLVAVGVALFTLPVEKILKDFLVWIKENLGPWGPLVLALAYIPLTVLAVPASILTLGGGYLFGLPVGFVADSIGATIGATAAFLLGRTIGRPYVLSKCKDYPKFQAVAIAIQRSGFKIVLLLRLVPLLPFNMLNYLLSVTPVGVGEYMLASWLGMMPITLALVYVGTTLKDLSDVTHGWSEISTTRWILIISGFVLSVVLIICITKIAKSSLEKALAENGELDVGTSQLPVVASPSDLQQPLVIKIDTSNEDHEK

SEQ ID NO: 8181 - DNA, 1641 bp, Sorghum bicolor
  misc_feature: Ceres ANNOT ID no. 6086974
  misc_feature: Encodes the peptide sequence at SEQ ID NO 8182
atggagaatacgaagctctcgtcgtcgctctttgccgggacccactttgaccgcaagcgtttcgccgccgacttcgctcggttccgtaaaggcccggctctcccatccgccgccgccaccgccaccgccgctccctccgcgccgtccccggagaagaagcggaagcgcaagagcggcaaggcaaaggcgaagaagaataagaagaagcgagccgaagatgcggccgccgcctcgtcgaatgttgtggaggggttcagcgtgttcaagggattggcggatagtaatgcggagctaccttctgagaaggtggatatgaggaaggacgaggattcggtggctgtgaggcagcggaaggagattgagagggaaatcgagagggctgcagttcttcgtaagaggtttgacatccacattgccgggcaaaatgctccagcaccacttgagagctttgaagaattgatttcaaggtatggttgtgattcttatttggttgggaacttgtcaaaacttggttttcaagaacctacaccaattcaaaggcaggccatgcctatacttctttcgggtagggaatgctttgcgtgtgccccaactggttctggcaagacactggctttcttgtttccacttcttatgaaaattaagccagggtcaaaaggtggcgttaaagccgtgattctttgcccgacaagggaattggctgcacaaactgtgagagaatgcaagaagttgattaaggggaggaagtactatattaaattgatgaccaaagaactatccaaatcagggaatttcaaagatatgcactgtgatatccttgtttccacccctcttcgtttggaccatgctgtaaagaaaagagaccttgatttaagtagtgtggaataccttgtcttagatgaatctgataaactttttgagcttggatttgttgaagtggttgattcagttgttgaagcctgttccaatccttcaataattcggtctctgttcagtgccactttgcccgattcaattgaggctcttgcacgcactataatgcatgatgccattcgagtcattgtcggcagaaagaattcagcctcctcactgattaagcaaaagttgattttcgctggaactgagaggggaaagttgctagcacttcgccaaagctttcaagagtctctcaatcctccagtattgatttttgttcaaagcaaagagagggccaaagagctttacaaagaactggcatttgatgacgttagagttgatgcaattcatgcagatctcaatgagcagcagcgtcaagatgctgttgacaatttgagagctggaaagacctgggtactgatagcaacagaagtcattgcccggggaatggacttcaaaggtgtaaactgcgtgataaactatgattttccggagtcagctgctgcctatattcacaggataggacgatgtggaagagctggtaggtttggggaggctatcacgttcttcacagaggaggacaagccattcttgaggaatatcgccaatgtgttggtatcttcgggctgtgaagtgccttcctggataatggcactgccaaagctcaagcgaaagaagcacagggtggatagggacccaatctccaacttacccgatgaagattga

SEQ ID NO: 8182 - protein, 546 aa, Sorghum bicolor
  misc_feature: Ceres ANNOT ID no. 6086974
  misc_feature (176)..(342): Pfam Id: DEAD Pfam Desc: DEAD/DEAH box helicase
  misc_feature (410)..(486): Pfam Id: Helicase_C Pfam Desc: Helicase conserved C-terminal domain
  misc_feature (172)..(337): Pfam Id: ResIII Pfam Desc: Type III restriction enzyme, res subunit
  misc_feature (51)..(544): NCBI GI: 92868239 NCBI Desc: helicase, c-terminal; type iii restriction enzyme, res subunit [medicago truncatula]
  misc_feature (66)..(543): NCBI GI: 74688760 NCBI Desc: atp-dependent rna helicase rok1
  misc_feature (16)..(543): NCBI GI: 38569505 NCBI Desc: atp-dependent rna helicase rok1 isoform a [homo sapiens]
  misc_feature (125)..(543): NCBI GI: 74694371 NCBI Desc: atp-dependent rna helicase rok1
  misc_feature (125)..(543): NCBI GI: 44982634 NCBI Desc: adl024cp [eremothecium gossypii]
MENTKLSSSLFAGTHFDRKRFAADFARFRKGPALPSAAATATAAPSAPSPEKKRKRKSGKAKAKKNKKKRAEDAAAASSNVVEGFSVFKGLADSNAELPSEKVDMRKDEDSVAVRQRKEIEREIERAAVLRKRFDIHIAGQNAPAPLESFEELISRYGCDSYLVGNLSKLGFQEPTPIQRQAMPILLSGRECFACAPTGSGKTLAFLFPLLMKIKPGSKGGVKAVILCPTRELAAQTVRECKKLIKGRKYYIKLMTKELSKSGNFKDMHCDILVSTPLRLDHAVKKRDLDLSSVEYLVLDESDKLFELGFVEVVDSVVEACSNPSIIRSLFSATLPDSIEALARTIMHDAIRVIVGRKNSASSLIKQKLIFAGTERGKLLALRQSFQESLNPPVLIFVQSKERAKELYKELAFDDVRVDAIHADLNEQQRQDAVDNLRAGKTWVLIATEVIARGMDFKGVNCVINYDFPESAAAYIHRIGRCGRAGRFGEAITFFTEEDKPFLRNIANVLVSSGCEVPSWIMALPKLKRKKHRVDRDPISNLPDED

SEQ ID NO: 8183 - DNA, 687 bp, Sorghum bicolor
  misc_feature: Ceres ANNOT ID no. 6086987
  misc_feature: Encodes the peptide sequence at SEQ ID NO 8184
atgcacaagacggcgcaggcctggttcaccggcgggaccgccgcctccaccggcaccgccgccgagtcgcagccgtccctcctcgccgactggaactcgtacgccgccacccgctccgacgcctcctcgtcctcgccgctccccttcgacatcgaggccgcggtccgctccgccaacgacaccgtctccggcaccttcagctcggtcaccaagggcgtgcgggagctcccggggagcttccagagcgccaccagcagcttcccctccgggaaggcgctcatgtacttcggcctcttcctcgccaccggcatcttcttcgtcttcatcgccttcgcgctcttcctccccgtcatggtgctcatgccgcagaagttcgccatctgcttcacgcttgggtgcgcgctcatcattgcgtcgctctttgcgctcaagggaccagcaaaccagctcgcccacatgacctccaaggagaggctaccgttttcagtgggatttattggatgcatggttggtacgatttatgtttctatggtgcttcacagctatttcctctctgtgatcttctcagtccttcaggttctggcccttgcatattacactatatcctacttccctggaggatctagtggactgaaattcatctcgtctggtctgttgtcctcggcagcaagtttatttagtcgatga

SEQ ID NO: 8184 - protein, 228 aa, Sorghum bicolor
  misc_feature: Ceres ANNOT ID no. 6086987
  misc_feature (87)..(211): Pfam Id: SFT2 Pfam Desc: SFT2-like protein
  misc_feature (5)..(228): NCBI GI: 51536558 NCBI Desc: at5g56020 [arabidopsis thaliana]
  misc_feature (81)..(227): NCBI GI: 46229268 NCBI Desc: conserved, similar to membrane protein involved in er to golgi transport [cryptosporidium parvum]
  misc_feature (16)..(218): NCBI GI: 89302939 NCBI Desc: phosphatidylinositol-4-phosphate 5-kinase family protein [tetrahymena thermophila sb210]
  misc_feature (91)..(214): NCBI GI: 119397434 NCBI Desc: sft2 domain protein [aspergillus clavatus nrrl 1]
  misc_feature (22)..(222): NCBI GI: 44982723 NCBI Desc: adr066cp [eremothecium gossypii]
MHKTAQAWFTGGTAASTGTAAESQPSLLADWNSYAATRSDASSSSPLPFDIEAAVRSANDTVSGTFSSVTKGVRELPGSFQSATSSFPSGKALMYFGLFLATGIFFVFIAFALFLPVMVLMPQKFAICFTLGCALIIASLFALKGPANQLAHMTSKERLPFSVGFIGCMVGTIYVSMVLHSYFLSVIFSVLQVLALAYYTISYFPGGSSGLKFISSGLLSSAASLFSR

SEQ ID NO: 8185 - DNA, 1356 bp, Sorghum bicolor
  misc_feature: Ceres ANNOT ID no. 6087000
  misc_feature: Encodes the peptide sequence at SEQ ID NO 8186
atgcccgaggacggcgcgtcgatgcacatgctgcggcgcgtcctcgacggcctgcagtgcctgcacccgcgccggcggcggcggcacggaggcgcggggccgcctaagcagaaggcgcgcgtcgcggtgcggcggttcggcaccagcaaggccacgacgtgcggcggtgaaggtggaggtggaggcgccagcgcgggcggagggcgggaggtgacgatccgcgtggcgacgttcaacgcggccatgttctccatggcgcccgcggtgtccggcgaggccgcgccggcagcggcaacggcagcgggggcgggggcgggcgctgggctccccggcagcccgcggcggccgcccaagggcatcctgaaggcgcaggcggcggcgagcctggcgcggtcgccgagcaaggcgcgcgtgtccatcaacctccaggacaacgagatctccctggagcggacccggctgtggcgcggcggcggcggcggcagcaccaagaggcagcagcagcagccggtcccggcgtcgtcggcgccgcggcctcggcggtggagcgtggaggaggtgctgcgcgaggccggcgccgacatcatcgggcttcagaacgtgcgcgccgaggaggagcgcgggatgcggccgctgtcggagctggcggaggggctgggcatgcgctacgtgttcgccgagagctgggcgcccgagtacggcaacgccgtgctctcccgctggcccatcaagcgctggaaggcgcaccgcgtcgccgaccaatccgacttccggaacgtgctgcgcgccacgatcgaggtgccggacgccggcgaggtgaacttccactgcacgcacctggaccacctggacgagaggtggaggatgaagcaggtggacgccatcatccgctccggcgacggcccgcacatcctcgccggcggcctcaacgcgctcgacggcaccgactactccgccgaccgatgggccgacatcgtcaagtactacgaggagatcggcaagccgacgcccaaggtggaggtgatgcagtacctcaaggcgaagcagtacgtcgacgccaaggacttcgccggagaatgcgaggcggtggtggttgtggccaaaggacaaaatgtgcaagggacgtgcaagtacggcacgagggtggactacatcctggcgtcgcccaactcctcctacaagttcgtgcctggatcctacacggtcgtatcctccaaagggacatcggatcatcacatcgttcgggtcgacgtcgccatacctcagatcagagaaaccgacgccgagaccgccacgaacgggaaacgcagagtagtcaagatgaacaagaagagctcgagaaaggggatatggtga

SEQ ID NO: 8186 - protein, 451 aa, Sorghum bicolor
  misc_feature: Ceres ANNOT ID no. 6087000
  misc_feature (73)..(418): Pfam Id: Exo_endo_phos Pfam Desc: Endonuclease/Exonuclease/phosphatase family
  misc_feature (180)..(324): NCBI GI: 119876262 NCBI Desc: endonuclease/exonuclease/phosphatase [stenotrophomonas maltophilia r551-3]
  misc_feature (188)..(314): NCBI GI: 134300632 NCBI Desc: endonuclease/exonuclease/phosphatase [desulfotomaculum reducens mi-1]
  misc_feature (184)..(310): NCBI GI: 89209549 NCBI Desc: endonuclease/exonuclease/phosphatase [halothermothrix orenii h 168]
  misc_feature (183)..(312): NCBI GI: 86141528 NCBI Desc: probable secreted protein [flavobacterium sp. med217]
  misc_feature (187)..(310): NCBI GI: 134291232 NCBI Desc: endonuclease/exonuclease/phosphatase [burkholderia vietnamiensis g4]
MPEDGASMHMLRRVLDGLQCLHPRRRRRHGGAGPPKQKARVAVRRFGTSKATTCGGEGGGGGASAGGGREVTIRVATFNAAMFSMAPAVSGEAAPAAATAAGAGAGAGLPGSPRRPPKGILKAQAAASLARSPSKARVSINLQDNEISLERTRLWRGGGGGSTKRQQQQPVPASSAPRPRRWSVEEVLREAGADIIGLQNVRAEEERGMRPLSELAEGLGMRYVFAESWAPEYGNAVLSRWPIKRWKAHRVADQSDFRNVLRATIEVPDAGEVNFHCTHLDHLDERWRMKQVDAIIRSGDGPHILAGGLNALDGTDYSADRWADIVKYYEEIGKPTPKVEVMQYLKAKQYVDAKDFAGECEAVVVVAKGQNVQGTCKYGTRVDYILASPNSSYKFVPGSYTVVSSKGTSDHHIVRVDVAIPQIRETDAETATNGKRRVVKMNKKSSRKGIW

SEQ ID NO: 8187 - DNA, 561 bp, Sorghum bicolor
  misc_feature: Ceres ANNOT ID no. 6087003
  misc_feature: Encodes the peptide sequence at SEQ ID NO 8188
atggcggacgtgacgttcaagagcatcggcgacgtgctgaagctgctgccgacggcgacggtgatcgtgtacgaggtgctgaacccgatcgtgaccaacacgggcaactgcggcgccgtcgggtacaagatcgccacggggatcctcctggccgtctccgccttcttctgcgccttctccaccttcaccgacagctacgtgggcgccgacgacggcaaggtcaagtacggcctcgtgacgccccggggcctcctccccttcaccgacggcggcgccgccaccagcgggagggacttctccaagtaccggctgcgattcggggacttcgtgcacgccgcgttcgccgtcgccgtcttcgcggcggtgtcgctgctggcggacgccaacacggtggcgtgcttctacccgtcgctcagggacaagcagaaggaggtggtcatggcgctccccgtcgtcgtcggcgccgtcgccagcgtcgtcttcgtcgtgttcccctccacgcgccacgggatcgggtacccgccgtccaagtccgggacgagcgcgctcgcctcgcagtag

SEQ ID NO: 8188 - protein, 186 aa, Sorghum bicolor
  misc_feature: Ceres ANNOT ID no. 6087003
  misc_feature (15)..(174): NCBI GI: 115441457 NCBI Desc: os01g0882400 [oryza sativa (japonica cultivar-group)]
  misc_feature (12)..(172): NCBI GI: 72384432 NCBI Desc: 52o08_3 [brassica rapa subsp. pekinensis]
  misc_feature (1)..(173): NCBI GI: 15528693 NCBI Desc: p0560b06.26 [oryza sativa (japonica cultivar-group)]
  misc_feature (1)..(173): NCBI GI: 115436576 NCBI Desc: os01g0368700 [oryza sativa (japonica cultivar-group)]
  misc_feature (116)..(176): NCBI GI: 115465445 NCBI Desc: os05g0562800 [oryza sativa (japonica cultivar-group)]
MADVTFKSIGDVLKLLPTATVIVYEVLNPIVTNTGNCGAVGYKIATGILLAVSAFFCAFSTFTDSYVGADDGKVKYGLVTPRGLLPFTDGGAATSGRDFSKYRLRFGDFVHAAFAVAVFAAVSLLADANTVACFYPSLRDKQKEVVMALPVVVGAVASVVFVVFPSTRHGIGYPPSKSGTSALASQ

SEQ ID NO: 8189 - DNA, 1761 bp, Sorghum bicolor
  misc_feature: Ceres ANNOT ID no. 6087006
  misc_feature: Encodes the peptide sequence at SEQ ID NO 8190
atgctcgccgccgctcgctccctccgccgcctctccacttcctcttcatcctccgtccgcgcccttcgccgcgtcctcctgcaccatccaccatccccgccctcacttccgcctcctctcccgcctctccgaacccttacgcgcgccttcctcccgcacctcgcagctacccacgggctctccgctgcttccttctctacctccgccccatcacgcctaggagaacgtgttgacgtgcggggagcgccggcgatacccgaggaggaggagggggaggagacggcgggggcgttggtgcggcatgacacggatgcgtacgcggcggtggagctggctctggactcagtggtgaaggtgttcacggtgtccagcagccccaactacttcttgccatggcagaataaggcgcagcgggagagcatgggatccgggtttgtaattcctggaagaaggatcgtgacgaatgcgcatgtggtagctgatcatacttttgttcttgtgaggaagcatggttctcctactaaatacagagcagaagtccaagctgttggtcatgaatgtgacttggctctgttgacagttgagagtgaggagttttgggatggggtgaacagtttggagcttggtgacatcccctttttgcaagaagccgtcgctgtggttggctaccctcaaggtggagataatatttctgtcaccaagggggttgtatctagagttgaaccaacacaatatgcccatggtgctacgcagcttatggctatacagatagacgcagccataaatccaggtaatagtggagggcctgccattatgggtgataaagtagccggagttgctttccagaatttgtcaggggcggaaaacattggttatatcataccggtgcccgtaattaagcgtttcatttctggagtagaagagagcggtagatattctgggttttgtactcttggagtatcttgccaggctactgaaaatattcagttaagagagtgctttgggatgcggcctgaaatgactggagttttagttagtagaataaaccctctatctgatgcttacaagattttgaagaaggatgacatccttcttgagtttgatggtgtgcctatcgcaaatgatggcacagttccattccggaatagagagagaatcacctttgatcatctggtgtccatgaaaaaacctgaagaaacagctgttctcaaagtattacgagatggtaaagagcaagaattgagagtaacacttagacctctgcaacctttagtcccagtccatcaatttgataaattaccgagctactacatatttgctggttttgtttttatcccatttacccagccttatctccatgaatttggagaagactggtataatgcctcaccacgccgattatgtgaacgggcactaagagagcttccaaagaaggctggtgaacaattagttatcctatctcaggttctaatggatgatatcaatgtcggttatgaaaggcttgctgaactacaggtaaagaaggtaaatggtgtggaggttgaaaacctgaagcacctgtgcagcctcgtggaaggctgcaccgaagaaaacttaaggtttgacttggacgatgaaagagtcattgtcctgaagtaccagaacgcaaagcttgccacatcccgggtcctcaaacggcacaggataccgtcagccatatcgagtgaccttgtcgaagatgaaccaactaatggcgaggttgagacatcatgcaccagctaa

SEQ ID NO: 8190 - protein, 586 aa, Sorghum bicolor
  misc_feature: Ceres ANNOT ID no. 6087006
  misc_feature (118)..(303): Pfam Id: Trypsin Pfam Desc: Trypsin
  misc_feature (107)..(487): NCBI GI: 91806029 NCBI Desc: degp protease [arabidopsis thaliana]
  misc_feature (107)..(483): NCBI GI: 2190549 NCBI Desc: f5i14.17 gene product [arabidopsis thaliana]
  misc_feature (107)..(386): NCBI GI: 2190559 NCBI Desc: f5i14.16 [arabidopsis thaliana]
  misc_feature (115)..(564): NCBI GI: 84999382 NCBI Desc: serine protease [theileria annulata strain ankara]
  misc_feature (116)..(368): NCBI GI: 33332321 NCBI Desc: degp-like serine protease 1 precursor [plasmodium falciparum]
MLAAARSLRRLSTSSSSSVRALRRVLLHHPPSPPSLPPPLPPLRTLTRAFLPHLAATHGLSAASFSTSAPSRLGERVDVRGAPAIPEEEEGEETAGALVRHDTDAYAAVELALDSVVKVFTVSSSPNYFLPWQNKAQRESMGSGFVIPGRRIVTNAHVVADHTFVLVRKHGSPTKYRAEVQAVGHECDLALLTVESEEFWDGVNSLELGDIPFLQEAVAVVGYPQGGDNISVTKGVVSRVEPTQYAHGATQLMAIQIDAAINPGNSGGPAIMGDKVAGVAFQNLSGAENIGYIIPVPVIKRFISGVEESGRYSGFCTLGVSCQATENIQLRECFGMRPEMTGVLVSRINPLSDAYKILKKDDILLEFDGVPIANDGTVPFRNRERITFDHLVSMKKPEETAVLKVLRDGKEQELRVTLRPLQPLVPVHQFDKLPSYYIFAGFVFIPFTQPYLHEFGEDWYNASPRRLCERALRELPKKAGEQLVILSQVLMDDINVGYERLAELQVKKVNGVEVENLKHLCSLVEGCTEENLRFDLDDERVIVLKYQNAKLATSRVLKRHRIPSAISSDLVEDEPTNGEVETSCTS

SEQ ID NO: 8191 - DNA, 2799 bp, Sorghum bicolor
  misc_feature: Ceres ANNOT ID no. 6087010
  misc_feature: Encodes the peptide sequence at SEQ ID NO 8192
atgccgtcagcgtcgggtccggtggccgtggcgtcagcgtcggcggcggcgaaggccgcgccgtccccggccatcgggatctcgccggacctgtacccgacggaggacgacctgccctacgaggaggagatcctgcgggagcctttcaagctcaaggggtggtggcgctacctcgtggctcgcgcctccgctccgttcgccaagcgcgccgtcatctacgagcgcgcgctcaaggcgctccccgggagctacaagctctggcacgcctacctccgcgaccgcctcgaccacgcgcgcccgcaccccatcgaccacccggcctactcctccctcaacaacaccttcgagcgggcgctggccaccatgcacaagatgccgcgtgtctgggtcctctacctcacctcactgctcgaccagcgcctgctcacgcgcgcgcgccgctccttcgaccgtgccctccgcgcgctccccgtcacgcagcacgaccgcatctggccgctgtacctccgcctcgcctcgctcccggcctgccccgtcgagacgtcgctccgagtcttccgccgatacctccaattcgacccctcccacgccgaggacttcatcaacttccttatatccgccaaccactggcaggaggctgccaaccgtctagcatccgtgctcaacgacgatgggttccgctccgtcaaggggaaaacaaggcaccagctctggctcgagctctgcgagatcctcaccaagcatgccgatgaggttgccggcctcaaggtggacgccatcctgcgtggcgggatacgcaagttcaccgatgaggtcggcaagctttggacctcactggctgattactatgtcaggagaggccttttcgaaaaagctagggatgtatttgaggagggcatttcttcagtggttaccgtcaaggagttcagcgtggtgtttgaggcatatacacagtttgagcagagtatgcttgcggcaaagctggaggctgctgaggaagaaggggctgaggatgagaacgagggagggggcagaaagagtgggatggataagttatcaaagaaattcctcgatgaattctggttgaacgatgaggatgatactgatttgaggatggcaaggtttgagcggctgttggatcgcagaccagagcttcttagcagcgtgctgttgcgacagaatccacacaatgtggaggagtggcacaggagggtgaaactctttgaaaaggatcctgcaaggcaagtagcgacatatgttgaggccgtgaaaactgtagacccaatgaaggcagttgggaagccccatactctatgggtggcatttgccaagatgtatgagaaacacaatcgtctagatagtgctgaagatattttcaaacgggctactcaagtgaattataaggcagttgaccacttagccagtatctggtgtgagtgggcagagatggagctgcgccacaacaattttgacaaggctattgagctgatgaggcaggcaacggcagagccctctgttgaggttaagaggcgggctgctgctgagggggacgagcctgtccaaatgaaagtgcacaaatctttgaaaatgtggagcttttatgttgatctggaggagagccttggaaccttagactctacccgtgcagtttatgagagaatattggatttacgaattgccactccacagataattctcaactatgcatatcttcttgaggagcacaagtatttcgaagatgcatttaaagtgtatgaaaggggtgtgaaaatattcaagtatccccacgttaaggccatttgggtgacctaccttacaaagtttgtacagagatacaagagaagcaagttagaacgagcaagagagcttttccatgaagctgtccaacaggctcctccagaggaaaagaagcccctatatttacaatgggcaaaactggaggaagactatggtcttgccaaacgtgctatgaatgtatatgatgaagctgtaagagctgttcctaacagtgaaaaaatggctatgtatgaaatctatatagcacgtgctgccgaactcttcggtgttccaaggacaagacaaatatatgagcaagcaattgaatcaggcctcccagacagagatgttctgacaatgtgcatgaaattcgctgagttagagagaaaccttggggaaattgatcgttcgcgtgccatctatgtgcatgcatccaactatgctgatccaaacaatcctgacttttggaagaagtggaatgattttgagattcagcacggtaacgaagacacattcagggagatgcttcgtatcaagcgtacagtggctgctagccgcagtcagacacatttcatactaccggagtacttgatgcagagggatcagaggttaaatctggacgaagcagttgacactcttaagcgtgctggcgtccctgaagatgagatggcagccttggaaaggcaactggctccgggaccatccactgcaccaccagcagcaccaagcactgccccagcgtctgctaacaggatgatgaacttcgtcagtgctggagtagaagcgcaggccgagagcagcagacaacaggctggtaacaatgaggacattgagctgcccgacgagagtgacgacgaggaacctgatgtccaaattgcggaaaagagtgttcctgctgcggtatttggtgagcttggcaagagagctgctgagaatgctgccgagaataatgaggaaagctcaggtgcccaagggaatgagcagctgggcgcccttgagaggataaagagacgacgacaatag

SEQ ID NO: 8192 - protein, 932 aa, Sorghum bicolor
  misc_feature: Ceres ANNOT ID no. 6087010
  misc_feature (349)..(897): NCBI GI: 40786529 NCBI Desc: xpa binding protein 2 [danio rerio]
  misc_feature (349)..(897): NCBI GI: 34783757 NCBI Desc: xab2 protein [danio rerio]
  misc_feature (367)..(843): NCBI GI: 74599212 NCBI Desc: pre-mrna splicing factor syf1
  misc_feature (363)..(876): NCBI GI: 115387509 NCBI Desc: pre-mrna splicing factor syf-1 [aspergillus terreus nih2624]
  misc_feature (452)..(897): NCBI GI: 9295341 NCBI Desc: hcnp [homo sapiens]
MPSASGPVAVASASAAAKAAPSPAIGISPDLYPTEDDLPYEEEILREPFKLKGWWRYLVARASAPFAKRAVIYERALKALPGSYKLWHAYLRDRLDHARPHPIDHPAYSSLNNTFERALATMHKMPRVWVLYLTSLLDQRLLTRARRSFDRALRALPVTQHDRIWPLYLRLASLPACPVETSLRVFRRYLQFDPSHAEDFINFLISANHWQEAANRLASVLNDDGFRSVKGKTRHQLWLELCEILTKHADEVAGLKVDAILRGGIRKFTDEVGKLWTSLADYYVRRGLFEKARDVFEEGISSVVTVKEFSVVFEAYTQFEQSMLAAKLEAAEEEGAEDENEGGGRKSGMDKLSKKFLDEFWLNDEDDTDLRMARFERLLDRRPELLSSVLLRQNPHNVEEWHRRVKLFEKDPARQVATYVEAVKTVDPMKAVGKPHTLWVAFAKMYEKHNRLDSAEDIFKRATQVNYKAVDHLASIWCEWAEMELRHNNFDKAIELMRQATAEPSVEVKRRAAAEGDEPVQMKVHKSLKMWSFYVDLEESLGTLDSTRAVYERILDLRIATPQIILNYAYLLEEHKYFEDAFKVYERGVKIFKYPHVKAIWVTYLTKFVQRYKRSKLERARELFHEAVQQAPPEEKKPLYLQWAKLEEDYGLAKRAMNVYDEAVRAVPNSEKMAMYEIYIARAAELFGVPRTRQIYEQAIESGLPDRDVLTMCMKFAELERNLGEIDRSRAIYVHASNYADPNNPDFWKKWNDFEIQHGNEDTFREMLRIKRTVAASRSQTHFILPEYLMQRDQRLNLDEAVDTLKRAGVPEDEMAALERQLAPGPSTAPPAAPSTAPASANRMMNFVSAGVEAQAESSRQQAGNNEDIELPDESDDEEPDVQIAEKSVPAAVFGELGKRAAENAAENNEESSGAQGNEQLGALERIKRRRQ

SEQ ID NO: 8193 - DNA, 1713 bp, Sorghum bicolor
  misc_feature: Ceres ANNOT ID no. 6087014
  misc_feature: Encodes the peptide sequence at SEQ ID NO 8194
atggcggagccggccctcctcgcgccggaccccttcgcggacctccccttccccgaattccaggcgcccgtggacggcgacaccttcgcgttcgaggacttcgatctggaggatctggacctggacctggacgtcgacttcgacctcgatctatttgcctcggacgggcaactctcgcagccgccccctctcgcgacctcgtcctcctcggccgggtctccggaggggggatcgtcctcttccggcggcggcggcgggctgaggaacgaggagtcctcggagtcgtcttcgaggagcgcgagcggcacggatggcagcgacaaggggaagggggaggacgacgaagcgaagcgccgcgcgcggctggtacgcaaccgcgagagcgcgcacctgtcgcggcagaggaagaagcagtacgtggaggagctggaaggtaaggtgaaggccatgcaggccaccatcgctgacctctccgccaggatctcctgcgtcaccgccgagaacgccgctctcaagcagcagctgggtggcgctgctggagccgcgccgccgctgccaatgccgatgtaccccgcgatgtatcctttgccgatgccgtggatgcacccggcgtatcccatgcgtggatcacaggtaccgctggtgccaattcctcggctgaaaccccagcaacctgcacctactgcagcagagccaccggccaagaaggctaggaagaccaagaaggttgcaagtgttagcttcctggggttgctttgccttgcgatgctctgtgggtgtttgatttctgtagtacatcggatgtatccctctgttgatgctggagaaggtgctgcatttggtccttctcatcatgggaggatcctggctgttgaggggcctcatgataatgtctcggatggtatcgatccaaagccgccacagagtggcagtgagacccttccagcgctgttgtatctaccgaagaatgggaaacatgtcaagattaatgggaatcttgttattaagtcaattgttgctagtgagaaagcttcattgcggttgcctggctatgatgggacgagtcctcaaaagcaaaagaaggaagagactagcttggcaattcccggctatgtgactccattggaagctggagaggttatggaatcagccaaaggagtgatgaaaaatgaactgatggctttggctcctgcagatggaaatgtgtatagggaggaggatggattgctgccacagtggtttagtgaagcaatgtctggtcccttgctgagctcaggaatgtgcactgaagttttccagtttgatgcatctccatcatctgctcattcaaatggcatcattcctgtctactccaataccatgtcaaactcgtcacagaattttactcaaaagcttccctccgcttgtcctcgcacggtgaagaacagaaggatttcatactctgagaccattcctttaagaggttcaacatccaacgacaccgagcacttcaaaacaccaccgaagaatgagagctttggcagtacgaagcctgtttcatcggtggtcgtctcagtgctggctgatcccagagaggctggtgacggggatggtgaggggaggatctcttcaaaatcgttgtcccggatcttcgttgtcgttcttatagatagtgttaagtatgttacttactcttgtgtcctgccgttcaaaagccatagccctcacctttag

SEQ ID NO: 8194 - protein, 570 aa, Sorghum bicolor
  misc_feature: Ceres ANNOT ID no. 6087014
  misc_feature (113)..(176): Pfam Id: bZIP_1 Pfam Desc: bZIP transcription factor
  misc_feature (113)..(167): Pfam Id: bZIP_2 Pfam Desc: Basic region leucine zipper
  misc_feature (274)..(570): NCBI GI: 20196934 NCBI Desc: bzip family transcription factor [arabidopsis thaliana]
  misc_feature (309)..(562): NCBI GI: 124361217 NCBI Desc: camp response element binding (creb) protein [medicago truncatula]
  misc_feature (66)..(570): NCBI GI: 7594544 NCBI Desc: transcription factor-like protein [arabidopsis thaliana]
  misc_feature (70)..(302): NCBI GI: 110742142 NCBI Desc: bzip transcription factor atbzip28 [arabidopsis thaliana]
  misc_feature (286)..(570): NCBI GI: 145652329 NCBI Desc: transcription factor bzip38 [glycine max]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1226 in the 10/412,699US patent application
  misc_feature: The sequence is a functional homolog of SEQ ID NO 1343 in the 10/374,780US patent application
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 148 in the 10/412,699US patent application
  misc_feature: The sequence is a functional homolog of SEQ ID NO 1483 in the 10/412,699US patent application
  misc_feature: The sequence is a functional homolog of SEQ ID NO 2 in the 10/374,780US patent application
  misc_feature: The sequence is a functional homolog of SEQ ID NO 2266 in the 10/374,780US patent application
  misc_feature: The sequence is a functional homolog of SEQ ID NO 341 in the 11/479,226US patent application
  misc_feature: The sequence is a functional homolog of SEQ ID NO 368 in the 10/412,699US patent application
  misc_feature: The sequence is a functional homolog of SEQ ID NO 4 in the 10/286,264US patent application
  misc_feature: The sequence is a functional homolog of SEQ ID NO 42 in the 10/286,264US patent application
  misc_feature: The sequence is a functional homolog of SEQ ID NO 464 in the 11/435,388US patent application
  misc_feature: The sequence is a functional homolog of SEQ ID NO 58 in the 11/375,241US patent application
  misc_feature: The sequence is a functional homolog of SEQ ID NO 859 in the 11/479,226US patent application
  misc_feature: The sequence is a functional homolog of SEQ ID NO 923 in the 10/374,780US patent application
  misc_feature: The sequence is a functional homolog of SEQ ID NO 933 in the 10/374,780US patent application
  misc_feature: Useful for making plants with modulated growth and phenotype characteristics
  misc_feature: The sequence is a functional homolog of SEQ ID NO 4 in the 20030093837 US patent application
  misc_feature: The sequence is a functional homolog of SEQ ID NO 42 in the 20030093837 US patent application
  misc_feature: The sequence is a functional homolog of SEQ ID NO 12 in the 20040045049 US patent application
  misc_feature: The sequence is a functional homolog of SEQ ID NO 1226 in the 20040045049 US patent application
  misc_feature: The sequence is a functional homolog of SEQ ID NO 148 in the 20040045049 US patent application
  misc_feature: The sequence is a functional homolog of SEQ ID NO 1483 in the 20040045049 US patent application
  misc_feature: The sequence is a functional homolog of SEQ ID NO 1343 in the 20060162006 US patent application
  misc_feature: The sequence is a functional homolog of SEQ ID NO 933 in the 20060162006 US patent application
MAEPALLAPDPFADLPFPEFQAPVDGDTFAFEDFDLEDLDLDLDVDFDLDLFASDGQLSQPPPLATSSSSAGSPEGGSSSSGGGGGLRNEESSESSSRSASGTDGSDKGKGEDDEAKRRARLVRNRESAHLSRQRKKQYVEELEGKVKAMQATIADLSARISCVTAENAALKQQLGGAAGAAPPLPMPMYPAMYPLPMPWMHPAYPMRGSQVPLVPIPRLKPQQPAPTAAEPPAKKARKTKKVASVSFLGLLCLAMLCGCLISVVHRMYPSVDAGEGAAFGPSHHGRILAVEGPHDNVSDGIDPKPPQSGSETLPALLYLPKNGKHVKINGNLVIKSIVASEKASLRLPGYDGTSPQKQKKEETSLAIPGYVTPLEAGEVMESAKGVMKNELMALAPADGNVYREEDGLLPQWFSEAMSGPLLSSGMCTEVFQFDASPSSAHSNGIIPVYSNTMSNSSQNFTQKLPSACPRTVKNRRISYSETIPLRGSTSNDTEHFKTPPKNESFGSTKPVSSVVVSVLADPREAGDGDGEGRISSKSLSRIFVVVLIDSVKYVTYSCVLPFKSHSPHL

SEQ ID NO: 8195 - DNA, 957 bp, Sorghum bicolor
  misc_feature: Ceres ANNOT ID no. 6087015
  misc_feature: Encodes the peptide sequence at SEQ ID NO 8196
atggcgacggtcgcagcccgccgcctcctccagcagcgatgggtggccggcgggcggtgccggctgctgggcacggcggcggaggcttctcccggcggggagggtgcgcgaggaggaggtggtggatctggcgacgcgatctacgtgaagaagccggcagccgccgcggccgtgacgacgcgggacgagacgtcggtggcgatgccgacgtcgttcatgacggggtcggtggttgggaagcgcttctaccgcgacgccaccgtgcggcgcgccgacgacggcaacgggtggaccgtgatgctggactaccgcacgctcaagtcgccggccaagcggccgctcaagctgccctcgcgcgcgctcgccatggccatcgccgccgagtgggagtaccaggaatcagatggaattcgacctttcacaatgcctctcatgaagcttgcttgcactgcattggagagagttcctttgacacggagaaaagtaattgataatttgatgaagaaatttcatcaagatttggtattctgtcgctcacctgctgatagtgaactgaccattggagttcatcaaaagcagaaggagaaaattgatcctattctggagtgggtagatactgaatttgggttcaagcctattgtctacacgaccttctttgggggaaagcaagatgagggccttgctaaggctgtagaaactgttctaaagaaagcaactgactgtgagttggcatctattgatgctatggctgcagcagcccattccctggtgatccctcttgcaatatttagagaaaggttgggtattgaggaggccattgagttgatcaggctagaagaagaccaccaggttgaccgatggggcttggtggaaggaggtcatgacgttgatattgctgatcttaaagtgcagatgtcctcggctgttgtatttcttgaacttacacggggactgtga

SEQ ID NO: 8196 - protein, 318 aa, Sorghum bicolor
  misc_feature: Ceres ANNOT ID no. 6087015
  misc_feature (73)..(208): Pfam Id: ATP12 Pfam Desc: ATP12 chaperone protein
  misc_feature (50)..(316): NCBI GI: 22655442 NCBI Desc: at5g40660/mnf13_180 [arabidopsis thaliana]
  misc_feature (49)..(314): NCBI GI: 21735485 NCBI Desc: atp synthase mitochondrial f1 complex assembly factor 2 [homo sapiens]
  misc_feature (78)..(299): NCBI GI: 146278538 NCBI Desc: atp12 atpase [rhodobacter sphaeroides atcc 17025]
  misc_feature (80)..(314): NCBI GI: 21703852 NCBI Desc: atp synthase mitochondrial f1 complex assembly factor 2 [mus musculus]
  misc_feature (80)..(314): NCBI GI: 88862666 NCBI Desc: atp12 atpase [jannaschia sp. ccs1]
MATVAARRLLQQRWVAGGRCRLLGTAAEASPGGEGARGGGGGSGDAIYVKKPAAAAAVTTRDETSVAMPTSFMTGSVVGKRFYRDATVRRADDGNGWTVMLDYRTLKSPAKRPLKLPSRALAMAIAAEWEYQESDGIRPFTMPLMKLACTALERVPLTRRKVIDNLMKKFHQDLVFCRSPADSELTIGVHQKQKEKIDPILEWVDTEFGFKPIVYTTFFGGKQDEGLAKAVETVLKKATDCELASIDAMAAAAHSLVIPLAIFRERLGIEEAIELIRLEEDHQVDRWGLVEGGHDVDIADLKVQMSSAVVFLELTRGL

SEQ ID NO: 8197 - DNA, 1107 bp, Sorghum bicolor
  misc_feature: Ceres ANNOT ID no. 6087017
  misc_feature: Encodes the peptide sequence at SEQ ID NO 8198
atggcttcagcagctagcgagatggaaggcgaaggcgccggcgccggcaccggcactggggaaggagcgccaatcgcgccgcgcaggccggccctgccgttgaaggtgcggttccagctcatgtgcctcgacgtcgtcggtggcctctcgatgcgtcgcgacggcaccatcaaccgctccctcttcagcctcttcgaccgccgcgcccgcgctagcgcgcgcccggatggcctcggcgtccggtccgccgacgtgcacgtggacgcgtcgcgcggcttgtgggcgcgcgtgttctcgccgtcggaggcggccgggtcaccgctccccgtcgtggtctatttccacggtggcgcattcgcgctgctctccgcggcctcggtcccctacgacgccatgtgccgccggttctgccgcgagctgggcgccgtcgtcgtgtccgtcgactaccgcctcgccccggagcaccgctgccccgccgcgtacgacgacggcgtcgacgtgctccggcacctcgcctccacagggctccccgacggcgtcgccgtgccggtcgacctctcccgctgcttcctcgccggggacagcgccggggccaacatcgctcaccacgtggcgcagcgctggacgacggccggcgtcgcgtcctcctcgtcgtccccgccgcgttcctgccccgtccgcctcgcgggcgtcgtcctggtgcagccgtacctgggcggcgaggagcggacggacgcggaggtcatgctggacgggaaggtgccggtggtcaccgtgcggggctcggactggatgtggcgggcgttcctgccggagggcgccgacaggaaccaccccgccgcgcacgtgaccgacgagaacgccgacctggcggacggctttccgccggcgatggtggtgatcggcggcctcgacccgctgcaggattggcagaggcggtacgccgacgtgctgcggcggaaggggaaggcggtgcgggtggtggagttccaggaggccattcacacgttcttcttcttccccgagctccccgactgcgccaggctcgtggaggcgatgaaggccttcatagatgacagcaacgcatcctccgtctcggctgcttga

SEQ ID NO: 8198 - protein, 368 aa, Sorghum bicolor
  misc_feature: Ceres ANNOT ID no. 6087017
  misc_feature (111)..(339): Pfam Id: Abhydrolase_3 Pfam Desc: alpha/beta hydrolase fold
  misc_feature (28)..(365): NCBI GI: 23237915 NCBI Desc: carboxylesterase-like protein [oryza sativa (japonica cultivar-group)]
  misc_feature (17)..(368): NCBI GI: 115484865 NCBI Desc: os11g0239500 [oryza sativa (japonica cultivar-group)]
  misc_feature (30)..(357): NCBI GI: 115484875 NCBI Desc: os11g0240600 [oryza sativa (japonica cultivar-group)]
  misc_feature (30)..(357): NCBI GI: 82697971 NCBI Desc: cxe carboxylesterase [actinidia deliciosa]
  misc_feature (23)..(362): NCBI GI: 92871235 NCBI Desc: esterase/lipase/thioesterase [medicago truncatula]
MASAASEMEGEGAGAGTGTGEGAPIAPRRPALPLKVRFQLMCLDVVGGLSMRRDGTINRSLFSLFDRRARASARPDGLGVRSADVHVDASRGLWARVFSPSEAAGSPLPVVVYFHGGAFALLSAASVPYDAMCRRFCRELGAVVVSVDYRLAPEHRCPAAYDDGVDVLRHLASTGLPDGVAVPVDLSRCFLAGDSAGANIAHHVAQRWTTAGVASSSSSPPRSCPVRLAGVVLVQPYLGGEERTDAEVMLDGKVPVVTVRGSDWMWRAFLPEGADRNHPAAHVTDENADLADGFPPAMVVIGGLDPLQDWQRRYADVLRRKGKAVRVVEFQEAIHTFFFFPELPDCARLVEAMKAFIDDSNASSVSAA

SEQ ID NO: 8199 - DNA, 1485 bp, Sorghum bicolor
  misc_feature: Ceres ANNOT ID no. 6087027
  misc_feature: Encodes the peptide sequence at SEQ ID NO 8200
atgactcgatcttcgactatcgattttggtcggaggaagcagagcgagctcttcgggtcagggccactgcgtccagcaaacatcatcaggaataagttccctacctacaagaatggttcaaacgggattgttatcaaattggtggatgccccagaaatgccatctcttaaggaggctgttgccaaggagacaactgatttgcttgataggtgtcagcgcctttcagtccgtgagctcaccatgaaattcgagaagggctttaacacagctaccttgttgtctaatgaggctaaatggagacatgcggctttattggagcgagacatccttctaaagaatcttaaaagcgtattggaatcattgagaggtcgagtagggggcaaaaataaagatgaaattgaggagtctctatctatggtggatattttagcagttgagctatccaaaagagaagatgagttgcttcagcaaaaaacagagatcaccaaaattgcagccacattgaaactggcttctaaagatgccaagagaattgttgatgaagaaagagctaatgctcggttggagatagaaagtgctaaagctgctgtacataaaattcaattagcacttaaagagcaggaaaatttttatcaaagaactgggaagcaggatgttgatgaactgaaggaagaagttcaagaagcacggagagtgaaaatgctgcattgcccaagcaaggcaatggacatcgagaacgagatccaagttctacgtgaccaactgtctgaaaaatcttcaacttctcttcaccttttgaaagagttggagctgcatcgaagttacgaggaaaatgccatgcccttgtgtgaattaaagggtctagaaaccttaggttcaatgttacgcatagttgttcaagattgtgcacatgtagatttttcaaattgttcaatccagtggtttcgcatacaacctgaaggaagcaatcaagaaattatttcaggtgccacaaagccagtatatgctccagaaccacatgacgtggggcgttacatccaagctgaaatcaaattcggtggtcaaatctcaatcgcaaagactgctggtccaatagatcctgctccaggattggttgattatgtagaggctcttgtgaggaatcctgaaactgattataatgtagttattcttcaagtgaatggaattgctcaggctgcagattctttacatgttctttgtattgggagattgcggatgaggcttgctaaagaaaaggcagtcgttgcgaaggagttctattcgtcgtcaatgcagttgtgtggcgttagaggaggtggagacgctgctccccaagcgatcttctggcaaccaagaaaggatctcagctttgtgctggcctttgaaacaaccagagagcgcaactcggcactcatgctggcccggagattcgcgatcgattgcaatgggataaaactccagcgcactctgaaacctgaagtctga

SEQ ID NO: 8200 - protein, 494 aa, Sorghum bicolor
  misc_feature: Ceres ANNOT ID no. 6087027
  misc_feature (27)..(482): NCBI GI: 115440567 NCBI Desc: os01g0805700 [oryza sativa (japonica cultivar-group)]
  misc_feature (27)..(482): NCBI GI: 55296828 NCBI Desc: plectin-related protein-like [oryza sativa (japonica cultivar-group)]
  misc_feature (52)..(433): NCBI GI: 42569815 NCBI Desc: proline-rich family protein [arabidopsis thaliana]
  misc_feature (251)..(482): NCBI GI: 115453143 NCBI Desc: os03g0364500 [oryza sativa (japonica cultivar-group)]
  misc_feature (48)..(277): NCBI GI: 27227803 NCBI Desc: smc2 protein [oryza sativa]
  misc_feature: Useful for making plants with altered alkaloid content
  misc_feature: Useful for making plants with altered terpenoid content
  misc_feature: Functional homolog of the protein sequence given in SEQ ID NO 13203
  misc_feature: Useful for making plants with altered alkaloid content
  misc_feature: Useful for making plants with altered terpenoid content
  misc_feature: Functional homolog of the protein sequence given in SEQ ID NO 13203
MTRSSTIDFGRRKQSELFGSGPLRPANIIRNKFPTYKNGSNGIVIKLVDAPEMPSLKEAVAKETTDLLDRCQRLSVRELTMKFEKGFNTATLLSNEAKWRHAALLERDILLKNLKSVLESLRGRVGGKNKDEIEESLSMVDILAVELSKREDELLQQKTEITKIAATLKLASKDAKRIVDEERANARLEIESAKAAVHKIQLALKEQENFYQRTGKQDVDELKEEVQEARRVKMLHCPSKAMDIENEIQVLRDQLSEKSSTSLHLLKELELHRSYEENAMPLCELKGLETLGSMLRIVVQDCAHVDFSNCSIQWFRIQPEGSNQEIISGATKPVYAPEPHDVGRYIQAEIKFGGQISIAKTAGPIDPAPGLVDYVEALVRNPETDYNVVILQVNGIAQAADSLHVLCIGRLRMRLAKEKAVVAKEFYSSSMQLCGVRGGGDAAPQAIFWQPRKDLSFVLAFETTRERNSALMLARRFAIDCNGIKLQRTLKPEV

SEQ ID NO: 8201 - DNA, 1716 bp, Sorghum bicolor
  misc_feature: Ceres ANNOT ID no. 6087040
  misc_feature: Encodes the peptide sequence at SEQ ID NO 8202
  misc_feature: Up-regulated in shoot tissues in response to salicylic acid treatment
atggcgttcctattcggtgcattcctgggcctggtggtgggcgtggccgtcgtgatggcgtttgcgcgattcgagaacagccgcgccgagcagcgccgtgagctggctgctatagctgctgctttctcgaagttgactgtacaggatttgaggaagctcatcccacctgagttctatccatcatgggtttcattcacacaaaagcagaagcttaaatggctgaatcaagagttggtaaaaatctggccatatgtcaatgaggctgcatcagagttgattaaaacttctgtggagcctgtttttgagcagtacaagtcattcatcttggcttccctccatttctcaaagttgacacttggcactgttgcccctcagtttactggtgtttcaatcttggagagtgatgattctgccatcaccatggaactcgagttgcaatgggatggcaatcccaatatcgtacttgacatccaaacaacacttggaatttctcttcctgtacaggtgaaaaatattggattcacaggagtacttcggctcgtattcaaacctcttgtggctgaattaccctgttttggagccgtttgttgttctttaagggagaagagcaaggtggaatttaccctcaaggtcattggtggcgaaatgactgctattccaggaatttctgatgcaattgagggtacgatacgtgatacaatcgaggatacactgacatggccgaatcgcataattgttcccattgtacctggtgactataggttactcactgcacacataatctggaatgacttggagttgaaacctactggggtattagaagtaaaactggtggaagctagggacctaacgaacaaggaccttgtgggaaagtcagacccttttgcagtgctatacatacgtccattgcgtgagaaaacaaagaaaagcaaaacaattaacaatgatttgaaccccatctggaacgagcactatgaatttgtggttgaggacatatctacacagcacttgactgtaaaaatttatgatgacgaaggactccaatcatcagagatcattggctgtgctcgagtagacttagctgatctacagccaggaaaagtgaaagatttatggttagatcttgtgaaggacctggaaattcaacgagacaagaaacctcgtggtcaggttcacttggagctcctctactacccttacgctaagcatgaaggggttcctaatccttttgctaatcagattcaattaacttcattggagaaggttctcaaaaccgagtctaatggatatgatgttaatcagaggaaaaatgttattatgagaggagtcctttcggtaacagtcatatctgcagaggacttgccacctatggacattggtggcaaggctgacccatttgtggtcctgtacttgaagaagggagaaaccaaaaagaagacaagggttgtgacagacacgctaaatccaatatggaaccagacatttgatttcatggtagaagatgcactgcatgatttgctcatggtggaagtatgggaccatgatacatttggaaaggattacgtagggaggtgcatcttgacactcacgagagttatacttgaaggtgaattccaagatacctttgtcttgcaaggtgccaaatcgggaaaactgaacctgcacttcaagtggacgccacagccaatctatcgagatcgtgaccgggaccagtga

SEQ ID NO: 8202 - protein, 571 aa, Sorghum bicolor
  misc_feature: Ceres ANNOT ID no. 6087040
  misc_feature (273)..(357): Pfam Id: C2 Pfam Desc: C2 domain
  misc_feature (444)..(526): Pfam Id: C2 Pfam Desc: C2 domain
  misc_feature (65)..(571): NCBI GI: 115475792 NCBI Desc: os08g0300200 [oryza sativa (japonica cultivar-group)]
  misc_feature (1)..(570): NCBI GI: 38344897 NCBI Desc: osjnba0033g05.21 [oryza sativa (japonica cultivar-group)]
  misc_feature (1)..(566): NCBI GI: 92881657 NCBI Desc: c2 [medicago truncatula]
  misc_feature (1)..(566): NCBI GI: 117557355 NCBI Desc: ntermtm-c2type2.2 protein [arabidopsis thaliana]
  misc_feature (1)..(566): NCBI GI: 9795162 NCBI Desc: clb1-like protein [arabidopsis thaliana]
  misc_feature: Up-regulated in shoot tissues in response to salicylic acid treatment
MAFLFGAFLGLVVGVAVVMAFARFENSRAEQRRELAAIAAAFSKLTVQDLRKLIPPEFYPSWVSFTQKQKLKWLNQELVKIWPYVNEAASELIKTSVEPVFEQYKSFILASLHFSKLTLGTVAPQFTGVSILESDDSAITMELELQWDGNPNIVLDIQTTLGISLPVQVKNIGFTGVLRLVFKPLVAELPCFGAVCCSLREKSKVEFTLKVIGGEMTAIPGISDAIEGTIRDTIEDTLTWPNRIIVPIVPGDYRLLTAHIIWNDLELKPTGVLEVKLVEARDLTNKDLVGKSDPFAVLYIRPLREKTKKSKTINNDLNPIWNEHYEFVVEDISTQHLTVKIYDDEGLQSSEIIGCARVDLADLQPGKVKDLWLDLVKDLEIQRDKKPRGQVHLELLYYPYAKHEGVPNPFANQIQLTSLEKVLKTESNGYDVNQRKNVIMRGVLSVTVISAEDLPPMDIGGKADPFVVLYLKKGETKKKTRVVTDTLNPIWNQTFDFMVEDALHDLLMVEVWDHDTFGKDYVGRCILTLTRVILEGEFQDTFVLQGAKSGKLNLHFKWTPQPIYRDRDRDQ

SEQ ID NO: 8203 - DNA, 663 bp, Sorghum bicolor
  misc_feature: Ceres ANNOT ID no. 6087049
  misc_feature: Encodes the peptide sequence at SEQ ID NO 8204
atgggatcagaaggaccttcagttgtcactgtccatgttactggatttaagaagttccatggggttgctgagaacccaactgagaaaattgtgaccaatcttaattctttcttggaaaagcgagggttgccaaaaaatcttgtccttggaagctgtacagttctcgaaacagcaggacagggggcacttcccacattatataaggttttagagtctgctattgcagacagaggaactgggtcctcggcacagggacaagtaatttggatccactttggagtcaacagtggtgcaacaaggtttgcccttgagaaccaagctgttaatgaggccaccttccggtgtccagatgagttaggatggaaacctcagagggtccctatcgtgccctctgatggaagcatctcacggacgagagagactaccctgccagtgaatgaattgaccaagtcgctccggaagataggctacgacgtggtgccctccgacgacgctggtcggtttgtatgcaactatgtgtactaccattctcttcggttcgcggagcaacacggcatcaaatctctgttcgtgcatgttcccctcttcttgacgatcgacgaggaggtccagatgcactttgccgcttccctcctcgaagtcctcgcttcctcctccaactag

SEQ ID NO: 8204 - protein, 220 aa, Sorghum bicolor
  misc_feature: Ceres ANNOT ID no. 6087049
  misc_feature (11)..(221): Pfam Id: Peptidase_C15 Pfam Desc: Pyroglutamyl peptidase
  misc_feature (1)..(216): NCBI GI: 38175741 NCBI Desc: pyrrolidone carboxyl peptidase-like protein [oryza sativa (japonica cultivar-group)]
  misc_feature (1)..(216): NCBI GI: 50252601 NCBI Desc: pyrrolidone carboxyl peptidase-like protein [oryza sativa (japonica cultivar-group)]
  misc_feature (90)..(218): NCBI GI: 8778575 NCBI Desc: f28c11.8 [arabidopsis thaliana]
  misc_feature (30)..(217): NCBI GI: 145325451 NCBI Desc: pyrrolidone-carboxylate peptidase family protein [arabidopsis thaliana]
  misc_feature (1)..(90): NCBI GI: 42571611 NCBI Desc: pyrrolidone-carboxylate peptidase family protein [arabidopsis thaliana]
MGSEGPSVVTVHVTGFKKFHGVAENPTEKIVTNLNSFLEKRGLPKNLVLGSCTVLETAGQGALPTLYKVLESAIADRGTGSSAQGQVIWIHFGVNSGATRFALENQAVNEATFRCPDELGWKPQRVPIVPSDGSISRTRETTLPVNELTKSLRKIGYDVVPSDDAGRFVCNYVYYHSLRFAEQHGIKSLFVHVPLFLTIDEEVQMHFAASLLEVLASSSN

SEQ ID NO: 8205 - DNA, 1689 bp, Sorghum bicolor
  misc_feature: Ceres ANNOT ID no. 6087057
  misc_feature: Encodes the peptide sequence at SEQ ID NO 8206
atgtcggggcgaggctctctgccggagggctcgctctttcttggattggacagctccactcaatcgctgaaagctacggtgctcaacaatgagttaacaatagtagcttctgaaattgttaattttgactctgaattgccgcactacaaaactgaaggtggggtgtacagagaccccgcagatgatggccacattttttcaccaaccattatgtgggtggaagctctggagctgctgcttgagaagctaaaaccaaagatcaacttcggtaaggtagtggctgtctcagggagtgggcagcaacatggcagcgtttattggaagaagggcagccatgctgtgttgtcctccttggatgctagtaagagcctgttatcgcagctcaaggatgcattttctacgatgaactcaccgatatggatggatagtagcacaactaagcaatgcagagaaatagagaatgcagttggaggtgcactggagttagcaaaactgacaggatctcgtgcctatgaaagattcactggtcctcagataaggaagatctatcagacagaacctgatgtttatgaagatactgagagaatatctttggtgagctcgttcatggcatctatccttgttggaagctatgcaagtattgatgaaactgatggtgcggggatgaacttgatggatataaaccaaaggatctggtcaaaatctgttctagaggcaactgctcctggacttgaagcaaagcttggaaatctagcaccagcgtattcagctgctggccgaatcgctccttattttgtagaaaggtttcagtttgataagaactgtttggtcattcagtggtctggagacaatcctaatagccttgcaggtttaactttgaatactcctggtgatcttgccattagccttggtactagcgatacagtattcgggataactgcagaagctaaaccaagcattgaagggcatgttttccccaatcctgttgaacccgatggttatatggtgatgctatgctacaaaaatggctctttgaccagagaagatgtgcgaaatcggtgtgcagacaaatcatgggatgtttttaacaattatctggagaaaacaccccctctaaatggtggaaagttaggattctactacaaagaccatgaaatccttccaccacttccagtgggtttccatcggtacgctgtcgaaaacctcaatgacgttacatcagacactctgttggagcgtgaagtggaagaatttgacccaccgtctgaggttcgtgccatcattgagggtcaaatgctgtcaatgcgaggccacgccgagaggtttggcatgccgaaccctcccaagcggatcatagcaaccggtggggcatcctccaacgaaagcatcctcaagtcaatcgcccagatcttcggctgccctgtctttacagtccagagacctgattcggcttcgctgggggcggcgctgagagctgcccacgggtggctgtgcaacgcccaaggcagcttcgtccccatctcatgcctgtaccagggcaacctggagaaaacctctcttggctcgaagctggcggtgccggccggcgacaaggaggaggaccgggagctcctccagaagtacaccctcctgatgaggaagaggatggagatcgagagacgcctggtggagaagatcgggcgatcatag

SEQ ID NO: 8206 - protein, 562 aa, Sorghum bicolor
  misc_feature: Ceres ANNOT ID no. 6087057
  misc_feature (12)..(290): Pfam Id: FGGY_N Pfam Desc: FGGY family of carbohydrate kinases, N-terminal domain
  misc_feature (294)..(520): Pfam Id: FGGY_C Pfam Desc: FGGY family of carbohydrate kinases, C-terminal domain
  misc_feature (6)..(561): NCBI GI: 92896307 NCBI Desc: carbohydrate kinase, fggy [medicago truncatula]
  misc_feature (7)..(561): NCBI GI: 115489724 NCBI Desc: os12g0633000 [oryza sativa (japonica cultivar-group)]
  misc_feature (6)..(560): NCBI GI: 8809688 NCBI Desc: xylulose kinase [arabidopsis thaliana]
  misc_feature (11)..(504): NCBI GI: 41055207 NCBI Desc: xylulokinase homolog [danio rerio]
  misc_feature (14)..(508): NCBI GI: 18860918 NCBI Desc: xylulokinase homolog [homo sapiens]
MSGRGSLPEGSLFLGLDSSTQSLKATVLNNELTIVASEIVNFDSELPHYKTEGGVYRDPADDGHIFSPTIMWVEALELLLEKLKPKINFGKVVAVSGSGQQHGSVYWKKGSHAVLSSLDASKSLLSQLKDAFSTMNSPIWMDSSTTKQCREIENAVGGALELAKLTGSRAYERFTGPQIRKIYQTEPDVYEDTERISLVSSFMASILVGSYASIDETDGAGMNLMDINQRIWSKSVLEATAPGLEAKLGNLAPAYSAAGRIAPYFVERFQFDKNCLVIQWSGDNPNSLAGLTLNTPGDLAISLGTSDTVFGITAEAKPSIEGHVFPNPVEPDGYMVMLCYKNGSLTREDVRNRCADKSWDVFNNYLEKTPPLNGGKLGFYYKDHEILPPLPVGFHRYAVENLNDVTSDTLLEREVEEFDPPSEVRAIIEGQMLSMRGHAERFGMPNPPKRIIATGGASSNESILKSIAQIFGCPVFTVQRPDSASLGAALRAAHGWLCNAQGSFVPISCLYQGNLEKTSLGSKLAVPAGDKEEDRELLQKYTLLMRKRMEIERRLVEKIGRS

SEQ ID NO: 8207 - DNA, 1092 bp, Sorghum bicolor
  misc_feature: Ceres ANNOT ID no. 6087089
  misc_feature: Encodes the peptide sequence at SEQ ID NO 8208
  misc_feature: Up-regulated in root tissues in response to salicylic acid treatment
  misc_feature: Down-regulated in shoot tissues in response to salicylic acid treatment
atggcgtcggagccggtggcgcgggcggtggcggaggaggtggggcgatgggggagcatgaagcagacgggggtgaccctgaggtacatgatggagttcggctcccgccccaccccgcgcaacctgctgctctccgcgcagttcctgcacaaggagctccccatccgcttcgcgcgccgcgcgctcgagctcgagtcgctgcccttcggcctctccaacaagcccgccatcctcaaggtgcgggattggtacttggactcattccgcgacatcagatacttccctgaagtgaggagccggaacgacgagctcgctttcacacagatgatcaatatggtcaaaatgcggcacaataatgtggttccaacaatggctttgggagtgcagcagctgaagaaggaactgggccacgcaaggaaggttccctttgaattcgatgatcagatccacgagttccttgatcgtttctacatgtcaaggattggcatccgcatgctgatagggcagcatgtggctttgcatgatcctcaaccctctggtgtcataggcctcattaatacaagattatccccaatacaggtggctcaagctgcttgtgaagatgcccgtgctatttgcttaagggaatatggatcagctcctgatattaacatttatggtgatccaaattttacatttccatatgtcacacatcacctacatctgatgttatttgaattggtcaagaactctctccgtgcggtgcaagaacggtatatgaattctgatgaagatgttcctccagttagaattatagttgctgatggagaagaagatgttactatcaaggttagtgatgaaggtggcgggataccaagaagtggcctcccaagaattttcacgtatctgtatagcactgcaaagaatcctcctgagctagatagacctaatgtaggagtaactatggccggatatggtttcgggctcccaatcagccggctttacgctcggtattttgggggcgacttgcaaatcatctcaatggaaggatacggtaccgatgcttacctccacttgtcacggctgggagattcagaggagcccttgccttga

SEQ ID NO: 8208 - protein, 363 aa, Sorghum bicolor
  misc_feature: Ceres ANNOT ID no. 6087089
  misc_feature (228)..(355): Pfam Id: HATPase_c Pfam Desc: Histidine kinase-, DNA gyrase B-, and HSP90-like ATPase
  misc_feature (1)..(363): NCBI GI: 3695005 NCBI Desc: pyruvate dehydrogenase kinase isoform 2; pdk2 [zea mays]
  misc_feature (1)..(363): NCBI GI: 23237829 NCBI Desc: pyruvate dehydrogenase kinase 1 [oryza sativa (japonica cultivar-group)]
  misc_feature (1)..(363): NCBI GI: 12829952 NCBI Desc: pyruvate dehydrogenase kinase 1 [oryza sativa subsp. indica]
  misc_feature (1)..(363): NCBI GI: 60499792 NCBI Desc: pyruvate dehydrogenase kinase [oryza sativa (indica cultivar-group)]
  misc_feature (1)..(363): NCBI GI: 3746431 NCBI Desc: pyruvate dehydrogenase kinase isoform 1; pdk1 [zea mays]
  misc_feature: Up-regulated in root tissues in response to salicylic acid treatment
  misc_feature: Down-regulated in shoot tissues in response to salicylic acid treatment
MASEPVARAVAEEVGRWGSMKQTGVTLRYMMEFGSRPTPRNLLLSAQFLHKELPIRFARRALELESLPFGLSNKPAILKVRDWYLDSFRDIRYFPEVRSRNDELAFTQMINMVKMRHNNVVPTMALGVQQLKKELGHARKVPFEFDDQIHEFLDRFYMSRIGIRMLIGQHVALHDPQPSGVIGLINTRLSPIQVAQAACEDARAICLREYGSAPDINIYGDPNFTFPYVTHHLHLMLFELVKNSLRAVQERYMNSDEDVPPVRIIVADGEEDVTIKVSDEGGGIPRSGLPRIFTYLYSTAKNPPELDRPNVGVTMAGYGFGLPISRLYARYFGGDLQIISMEGYGTDAYLHLSRLGDSEEPLP

SEQ ID NO: 8209 - DNA, 366 bp, Sorghum bicolor
  misc_feature: Ceres ANNOT ID no. 6087092
  misc_feature: Encodes the peptide sequence at SEQ ID NO 8210
atgaggagcagcgaggccatggagctcctgggcttccctccctactcccgcccatccccttccgaggtgaaggctgcgtatagaagaatggtgatggagtcccatcctgatcgtgtcccaacgcatctgaaatcgcaggctgagtcgaaattcaaggagatatcagaagcatattcttgtttgaaggatgttcatgttatgcgttctggtgttccgactggctacggaagatcaaatagaacgttggttaaagccccatttctactcataatgtttgcggcagtttcttttggtgcctttagcgcatcaagggcatatcaacggcaaaaggaactgtgttcctcccagaacccctttctaccatag

SEQ ID NO: 8210 - protein, 121 aa, Sorghum bicolor
  misc_feature: Ceres ANNOT ID no. 6087092
  misc_feature (5)..(67): Pfam Id: DnaJ Pfam Desc: DnaJ domain
  misc_feature (1)..(121): NCBI GI: 140055579 NCBI Desc: heat shock protein dnaj, n-terminal [medicago truncatula]
  misc_feature (1)..(63): NCBI GI: 115473601 NCBI Desc: os07g0637100 [oryza sativa (japonica cultivar-group)]
  misc_feature (8)..(63): NCBI GI: 3142372 NCBI Desc: mrj [mus musculus]
  misc_feature (8)..(63): NCBI GI: 61553865 NCBI Desc: dnaj (hsp40) homolog, subfamily b, member 6 isoform a [bos taurus]
  misc_feature (8)..(63): NCBI GI: 15643612 NCBI Desc: dnaj protein [thermotoga maritima msb8]
MRSSEAMELLGFPPYSRPSPSEVKAAYRRMVMESHPDRVPTHLKSQAESKFKEISEAYSCLKDVHVMRSGVPTGYGRSNRTLVKAPFLLIMFAAVSFGAFSASRAYQRQKELCSSQNPFLP

SEQ ID NO: 8211 - DNA, 1191 bp, Sorghum bicolor
  misc_feature: Ceres ANNOT ID no. 6087111
  misc_feature: Encodes the peptide sequence at SEQ ID NO 8212
atggcctcctccacttgcgctcttgccctggttcttgcgctgtcggtcggtgcaagcgtggcgcgtggctccgagccctggtggaacgagacgcaggtgtacaccaccaccgccaactccggtggcagcaacggcgtcttcgtcggcctcaccctcatccagtcggcggcggccaagggagcggtgtgcttggatggaagcttaccaggttaccacctgcacagagggtttggatcaggagcgaacagttggcttgtcaatctcgagggtggaggctggtgcaatgatgtcagcagctgtgtgttccgcaagggtagtcgtcgtggatcatcaaatcacatggagcggcaactccagtttacagggataatgagtaacagacctgatgagaatcctgatttctacaactggaatagagtgaaggtccggtactgtgacggtggatccttcactggtgatggctctgatgcggctgcaggcctttatttccgaggtcagcgtatttggcaggccgctatggatgacctaatggcccaaggaatgcgttatgctaatcaggcccttctttctggatgctctgccggtggtgtttctaccatacttcactgtgatgaattccgtggattgtttccatcaaataccagagtcaaatgcctggctgatgctggaatgtttcttgacactgttgatgtttctggccgtcgggaaatgagatcttttttcaatggcattgtgagattgcagtgctttttcccgcagaacgtgttaccaaacattcaaaccccaacttttgttttgaacactgcctatgacgtgtggcagcttcaacaaagtgtggcccccagaacagctgatccccaaggtctttggtcaaagtgtaggacgaaccacgctttctgtaatagcaaccagcttcagtttttgcaagggtttaggaaccaaatgcttgatgccgtgaagggtttttctgcgtcaaggcgaaatggtttgttcatcaactcatgttttgctcattgccagagcgagagacaggatacttggtatgcgaacaactcgccacgtcttggtaacaagaaaatcgctgacgctgtcggtgattggttctttgagaggggagacgccaagtacacagactgcccatacccttgcgatggcacttgccatcatcttgtgttcaggggagaccattaa

SEQ ID NO: 8212 - protein, 396 aa, Sorghum bicolor
  misc_feature: Ceres ANNOT ID no. 6087111
  misc_feature (32)..(377): Pfam Id: PAE Pfam Desc: Pectinacetylesterase
  misc_feature (41)..(261): NCBI GI: 87241323 NCBI Desc: pectinacetylesterase [medicago truncatula]
  misc_feature (63)..(261): NCBI GI: 109509142 NCBI Desc: pectin acetylesterase [eucalyptus globulus subsp. globulus]
  misc_feature (28)..(248): NCBI GI: 79366428 NCBI Desc: carboxylic ester hydrolase [arabidopsis thaliana]
  misc_feature (28)..(248): NCBI GI: 21703105 NCBI Desc: at1g57590/t8l23_6 [arabidopsis thaliana]
  misc_feature (29)..(248): NCBI GI: 140049891 NCBI Desc: pectinacetylesterase [medicago truncatula]
  misc_feature: Useful for making plants with altered cell wall content and/or composition
  misc_feature: Functional homolog of the protein sequence encoded by LOCUS at1g09550
  misc_feature: Functional homolog of the protein sequence encoded by LOCUS at1g57590
  misc_feature: Functional homolog of the protein sequence encoded by LOCUS at2g46930
  misc_feature: GREAT-hit functional homolog of the protein sequence encoded by LOCUS at3g05910
  misc_feature: Functional homolog of the protein sequence encoded by LOCUS at3g62060
  misc_feature: GREAT-hit functional homolog of the protein sequence encoded by LOCUS at5g26670
  misc_feature: Useful for making plants with altered carbohydrate content
  misc_feature: Functional homolog of the protein sequence given in SEQ ID NO 13670
  misc_feature: Useful for making plants with altered cell wall content and/or composition
  misc_feature: Functional homolog of the protein sequence given in SEQ ID NO 14015
MASSTCALALVLALSVGASVARGSEPWWNETQVYTTTANSGGSNGVFVGLTLIQSAAAKGAVCLDGSLPGYHLHRGFGSGANSWLVNLEGGGWCNDVSSCVFRKGSRRGSSNHMERQLQFTGIMSNRPDENPDFYNWNRVKVRYCDGGSFTGDGSDAAAGLYFRGQRIWQAAMDDLMAQGMRYANQALLSGCSAGGVSTILHCDEFRGLFPSNTRVKCLADAGMFLDTVDVSGRREMRSFFNGIVRLQCFFPQNVLPNIQTPTFVLNTAYDVWQLQQSVAPRTADPQGLWSKCRTNHAFCNSNQLQFLQGFRNQMLDAVKGFSASRRNGLFINSCFAHCQSERQDTWYANNSPRLGNKKIADAVGDWFFERGDAKYTDCPYPCDGTCHHLVFRGDH

SEQ ID NO: 8213 - DNA, 669 bp, Sorghum bicolor
  misc_feature: Ceres ANNOT ID no. 6087117
  misc_feature: Encodes the peptide sequence at SEQ ID NO 8214
atggcctatgatggagatgatggacaaagccaggattatctcttcaaaattgtcctgcttggggattcctctgttggtaaatcaaacttgctagcaagatttgcaaggaatgagttctacccaaactctaagtccactataggagtggagttccagacacaaaagttggtaatcgatggaaaggagattaaagctcagatatgggacactgctggacaagagcgctttcgagcagtaacttctgcttactaccggggcgctgtgggagctcttctcgtctatgatattagcaggcgtcagacttttgatagtgttggtcgatggctcaatgaactgcacactcattccgatatgaatgtcgtcacaattctggtgggtaacaaaacagatctgaagcatgcacgtgaggtgagcactgcggaaggacaagccttggcggaggcccagggcctcttcttcatggaaacctcagctttggattcgtcaaatgttgcagcagcttttcaaactgtcgttaaggagatctacagcatactaagcaggaaggtgtttcaatcactagagcagaagaaaagcgagctgcagtcgctaagcaacgggaaagccgtggtgctgcagggtgagaccaaccaaacaagcagtggtgggaggtggtgctgttcttcatga

SEQ ID NO: 8214 - protein, 222 aa, Sorghum bicolor
  misc_feature: Ceres ANNOT ID no. 6087117
  misc_feature (16)..(177): Pfam Id: Ras Pfam Desc: Ras family
  misc_feature (16)..(130): Pfam Id: Miro Pfam Desc: Miro-like protein
  misc_feature (1)..(175): Pfam Id: Arf Pfam Desc: ADP-ribosylation factor family
  misc_feature (1)..(222): NCBI GI: 1370160 NCBI Desc: rab11j [lotus corniculatus var. japonicus]
  misc_feature (1)..(222): NCBI GI: 5714658 NCBI Desc: rab gtp-binding protein rab11a [gossypium hirsutum]
  misc_feature (1)..(222): NCBI GI: 89257484 NCBI Desc: ras family gtp-binding protein [brassica oleracea]
  misc_feature (1)..(222): NCBI GI: 560504 NCBI Desc: guanine nucleotide regulatory protein [vicia faba]
  misc_feature (1)..(222): NCBI GI: 5714660 NCBI Desc: rab gtp-binding protein rab11b [gossypium hirsutum]
  misc_feature: Useful for making plants with altered Lignin content
  misc_feature: Useful for making plants with altered alkaloid content
  misc_feature: Useful for making plants with altered terpenoid content
  misc_feature: Functional homolog of the protein sequence given in SEQ ID NO 13157
  misc_feature: GREAT-hit functional homolog of the protein sequence given in SEQ ID NO 13220
  misc_feature: GREAT-hit functional homolog of the protein sequence given in SEQ ID NO 13238
  misc_feature: Useful for making plants with altered lignin content
  misc_feature: Functional homolog of the protein sequence given in SEQ ID NO 13238
  misc_feature: Useful for making plants with altered alkaloid content
  misc_feature: Functional homolog of the protein sequence given in SEQ ID NO 13220
  misc_feature: Useful for making plants with altered terpenoid content
  misc_feature: Functional homolog of the protein sequence given in SEQ ID NO 13157
  misc_feature: The sequence is a functional homolog of SEQ ID NO. 400 in the 11/188,298 US application
MAYDGDDGQSQDYLFKIVLLGDSSVGKSNLLARFARNEFYPNSKSTIGVEFQTQKLVIDGKEIKAQIWDTAGQERFRAVTSAYYRGAVGALLVYDISRRQTFDSVGRWLNELHTHSDMNVVTILVGNKTDLKHAREVSTAEGQALAEAQGLFFMETSALDSSNVAAAFQTVVKEIYSILSRKVFQSLEQKKSELQSLSNGKAVVLQGETNQTSSGGRWCCSS

SEQ ID NO: 8215 - DNA, 1101 bp, Sorghum bicolor
  misc_feature: Ceres ANNOT ID no. 6087118
  misc_feature: Encodes the peptide sequence at SEQ ID NO 8216
atgcgtgcgtctggcttttggttcagcagctcgcgggcgacgacgggttcgccggccgtgcctggacctggaggacgtccggaggcgccgagcgtcgctgggaccgggagagacggtggcggagggcccgcgcggaccgcggagggcgacgagcgcgcgcgtctggtcgtgacgacgatgccgccgccggtgggcgccacggcggcggggggcgtggctgtggccgtgcctgtgcaggcgcctgagaccaggccgtgggcgcggtcgaggtcgatgtcgtccgtcacgtgggcgaagctcgtggtcggattgctgctcctcgttctgctcggctacgcattcttcaagtggggcgtcccgtatctctcggagaaggtaatcatgccaattattcaatgggaagcaaaatcatttggccgccccgtgttagcggtggtcataatcacttctctagcgctgttccctgtggtgttgctgccttctggtcctccaatgtggttaacaggaatagttttcggctatggtatcggcttcttgatcatcatggccggtgtcaccattggcatgtctttaccttattggattggcctattgtttcgtgaccgcctgaatctctggttggaaaagaaatggccacgacagattgctctgattaaactggcaggtcaagggagttggttccagcaattccgggtggctgcattgctaagaatctcaccgttcccatatccattgttcaactatgctgtaactgtgacggagatgaagttcatcccttacatatgtggttcggttgttggaatggtgcctgatgtgttcatcaacatctacagtgggcggctgatacgcacattggctgagctgaattatcacgagcaccgaatgacaacagttgagatagtgtacaacgttgtatctgtaattgttgccatcgtctttgcgattggatttacagtatatgcgagacgagctttggataacatggaacgttccgaagccatctgcactgaacctgtcggcgcccctgccggatcgactgagttcagagatcagcttgagggatgttcaactgcacgttccgtaccaatcgatgttgtataa

SEQ ID NO: 8216 - protein, 366 aa, Sorghum bicolor
  misc_feature: Ceres ANNOT ID no. 6087118
  misc_feature (159)..(281): Pfam Id: SNARE_assoc Pfam Desc: SNARE associated Golgi protein
  misc_feature (79)..(333): NCBI GI: 124359825 NCBI Desc: f5o11.19, related [medicago truncatula]
  misc_feature (76)..(278): NCBI GI: 92892046 NCBI Desc: at1g12450-related [medicago truncatula]
  misc_feature (91)..(205): NCBI GI: 8778630 NCBI Desc: f5o11.19 [arabidopsis thaliana]
  misc_feature (130)..(327): NCBI GI: 67922563 NCBI Desc: deda [crocosphaera watsonii wh 8501]
  misc_feature (100)..(339): NCBI GI: 75908987 NCBI Desc: deda [anabaena variabilis atcc 29413]
MRASGFWFSSSRATTGSPAVPGPGGRPEAPSVAGTGRDGGGGPARTAEGDERARLVVTTMPPPVGATAAGGVAVAVPVQAPETRPWARSRSMSSVTWAKLVVGLLLLVLLGYAFFKWGVPYLSEKVIMPIIQWEAKSFGRPVLAVVIITSLALFPVVLLPSGPPMWLTGIVFGYGIGFLIIMAGVTIGMSLPYWIGLLFRDRLNLWLEKKWPRQIALIKLAGQGSWFQQFRVAALLRISPFPYPLFNYAVTVTEMKFIPYICGSVVGMVPDVFINIYSGRLIRTLAELNYHEHRMTTVEIVYNVVSVIVAIVFAIGFTVYARRALDNMERSEAICTEPVGAPAGSTEFRDQLEGCSTARSVPIDVV

SEQ ID NO: 8217 - DNA, 1509 bp, Sorghum bicolor
  misc_feature: Ceres ANNOT ID no. 6087122
  misc_feature: Encodes the peptide sequence at SEQ ID NO 8218
atggaggtcgatggcggggcacagcctttccgcctattctccaacaggggcaagtccaaacccaggctcaagctcgagcctcaggtgcaaccccagccccagccggaaccggaacccccaagctctgaacccgccgccgccgaggccgaccaccccccgtctcccaccatcgtgaccgagaccagccaggccgatgacgtcgaggccgcgtccggcgcggcgccggcgaccttcgcggacctcggcctgtcgcagtggctggtggacgcgtgcgacgccctgggcatgcggcgccccacggcggtgcagcgccggtgcatcccgcgcgcgctcgcgggggaggacgtgctggggatcgccgagacggggagcggcaagacggccgcgttcgcgctgcccatcctgcaccgcctcggggaggacccctacggcgtggccgcgctcgcgctcgcccccacgcgcgagctcgcggcgcagctcgccgagcagttccgcgcgctcggggcgccgctcggactcaggtgcctcgcggccatcggaggcttcgactcgctcgcgcaggccaaggggctctcgcgtcgcccccatgtcgtcgtcgccaccccaggccgcattgccacgctcgtcaaagacgatcctgaccttgccaaagtattcgctcgaaccaagtttcttgtgttggacgaggcggatagagttctagatgttaattttgaagaggaacttcgtgtcatatttggctgtttaccaaagaaacggcaaaccttcctgttttcagcaacgatgtcagacaatctgagatcattgcttgaactttccggcaacaaatcatacttttttgaagcatatgaagggttcaagacagtagagaccttaaagcaacaatacattcatgtccctcctcaggggaaagagctccatctttggtatcttctgtcaattatgaaggaaaaaaaggaagaccctatccgttcagccattgtatttgtctcaaaatgcaatgtctgccaatatttagatctgctgctggaagagcttggttatcctgctgttgctttgaactctcacaagtctcaggcacaacggctcttagcacttaaccggtttaaatccggccaggttcccatattgatttccactgatgtgggcagtcgtgggttggatatccaaacagttgatctagttatcaactatgacatgccaatgtctccacgtgattacatccaccgggttggacgaactgcaagagcttcaaggggagggcttgctataagctttgttacacagaaagatatatgtcttttgcatgagatagaagatgttgtggggaagcagttggaggcctatgagtgcaatgataaagaagttactaaagatattacaaaggtgttcaaagcaagacgtctggcgaagatgaggagcagggacgagggacacgatgagaaagtagaagccagaaaagagcagaagaaaagagatcgggcaagaaagaggaaacatgaagactga

SEQ ID NO: 8218 - protein, 502 aa, Sorghum bicolor
  misc_feature: Ceres ANNOT ID no. 6087122
  misc_feature (100)..(269): Pfam Id: DEAD Pfam Desc: DEAD/DEAH box helicase
  misc_feature (342)..(418): Pfam Id: Helicase_C Pfam Desc: Helicase conserved C-terminal domain
  misc_feature (30)..(490): NCBI GI: 92872333 NCBI Desc: helicase, c-terminal [medicago truncatula]
  misc_feature (76)..(501): NCBI GI: 62898149 NCBI Desc: dead (asp-glu-ala-asp) box polypeptide 49 variant [homo sapiens]
  misc_feature (78)..(501): NCBI GI: 29612573 NCBI Desc: ddx49-a-prov protein [xenopus laevis]
  misc_feature (76)..(501): NCBI GI: 49903707 NCBI Desc: dead (asp-glu-ala-asp) box polypeptide 49 [danio rerio]
  misc_feature (76)..(501): NCBI GI: 38198641 NCBI Desc: dead (asp-glu-ala-asp) box polypeptide 49 [danio rerio]
MEVDGGAQPFRLFSNRGKSKPRLKLEPQVQPQPQPEPEPPSSEPAAAEADHPPSPTIVTETSQADDVEAASGAAPATFADLGLSQWLVDACDALGMRRPTAVQRRCIPRALAGEDVLGIAETGSGKTAAFALPILHRLGEDPYGVAALALAPTRELAAQLAEQFRALGAPLGLRCLAAIGGFDSLAQAKGLSRRPHVVVATPGRIATLVKDDPDLAKVFARTKFLVLDEADRVLDVNFEEELRVIFGCLPKKRQTFLFSATMSDNLRSLLELSGNKSYFFEAYEGFKTVETLKQQYIHVPPQGKELHLWYLLSIMKEKKEDPIRSAIVFVSKCNVCQYLDLLLEELGYPAVALNSHKSQAQRLLALNRFKSGQVPILISTDVGSRGLDIQTVDLVINYDMPMSPRDYIHRVGRTARASRGGLAISFVTQKDICLLHEIEDVVGKQLEAYECNDKEVTKDITKVFKARRLAKMRSRDEGHDEKVEARKEQKKRDRARKRKHED

SEQ ID NO: 8219 - DNA, 396 bp, Sorghum bicolor
  misc_feature: Ceres ANNOT ID no. 6087124
  misc_feature: Encodes the peptide sequence at SEQ ID NO 8220
atggcgatgtcttggacaagagggttaaagcatggcgttgttccgaggcatgccgctcaattgatagagagtagaagccttgcaattgcaagcaagggaaagaagggtggaaagggcggtgcggctgatgctgccaaaactcctgcgctcagccaagagcttaagagtacaacagtgtttggggcaaacatcctcaaggagggttctgatccaaaaattcaaccagactctgagtatcctgactggctgtggcacatgctcaacaagcgtcctgtgctgagtgagctgcggaggaaagatcccaagacactcccttatgaagacctgaagcgttttgtcaagttggacaaccgatctaggatcaaggaaaagaatgccctcactgctaagaactga

SEQ ID NO: 8220 - protein, 131 aa, Sorghum bicolor
  misc_feature: Ceres ANNOT ID no. 6087124
  misc_feature (22)..(130): Pfam Id: Ribosomal_L37 Pfam Desc: Mitochondrial ribosomal protein L37
  misc_feature (19)..(123): NCBI GI: 17863026 NCBI Desc: sd09147p [drosophila melanogaster]
  misc_feature (32)..(127): NCBI GI: 27436908 NCBI Desc: mitochondrial ribosomal protein l54 [homo sapiens]
  misc_feature (19)..(123): NCBI GI: 20130195 NCBI Desc: cg9353-pa [drosophila melanogaster]
  misc_feature (28)..(123): NCBI GI: 125811536 NCBI Desc: ga21722-pa [drosophila pseudoobscura]
  misc_feature (21)..(106): NCBI GI: 94732860 NCBI Desc: novel protein similar to vertebrate mitochondrial ribosomal protein l54 (mrpl54) [danio rerio]
MAMSWTRGLKHGVVPRHAAQLIESRSLAIASKGKKGGKGGAADAAKTPALSQELKSTTVFGANILKEGSDPKIQPDSEYPDWLWHMLNKRPVLSELRRKDPKTLPYEDLKRFVKLDNRSRIKEKNALTAKN

SEQ ID NO: 8221 - DNA, 630 bp, Sorghum bicolor
  misc_feature: Ceres ANNOT ID no. 6087125
  misc_feature: Encodes the peptide sequence at SEQ ID NO 8222
atgagaaggggctacagttacagcccttcaccaccaaggggctacaggagaagggagcgcagcccaagcccccgtgattattatggtggccgtggtagggatctcccaaccagtcttctggtcaggaatctccgtcgggactgcaggccagaagacctccgtcggccatttggacaatttggtcgacttaaagatatatatcttccaagagattattacactggggagcctcgagggtttggatttgtccagtattatgatcctgatgatgctgctgatgcaaagtattatatggatgggcaggtagttcttggtaggcaaataacagttgtttttgcagaagagaacagaaagaagcctcaagagatgagagctagagatagagtcaggggtcattcttatgatcggaggtattctcgctctaggtcccctcgttattatagaggtggctctccttcacgcagccgaagctactcaaggtctccttcacctcgggatccaaaacacagacttagagagaggtcgtactccggctcacctgtggacagcatatcaagaagtgggagcccgtatgaggatggatatcccagatcatcacaaagggagagatctgtttctgtcagcggatga

SEQ ID NO: 8222 - protein, 209 aa, Sorghum bicolor
  misc_feature: Ceres ANNOT ID no. 6087125
  misc_feature (39)..(110): Pfam Id: RRM_1 Pfam Desc: RNA recognition motif. (a.k.a. RRM, RBD, or RNP domain)
  misc_feature (1)..(208): NCBI GI: 115453225 NCBI Desc: os03g0374500 [oryza sativa (japonica cultivar-group)]
  misc_feature (3)..(189): NCBI GI: 9843659 NCBI Desc: sc35-like splicing factor scl33, 33 kd [arabidopsis thaliana]
  misc_feature (3)..(189): NCBI GI: 79320030 NCBI Desc: sr33; rna binding [arabidopsis thaliana]
  misc_feature (3)..(198): NCBI GI: 92888070 NCBI Desc: rna-binding region rnp-1 (rna recognition motif) [medicago truncatula]
  misc_feature (3)..(206): NCBI GI: 9843661 NCBI Desc: sc35-like splicing factor scl30a, 30a kd [arabidopsis thaliana]
  misc_feature: Useful for making plants with altered terpenoid content
  misc_feature: Functional homolog of the protein sequence given in SEQ ID NO 13113
  misc_feature: The sequence is a functional homolog of SEQ ID NO. 458 in the 11/188,298 US application
MRRGYSYSPSPPRGYRRRERSPSPRDYYGGRGRDLPTSLLVRNLRRDCRPEDLRRPFGQFGRLKDIYLPRDYYTGEPRGFGFVQYYDPDDAADAKYYMDGQVVLGRQITVVFAEENRKKPQEMRARDRVRGHSYDRRYSRSRSPRYYRGGSPSRSRSYSRSPSPRDPKHRLRERSYSGSPVDSISRSGSPYEDGYPRSSQRERSVSVSG

SEQ ID NO: 8223 - DNA, 621 bp, Sorghum bicolor
  misc_feature: Ceres ANNOT ID no. 6087126
  misc_feature: Encodes the peptide sequence at SEQ ID NO 8224
atgttggtggttagagagtggaacagtaaaatgtttggcaaaagattgcacggattcctgctcctgctcgtcttccttctggcaaacgtagcaggcagccatgctgaaaccaccgtcgatccagattcagtggacggcagcaagaggaggtcgctggccaccagcttgttctgtgtggcgaaacagggcgcggacccgacggctctgcagatgggactgaactgggcgtgcgggccggggcaagcgaactgtgcgcccattcagcccggcgggtcgtgctacaagcaggacaacctggaggcgctagcgtcctacgcctacaacgactactaccagaagaactttgccaccggcgcctcttgcaacttcaacggcacggccgcgaccaccacctctgatcccagctcggggcagtgtgtcttcacaggaagctccatggcaggaggcagcacgccggctgcgagcgcccccagcggcctctccccgccgtcaacgttcacgccgggcatcgggagcccttccaacaccctgatccctctggacggcgcggagagcctagtgtccagcgcccggtgggcgatctgcgccctgctgctggcgttgccgctcttcttcctctga

SEQ ID NO: 8224 - protein, 206 aa, Sorghum bicolor
  misc_feature: Ceres ANNOT ID no. 6087126
  misc_feature (56)..(141): Pfam Id: X8 Pfam Desc: X8 domain
  misc_feature (11)..(204): NCBI GI: 33146901 NCBI Desc: beta-1,3-glucanase-like protein [oryza sativa (japonica cultivar-group)]
  misc_feature (53)..(162): NCBI GI: 140066678 NCBI Desc: glycoside hydrolase, family 17; x8 [medicago truncatula]
  misc_feature (57)..(172): NCBI GI: 115472977 NCBI Desc: os07g0577300 [oryza sativa (japonica cultivar-group)]
  misc_feature (37)..(164): NCBI GI: 9280308 NCBI Desc: beta-1,3-glucanase-like protein [arabidopsis thaliana]
  misc_feature (57)..(162): NCBI GI: 92888073 NCBI Desc: glycoside hydrolase, family 17 [medicago truncatula]
  misc_feature: Useful for making plants with altered carbohydrate content
  misc_feature: Functional homolog of the protein sequence given in SEQ ID NO 14016
  misc_feature: Useful for making plants with altered cell wall content and/or composition
  misc_feature: Functional homolog of the protein sequence given in SEQ ID NO 14017
MLVVREWNSKMFGKRLHGFLLLLVFLLANVAGSHAETTVDPDSVDGSKRRSLATSLFCVAKQGADPTALQMGLNWACGPGQANCAPIQPGGSCYKQDNLEALASYAYNDYYQKNFATGASCNFNGTAATTTSDPSSGQCVFTGSSMAGGSTPAASAPSGLSPPSTFTPGIGSPSNTLIPLDGAESLVSSARWAICALLLALPLFFL

SEQ ID NO: 8225 - DNA, 807 bp, Sorghum bicolor
  misc_feature: Ceres ANNOT ID no. 6087137
  misc_feature: Encodes the peptide sequence at SEQ ID NO 8226
atggcggccgcgctcttctccacctcgctctcgccacgcttccttgccctatcctccgcgaagccggctgcgcccgcggcctcagccttcctccccttcaggctgccgcttcgcgctgtgtcggcgccggggaggcgggtcttcgagcccgtggccgtcgcggtgtcgtcggagtacgagaccgagggcgcggagcaggaggaggagggagccgaggagttctccgaggacctcaagctgttcgtcggcaacctgccgttcagcgtcgacagcgcgcagctcgctgggctcttcgagcaggccggctccgtcgagatggtcgaggttgtatatgatagaatgactggacggagccgtggatttggattcgtgacaatgtcttcagctgaagaagctggagctgctgtcgagcaattcaacggttatacatttcaaggaagaccactgagggtgaactgtggaccgccgccgcctagagatgaatccgcaccaagagcaccaaggggtggtggtggtggtggtggcggtggtagctttgtcgattcagcgaacaaggtctatgtggggaaccttgcatggggcgttgataactcaactctggagaacctattcagtgagcaagggcaggtgcttgatgctaaggtcatctatgacagggagagcggcaggtcaagggggtttggtttcgtcacctatggcacagccgcggaggtcaacaatgccatatcaaaccttgatggcatcgacttggatggtagacagatccgagtcacggttgcagaatcaaagccgaggcgtcaattttga

SEQ ID NO: 8226 - protein, 268 aa, Sorghum bicolor
  misc_feature: Ceres ANNOT ID no. 6087137
  misc_feature (80)..(151): Pfam Id: RRM_1 Pfam Desc: RNA recognition motif. (a.k.a. RRM, RBD, or RNP domain)
  misc_feature (186)..(257): Pfam Id: RRM_1 Pfam Desc: RNA recognition motif. (a.k.a. RRM, RBD, or RNP domain)
  misc_feature (2)..(268): NCBI GI: 19754 NCBI Desc: 29kd a ribonucleoprotein [nicotiana sylvestris]
  misc_feature (53)..(177): NCBI GI: 681904 NCBI Desc: cp29 [arabidopsis thaliana]
  misc_feature (53)..(177): NCBI GI: 681902 NCBI Desc: cp29 [arabidopsis thaliana]
  misc_feature (53)..(177): NCBI GI: 21593426 NCBI Desc: rna-binding protein cp29 protein [arabidopsis thaliana]
  misc_feature (2)..(268): NCBI GI: 19708 NCBI Desc: rna binding protein 30 [nicotiana plumbaginifolia]
  misc_feature: The plant is abnormally small.
  misc_feature: The sequence is a functional homolog of SEQ ID NO 1039 in the 10/374,780US patent application
  misc_feature: The sequence is a functional homolog of SEQ ID NO 1042 in the 10/374,780US patent application
  misc_feature: The sequence is a functional homolog of SEQ ID NO 849 in the 10/666,642US patent application
  misc_feature: The sequence is a functional homolog of SEQ ID NO 852 in the 10/666,642US patent application
  misc_feature: Useful for making plants with modulated biomass
  misc_feature: Useful for making plants with modulated growth and phenotype characteristics
  misc_feature: Useful for making plants with modulated nitrogen use efficiency
  misc_feature: GREAT-hit functional homolog of the protein sequence given in SEQ ID NO 12896
  misc_feature: The sequence is a functional homolog of SEQ ID NO 1039 in the 20060162006 US patent application
  misc_feature: The sequence is a functional homolog of SEQ ID NO 1042 in the 20060162006 US patent application
  misc_feature: The sequence is a functional homolog of SEQ ID NO 22 in US patent 7244875
  misc_feature: Useful for making plants with altered alkaloid content
  misc_feature: Functional homolog of the protein sequence given in SEQ ID NO 13848
  misc_feature: The sequence is a functional homolog of SEQ ID NO. 339 in the 11/188,298 US application
  misc_feature: The sequence is a functional homolog of SEQ ID NO. 458 in the 11/188,298 US application
MAAALFSTSLSPRFLALSSAKPAAPAASAFLPFRLPLRAVSAPGRRVFEPVAVAVSSEYETEGAEQEEEGAEEFSEDLKLFVGNLPFSVDSAQLAGLFEQAGSVEMVEVVYDRMTGRSRGFGFVTMSSAEEAGAAVEQFNGYTFQGRPLRVNCGPPPPRDESAPRAPRGGGGGGGGGSFVDSANKVYVGNLAWGVDNSTLENLFSEQGQVLDAKVIYDRESGRSRGFGFVTYGTAAEVNNAISNLDGIDLDGRQIRVTVAESKPRRQF

SEQ ID NO: 8227 - DNA, 786 bp, Sorghum bicolor
  misc_feature: Ceres ANNOT ID no. 6087138
  misc_feature: Encodes the peptide sequence at SEQ ID NO 8228
atgtcggcgcaggcgggtacagggacgtactccccggcggtggccgcaggggacaagcggcgggagaggaaggaggagctgcggcgccacctcgtcgaggacgccgactggccccgggccgacggccgctccttccacgactgccggccagcgtttatgcagacaggaccaactactgctgcatcagggtctgcttatgcggaatttgggaagacaaaggtcattgtatcggtgtttggaccaagggaaagtaaaaaagcaatgatgtacagtgatattggtaggctcaattgcaatgttagctatacaacctttgccactccagtgcgtggacagggagcagacaacaaagagtactcatcaatgctttataaagctttggaaggcgcagtaatgctacacacttttccaaagaccactgttgatgtttttgccttggttcttgagtctggcggcagtgatcttcccatcattatatcatgcgctagtcttgcactggcagatgctggaatcatgatgtatgaccttgttacatctgtatccgtgtcctgttttggtaagaacatcatcatcgacccaacctcagacgaggaagcatggcaagatggaagccttgtggttgctttcatgccagcccgcaaggagatcacacaactcacgctcaccggagagtggagtgatggcagaataaccaatgcagtagagctctgtatggatgcttgcagtaagctcggtgacatattgcgtgaccacttgaaagataccgccaccttgacgagtgaatga

SEQ ID NO: 8228 - protein, 261 aa, Sorghum bicolor
  misc_feature: Ceres ANNOT ID no. 6087138
  misc_feature (21)..(172): Pfam Id: RNase_PH Pfam Desc: 3' exoribonuclease family, domain 1
  misc_feature (1)..(261): NCBI GI: 42567185 NCBI Desc: 3' exoribonuclease family domain 1-containing protein [arabidopsis thaliana]
  misc_feature (39)..(253): NCBI GI: 15678710 NCBI Desc: ribonuclease ph [methanothermobacter thermautotrophicus str. delta h]
  misc_feature (34)..(254): NCBI GI: 73919276 NCBI Desc: probable exosome complex exonuclease 1
  misc_feature (34)..(254): NCBI GI: 118195240 NCBI Desc: rnase ph [cenarchaeum symbiosum]
  misc_feature (22)..(254): NCBI GI: 29337010 NCBI Desc: probable exosome complex exonuclease 1
MSAQAGTGTYSPAVAAGDKRRERKEELRRHLVEDADWPRADGRSFHDCRPAFMQTGPTTAASGSAYAEFGKTKVIVSVFGPRESKKAMMYSDIGRLNCNVSYTTFATPVRGQGADNKEYSSMLYKALEGAVMLHTFPKTTVDVFALVLESGGSDLPIIISCASLALADAGIMMYDLVTSVSVSCFGKNIIIDPTSDEEAWQDGSLVVAFMPARKEITQLTLTGEWSDGRITNAVELCMDACSKLGDILRDHLKDTATLTSE

SEQ ID NO: 8229 - DNA, 627 bp, Sorghum bicolor
  misc_feature: Ceres ANNOT ID no. 6087139
  misc_feature: Encodes the peptide sequence at SEQ ID NO 8230
atggctgagacgacaaacacgatggcggcgccgcggccactcctgcgccggatgctctcgttccgggagccactcctggtcatcccgtacctgctcaccttcctgggcgccgcggcgtcggcgctggcccgcagccactcgtcgctgctgcactcgctcgccagggcgctgttcccgcccgccaacgccaagcacgccgccgcgccgcacgcgccgtcgtccgctgccaccgccgccgccgccgcgacgtgcccggacgacagcgacggcgaggacgaggacgccgcgctgagcaaggcggaggtggaggcgatcatggccacgatcggcctcgcggcggctgggcgcggcgagggcctcgcgcccgccatagacctcgacgacgtccgcggcctcttcgacgccgatgagcccagcttcgcggaggtgcgggccgtcttcgcggtcttcgacgctgaccgcgacggctttatcggcgccgaggacctgcagggcgccctggcgcggctgggagtccggcaggacgccgccgcgtgccgcgccatggtcgtcgcggccggtggtggccgggacgcccggatgaacctgttccagttcgtcaggttcctcgagaacggcctgtgctga

SEQ ID NO: 8230 - protein, 208 aa, Sorghum bicolor
  misc_feature: Ceres ANNOT ID no. 6087139
  misc_feature (142)..(170): Pfam Id: efhand Pfam Desc: EF hand
  misc_feature (91)..(208): NCBI GI: 20466131 NCBI Desc: at5g39670/mij24_140 [arabidopsis thaliana]
  misc_feature (87)..(208): NCBI GI: 92871538 NCBI Desc: calcium-binding ef-hand [medicago truncatula]
  misc_feature (35)..(201): NCBI GI: 116503867 NCBI Desc: calmodulin a [coprinopsis cinerea okayama7#130]
  misc_feature (97)..(204): NCBI GI: 140052979 NCBI Desc: calcium-binding ef-hand [medicago truncatula]
  misc_feature (80)..(199): NCBI GI: 115463131 NCBI Desc: os05g0312600 [oryza sativa (japonica cultivar-group)]
MAETTNTMAAPRPLLRRMLSFREPLLVIPYLLTFLGAAASALARSHSSLLHSLARALFPPANAKHAAAPHAPSSAATAAAAATCPDDSDGEDEDAALSKAEVEAIMATIGLAAAGRGEGLAPAIDLDDVRGLFDADEPSFAEVRAVFAVFDADRDGFIGAEDLQGALARLGVRQDAAACRAMVVAAGGGRDARMNLFQFVRFLENGLC

SEQ ID NO: 8231 - DNA, 891 bp, Sorghum bicolor
  misc_feature: Ceres ANNOT ID no. 6087143
  misc_feature: Encodes the peptide sequence at SEQ ID NO 8232
atgggatccgaaggctttgcggccgcggcggccgcttgcccctccgccgccgaggccttcctcaagtactatggtatcgtatcaggaggtacaagtgtggagacaagacagggattggttgagctttcactagctatagatggaattgaaggaatgagggatgtgatttttgctgatatcccaaagctcattccatttattgatttggaggatatgaccctattcagttgcttctacgattttgtcttcttcatctgtcgtgaaaaggggcaaaagagtatcactattcagagagctgtggcagcatggaagattgttctgaacggaaggttccgtttgcttgatcgatggtgtaacttcgttgagaagtaccaacgccacaacatatccgaggatacttggcagcagctgctagctttcagcagatgtgtaaatgaagatctggaaggttatgacccacgaggtgcttggcctgttctgattgatgattttgtggagcaaatgcacagaatttatcactctactgactgcagcagtgcgatggaagcacagtgtagcatttcaagtacatttaaaggactggatcctctacctggatcaaagaggaaatgtcctcacttcaagtccaatgaagaggatgtagaactctcggatagttttacacgctccgtccatcttacaccaataaagcgactcaaggaaagtcacgacgctagatatggagtgggggaatcccacaaagttatccatttttctagtagctcctcagattaccacgaggagacgcatttacacaactcaagaggttgtcttcagaactccccttgtaatgttgaggatgccctgtcgaaagggtttgagggttgtatttcgatgaaatgccctttttga

SEQ ID NO: 8232 - protein, 296 aa, Sorghum bicolor
  misc_feature: Ceres ANNOT ID no. 6087143
  misc_feature (2)..(296): NCBI GI: 33146891 NCBI Desc: leucine zipper protein-like [oryza sativa (japonica cultivar-group)]
  misc_feature (51)..(191): NCBI GI: 54641896 NCBI Desc: ga20342-pa [drosophila pseudoobscura]
  misc_feature (49)..(190): NCBI GI: 24664675 NCBI Desc: cg7427-pa [drosophila melanogaster]
  misc_feature (34)..(166): NCBI GI: 18700658 NCBI Desc: leucine zipper protein [homo sapiens]
  misc_feature (44)..(166): NCBI GI: 116128485 NCBI Desc: ensangp00000016989 [anopheles gambiae str. pest]
  misc_feature: Abnormal phyllotaxy, leaf number higher than wild-type
  misc_feature: Useful for making plants with altered Lignin content
  misc_feature: Useful for making plants with modulated biomass
  misc_feature: Functional homolog of the protein sequence given in SEQ ID NO 13194
  misc_feature: GREAT-hit functional homolog of the protein sequence given in SEQ ID NO 13553
MGSEGFAAAAAACPSAAEAFLKYYGIVSGGTSVETRQGLVELSLAIDGIEGMRDVIFADIPKLIPFIDLEDMTLFSCFYDFVFFICREKGQKSITIQRAVAAWKIVLNGRFRLLDRWCNFVEKYQRHNISEDTWQQLLAFSRCVNEDLEGYDPRGAWPVLIDDFVEQMHRIYHSTDCSSAMEAQCSISSTFKGLDPLPGSKRKCPHFKSNEEDVELSDSFTRSVHLTPIKRLKESHDARYGVGESHKVIHFSSSSSDYHEETHLHNSRGCLQNSPCNVEDALSKGFEGCISMKCPF

SEQ ID NO: 8233 - DNA, 1719 bp, Sorghum bicolor
  misc_feature: Ceres ANNOT ID no. 6087144
  misc_feature: Encodes the peptide sequence at SEQ ID NO 8234
atggaggctggggaaatcggaggggccctcctcttcgtcctcgccgccgccgccgccgtcgcggtcgccgtgtccgtcggcgcggtcgacttcagccgcccgctcaccggctcgccgctcgacttccagggggcggtgtcctggctcatcggcatcctcgatggcacgtcctccgcggcggcggacgtgtacggggcgtgggtggcggtgcgggccgggctgatcgcgccggtgctgcaggtggcggtgtgggcgtgcatggtgatgtcggtgatgctggtggtggaggccgtgtacaacagcgtcgtcagcctcggcgtcaaggccattgggtggcggcctgagtggaggttcaagtggaagcccctcgacggcgccgacgaggagaaggggagcgcccacttccctatggtcctagtccagatacccatgtacaatgagctggaggtgtacaagctgtcaatagcggcagcatgtgggctgcagtggccaaaggacaggataatggttcaagtgctggacgattccactgacccctttatcaagaatttggtggagcttgaatgtgagcactgggcgaacaaaggcgtcaatattaagtatgccacaagaaccagccgcaaggggttcaaggcaggggctctgaagaaaggaatggaatgtgactatgcaaggcaaagcgaatacattgccatatttgatgctgatttccagcctgaaccagattttctgctccgaactgtcccattccttctgcacaatcccgaagttgcacttgttcaagctcggtggtcctttgtgaatggcaccacaagcctgctgacaagggtacagaagatgttttacgactaccacttcaaagttgaacaagaagcgggatcagcaacctttgccttcttcagtttcaatggaactgctggagtgtggcgtaccatagccataagagatgcaggaggttggaaggaccgaactacagttgaagacatggacttggcagttcgagcaaccctaaagggctggaaatttgtatatgttggggacattagggtcaagagtgaactgccgtccacttacaaggcctactgtcggcagcaattccggtggtctagtggtggtgcaaacttattccgtaagatggcaaaggatgttttgtttgccaaggacatatcactcgtcaagaaaatccatatgctctatagcttcttctttgtgaggagagttgtagcgccaacggctgcctgtattctcttcaatgtcataatccccatctcagtcacagtcccggagctctacttaccagtgtggggtgttgcctatattcccatggtgcttaccatagtcacagttataagacatccaaaaaatctacacataatgcctttttggattttgtttgagagtgtgatgacattgcatcgcatgagagctgcagtgactggactgctggaattagaagggttcaaccagtggactgtgaccaagaaggtggggaatgatctcgaggacactgaagttcctttgcttcagaaaacccggaaaaggctaagggacagagtcaatttccttgagattggattttcggtgtttctcttcctctgtgcgtcatacaacctggtgttccatgggacaagaagctactacttgtatatgtaccttcagggattagcatttctgttactagggcttaacttcactggcacttgttcttgttgccaatga

SEQ ID NO: 8234 - protein, 572 aa, Sorghum bicolor
  misc_feature: Ceres ANNOT ID no. 6087144
  misc_feature (139)..(317): Pfam Id: Glycos_transf_2 Pfam Desc: Glycosyl transferase family 2
  misc_feature (1)..(572): NCBI GI: 33146549 NCBI Desc: csla7 [oryza sativa (japonica cultivar-group)]
  misc_feature (94)..(572): NCBI GI: 17385967 NCBI Desc: csla7 [oryza sativa]
  misc_feature (48)..(304): NCBI GI: 34419208 NCBI Desc: tpa: cellulose synthase-like a4 [oryza sativa (japonica cultivar-group)]
  misc_feature (57)..(571): NCBI GI: 34419228 NCBI Desc: tpa: cellulose synthase-like a2 [oryza sativa (japonica cultivar-group)]
  misc_feature (67)..(567): NCBI GI: 109628383 NCBI Desc: cellulose synthase-like a1 [pinus taeda]
  misc_feature: Useful for making plants with altered cell wall content and/or composition
  misc_feature: Functional homolog of the protein sequence encoded by LOCUS at5g22740
  misc_feature: Useful for making plants with altered carbohydrate content
  misc_feature: Functional homolog of the protein sequence given in SEQ ID NO 13964
  misc_feature: Useful for making plants with altered cell wall content and/or composition
  misc_feature: Functional homolog of the protein sequence given in SEQ ID NO 14018
  misc_feature: The sequence is a functional homolog of SEQ ID NO. 403 in the 11/188,298 US application
MEAGEIGGALLFVLAAAAAVAVAVSVGAVDFSRPLTGSPLDFQGAVSWLIGILDGTSSAAADVYGAWVAVRAGLIAPVLQVAVWACMVMSVMLVVEAVYNSVVSLGVKAIGWRPEWRFKWKPLDGADEEKGSAHFPMVLVQIPMYNELEVYKLSIAAACGLQWPKDRIMVQVLDDSTDPFIKNLVELECEHWANKGVNIKYATRTSRKGFKAGALKKGMECDYARQSEYIAIFDADFQPEPDFLLRTVPFLLHNPEVALVQARWSFVNGTTSLLTRVQKMFYDYHFKVEQEAGSATFAFFSFNGTAGVWRTIAIRDAGGWKDRTTVEDMDLAVRATLKGWKFVYVGDIRVKSELPSTYKAYCRQQFRWSSGGANLFRKMAKDVLFAKDISLVKKIHMLYSFFFVRRVVAPTAACILFNVIIPISVTVPELYLPVWGVAYIPMVLTIVTVIRHPKNLHIMPFWILFESVMTLHRMRAAVTGLLELEGFNQWTVTKKVGNDLEDTEVPLLQKTRKRLRDRVNFLEIGFSVFLFLCASYNLVFHGTRSYYLYMYLQGLAFLLLGLNFTGTCSCCQ

SEQ ID NO: 8235 - DNA, 1167 bp, Sorghum bicolor
  misc_feature: Ceres ANNOT ID no. 6087146
  misc_feature: Encodes the peptide sequence at SEQ ID NO 8236
atggcagcggctgcaatcgcgaccctatccttcagttcagttccttgcaaaaaacggccccggcatggcgctagttccttcgacgcacaacagttcagtaactccagttcctactgtcactctctcactctaagaccaagagtgccaaggtcccgagccgtgagccgggtcgtcgtcgcgcaggccggcagcggcagctacaaggtggccatccttggcgcggcgggagggatcgggcagcctctttctctgctggccaagatgtccccgctcgtctcggcgctgcacctgtacgacatcgccaacgtggagcccgtgaccgccgacctcagccactgcaacaccccggcgcaggtcgccggcttcacaggtaaagacgcgctcgcggggtgcctatcgggcgcggacgtcgtggtcatccccgccggcgtgccccggaagcccggcatgacgcgggacgacctgttcagcgtcaacgccggcatcgtgcgcgacctcgtcgcggcggtggcggaccacgcgccgggcgcgctggtgcacgtgatcagcaacccggtgaactccacggtgccgatcgccgccgaggtgctgaagcagaagggcgcgtacgacccgcggaggctgttcggcgtcacgacgctgggcgtggtccgcgccaacgcgttcgtagcggcgaggaagggcctccccgtggcggaagtggatgtgccggttgtgggcggccacgcggcggctaccatcctgccgctgctgtccaaggcgcggcccaaggcggcgttcacggacgaggaggtggaggagctcaccgccaggatccgggacgccggcaccgaggtggtggaggccaaggccggcgccgggtccgccacgctgtccatggcgtacgccgccgcgcggttcctcgaggcgtcgctgcgtggactcgacggccacgacgacgtgtacgagtgcacgtacgtgcagtcgcaggttgtgccggagctcccgttcttcgcgtgcagggtgaagcttgggagggacggcgtggaggaggtgctgggttcagagctgaggggactcaccgactacgaggcgcgcgagctggaggatctcaagcccaagctcaaggccagcatcgacaagggcatcgcgtacgtgcagcagaaccaggaggcagcgttgaactga

SEQ ID NO: 8236 - protein, 388 aa, Sorghum bicolor
  misc_feature: Ceres ANNOT ID no. 6087146
  misc_feature (67)..(210): Pfam Id: Ldh_1_N Pfam Desc: lactate/malate dehydrogenase, NAD binding domain
  misc_feature (212)..(379): Pfam Id: Ldh_1_C Pfam Desc: lactate/malate dehydrogenase, alpha/beta C-terminal domain
  misc_feature (32)..(386): NCBI GI: 3377762 NCBI Desc: nodule-enhanced malate dehydrogenase [pisum sativum]
  misc_feature (66)..(386): NCBI GI: 3273828 NCBI Desc: nodule-enhanced malate dehydrogenase [glycine max]
  misc_feature (28)..(386): NCBI GI: 2827084 NCBI Desc: malate dehydrogenase precursor [medicago sativa]
  misc_feature (43)..(386): NCBI GI: 115476564 NCBI Desc: os08g0434300 [oryza sativa (japonica cultivar-group)]
  misc_feature (66)..(386): NCBI GI: 5123836 NCBI Desc: nad-malate dehydrogenase [nicotiana tabacum]
  misc_feature (6)..(388): SWISSPROT Homolog: EC 1.1.1.37 Malate dehydrogenase, chloroplast precursor
  misc_feature: The sequence is a functional homolog of SEQ ID NO. 341 in the 11/188,298 US application
MAAAAIATLSFSSVPCKKRPRHGASSFDAQQFSNSSSYCHSLTLRPRVPRSRAVSRVVVAQAGSGSYKVAILGAAGGIGQPLSLLAKMSPLVSALHLYDIANVEPVTADLSHCNTPAQVAGFTGKDALAGCLSGADVVVIPAGVPRKPGMTRDDLFSVNAGIVRDLVAAVADHAPGALVHVISNPVNSTVPIAAEVLKQKGAYDPRRLFGVTTLGVVRANAFVAARKGLPVAEVDVPVVGGHAAATILPLLSKARPKAAFTDEEVEELTARIRDAGTEVVEAKAGAGSATLSMAYAAARFLEASLRGLDGHDDVYECTYVQSQVVPELPFFACRVKLGRDGVEEVLGSELRGLTDYEARELEDLKPKLKASIDKGIAYVQQNQEAALN

SEQ ID NO: 8237 - DNA, 801 bp, Sorghum bicolor
  misc_feature: Ceres ANNOT ID no. 6087154
  misc_feature: Encodes the peptide sequence at SEQ ID NO 8238
atggtgcccagggacagggcgcatagcgccacaactgccaccgcggccccggcggagaacctcgttcaagggcctatcctgaacaacaagtgcgaaaagaaggctccaaagaaagtacataaatctgagagggagaagcgtaagcgcgacaagcagaatgatctctttggcgagctgggaaacatgctagaacctgataggcagaacaatgggaaggcatgcatattaagtgacactacacggatacttaaagatctactttcacaagtagaatctcttcgaaaggagaacaatacgctgaagaatgaatctcattatgttgccttggagagaaatgaactactggatgaaaccaatgtgatccgtggtgaaatctcagaacttcaaaatgagctgaggatgcggctagaaggcaaccctatctggagtcatgacacttctagatcaaatattacagcacctcatcctgcgaccacagtatttacattgcaacattcagcacatccacaagtcattgcaacaatggcacttcctctgcaacagccagcagtcgttgagcaatcttatgctgccccacggcgggagctacagctattccctgaagctgcacctactgaagatactgagccaccacaaaaccaggggatctctaataatgtgatgcggccccaggcaagatacccaccagtagtgacaactttgcctgtacatgtatatccagtccttccaagaatggaagatgagcaatgcagcagcggcactactagtagcagagaggaaggcggggtcggcaaccgctaa

SEQ ID NO: 8238 - protein, 266 aa, Sorghum bicolor
  misc_feature: Ceres ANNOT ID no. 6087154
  misc_feature (1)..(264): NCBI GI: 50508459 NCBI Desc: amelogenin precursor-like protein [oryza sativa (japonica cultivar-group)]
  misc_feature (35)..(223): NCBI GI: 51536178 NCBI Desc: basic helix-loop-helix-like protein [oryza sativa (japonica cultivar-group)]
  misc_feature (33)..(142): NCBI GI: 22329204 NCBI Desc: basic helix-loop-helix (bhlh) family protein [arabidopsis thaliana]
  misc_feature (33)..(130): NCBI GI: 23308269 NCBI Desc: at4g36060/t19k4_190 [arabidopsis thaliana]
  misc_feature (41)..(166): NCBI GI: 29367409 NCBI Desc: helix-loop-helix-like protein [oryza sativa (japonica cultivar-group)]
  misc_feature: The sequence is a functional homolog of SEQ ID NO 1185 in the 11/479,226US patent application
  misc_feature: The sequence is a functional homolog of SEQ ID NO 532 in the 10/412,699US patent application
  misc_feature: Useful for making plants with modulated growth and phenotype characteristics
  misc_feature: The sequence is a functional homolog of SEQ ID NO 532 in the 20040045049 US patent application
MVPRDRAHSATTATAAPAENLVQGPILNNKCEKKAPKKVHKSEREKRKRDKQNDLFGELGNMLEPDRQNNGKACILSDTTRILKDLLSQVESLRKENNTLKNESHYVALERNELLDETNVIRGEISELQNELRMRLEGNPIWSHDTSRSNITAPHPATTVFTLQHSAHPQVIATMALPLQQPAVVEQSYAAPRRELQLFPEAAPTEDTEPPQNQGISNNVMRPQARYPPVVTTLPVHVYPVLPRMEDEQCSSGTTSSREEGGVGNR

SEQ ID NO: 8239 - DNA, 801 bp, Sorghum bicolor; identical to SEQ ID NO: 8237
  misc_feature: Ceres ANNOT ID no. 6087161
  misc_feature: Encodes the peptide sequence at SEQ ID NO 8240

SEQ ID NO: 8240 - protein, 266 aa, Sorghum bicolor; identical to SEQ ID NO: 8238
  misc_feature: Ceres ANNOT ID no. 6087161
  misc_feature (1)..(264): NCBI GI: 50508459 NCBI Desc: amelogenin precursor-like protein [oryza sativa (japonica cultivar-group)]
  misc_feature (35)..(223): NCBI GI: 51536178 NCBI Desc: basic helix-loop-helix-like protein [oryza sativa (japonica cultivar-group)]
  misc_feature (33)..(142): NCBI GI: 22329204 NCBI Desc: basic helix-loop-helix (bhlh) family protein [arabidopsis thaliana]
  misc_feature (33)..(130): NCBI GI: 23308269 NCBI Desc: at4g36060/t19k4_190 [arabidopsis thaliana]
  misc_feature (41)..(166): NCBI GI: 29367409 NCBI Desc: helix-loop-helix-like protein [oryza sativa (japonica cultivar-group)]
  misc_feature: The sequence is a functional homolog of SEQ ID NO 1185 in the 11/479,226US patent application
  misc_feature: The sequence is a functional homolog of SEQ ID NO 532 in the 10/412,699US patent application
  misc_feature: Useful for making plants with modulated growth and phenotype characteristics
  misc_feature: The sequence is a functional homolog of SEQ ID NO 532 in the 20040045049 US patent application

SEQ ID NO: 8241 - DNA, 1797 bp, Sorghum bicolor
  misc_feature: Ceres ANNOT ID no. 6087182
  misc_feature: Encodes the peptide sequence at SEQ ID NO 8242
atggttctcgcgcgagtcctcacgctcccgctgcccgccccgtcgtccgcgccccaccgccgcttactcctgccgcctcaggcgtcgccggcgcctgcgcgtgtgcgcaccgtgcgggccgccgcctgccgtgcagcgaacgccatggcggcggtttctgtggacccgcccccggtcgctccgagccccgcagaggtcgcggccgtgggcgtcggggatgagctgccggaggggtacgatcagatgatgcccaccgtggagccgtcgcggcggcggcgcgcgggggtgctgctgcatccgacgtcgttgcggggaccgcacggcatcggcgacctcggggacgaggcgcttgccttcctgcattggctccgcgacgccggctgcacgctctggcaggttctaccacttgtccctccaggtaggacggctggggaggagggatctccttattctggacaggatgccaactgtggcaatacccttttgctatctcttgaggagcttgtaaaagatggtctattgatgtcagatgaacttcctgatcctgtggatacagagtatgttgaatttgacactgttgcaaatctgaaagaaccacttattgcaaaggcagcagagaggctcctactaagccatggagagctcagaacgcaatatgactgcttcaagaaaaatccaaatatatcaggttggcttgaagatgcagctctttttgctgctattgacaaaagcattggtgcattctcttggtacgagtggcctgaacctctgaaaaatcgccatcttggagccttggaagatatatatcaaaaacagaaggactttatagagacatttatggctcagcagttcttatttcaaaggcaatggcagcgggttcgtaaatatgcacaaaagctgggtatcagcatcatgggtgacatgcctatatatgttggctaccatagtgcagatgtttgggcgaacaggaaatcatttttgctggacaagaatggtttccccactttcgttagtggtgttccacctgatgcatttagcgaaacgggtcaactatggaacagtccattgtacgactggaaagctatggaagcagatggcttttcatggtggacaaagaggattaaacgtgcccttgatttgtatgatgagttccgtattgaccatttccggggtcttgcaggtttttgggcagtcccttctgatgcaaaagtagcactggttggaagctggagggtgagcattgaattgatgaacatggctggaccaaggaatagcttttttgacgcgctcttcaaagctgttggtagaataaatataatagcagaagacctgggggtaattactgaagatgttgttcagctaaggaaatccattggggcccctgggatggcagttctccagtttgcttttggaggtggttctgacaaccctcacttgccccataaccatgaaatggatcaagttgtgtacactggaacacatgataacgatacagttcttggctggtggcaaaatttgccagaggaagagaagaaaattgtgatcaagtatctaccagaagccgagaatactgacatatcatggacactgattacggctgccctctcttctgttgcgaggacttccatggtaaccatgcaggacattcttggcctcgacagttctgctcgaatgaatacgccagctacccagaaaggaaattggaggaggaggatgccaggctcagttggcttcgacagtctcagccctgaagcggcaaagctgaaggagctgcttgcgctgtacaatcggcagtga

SEQ ID NO: 8242 - protein, 598 aa, Sorghum bicolor
  misc_feature: Ceres ANNOT ID no. 6087182
  misc_feature (98)..(595): Pfam Id: Glyco_hydro_77 Pfam Desc: 4-alpha-glucanotransferase
  misc_feature (1)..(597): NCBI GI: 71084353 NCBI Desc: disproportionating enzyme [aegilops tauschii]
  misc_feature (1)..(597): NCBI GI: 71084351 NCBI Desc: disproportionating enzyme [triticum aestivum]
  misc_feature (7)..(597): NCBI GI: 115473487 NCBI Desc: os07g0627000 [oryza sativa (japonica cultivar-group)]
  misc_feature (67)..(597): NCBI GI: 296692 NCBI Desc: 4-alpha-glucanotransferase precursor [solanum tuberosum]
  misc_feature (67)..(597): NCBI GI: 99031627 NCBI Desc: chain a, structure determination and refinement at 1.8 a resolution of disproportionating enzyme from potato
  misc_feature (67)..(597): SWISSPROT Homolog: EC 2.4.1.25 4-alpha-glucanotransferase, chloroplast precursor
MVLARVLTLPLPAPSSAPHRRLLLPPQASPAPARVRTVRAAACRAANAMAAVSVDPPPVAPSPAEVAAVGVGDELPEGYDQMMPTVEPSRRRRAGVLLHPTSLRGPHGIGDLGDEALAFLHWLRDAGCTLWQVLPLVPPGRTAGEEGSPYSGQDANCGNTLLLSLEELVKDGLLMSDELPDPVDTEYVEFDTVANLKEPLIAKAAERLLLSHGELRTQYDCFKKNPNISGWLEDAALFAAIDKSIGAFSWYEWPEPLKNRHLGALEDIYQKQKDFIETFMAQQFLFQRQWQRVRKYAQKLGISIMGDMPIYVGYHSADVWANRKSFLLDKNGFPTFVSGVPPDAFSETGQLWNSPLYDWKAMEADGFSWWTKRIKRALDLYDEFRIDHFRGLAGFWAVPSDAKVALVGSWRVSIELMNMAGPRNSFFDALFKAVGRINIIAEDLGVITEDVVQLRKSIGAPGMAVLQFAFGGGSDNPHLPHNHEMDQVVYTGTHDNDTVLGWWQNLPEEEKKIVIKYLPEAENTDISWTLITAALSSVARTSMVTMQDILGLDSSARMNTPATQKGNWRRRMPGSVGFDSLSPEAAKLKELLALYNRQ

SEQ ID NO: 8243 - DNA, 801 bp, Sorghum bicolor
  misc_feature: Ceres ANNOT ID no. 6087200
  misc_feature: Encodes the peptide sequence at SEQ ID NO 8244
atgagcagccttcgagccatctcctctctcctccatatctactactcgtccgccgccgtgagacgaggcgccgggcggctggggttcgcaccggcgctcggcgggagcttccgggtaccgtcgaattccggtccgcccgcgttcgtgctcgacgaggtcgctagggcggccggcggggttcgaaggagagcgtccacgcgcgcggcgagttgggattcggagaagtcgccgtacgagacgcttgacgaggagaccataaagactgcctacagaagattggccaagttctatcaccctgatgtttatgatggtaagggaacccttgaggaaggggaaactgctgaagctcgtttcatcaagatccaagcagcgtatgagctgttgattgataatgaaaggagaagggcatatgatagagatcatcatgtgaatccgatgaaggcttctcaagcatggatggagtgggtaatgaagaagcggaaagcttttgaccaacgtggtgacatggctgtggctgcttgggctgagcagcagcaacgcgaaatgacactacgggcacggcgtctctcacgctcaaaggttgatcctgaggaagaaaggaagctatttgccaaggaaaagaaggcatctatggaattctacagcacaactctgaagagacatacccttgtgttacggaagagggatattatgcgcaagaaggcagaggaggagagggataatgagatcagtagacttctagcggcggaagggcttgagctggatacagatgaagatgaaaacaagacttttttggggtaa

SEQ ID NO: 8244 - protein, 266 aa, Sorghum bicolor
  misc_feature: Ceres ANNOT ID no. 6087200
  misc_feature (76)..(138): Pfam Id: DnaJ Pfam Desc: DnaJ domain
  misc_feature (1)..(262): NCBI GI: 6573763 NCBI Desc: f28k19.14 [arabidopsis thaliana]
  misc_feature (72)..(239): NCBI GI: 90654964 NCBI Desc: dnaj heat shock protein [nicotiana tabacum]
  misc_feature (86)..(142): NCBI GI: 1354228 NCBI Desc: 16 kda protein
  misc_feature (76)..(158): NCBI GI: 56478993 NCBI Desc: dnaj class protein [azoarcus sp. ebn1]
  misc_feature (45)..(139): NCBI GI: 9294487 NCBI Desc: dnaj homolog [arabidopsis thaliana]
MSSLRAISSLLHIYYSSAAVRRGAGRLGFAPALGGSFRVPSNSGPPAFVLDEVARAAGGVRRRASTRAASWDSEKSPYETLDEETIKTAYRRLAKFYHPDVYDGKGTLEEGETAEARFIKIQAAYELLIDNERRRAYDRDHHVNPMKASQAWMEWVMKKRKAFDQRGDMAVAAWAEQQQREMTLRARRLSRSKVDPEEERKLFAKEKKASMEFYSTTLKRHTLVLRKRDIMRKKAEEERDNEISRLLAAEGLELDTDEDENKTFLG

SEQ ID NO: 8245 - DNA, 507 bp, Sorghum bicolor
  misc_feature: Ceres ANNOT ID no. 6087202
  misc_feature: Encodes the peptide sequence at SEQ ID NO 8246
atggggggcaccttggagtacctgtcagggctgctgggagtgggagggagtggaagccatgaccacgagaacaagaagaagaagaggaagcagctgcagacggtggagctcaaggtcaggatggactgtgaagggtgcgagctcaaggtcaggagcaccctctcctccatgaaaggggtcgagtcggtggagataaacaggaagcagcagaaggtgacggtggtcgggtacgtggaggcgaccaaggtgctgaagaaggcgcagtccacggggaagaaggcggagctgtggccgtacgtgccctacaacctggtggcgcagccctacgtggccggcacctacgacaagcgcgccccgcccgggtacgtccggagcgtggagcctgctgcaggctacgtggtggccgccagtagccaactgcaggccgccgccggcggcaggccgccgggtgaccacctcaccgacatgttcaacgacgagaaccccaactcctgctcggtcatgtga

SEQ ID NO: 8246 - protein, 168 aa, Sorghum bicolor
  misc_feature: Ceres ANNOT ID no. 6087202
  misc_feature (36)..(96): Pfam Id: HMA Pfam Desc: Heavy-metal-associated domain
  misc_feature (1)..(168): NCBI GI: 92899055 NCBI Desc: heavy metal transport/detoxification protein [medicago truncatula]
  misc_feature (27)..(168): NCBI GI: 23304411 NCBI Desc: farnesylated protein 1 [hordeum vulgare subsp. vulgare]
  misc_feature (3)..(168): NCBI GI: 21536547 NCBI Desc: farnesylated protein (atfp6) [arabidopsis thaliana]
  misc_feature (3)..(168): NCBI GI: 28866019 NCBI Desc: farnesylated protein 3 [hordeum vulgare subsp. vulgare]
  misc_feature (26)..(168): NCBI GI: 4097573 NCBI Desc: gmfp7 [glycine max]
  misc_feature: Useful for biocontainment applications
  misc_feature: Functional homolog of the protein sequence given in SEQ ID NO 13156
MGGTLEYLSGLLGVGGSGSHDHENKKKKRKQLQTVELKVRMDCEGCELKVRSTLSSMKGVESVEINRKQQKVTVVGYVEATKVLKKAQSTGKKAELWPYVPYNLVAQPYVAGTYDKRAPPGYVRSVEPAAGYVVAASSQLQAAAGGRPPGDHLTDMFNDENPNSCSVM

SEQ ID NO: 8247 - DNA, 504 bp, Sorghum bicolor
  misc_feature: Ceres ANNOT ID no. 6087205
  misc_feature: Encodes the peptide sequence at SEQ ID NO 8248
atgtcgcgcctcagcctcgccgtcgcggtggccgtcctcgcgctagcgtccggcgcggcgtcgcaggcgccggggccgtcgtcgccgccggtcgactgctcgtcggcggtgaccgggctcatcggctgcctgccgtacgtgcagcaggggagcacgcagggcaagcccaccagtgggtgctgcaccggcgtcaaggccgccctcaagagccccgccaccgtcgcctgcctctgcgccgccttcggccagaactacggcattcaggtcaacctcacccgcgccgccgggcttcccgcggcctgcggcgaagatcccgccgccttgagcaaatgcaacatcaaagtgcccggcgcccctgcttcagcgcctacagcttctggagccgctccggttccagcaggcccaagctcaggcttgccaaagtcagcagcggtgatgcgatcgccggtctcagcgttcgccgccgtggccgccgctactctgctctcgcactgcctcctctga

SEQ ID NO: 8248 - protein, 167 aa, Sorghum bicolor
  misc_feature: Ceres ANNOT ID no. 6087205
  misc_feature (4)..(156): NCBI GI: 42573786 NCBI Desc: protease inhibitor/seed storage/lipid transfer protein (ltp) family protein [arabidopsis thaliana]
  misc_feature (6)..(166): NCBI GI: 49204581 NCBI Desc: xylogen protein 1 [zinnia elegans]
  misc_feature (4)..(156): NCBI GI: 20147301 NCBI Desc: at5g64080/mhj24_6 [arabidopsis thaliana]
  misc_feature (4)..(156): NCBI GI: 21618136 NCBI Desc: nonspecific lipid-transfer protein-like protein [arabidopsis thaliana]
  misc_feature (4)..(111): NCBI GI: 115453301 NCBI Desc: os03g0385100 [oryza sativa (japonica cultivar-group)]
MSRLSLAVAVAVLALASGAASQAPGPSSPPVDCSSAVTGLIGCLPYVQQGSTQGKPTSGCCTGVKAALKSPATVACLCAAFGQNYGIQVNLTRAAGLPAACGEDPAALSKCNIKVPGAPASAPTASGAAPVPAGPSSGLPKSAAVMRSPVSAFAAVAAATLLSHCLL

SEQ ID NO: 8249 - DNA, 1356 bp, Sorghum bicolor
  misc_feature: Ceres ANNOT ID no. 6087209
  misc_feature: Encodes the peptide sequence at SEQ ID NO 8250
atggaaatgtacttggtcgaggacctggatttgcttgacgacgacgacgagttcggcgggtttggagtcaccgtcggcagcggtacccccaggccgtggcagagtcactgcggagaagactcaggtgtataccgtagtactagtatagagacatcactccaagataagcaaacgtatgatacttctgctgtggagtacagaaatgggaaagacatgcaagggataccgtgggagaggctgaactatggtagaaatgactaccgtaggatgaggttgaaggagtacaagaactatgagagcctctccagatcacatgagttgttggattcggagtgcaaacaagtggacagaggaagcacattctatgatttccgcttcaacacaagacttgtcaagtcaacaatagttcactttcagctgagggacctcatttgggccacatccaagcatgatgtctacacgacacagaattattcagttatgcactggtcttctcttcttcaaagagggaaagaagtgctcaatgtggcaaatcgagtacttccaaagaagatggttcgtggggctcagccactgttcagaatgcagatgagcacaatggccataaaagataatcttttggtagctggtggtttccgtggcgaactgatttgcaagtatgttgatcaacctggagtggctttctgtacaaatcttgctgaggataaggatagcatcacaaatgctgtagatgtgtacgagtctccaaatggctctacacgagtgatggccaccaacaatgactgtgctgtcagagtttttgataccgaaaggttcaagctacttagccacttgaaattcccatggtcggtcaatgatacttctgcgagtcctgatggcaaactagttgctgttcttggcgatagctctgagtgtttggtagctgatgctcagtctggcaaggaaatcgcaagcctcaatgggcacctagactactcgttctcatccgcctggcaccctgacggccgcgtccttgccaccgggaaccaggacaccacctgcagactgtgggacgtgcgcaacctctcgcggtctttcacggtgctcaaggggagaatcggcgcggtgaggggcctcaagttctcgtcggacggccggttcctggcgatgtcggaggcggcggacttcgtccacgtgtacgactcgcaggctgattactcgaaagagcaggagatcgacatctttggagagatcgcaggcatgtcattcagcccggacgcggaggccctgtttgtcggggtcgctgaccggacgtatggcagcctgatcgagttcaccaggaggcatcggtacgactacttcgactcctatctatga

SEQ ID NO: 8250 - protein, 451 aa, Sorghum bicolor
  misc_feature: Ceres ANNOT ID no. 6087209
  misc_feature (313)..(351): Pfam Id: WD40 Pfam Desc: WD domain, G-beta repeat
  misc_feature (27)..(451): NCBI GI: 50881464 NCBI Desc: wd domain, g-beta repeat containing protein [oryza sativa (japonica cultivar-group)]
  misc_feature (4)..(449): NCBI GI: 25090156 NCBI Desc: at1g78070/f28k19_28 [arabidopsis thaliana]
  misc_feature (4)..(449): NCBI GI: 42572153 NCBI Desc: wd-40 repeat family protein [arabidopsis thaliana]
  misc_feature (56)..(450): NCBI GI: 18400003 NCBI Desc: wd-40 repeat family protein [arabidopsis thaliana]
  misc_feature (250)..(449): NCBI GI: 6573770 NCBI Desc: f28k19.28 [arabidopsis thaliana]
  misc_feature: The sequence is a functional homolog of SEQ ID NO. 502 in the 11/188,298 US application
MEMYLVEDLDLLDDDDEFGGFGVTVGSGTPRPWQSHCGEDSGVYRSTSIETSLQDKQTYDTSAVEYRNGKDMQGIPWERLNYGRNDYRRMRLKEYKNYESLSRSHELLDSECKQVDRGSTFYDFRFNTRLVKSTIVHFQLRDLIWATSKHDVYTTQNYSVMHWSSLLQRGKEVLNVANRVLPKKMVRGAQPLFRMQMSTMAIKDNLLVAGGFRGELICKYVDQPGVAFCTNLAEDKDSITNAVDVYESPNGSTRVMATNNDCAVRVFDTERFKLLSHLKFPWSVNDTSASPDGKLVAVLGDSSECLVADAQSGKEIASLNGHLDYSFSSAWHPDGRVLATGNQDTTCRLWDVRNLSRSFTVLKGRIGAVRGLKFSSDGRFLAMSEAADFVHVYDSQADYSKEQEIDIFGEIAGMSFSPDAEALFVGVADRTYGSLIEFTRRHRYDYFDSYL

SEQ ID NO: 8251 - DNA, 1149 bp, Sorghum bicolor
  misc_feature: Ceres ANNOT ID no. 6087210
  misc_feature: Encodes the peptide sequence at SEQ ID NO 8252
atgacgaagcacaccgccttcgccgcggacgacgcgatcaccgccgccgccggcgtcacgtcgccgcagcccggccgacggttcacgtcgtacccgccgccgacaagggcgcgcggcggatgcaggctggccgctgcggcggcgcggcaggccacggacccaggcgccgcgggcgtagccgcggggtcctggccggaactcgtgccgcgccacgccgacttcgacgactggatggagaagcacccgtcggcgttggccgagttcgagtcggtgctggccaccgccaagggcaagcagatcgtcatgttcctggactacgacggcacgctgacgccgatcgtcaaggaccccgacagcgccgtcatgtccgaggagatgcgagacgcggtgagaggcgtggccgagcacttcccgacggcgatcgtgagcgggaggtgcagagacaaggtgttcaacttcgtgaagctggcggaactatactacgcagggagccacggcatggacatcaaggggcccacggcacagtccaagcacaccaaggcaaaggccgaggctgttctgtgccaaccagcgagcgcgttcctcccggtcattgacgaggtgtatcgcacgctgacggcgaggacggcgccgatccccggcgccacggtggagaacaacaagttctgcctctccgtccacttccgctgcgtccaggaggagaaatggcgcgctctggaggagcaggtccggtcggtgctcaaggagtacccggacctccggctcaccaagggcaggaaggtcttggagatccggccgtccatcgagtgggacaagggcaacgccctacagttcttgcttgagtctctcggttttgctgacagtaacgacaatgtcttcccgatatatatcggagatgatcgcaccgacgaggacgcgttcaaggtgctgcgcagcatggggcaagggatcggaatccttgtgagcaagattccaaaggagaccgcggcatcctactccttgcgtgaaccttctgaggtagtaacacaactctacccactgctactagtaacagtgcacgggctacctatctcagctcagaacttttatgctctggaaaatgtgaaggagttcctgcgcaagttggtgaggtccaagcagcgggactag

SEQ ID NO: 8252 - protein, 382 aa, Sorghum bicolor
  misc_feature: Ceres ANNOT ID no. 6087210
  misc_feature (103)..(338): Pfam Id: Trehalose_PPase Pfam Desc: Trehalose-phosphatase
  misc_feature (1)..(340): NCBI GI: 90200725 NCBI Desc: sister of ramosa 3 [zea mays]
  misc_feature (99)..(340): NCBI GI: 90200731 NCBI Desc: sister of ramosa 3 [sorghum bicolor]
  misc_feature (1)..(340): NCBI GI: 90200723 NCBI Desc: ramosa 3 [zea mays]
  misc_feature (1)..(336): NCBI GI: 90200733 NCBI Desc: ramosa 3 [setaria viridis]
  misc_feature (99)..(340): NCBI GI: 90200735 NCBI Desc: sister of ramosa 3 [chasmanthium latifolium]
  misc_feature: Useful for making plants with modulated drought sensitivity
  misc_feature: GREAT-hit functional homolog of the protein sequence given in SEQ ID NO 13423
  misc_feature: GREAT-hit functional homolog of the protein sequence given in SEQ ID NO 13424
  misc_feature: Useful for making plants with modulated drought sensitivity
  misc_feature: Functional homolog of the protein sequence given in SEQ ID NO 13424
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: The sequence is a functional homolog of SEQ ID NO 16 in US patent 7214858
  misc_feature: Useful for making plants with modulated water use efficiency
  misc_feature: Functional homolog of the protein sequence given in SEQ ID NO 13348
MTKHTAFAADDAITAAAGVTSPQPGRRFTSYPPPTRARGGCRLAAAAARQATDPGAAGVAAGSWPELVPRHADFDDWMEKHPSALAEFESVLATAKGKQIVMFLDYDGTLTPIVKDPDSAVMSEEMRDAVRGVAEHFPTAIVSGRCRDKVFNFVKLAELYYAGSHGMDIKGPTAQSKHTKAKAEAVLCQPASAFLPVIDEVYRTLTARTAPIPGATVENNKFCLSVHFRCVQEEKWRALEEQVRSVLKEYPDLRLTKGRKVLEIRPSIEWDKGNALQFLLESLGFADSNDNVFPIYIGDDRTDEDAFKVLRSMGQGIGILVSKIPKETAASYSLREPSEVVTQLYPLLLVTVHGLPISAQNFYALENVKEFLRKLVRSKQRD

SEQ ID NO: 8253 - DNA, 1095 bp, Sorghum bicolor
  misc_feature: Ceres ANNOT ID no. 6087216
  misc_feature: Encodes the peptide sequence at SEQ ID NO 8254
atgacgaagcacaccgccttcgccgcggacgacgcgatcaccgccgccgccgtcacgtcgcagcccggccgccggttcacgtcgtacccgccgccgacgagggcgcgcggcggatgcagggtggccgcggcggcggcggcggcgcgccaggccacggaccccggcgccgtggtcgtggccgtggggtccttgccggaactcgtgccgcgccacgccgacctcgacttcgagaactggatggagaagcacccgtcggcattggccgagttcgagtcggtgctggccgccgccaaggggaagcagatcgtgatgttccttgactacgacggcaccctgtcgccgatcgttaaggaccccgacagcgccgtcatgtccgaggagatgcgagacgcggtgagaggcgtggccgagcacttcccgacggcgatcgtgagcgggaggtgtagagacaaggtgttcaacttcgtgaagctggcggagctgtactacgccgggagccacggcatggacatcaaggggcccacggcacagtccaagcacaccaaggcaaaggccgaagctgttctgtgccaaccagcgagcgcgttcctgccggtcattgacgaggtgtaccgcacgctgacggcgaggacagcgccgatccccggagcgacggtggagaacaacaagttctgcctctccgtccatttccgctgcgtccacgaggagaaatggcgcgctctggaggagcaggtccggtcggtgctcaaggagtacccggacctccggctcaccaagggcaggaaggtcttggagatccggccgtccatcgagtgggacaagggcaacgccctacagttcttgcttgagtccctcggtttcgctgacagtaacaatgtgttcccgatatatatcggagacgatcgcacggatgaggacgcgttcaaggtgctgcgcagcatgggccaagggatcggaatccttgtgagcaagattccaaaggagaccagtgcatcctactccttgcgtgaaccttctgagaagcaaagaacagcaatttgtgggggcagcaggccatgggaccatgcatggtcgatcgcatgcatgcatgcatga

SEQ ID NO: 8254 - protein, 364 aa, Sorghum bicolor
  misc_feature: Ceres ANNOT ID no. 6087216
  misc_feature (105)..(339): Pfam Id: Trehalose_PPase Pfam Desc: Trehalose-phosphatase
  misc_feature (1)..(340): NCBI GI: 90200725 NCBI Desc: sister of ramosa 3 [zea mays]
  misc_feature (101)..(340): NCBI GI: 90200731 NCBI Desc: sister of ramosa 3 [sorghum bicolor]
  misc_feature (1)..(337): NCBI GI: 90200733 NCBI Desc: ramosa 3 [setaria viridis]
  misc_feature (101)..(340): NCBI GI: 90200735 NCBI Desc: sister of ramosa 3 [chasmanthium latifolium]
  misc_feature (1)..(340): NCBI GI: 90200723 NCBI Desc: ramosa 3 [zea mays]
  misc_feature: Useful for making plants with modulated drought sensitivity
  misc_feature: GREAT-hit functional homolog of the protein sequence given in SEQ ID NO 13423
  misc_feature: GREAT-hit functional homolog of the protein sequence given in SEQ ID NO 13424
  misc_feature: Useful for making plants with modulated drought sensitivity
  misc_feature: Functional homolog of the protein sequence given in SEQ ID NO 13424
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: The sequence is a functional homolog of SEQ ID NO 16 in US patent 7214858
  misc_feature: Useful for making plants with modulated water use efficiency
  misc_feature: Functional homolog of the protein sequence given in SEQ ID NO 13348
MTKHTAFAADDAITAAAVTSQPGRRFTSYPPPTRARGGCRVAAAAAAARQATDPGAVVVAVGSLPELVPRHADLDFENWMEKHPSALAEFESVLAAAKGKQIVMFLDYDGTLSPIVKDPDSAVMSEEMRDAVRGVAEHFPTAIVSGRCRDKVFNFVKLAELYYAGSHGMDIKGPTAQSKHTKAKAEAVLCQPASAFLPVIDEVYRTLTARTAPIPGATVENNKFCLSVHFRCVHEEKWRALEEQVRSVLKEYPDLRLTKGRKVLEIRPSIEWDKGNALQFLLESLGFADSNNVFPIYIGDDRTDEDAFKVLRSMGQGIGILVSKIPKETSASYSLREPSEKQRTAICGGSRPWDHAWSIACMHA

SEQ ID NO: 8255 - DNA, 3039 bp, Sorghum bicolor
  misc_feature: Ceres ANNOT ID no. 6087235
  misc_feature: Encodes the peptide sequence at SEQ ID NO 8256
atggcggagattcgcaagtacgccatgtccaaccagcccccagatattcctcagatactactggaagctcagaataggtggttgcggcccaccgaaatctgccaaatattgtcaaactacaagaagttttccattgcgcctgagccgccgaacagacctcaaagtggttccctgtttctgtttgatcggaaaatattgagatacttcaggaaggatggacacaactggagaaagaaaaaggatggaaagacagttaaagaagctcatgagaagcttaaagttggcagtgttgatgtacttcattgctattatgcccatggcgaggagaatgagaacttccaaagacgaacatattggctgcttgaagagagtttcatgaatattgttcttgttcactaccttgaaatcaagggtgtcaaacaaagtttcaatcgtgctaaagaagctgaagagaatgcaggattatctcatgctgatagtcctgcatgttcaaactctttcgctagtcagagccaggtagcctcccaatctatggatgctgaaagcccaattagtggacagatttcggaatatgaagatgctgaaacagataattctcgagcaagctccagataccaccctttcactgagatgcagcagcctgtggatggtatcatgatgggttatcttggtgaaatgcaacctacgggagctaacttaaccaatcatttttccactcgcaatgacgtagctagtgtgttcaatgaaactggctctgagttaggaggtggtcccaaagcttcaattgattcagtgctgttgggtgaaccatttcaagaatatccaggcggcttcatggattcgacactctattcttctgttgcaacgttgggtaatagtctggatgatggtttgcagacatttatgtctgaggcgctctacaccaacaatctcacacaaaaggaggttgatgcacttagtgcagcaggcataacatcctcaaaggcagagaatgatggttatacagatcaaagtgtcaggtatccacttttaaagcagtcatcatcagatctctttaagatggagccagatggtttgaagaaatttgacagcttttcaaggtggatgaacaatgagcttccagaggttgctgatttggatatcaagtccagttctgatgctttctggagtactactgaaaccgtgaatgttgctgatggatctagtatacctattaatgagcagttggatgcatttgtagtcagcccctcactttctgaagagcagcttttcagtattattgatgtgtctccaagctgggcatacaatggcaaaaaaaccaaggtcttaattactggtacatttttggcaaaaaaagaagatgtggaaaatcgcaggtggtcttgtatgtttggagatgctgaagtctctgctgaagttttagtggatggctccttgcgttgctatacaccagtacatcgttctggacgagttccattttatgtgacatgttcaaatagagtagcttgtagtgaagtgcgagaatttgagttccgcgattctgagacacattatatggatacttcagatcagcatactactggcataaatgaaatgcatttacatatccgccttgataagttactttccttggaacaagaagactatgaaatgtatgtcttgagtaatggaaataagtctgagttgatcgacactatcaattcattgatgcttgacgataatttgtctaatctggcattgccatttgatgagaaggaattgtccactgtacgggatcagaatcttgagaaacaggtgaaagaaaagctgtattattggctcatccataagatacatgatgatggaaaaggtccaaatgtcctaggcaaggaaggacaaggtgccattcatttagtagctgcacttggctatgattgggctatcaaaccaatagttgctgcaggagtaaatataaacttcagggatattcgtggatggactgcacttcactgggctgcatcttgtggaagggagcggacagtaggtgccctaatagcaaacggagctgcatcaggtcctttaacagatccaacacagcagtatccatctggaagaactcctgctgatctagcatcagaaaatggtcacaaaggcattgctggttttcttgcagagtctgctttgacaagtcacctctcagctcttacactaaaggagtcacagggtggcaatgtggaagaaatatgtggagtaacagcaccagcagctgaagattttgcagaaccaagttcttctcagcttgcttgtgttaattctcaggaagagtccttaaaagattcacttggtgcagttcgtaaatcaactcaagccgcagccagaatatttcaagcttttagggtggaatcattccacagaaagaaggttatcgaatatggagatgatgattgtggactgtctgatgaacgcacactttcacttatttccctaagaaatccgaaacctggacatggtgatttgcattctgctgctgttcgtatccaaaacaagtttagaggatggaaaggaagaaaagagtttatgattatccggcagaaaattgtgaagatacaggcccatgtacgtggacatcaggtaaggaaaaactatcggaaggtagtctggtctgttggcattgtggagaaagtcatactgaggtggaggagaaagagaaggggtcttcgaggtttccaacccgagaaacaacttgaaggtccatcatggcagatccaacctgcaaaggctgaggctgaggatgaatatgatttcttgaaggatggcaggaaacaggctgaaggcaggttgcaaagagcactggctcgtgtgcattcaatgaatcagtatcctgaagcaagagaccagtaccgcaggctgcaagcctgtgttaacagcctacaagagtcccaggcgatgcaggacaggatgctggctgattcagctggcaccgatgggggtgatttcatggctgaattggaggagctatgccgggatgatggcgatgccccaatgtcgactatttcgtga

SEQ ID NO: 8256 - protein, 1012 aa, Sorghum bicolor
  misc_feature: Ceres ANNOT ID no. 6087235
  misc_feature (19)..(137): Pfam Id: CG-1 Pfam Desc: CG-1 domain
  misc_feature (856)..(876): Pfam Id: IQ Pfam Desc: IQ calmodulin-binding motif
  misc_feature (657)..(689): Pfam Id: Ank Pfam Desc: Ankyrin repeat
  misc_feature (222)..(1007): NCBI GI: 115451259 NCBI Desc: os03g0191000 [oryza sativa (japonica cultivar-group)]
  misc_feature (233)..(801): NCBI GI: 110741068 NCBI Desc: calmodulin-binding transcription activator 3 [arabidopsis thaliana]
  misc_feature (270)..(1003): NCBI GI: 75324343 NCBI Desc: calmodulin-binding transcription activator 2 (signal-responsive protein 4) (ethylene-induced calmodulin-binding protein c) (eicbp.c) (ater66)
  misc_feature (15)..(1003): NCBI GI: 9759398 NCBI Desc: er66 protein-like [arabidopsis thaliana]
  misc_feature (351)..(1003): NCBI GI: 110737392 NCBI Desc: calmodulin-binding transcription activator 1 [arabidopsis thaliana]
  misc_feature: The sequence is a functional homolog of SEQ ID NO 130 in the 10/666,642US patent application
  misc_feature: The sequence is a functional homolog of SEQ ID NO 1308 in the 10/666,642US patent application
  misc_feature: The sequence is a functional homolog of SEQ ID NO 1309 in the 10/666,642US patent application
  misc_feature: The sequence is a functional homolog of SEQ ID NO 58 in the 10/666,642US patent application
  misc_feature: The sequence is a functional homolog of SEQ ID NO 588 in the 10/666,642US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13200
  misc_feature: The sequence is a functional homolog of SEQ ID NO 130 in the 20070033671 US patent application
  misc_feature: The sequence is a functional homolog of SEQ ID NO 1308 in the 20070033671 US patent application
  misc_feature: The sequence is a functional homolog of SEQ ID NO 1309 in the 20070033671 US patent application
  misc_feature: The sequence is a functional homolog of SEQ ID NO 58 in the 20070033671 US patent application
  misc_feature: The sequence is a functional homolog of SEQ ID NO 588 in the 20070033671 US patent application
  misc_feature: The sequence is a functional homolog of SEQ ID NO 1309 in the 10/666,642 US patent application
  misc_feature: The sequence is a functional homolog of SEQ ID NO 1308 in the 10/666,642 US patent application
MAEIRKYAMSNQPPDIPQILLEAQNRWLRPTEICQILSNYKKFSIAPEPPNRPQSGSLFLFDRKILRYFRKDGHNWRKKKDGKTVKEAHEKLKVGSVDVLHCYYAHGEENENFQRRTYWLLEESFMNIVLVHYLEIKGVKQSFNRAKEAEENAGLSHADSPACSNSFASQSQVASQSMDAESPISGQISEYEDAETDNSRASSRYHPFTEMQQPVDGIMMGYLGEMQPTGANLTNHFSTRNDVASVFNETGSELGGGPKASIDSVLLGEPFQEYPGGFMDSTLYSSVATLGNSLDDGLQTFMSEALYTNNLTQKEVDALSAAGITSSKAENDGYTDQSVRYPLLKQSSSDLFKMEPDGLKKFDSFSRWMNNELPEVADLDIKSSSDAFWSTTETVNVADGSSIPINEQLDAFVVSPSLSEEQLFSIIDVSPSWAYNGKKTKVLITGTFLAKKEDVENRRWSCMFGDAEVSAEVLVDGSLRCYTPVHRSGRVPFYVTCSNRVACSEVREFEFRDSETHYMDTSDQHTTGINEMHLHIRLDKLLSLEQEDYEMYVLSNGNKSELIDTINSLMLDDNLSNLALPFDEKELSTVRDQNLEKQVKEKLYYWLIHKIHDDGKGPNVLGKEGQGAIHLVAALGYDWAIKPIVAAGVNINFRDIRGWTALHWAASCGRERTVGALIANGAASGPLTDPTQQYPSGRTPADLASENGHKGIAGFLAESALTSHLSALTLKESQGGNVEEICGVTAPAAEDFAEPSSSQLACVNSQEESLKDSLGAVRKSTQAAARIFQAFRVESFHRKKVIEYGDDDCGLSDERTLSLISLRNPKPGHGDLHSAAVRIQNKFRGWKGRKEFMIIRQKIVKIQAHVRGHQVRKNYRKVVWSVGIVEKVILRWRRKRRGLRGFQPEKQLEGPSWQIQPAKAEAEDEYDFLKDGRKQAEGRLQRALARVHSMNQYPEARDQYRRLQACVNSLQESQAMQDRMLADSAGTDGGDFMAELEELCRDDGDAPMSTIS

SEQ ID NO: 8257 - DNA, 1623 bp, Sorghum bicolor
  misc_feature: Ceres ANNOT ID no. 6087241
  misc_feature: Encodes the peptide sequence at SEQ ID NO 8258
atggcgctggccaccaactccgccgccgccgccgcagcagcagcggccgtatccggtggcgcgtcatcccagccgcgccgcgcggccgtgttcctcccgctgaagaggcgcaccatctccgccatccacgccgccgacccgtcaaagaacaacggacccgccgtccccgcggcggccgctgccaagtcttccgcctcggcggtggccacgccggagaagaagccggcggctccggggaagtgggcggtcgacagctggaaatcgaagaaggcgctgcagctccccgaatacccgaaccaggaggagctggacacggtgctcaagaccatcgaaacgttcccgccggtcgtgttcgccggagaggcgcgccacctcgaggagcgcatggcagaggctgccatgggccgcgccttcgtcctccagggcggcgactgcgccgagagcttcaaggagttccacgccaacaatatccgtgacaccttccgtattctgctccagatgggcgccgtgctcatgttcggtggtcaggtgccggtcgtcaaggtggggaggatggctggccagttcgccaagccaaggtccgaaccgttcgaggagagggatggtgttaagctgccgagctacaggggtgacaacgtcaacggcgatgacttcaccgagaagagccgcgtgccagacccgcagaggatgatccgcgcctacgcgcagtcggtggcgacgctcaacctgctccgcgcgttcgccacaggagggtatgctgccatgcagcgtgtcacacaatggaacctcgacttcatggatcacagcgagcaaggtgataggtaccgtgaattggcccatagggtggatgaggctcttgggttcatgactgcagcaggacttaccgttgaccacccgataatgacgactactgacttctggacctcgcacgagtgccttctcttaccctatgagcaggctcttacccgtgaggactccaccagtggccttttctatgattgttcagcccacatgttgtgggttggtgagcgcactcgtcaacttgatggagctcatgttgaattcctccgtggtgtggccaaccctcttggcataaaggtgagtgacaaaatgaatcccagtgacttggtgaagctgattgagattctgaacccttcaaacaaacccggaaggatcaccataattacaaggatgggggcagagaacatgagagtaaagttgcctcatctcatccgtgctgtccgcaatgctggattgattgtcacatggattactgatcctatgcatggaaacaccataaaggccccttgtggcttgaagactcgtcctttcgattccattctggctgaagtgcgcgcattcttcgacgtgcatgaccaagaaggaagtcacccaggaggtatccaccttgaaatgactgggcagaacgtgaccgagtgcattggtggatcacggactgtgacctttgacgacctgagcgaccgctaccacacccactgtgacccaagactgaacgcctcccagtccctggagcttgccttcatcattgcagagaggctcaggaagaggaggatgcggtcagggctcaacaacagcctgccgctgccaccactggctttctga

SEQ ID NO: 8258 - protein, 540 aa, Sorghum bicolor
  misc_feature: Ceres ANNOT ID no. 6087241
  misc_feature (80)..(517): Pfam Id: DAHP_synth_2 Pfam Desc: Class-II DAHP synthetase family
  misc_feature (1)..(540): NCBI GI: 75138360 NCBI Desc: phospho-2-dehydro-3-deoxyheptonate aldolase 2, chloroplast precursor (phospho-2-keto-3-deoxyheptonate aldolase 2) (dahp synthetase 2) (3-deoxy-d-arabino-heptulosonate
  misc_feature (1)..(540): NCBI GI: 75138360 (continued) 7-phosphate synthase 2)
  misc_feature (1)..(540): NCBI GI: 46359608 NCBI Desc: 3-deoxy-d-arabino heptulosonate-7-phosphate synthase [oryza sativa (japonica cultivar-group)]
  misc_feature (1)..(537): NCBI GI: 110832750 NCBI Desc: phospho-2-dehydro-3-deoxyheptonate aldolase 1, chloroplast precursor (phospho-2-keto-3-deoxyheptonate aldolase 1) (dahp synthetase 1) (3-deoxy-d-arabino-heptulosonate
  misc_feature (1)..(537): NCBI GI: 110832750 (continued) 7-phosphate synthase 1)
  misc_feature (1)..(537): NCBI GI: 115453341 NCBI Desc: os03g0389700 [oryza sativa (japonica cultivar-group)]
  misc_feature (11)..(519): NCBI GI: 46093428 NCBI Desc: 3-deoxy-d-arabino heptulosonate-7-phosphate synthase [oryza sativa (japonica cultivar-group)]
  misc_feature (1)..(540): SWISSPROT Homolog: EC 2.5.1.54 Phospho-2-dehydro-3-deoxyheptonate aldolase 2, chloroplast precursor
MALATNSAAAAAAAAAVSGGASSQPRRAAVFLPLKRRTISAIHAADPSKNNGPAVPAAAAAKSSASAVATPEKKPAAPGKWAVDSWKSKKALQLPEYPNQEELDTVLKTIETFPPVVFAGEARHLEERMAEAAMGRAFVLQGGDCAESFKEFHANNIRDTFRILLQMGAVLMFGGQVPVVKVGRMAGQFAKPRSEPFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPPLAF

SEQ ID NO: 8259 - DNA, 1272 bp, Sorghum bicolor
  misc_feature: Ceres ANNOT ID no. 6087251
  misc_feature: Encodes the peptide sequence at SEQ ID NO 8260
atgcagccggacaacgcgggcaagccgatccggtgcaaagcggcggtgagcaaggcggcggggcagccgctggagatggaggaggtggaggtggcgccgccgcgggcgcacgaggtccgcgtcaggatcatctgcacctcgctctgccacacggacatcaccttctggcgcatgaaggattttccggccatgtttccatccatcctgggccatgaagcaatcggtgtggtggagagcgtgggggaccatgtgcacgaagtgggcgtgggcgacgcggtggtgccggtgttcctgccgcagtgcggggagtgcgccgactgcgtctccgcccgcagcaacatctgctccgcgctgccgtaccgccccggcgtcatgccgcgggacggcaccacgcgcttctcgctcgccgccactggcgagcccgtccacagcttcctgtgcgtctccagcttcgccgagtacacggtggtggacgtcgcgcacctcgtcaagctcgacgtcgtcggccccgcccccgcgctgccgccggagaaggcgtgcctgctcagctgcggcgtcaccaccggagttggtgcgacttggaaggttgcggcggtggagcccggctccaccgtagccgtctttggactaggagctgttgggttagcggtagcgcaaggggccaagatgcgaggagctaagaggatcatcggggtagacgtgaatcctgacaagttcgagatcggcaagaagatggggatcaccgacttcgtcaatccaaatgatatcgcggagaagaccgccgtgagcgaggtcatcaaggagatgaccggcggcgaaggcgccgactactgcttcgagtgcatcggttcagtttcagtcatggcggaagcattcaaaagctcacgaacgggctgggggaagacggtcgttctcggcgtcgacggcagcttggcgccgatcagcgtgccgtcgttcgacatcatgcgggggcggtcggtcaccggctcgctcttcggtgggatcaagcccaaggacgacatccccgtgctggcacacaagtacctagacaaggagctggagctggacgacttcatcacgcaccagatgggtttccaggagataaaccgcgcgttcgacctgctcacccaagggaagtgcatccgctgcatcatctggatggacgacgactacggcgccaaggagaacgacggcgccggtgatgacagctcggtgacctatatcgtgggcaggccggtgagggcactacccgcagcccgcagctactgttga

SEQ ID NO: 8260 - protein, 423 aa, Sorghum bicolor
  misc_feature: Ceres ANNOT ID no. 6087251
  misc_feature (201)..(346): Pfam Id: ADH_zinc_N Pfam Desc: Zinc-binding dehydrogenase
  misc_feature (36)..(165): Pfam Id: ADH_N Pfam Desc: Alcohol dehydrogenase GroES-like domain
  misc_feature (6)..(388): NCBI GI: 7705214 NCBI Desc: alcohol dehydrogenase adh [lycopersicon esculentum]
  misc_feature (7)..(388): NCBI GI: 144923670 NCBI Desc: alcohol dehydrogenase superfamily, zinc-containing [medicago truncatula]
  misc_feature (7)..(388): NCBI GI: 21618210 NCBI Desc: alcohol dehydrogenase-like protein [arabidopsis thaliana]
  misc_feature (6)..(388): NCBI GI: 7705215 NCBI Desc: alcohol dehydrogenase adh [lycopersicon esculentum]
  misc_feature (4)..(389): NCBI GI: 92888659 NCBI Desc: alcohol dehydrogenase superfamily, zinc-containing [medicago truncatula]
  misc_feature (7)..(389): SWISSPROT Homolog: EC 1.1.1.1 Alcohol dehydrogenase 1
  misc_feature: The sequence is a functional homolog of SEQ ID NO. 530 in the 11/188,298 US application
MQPDNAGKPIRCKAAVSKAAGQPLEMEEVEVAPPRAHEVRVRIICTSLCHTDITFWRMKDFPAMFPSILGHEAIGVVESVGDHVHEVGVGDAVVPVFLPQCGECADCVSARSNICSALPYRPGVMPRDGTTRFSLAATGEPVHSFLCVSSFAEYTVVDVAHLVKLDVVGPAPALPPEKACLLSCGVTTGVGATWKVAAVEPGSTVAVFGLGAVGLAVAQGAKMRGAKRIIGVDVNPDKFEIGKKMGITDFVNPNDIAEKTAVSEVIKEMTGGEGADYCFECIGSVSVMAEAFKSSRTGWGKTVVLGVDGSLAPISVPSFDIMRGRSVTGSLFGGIKPKDDIPVLAHKYLDKELELDDFITHQMGFQEINRAFDLLTQGKCIRCIIWMDDDYGAKENDGAGDDSSVTYIVGRPVRALPAARSYC

SEQ ID NO: 8261 - DNA, 651 bp, Sorghum bicolor
  misc_feature: Ceres ANNOT ID no. 6087253
  misc_feature: Encodes the peptide sequence at SEQ ID NO 8262
atggctgccgaaggcaatgctccgtcgctcgccgaggtagggaagccgtatcctctccccatcctcgaacctgctctctcgagcattcgcctaaagctgtaccacttgcccatgaaactgaacctcagattgaatttcaagccggagagcattgtgcggtctgagattgtcgaatattcgctgccatcccaagaggtccaagtacataatccatctgaggagaaatctgctgtcaggactacggctgaagtcgtccctgacaaaagtgctgaaactccagcagctgatgagaccactgttgctgtcaaagaaacaagtgaaactccagaggtgaaagaaccctccgagaagccagaagctgaggacagctctgctgctgaagaaagtagtgaggtctctgaggaagcagctgatgagaaaccagaaattaagattgagacagctccagcagattttcgtttcccaacaacaaatcaaacaagacattgcttcacacgctatattgaatatcataggtgcgtagctgcaaaaggggagggtgctcctgagtgtgaaaagtttgctaagtactacagatcactctgcccaagtgaatggattgagcgttggaacgagcaacgtgaaaacggcacgttccctggacccctgtaa

SEQ ID NO: 8262 - protein, 216 aa, Sorghum bicolor
  misc_feature: Ceres ANNOT ID no. 6087253
  misc_feature (143)..(215): Pfam Id: COX6B Pfam Desc: Cytochrome oxidase c subunit VIb
  misc_feature (142)..(216): NCBI GI: 90265127 NCBI Desc: h0711g06.1 [oryza sativa (indica cultivar-group)]
  misc_feature (142)..(216): NCBI GI: 38345393 NCBI Desc: osjnba0067k08.22 [oryza sativa (japonica cultivar-group)]
  misc_feature (142)..(216): NCBI GI: 115459224 NCBI Desc: os04g0498200 [oryza sativa (japonica cultivar-group)]
  misc_feature (142)..(216): NCBI GI: 116310722 NCBI Desc: osigba0092e01.14 [oryza sativa (indica cultivar-group)]
  misc_feature (142)..(216): NCBI GI: 21592329 NCBI Desc: cytochrome c oxidase subunit 6b [arabidopsis thaliana]
  misc_feature (152)..(216): SWISSPROT Homolog: EC 1.9.3.1 Cytochrome c oxidase polypeptide VIb
MAAEGNAPSLAEVGKPYPLPILEPALSSIRLKLYHLPMKLNLRLNFKPESIVRSEIVEYSLPSQEVQVHNPSEEKSAVRTTAEVVPDKSAETPAADETTVAVKETSETPEVKEPSEKPEAEDSSAAEESSEVSEEAADEKPEIKIETAPADFRFPTTNQTRHCFTRYIEYHRCVAAKGEGAPECEKFAKYYRSLCPSEWIERWNEQRENGTFPGPL

SEQ ID NO: 8263 - DNA, 612 bp, Sorghum bicolor
  misc_feature: Ceres ANNOT ID no. 6087261
  misc_feature: Encodes the peptide sequence at SEQ ID NO 8264
atgttctccttgttctatggtctatggaagcatgtcttcagcaagacagagttccatgtgcttatcctcggagttcacaagtctggcaagacgaccttgctagaaaagttgaagtcgatctacttgaagggagaagggcttccgcatgatcgtattgttccaacagttgggcttaatattgggcgtattgaagatgcgaatgtaaagcttgttttctgggatctgggaggccagcctggcctgcgaacaatatgggagaaatattatgaggaggcccatgctgtaatatatgttatcgactctgcttctgcatcttcatttgaggatgctaaatctgctctcgagaaagttctccgccatgaagatctgcatggagcgccaatactcatatttgcaaacaagcaggattcaccagcagctgtcacggaggaagaattggctagacatctgcatcttaaggagttagatgagaggccatgcatgttccaggctggatctgccttcgatgggactgggatcaaacatggtgttgactggttggtggaggaaatggaaaggagtaaacgcactgaggcactaagggcgcgtacagaagcagctgggaagatttaa

SEQ ID NO: 8264 - protein, 203 aa, Sorghum bicolor
  misc_feature: Ceres ANNOT ID no. 6087261
  misc_feature (1)..(184): Pfam Id: Arf Pfam Desc: ADP-ribosylation factor family
  misc_feature (19)..(136): Pfam Id: Miro Pfam Desc: Miro-like protein
  misc_feature (19)..(186): Pfam Id: Ras Pfam Desc: Ras family
  misc_feature (18)..(136): Pfam Id: MMR_HSR1 Pfam Desc: GTPase of unknown function
  misc_feature (1)..(203): NCBI GI: 2961178 NCBI Desc: gtp-binding protein [oryza sativa]
  misc_feature (1)..(196): NCBI GI: 21553780 NCBI Desc: gtp-binding protein-like [arabidopsis thaliana]
  misc_feature (1)..(147): NCBI GI: 60467561 NCBI Desc: adp-ribosylation factor-like [dictyostelium discoideum]
  misc_feature (1)..(187): NCBI GI: 32484235 NCBI Desc: cg7039-prov protein [xenopus laevis]
  misc_feature (1)..(187): NCBI GI: 16758878 NCBI Desc: adp-ribosylation factor related protein 1 [rattus norvegicus]
  misc_feature: The sequence is a functional homolog of SEQ ID NO. 400 in the 11/188,298 US application
MFSLFYGLWKHVFSKTEFHVLILGVHKSGKTTLLEKLKSIYLKGEGLPHDRIVPTVGLNIGRIEDANVKLVFWDLGGQPGLRTIWEKYYEEAHAVIYVIDSASASSFEDAKSALEKVLRHEDLHGAPILIFANKQDSPAAVTEEELARHLHLKELDERPCMFQAGSAFDGTGIKHGVDWLVEEMERSKRTEALRARTEAAGKI

SEQ ID NO: 8265 - DNA, 1353 bp, Sorghum bicolor
  misc_feature: Ceres ANNOT ID no. 6087262
  misc_feature: Encodes the peptide sequence at SEQ ID NO 8266
atgatctcgcagttcttcgtgctgtcgcagcgcggcgaccacatcgtcttccgcgactatcgcggcgaggtgcccaagggcagcgcggagatcttcttccggaaggtgaagttctggaacgacgacgaggcagaggaggcgcccccagtcttcaatgtcgatggggttaactatattcatgtcaaggtcgctggactattttttgtggtaaccacaatggttaatgtttccccatcccttctcttggaacttcttcaaaggattgcacgtgttacaaaggattatctcggcgttcttaatgaagattcactgcggaagaattttattttggtgtatgaattgcttgatgaagtcattgactttggatacccacaaacaacctctactgaggttctgaagtcgtacatattcaatgaaccgattatggttgatgctggaaggctgccaccgcttggtcctgctgctatgttcatgcaaggcacaaagcgtatgcctggtacagctgttaccaaatctgtggttgctactgagccaggggggaagaagagggaggaaatttttgttgatatcattgagaggataagtgtgacattcagctcgagtggctatatacttacatctgagattgacggaacgattcaaatgaaaagttacctcactggtaatccagaaatccgtcttgctctcaatgaggatttgagcattggaagaactggatcttcatatgattacagaagttcttctggaggtggaacagtcattcttgatgattgcaacttccatgagtcagtacatctggatagttttgacattgacagaactttgactctgataccacctgacggagaatttcctgtaatgaactaccggatgacccaagaatttaagccgccgttccgtgtaaccgctctaattgaagaagctggaccatcgagggctgaagttctactgaaaataagagcagacttctccgcaaatgccactgctaacacaatcacagtacaaatgccagtgccatcatacacaatgagagcaagttttgagttggaagctggagcagttggacagacaaccgatttcaaggaaggatccaggagactcgagtggaatctcaagaagattgttggtggttctgagcacacccttcgtgcaaagctgacattttctcaggagtcacatggaaatatcacaaaggaagctggcccagtgaatatgaatttcactataccgatgtacaatgcatcaaagttgcaggtgaggtatcttcagatagcaaagaaatcaaaggcatacaacccttacagatgggtacgatatgtaacacaagctaactcctacgtagctcgtctatga

SEQ ID NO: 8266 - protein, 450 aa, Sorghum bicolor
  misc_feature: Ceres ANNOT ID no. 6087262
  misc_feature (174)..(450): Pfam Id: Adap_comp_sub Pfam Desc: Adaptor complexes medium subunit family
  misc_feature (1)..(373): NCBI GI: 30686572 NCBI Desc: clathrin adaptor complexes medium subunit family protein [arabidopsis thaliana]
  misc_feature (1)..(449): NCBI GI: 89288060 NCBI Desc: adaptor complexes medium subunit family protein [tetrahymena thermophila sb210]
  misc_feature (176)..(450): NCBI GI: 66359650 NCBI Desc: clathrin coat assembly protein ap50 [cryptosporidium parvum]
  misc_feature (176)..(450): NCBI GI: 46228798 NCBI Desc: clathrin coat assembly protein ap50 [cryptosporidium parvum]
  misc_feature (1)..(450): NCBI GI: 50540412 NCBI Desc: zgc:91931 [danio rerio]
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVATEPGGKKREEIFVDIIERISVTFSSSGYILTSEIDGTIQMKSYLTGNPEIRLALNEDLSIGRTGSSYDYRSSSGGGTVILDDCNFHESVHLDSFDIDRTLTLIPPDGEFPVMNYRMTQEFKPPFRVTALIEEAGPSRAEVLLKIRADFSANATANTITVQMPVPSYTMRASFELEAGAVGQTTDFKEGSRRLEWNLKKIVGGSEHTLRAKLTFSQESHGNITKEAGPVNMNFTIPMYNASKLQVRYLQIAKKSKAYNPYRWVRYVTQANSYVARL

SEQ ID NO: 8267 - DNA, 2913 bp, Sorghum bicolor
  misc_feature: Ceres ANNOT ID no. 6087263
  misc_feature: Encodes the peptide sequence at SEQ ID NO 8268
atgtggcgccgcctccccacccgccgcctcgcctccgtcctcctctcctcctcacctctccagcgcgccgccgcaacgcacgctcctcctctcgagcgccatctccctgctacggcctccggtctccttccgccgtcacgcttgccccggtggcagcaggacccgcggtggttcgcctcctcctccgccgcggaggctgtgtcctcggaggatgccgaggagctgcaccacgcgatagaggagatcgtccgggcgcagccgagtcagaatctgcctcgacctcagtcggtggcagaggagcggcaggcacccgggcgggaccaccgtagccggcataggagaagtgggcgcgggcggcatgtggaagtgatggcggcggagcacgggatgacgtaccacaggtacacctcccttcgccggcggcagatccgcgtcgagacggaggcgtgggagcaggccgccaaggagtaccgtgagcttctcgcggacatgtgcgagcagaagctcgcccccaacctaccctacatcaagtcgctctttcttggctggttcgagccgctgcgggaccagatcgtcactgagcaagagcttgtggcagacccggggtcccgggcctcgcacggcccctatttcaacatgctccctgcggacatgatggccgtaatcaccatgcacaagctcatggggttgctcatgacgggtagtggggacggcagtgttcgagtcatccaggccgcctgtcagattggcgaggccattgagcacgaggttcgaataaacagatttctggagaaaacaaggaaaaaaagcaacaaagaaatggaaaaggaagaagaagctgctggtgacacagacattgccaaagaacaacagcgtctaagaaagaaagtcactgacctaatgaaaaagcaaaagttacggcaagtaaggaatatagtgaagaatcaagataattccaggccatggggtcaagatgttcaagcaaaagttggtagtcgtttgattgagctctttatggatacagcacatatacaaccacctgcaagccagtcatcagatggtctgcctgacatccgtcctgctttcagacacgaaatgagaacagtggcgaaagaacaacagaagagtagtcgcagatatggtgtgatcaagtgtgatccactagtccggcaaggcttggatagaacagcaaagcacatggtcattccgtacatgcctatgttgattcctccaatctgttggacaggatatgacaagggagcacacctctttttaccatcatatgtaatgcgcacccatggcgctaggcaacagagggaggctgttaaaagagctccaagggaacaaatgcaatctgtttttgaggccttgaatactcttgggagcacgaagtggagggttaacaaaagagttcttagcattgttgacagaatatggtcaagtggtggccggcttgctgatttggttgatcgcactgatgttcccttaccggagaagcctgacactgaagatgaaaccttgataaagaactggaagtggcacttgaggtcagtcaagaaggagaacagtgaaaggcattctcagagatgtgatgttgaactcaaacttgctgttgctagaaaaatgaaggatgaagagggattttactatccacacaaccttgattttagaggtcgggcttatccaatgcatccttacctgaaccacttgggttcagatctttgtcgagggattctagagtttgctgaaggtcggccacttggcaagtcaggcttgcattggctgaagatacacctagcaaatttgtatgctggtggtgttgataagttgtcatatgatggccgggttgcatttactgagaatcatttggaggaaatatttgattctgctgataggcctttagaaggcaaacgatggtggcttggtgctgaagatccattccagtgcctggcagtatgcatgaatctcactgaagctttaagaagctcatctccagaaacaacgatctcacatattcctgtgcaccaggatggctcttgtaatggcctgcaacactatgcagcacttggaagggataagttgggagccattgctgtcaacttagtcgctggagaaaagcctgcagatgtttacactggaatagctaccagggtgttggaaattatgaggatggatgcacaaaaagacccttctatagatcctgatgtagctcgtgctcgtctgatagttgaccaggtggatagaaaattggtgaagcaaactgtgatgacatctgtatatggtgtcacctatgtcggagcacgtgaccaaataaaaagaagactaaaggagaggggggtcattcctgatgaagcggaactgtttggtgcatcatgctatgctgctaaggttactcttacagcacttggcgagatgttccaagctgcccgtggtatcatgaactggcttggtgactgtgccaaggtaattgcttgtgagaatgaaccagtgagatggacgactcctcttgggctcccagttgtacaaccttatcgcaaacttgggaggcatcttgttttgacccttcagcgggagactgataaggttatggtgaagcggcagaggacagctttccctccaaactttgtgcattctcttgatggctctcatatgatgatgactgctgttgcttgcaaaaggcaaggtctaaattttgcaggagttcatgattcatattggacccatgcctgtgatgttgatacaatgaataaaatacttcgggaaaagtttgtggaactctatgatacacctattttggaaaatttgttggagagtttcgagaaatctttccctaaattaaaattcccgccattgccggagaggggagatttcgatatgaaggaagtccttgagtctccgtattttttcaactag

SEQ ID NO: 8268 - protein, 970 aa, Sorghum bicolor
  misc_feature: Ceres ANNOT ID no. 6087263
  misc_feature (584)..(970): Pfam Id: RNA_pol Pfam Desc: DNA-dependent RNA polymerase
  misc_feature (1)..(970): NCBI GI: 4559304 NCBI Desc: t7-like rna polymerase [zea mays]
  misc_feature (1)..(970): NCBI GI: 115478128 NCBI Desc: os09g0246200 [oryza sativa (japonica cultivar-group)]
  misc_feature (1)..(970): NCBI GI: 6958204 NCBI Desc: single-subunit rna polymerase g [triticum aestivum]
  misc_feature (113)..(970): NCBI GI: 40255318 NCBI Desc: rna polymerase [hordeum vulgare]
  misc_feature (129)..(970): NCBI GI: 88933965 NCBI Desc: dna-directed rna polymerase 1b, mitochondrial precursor (t7 bacteriophage-type single subunit rna polymerase 1b) (nictarpot1-tom)
  misc_feature (129)..(970): SWISSPROT Homolog: EC 2.7.7.6 DNA-directed RNA polymerase 1B, mitochondrial precursor
MWRRLPTRRLASVLLSSSPLQRAAATHAPPLERHLPATASGLLPPSRLPRWQQDPRWFASSSAAEAVSSEDAEELHHAIEEIVRAQPSQNLPRPQSVAEERQAPGRDHRSRHRRSGRGRHVEVMAAEHGMTYHRYTSLRRRQIRVETEAWEQAAKEYRELLADMCEQKLAPNLPYIKSLFLGWFEPLRDQIVTEQELVADPGSRASHGPYFNMLPADMMAVITMHKLMGLLMTGSGDGSVRVIQAACQIGEAIEHEVRINRFLEKTRKKSNKEMEKEEEAAGDTDIAKEQQRLRKKVTDLMKKQKLRQVRNIVKNQDNSRPWGQDVQAKVGSRLIELFMDTAHIQPPASQSSDGLPDIRPAFRHEMRTVAKEQQKSSRRYGVIKCDPLVRQGLDRTAKHMVIPYMPMLIPPICWTGYDKGAHLFLPSYVMRTHGARQQREAVKRAPREQMQSVFEALNTLGSTKWRVNKRVLSIVDRIWSSGGRLADLVDRTDVPLPEKPDTEDETLIKNWKWHLRSVKKENSERHSQRCDVELKLAVARKMKDEEGFYYPHNLDFRGRAYPMHPYLNHLGSDLCRGILEFAEGRPLGKSGLHWLKIHLANLYAGGVDKLSYDGRVAFTENHLEEIFDSADRPLEGKRWWLGAEDPFQCLAVCMNLTEALRSSSPETTISHIPVHQDGSCNGLQHYAALGRDKLGAIAVNLVAGEKPADVYTGIATRVLEIMRMDAQKDPSIDPDVARARLIVDQVDRKLVKQTVMTSVYGVTYVGARDQIKRRLKERGVIPDEAELFGASCYAAKVTLTALGEMFQAARGIMNWLGDCAKVIACENEPVRWTTPLGLPVVQPYRKLGRHLVLTLQRETDKVMVKRQRTAFPPNFVHSLDGSHMMMTAVACKRQGLNFAGVHDSYWTHACDVDTMNKILREKFVELYDTPILENLLESFEKSFPKLKFPPLPERGDFDMKEVLESPYFFN

SEQ ID NO: 8269 - DNA, 1314 bp, Sorghum bicolor
  misc_feature: Ceres ANNOT ID no. 6087264
  misc_feature: Encodes the peptide sequence at SEQ ID NO 8270
atggcgatgggcggcgattacggcgcgttcatggagaaattcgagctgctgcctccgcaatctcagcagcacctcccgcttcacggccttaccttcgctatcaaagacatcttcgacatcagcggccgtgtcactgggtttggcaacccggattgggcgaggacgcatgcccccgccggcgccacctcccccgtcgtactggcgacgctggccgccggcgccatcagcatcggcaagaccgtcatggatgagatggcctacagcataaatggggagaacgcgcactacggcacgccgactaatccgtgcgcccccgatagagttccgggaggatcctccagtggatcagctgttgccgttggcgcaaaactcgtcgacttcgctctgggcactgacactggaggtagtgtgagggtacctgctgcctattgtggcatatttggactcaggccttcccatggattggtttcgacagaaaatgtcatcccaatgtcacagatgtttgacactgtcgggtggtttgctagagatttatctacattatctcgtgtaagcaatgtgttgttgccgctacctgctgacaacactatcaagcgaccaactcattttaagattcctaaagactgttttgaaatcttaggctctttgaatgaccaaacatatcagattctcaatgcatcagtagctaagagatttggtaacgatgcagtagacaataggaaccttggtgagttcgtctccagcaatgttccgactgttgggaaattcattagcgacttctccagaagcgaagcaccatctgtacctgctctatctgttatttcatatgtcatgcgatgcctccaaaggtctgaattcaaagctaaccatgcagagtgggtcaacactgtaaggcctaacctaggccctggcatccgagagcgggtgtatgaagccattgcatcagaagatggacccatggaggattttcatgttctgaagactgaattcaagttggcgctatctgctcttatcaaggatgatgggatccttgtgataccaacagttcctggttctccaccaaagctgcgcatggaggctgttgcattagagaacttccgcgcaagagcattttcattgctgtcgatcgctggactatctgggttttgccagctgagcattccactgggcgtgcgcggtggtgttccggtgtcagtctccctagtggcatgccatggtgcagaccgtttcctcctgagtgtggctcaggagctgtatgagactctcaaagaggagaccaagaaaggctggagctcaccagactcctctctctga

SEQ ID NO: 8270 - protein, 437 aa, Sorghum bicolor
  misc_feature: Ceres ANNOT ID no. 6087264
  misc_feature (9)..(412): Pfam Id: Amidase Pfam Desc: Amidase
  misc_feature (1)..(432): NCBI GI: 116308869 NCBI Desc: h0613h07.3 [oryza sativa (indica cultivar-group)]
  misc_feature (1)..(432): NCBI GI: 32451277 NCBI Desc: osjnba0020p07.1 [oryza sativa (japonica cultivar-group)]
  misc_feature (3)..(339): NCBI GI: 38344119 NCBI Desc: osjnbb0050o03.16 [oryza sativa (japonica cultivar-group)]
  misc_feature (1)..(424): NCBI GI: 92890069 NCBI Desc: amidase [medicago truncatula]
  misc_feature (1)..(418): NCBI GI: 28416539 NCBI Desc: at1g08980/f7g19_15 [arabidopsis thaliana]
MAMGGDYGAFMEKFELLPPQSQQHLPLHGLTFAIKDIFDISGRVTGFGNPDWARTHAPAGATSPVVLATLAAGAISIGKTVMDEMAYSINGENAHYGTPTNPCAPDRVPGGSSSGSAVAVGAKLVDFALGTDTGGSVRVPAAYCGIFGLRPSHGLVSTENVIPMSQMFDTVGWFARDLSTLSRVSNVLLPLPADNTIKRPTHFKIPKDCFEILGSLNDQTYQILNASVAKRFGNDAVDNRNLGEFVSSNVPTVGKFISDFSRSEAPSVPALSVISYVMRCLQRSEFKANHAEWVNTVRPNLGPGIRERVYEAIASEDGPMEDFHVLKTEFKLALSALIKDDGILVIPTVPGSPPKLRMEAVALENFRARAFSLLSIAGLSGFCQLSIPLGVRGGVPVSVSLVACHGADRFLLSVAQELYETLKEETKKGWSSPDSSL

SEQ ID NO: 8271 - DNA, 459 bp, Sorghum bicolor
  misc_feature: Ceres ANNOT ID no. 6087265
  misc_feature: Encodes the peptide sequence at SEQ ID NO 8272
atggggtccgcgttgctggcgacgctgcggctgaagagtgaggtggacaccgccatccgcgacaccctcgacaaggtcctcgtcctccgatttggtcgcgccatcgacgccgcttgcctccacctagatgacatcctggctagatcttcttgggacatatccaagtttgctacggtagcattggttgacatggactctgaggagattcaagtttacattgactactttgacattactttggttccagcaaccattttcttcttcaatgcccatcacatgaagatggattcagggacacctgatcacacaaaatggataggttcttttagcagcaaacaagacttcattgatgtggttgaggcaatatttagaggtgcgatgaaaggcaaattgatagtgtcttgcccccttcctcctgagaggataccaagattccagcttcttttcaaggatgtctga

SEQ ID NO: 8272 - protein, 152 aa, Sorghum bicolor
  misc_feature: Ceres ANNOT ID no. 6087265
  misc_feature (5)..(139): Pfam Id: DIM1 Pfam Desc: Mitosis protein DIM1
  misc_feature (3)..(152): NCBI GI: 79416715 NCBI Desc: catalytic/ electron transporter [arabidopsis thaliana]
  misc_feature (3)..(152): NCBI GI: 62897337 NCBI Desc: thioredoxin-like 4b variant [homo sapiens]
  misc_feature (3)..(152): NCBI GI: 62858633 NCBI Desc: loc549092 [xenopus tropicalis]
  misc_feature (1)..(134): NCBI GI: 115391665 NCBI Desc: mitosis protein dim1 [aspergillus terreus nih2624]
  misc_feature (1)..(134): NCBI GI: 119491357 NCBI Desc: pre-mrna splicing factor dim1 [neosartorya fischeri nrrl 181]
MGSALLATLRLKSEVDTAIRDTLDKVLVLRFGRAIDAACLHLDDILARSSWDISKFATVALVDMDSEEIQVYIDYFDITLVPATIFFFNAHHMKMDSGTPDHTKWIGSFSSKQDFIDVVEAIFRGAMKGKLIVSCPLPPERIPRFQLLFKDV

SEQ ID NO: 8273 - DNA, 327 bp, Sorghum bicolor
  misc_feature: Ceres ANNOT ID no. 6087276
  misc_feature: Encodes the peptide sequence at SEQ ID NO 8274
atggccgcggcagccctgaggcccctgacggctccgaacgcggcgctgccgccgagggggccggggaaggagcaccggacggcgatcacggtgccggagttcaagcgctgggtgaagcagttcgacaccgaccacgacggccgcatcagccggaaggagctccgggaggccatccgccgccggggcgcgtggttctccggcctgcgcgcactgttcgctgtccggcgcgccgacaggaaccgcaacgggttcgtggacgactccgagatcgagggcctcatcgacttcgccgagagggagctgggcttcaggatcacaacggaatga

SEQ ID NO: 8274 - protein, 108 aa, Sorghum bicolor
  misc_feature: Ceres ANNOT ID no. 6087276
  misc_feature (33)..(61): Pfam Id: efhand Pfam Desc: EF hand
  misc_feature (29)..(106): NCBI GI: 115473387 NCBI Desc: os07g0619200 [oryza sativa (japonica cultivar-group)]
  misc_feature (9)..(100): NCBI GI: 92890958 NCBI Desc: calcium-binding ef-hand [medicago truncatula]
  misc_feature (32)..(101): NCBI GI: 116126982 NCBI Desc: ensangp00000021244 [anopheles gambiae str. pest]
  misc_feature (27)..(98): NCBI GI: 123437436 NCBI Desc: ef hand family protein [trichomonas vaginalis g3]
MAAAALRPLTAPNAALPPRGPGKEHRTAITVPEFKRWVKQFDTDHDGRISRKELREAIRRRGAWFSGLRALFAVRRADRNRNGFVDDSEIEGLIDFAERELGFRITTE

SEQ ID NO: 8275 - DNA, 318 bp, Sorghum bicolor
  misc_feature: Ceres ANNOT ID no. 6087277
  misc_feature: Encodes the peptide sequence at SEQ ID NO 8276
atggccacggcagccctgacggctccgaaggcggcgctgccgccgaggggcccggggaaggagcaccggacggcgatcacggtgccggagttcaagcgctgggtgaagcagttcgacaccgaccacgacggccgcatcagccggaaggagctccgggaggccatccgccgccggggcccgtggttcgccggcctgcgcgcactgttcgctgtccggcgcgccgacaggaaccgcaacgggttcgtggacgactccgagatcgagggcctcatcgacttcgccgagagggagctgggcttcaggatcacaacggaatga

SEQ ID NO: 8276 - protein, 105 aa, Sorghum bicolor
  misc_feature: Ceres ANNOT ID no. 6087277
  misc_feature (30)..(58): Pfam Id: efhand Pfam Desc: EF hand
  misc_feature (26)..(103): NCBI GI: 115473387 NCBI Desc: os07g0619200 [oryza sativa (japonica cultivar-group)]
MATAALTAPKAALPPRGPGKEHRTAITVPEFKRWVKQFDTDHDGRISRKELREAIRRRGPWFAGLRALFAVRRADRNRNGFVDDSEIEGLIDFAERELGFRITTE

SEQ ID NO: 8277 - DNA, 279 bp, Sorghum bicolor
  misc_feature: Ceres ANNOT ID no. 6087278
  misc_feature: Encodes the peptide sequence at SEQ ID NO 8278
atggcgatccgaggcgtcgcctccacccgcgaggacatgacggtggaggagttcaaggagtggctcaagcagttcgacgccgacggcgacggcaggatcagccggaacgagctccgggaggcgttgcgccgccgcggcggctggttcaccacctggaagagcagccgtgctcttcgccaggccgacaagaacaacagcggcttcctggacgactccgagatcgagaaccttgtcgctttcgcccagaaggatctcggcatgaagatatccacctggtag

SEQ ID NO: 8278 - protein, 92 aa, Sorghum bicolor
  misc_feature: Ceres ANNOT ID no. 6087278
  misc_feature (17)..(45): Pfam Id: efhand Pfam Desc: EF hand
  misc_feature (1)..(92): NCBI GI: 115473387 NCBI Desc: os07g0619200 [oryza sativa (japonica cultivar-group)]
  misc_feature (11)..(84): NCBI GI: 14589311 NCBI Desc: calcium binding protein [sesbania rostrata]
  misc_feature (6)..(79): NCBI GI: 27807405 NCBI Desc: calcium binding protein 5 [bos taurus]
  misc_feature (6)..(88): NCBI GI: 4959155 NCBI Desc: calmodulin mutant syncam52 [synthetic construct]
  misc_feature (6)..(84): NCBI GI: 4959162 NCBI Desc: calmodulin mutant syncam57a [synthetic construct]
MAIRGVASTREDMTVEEFKEWLKQFDADGDGRISRNELREALRRRGGWFTTWKSSRALRQADKNNSGFLDDSEIENLVAFAQKDLGMKISTW

SEQ ID NO: 8279 - DNA, 1491 bp, Sorghum bicolor
  misc_feature: Ceres ANNOT ID no. 6087290
  misc_feature: Encodes the peptide sequence at SEQ ID NO 8280
  misc_feature: Up-regulated in shoot tissues in response to salicylic acid treatment
atggcggccgccatggcgagggccatgtccacggcggccgtcggcgcgccgccagtgtcactcaacaccatcaaccccaaggtcttgaagtgtgaatatgcagttcggggagagattgttacacatgctcagaacttacaacaagaattgcagaaaaatccagaatcacttcctttcgacgagatactctactgtaatattggaaatccccaatcacttggacaacaaccagttacctatttcagagaagttctctctttatgtgatcatccagctctgctggataaaagcgaaactcatgctttgtacagttcagatgctatagagagagcatggcaaattctagagaagataccaggtagagcgacaggagcatatagccatagtcagggtgtaaaaggtttacgtgatgaaattgctgctggaattgctgcacgtgatgggtttcacgcaagcggagataacatcttcctaacagatggagcaagcccagcagtgcacatgatgatgcagttgctgataagttctgagaaggatggcattctctgccctattccacagtacccactgtactctgcatcgattgctcttcacggtggttcccttgttccttattaccttgatgaagagacagggtggggactcgaggttgatgaactgaagaaacaactggaggaggctcgatctaagggcatcactgtgagggcgcttgttgtcataaatccagggaatccaacaggacaggttcttgctgaggaaaaccaaaagaaaattgtcgaattctgcaagaatgaaggacttgttcttcttgcggatgaggtttaccaagaaaatgtatatgttgaagataagaaattccactcattcaaaaaaattgcacggtcactgggatacactgatgatgatcttcctttggtatcattccagtcggtttctaaaggcttctacggagaatgtggaaaacgaggtggttatatggagataactggattcagtcctgaagtacgggaacaaatttacaaggtggcatcagtaaatctatgctccaatgtttcagggcaaattcttgctagccttgtaatgaacccaccaaaggctggggatgaatcctttgaatccttcatgttagagagggatggtatcctttcatcattggctcggcgtgcaaaggctttggaagaagcattcaatagtttagaaggtattacatgcaataaagccgaaggtgcaatgtatctgttcccacgccttcatttaccccagaaggcaattggagctgcccaagcagctggcactgccccagatgcatactatgctaaacgcctactagaagccactgggattgttgttgtccctggctctggttttggacaggtccctggaacatggcacttcagatgcacgatactgccgcaggaggacaaaataccagcaataatatctaggttcaaggagtttcacgagaagttcatggatgaattccgtgattga

SEQ ID NO: 8280 - protein, 496 aa, Sorghum bicolor
  misc_feature: Ceres ANNOT ID no. 6087290
  misc_feature (89)..(483): Pfam Id: Aminotran_1_2 Pfam Desc: Aminotransferase class I and II
  misc_feature (16)..(496): NCBI GI: 296204 NCBI Desc: alanine aminotransferase [panicum miliaceum]
  misc_feature (7)..(496): NCBI GI: 92884018 NCBI Desc: 1-aminocyclopropane-1-carboxylate synthase [medicago truncatula]
  misc_feature (14)..(496): NCBI GI: 115481822 NCBI Desc: os10g0390500 [oryza sativa (japonica cultivar-group)]
  misc_feature (14)..(496): NCBI GI: 4730886 NCBI Desc: alanine aminotransferase [oryza sativa]
  misc_feature (18)..(496): NCBI GI: 9082270 NCBI Desc: alanine aminotransferase [arabidopsis thaliana]
  misc_feature (16)..(496): SWISSPROT Homolog: EC 2.6.1.2 Alanine aminotransferase 2
  misc_feature: Useful for making plants with modulated nitrogen use efficiency
  misc_feature: GREAT-hit functional homolog of the protein sequence encoded by LOCUS at1g72330
  misc_feature: Useful for making plants with modulated nitrogen use efficiency
  misc_feature: Functional homolog of the protein sequence given in SEQ ID NO 13731
  misc_feature: Up-regulated in shoot tissues in response to salicylic acid treatment
  misc_feature: The sequence is a functional homolog of SEQ ID NO. 526 in the 11/188,298 US application
  misc_feature: The sequence is a functional homolog of SEQ ID NO. 527 in the 11/188,298 US application
  misc_feature: The sequence is a functional homolog of SEQ ID NO. 286 in the 11/188,298 US application
MAAAMARAMSTAAVGAPPVSLNTINPKVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGVKGLRDEIAAGIAARDGFHASGDNIFLTDGASPAVHMMMQLLISSEKDGILCPIPQYPLYSASIALHGGSLVPYYLDEETGWGLEVDELKKQLEEARSKGITVRALVVINPGNPTGQVLAEENQKKIVEFCKNEGLVLLADEVYQENVYVEDKKFHSFKKIARSLGYTDDDLPLVSFQSVSKGFYGECGKRGGYMEITGFSPEVREQIYKVASVNLCSNVSGQILASLVMNPPKAGDESFESFMLERDGILSSLARRAKALEEAFNSLEGITCNKAEGAMYLFPRLHLPQKAIGAAQAAGTAPDAYYAKRLLEATGIVVVPGSGFGQVPGTWHFRCTILPQEDKIPAIISRFKEFHEKFMDEFRD

SEQ ID NO: 8281 - DNA, 963 bp, Sorghum bicolor
  misc_feature: Ceres ANNOT ID no. 6087294
  misc_feature: Encodes the peptide sequence at SEQ ID NO 8282
atgtgcggcggggccattctcagtgatctctactcgccagtaaggcagaaggttactgctaatcacctatggacagagagtggcagcagtaagagtgggaagaactggaaaaggaagagttcttgggagtttggtgaagatgactttgaggctgatttcgagggatttgaggatggtgatagcgaggaagatgtggattttgtacatgagggccaagagttccaaacgaacagttcgaatctcgtggtggggtccaatgttcatactgccaaagtcgccagcaggaagagaaggacacagtatcgtgggatccggcggcgcccttggggcaaatgggcagctgagatcagagacccacgcaagggcgtccgagtctggcttggcacctacagcaccgctgaggaggctgcaagagcctacgacacggcagcctggcgcatacgtggcaagaaagccaaggtgaacttccccagcgccatcacaaatcccgagaaacgccgccgggggcgtgtggctcggccacgaaagaagattgcatcccaggagacgctgaagctcaacgacgcctctgatgatcatgtcatctcagcaggcagcagcactgatgatgccactgccgtcaagcttgagttgccagagtcggcttctccgccacccatgtccagcgcatggcttgatgcgtttgagctgaatcaggtcaatgagttaagctaccttgaagttgaagaaactgttggtgagactagggtgacagatacggtctttggcaatggcgaagtgaggcctgccgatgattttgtgtattatgatcctttcccggacttcgtgcagttaccttacctcgaaggtaactcatatgaaaacatcgacgtgcttttcaacggcgacaccgttcaggagggcgtcaacattggaggtctgtggagtttcgacgacgtgccaatggaccacggtgtttactga

SEQ ID NO: 8282 - protein, 320 aa, Sorghum bicolor
  misc_feature: Ceres ANNOT ID no. 6087294
  misc_feature (99)..(150): Pfam Id: AP2 Pfam Desc: AP2 domain
  misc_feature (1)..(212): NCBI GI: 22074046 NCBI Desc: transcription factor jerf1 [lycopersicon esculentum]
  misc_feature (1)..(181): NCBI GI: 30961941 NCBI Desc: callus-expressing factor [nicotiana tabacum]
  misc_feature (1)..(177): NCBI GI: 18496063 NCBI Desc: ethylene responsive element binding protein [fagus sylvatica]
  misc_feature (1)..(177): NCBI GI: 38343926 NCBI Desc: ethylene transcription factor [fagus sylvatica]
  misc_feature (1)..(223): NCBI GI: 24940524 NCBI Desc: ethylene response element binding protein [triticum aestivum]
  misc_feature: The sequence is a functional homolog of SEQ ID NO 1291 in the 10/374,780US patent application
  misc_feature: The sequence is a functional homolog of SEQ ID NO 44 in the 10/838,616US patent application
  misc_feature: Useful for biocontainment applications
  misc_feature: Useful for making plants with altered sugar content
  misc_feature: Useful for making plants with altered terpenoid content
  misc_feature: Useful for making plants with modulated cold sensitivity
  misc_feature: Useful for making plants with modulated growth and phenotype characteristics
  misc_feature: Useful for making plants with modulated seed size
  misc_feature: Functional homolog of the protein sequence given in SEQ ID NO 13188
  misc_feature: Functional homolog of the protein sequence given in SEQ ID NO 13513
  misc_feature: Functional homolog of the protein sequence given in SEQ ID NO 13515
  misc_feature: The sequence is a functional homolog of SEQ ID NO 44 in the 20060008874 US patent application
  misc_feature: The sequence is a functional homolog of SEQ ID NO 1291 in the 20060162006 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
MCGGAILSDLYSPVRQKVTANHLWTESGSSKSGKNWKRKSSWEFGEDDFEADFEGFEDGDSEEDVDFVHEGQEFQTNSSNLVVGSNVHTAKVASRKRRTQYRGIRRRPWGKWAAEIRDPRKGVRVWLGTYSTAEEAARAYDTAAWRIRGKKAKVNFPSAITNPEKRRRGRVARPRKKIASQETLKLNDASDDHVISAGSSTDDATAVKLELPESASPPPMSSAWLDAFELNQVNELSYLEVEETVGETRVTDTVFGNGEVRPADDFVYYDPFPDFVQLPYLEGNSYENIDVLFNGDTVQEGVNIGGLWSFDDVPMDHGVY

SEQ ID NO: 8283 - DNA, 1386 bp, Sorghum bicolor
  misc_feature: Ceres ANNOT ID no. 6087295
  misc_feature: Encodes the peptide sequence at SEQ ID NO 8284
atgggaactccaaatgaaatgatggcatactcttccctgtccaaaatggacaccggccagaagggagctgctctgtccaatgtagttgctggaaacaactatccggttcaggattatctttatgagccagcatatgaaccagacttcccagagtatgattcaagagatgacccgtttgctccaacacaagctagtccaaaagtcaatctgaagactgttctaggtgggctggtttcgattgtcacgggtgtaaacaagagtgaggatgacgcatcgcagcaggaaggtttcagcacagacatatcattccttggatctgacaagaatggtgatgtcaatgtgcacccttccgtctgtgttccaagtgccccaccactacttgaagcgaatgctttacaatatagtgcatacagggaggtgttgctagcagatccaccagaatggttgccagatagctctgcaaatgcgtgcctgcattgcaacttgcctttcacggctctgactcgtggtaggcaccattgtcggttctgtggaggtatattctgcaaaaactgttcaaaggggagatgtttgatgcccatgaaattcaggattcgtgatcctcagagagtttgtgatgcttgctatgagaggcttgatccacttcagggcttattgatcaactacaatagtaactgcatgcagcaagcaaaacacgatgtcatggactggacaagcactagaagctggttgaacatgcctgtaggtgtatcaatggagtacgagatatacaaggctacaaacacaatgaagaaatattgtcagattgctagattaaaccctgagaagtccataccatcatctattctcaagggagcgaagggacttgcaattctaacagttgccaaggcaggtgcagttcttacatacaaagttggcactggtcttgtggttgctcgcagatcagatggatcatggtctgctccctctgcaattttatctgttggcctgggatggggagtgcagattggaggagagctgacagactttatcattgtgcttcatgaccgtaaagctgtcaaggctttcagcagtcgcattcatctttcacttggggcaggattgagtgctgcagcaggacccattggcagagcctttgaggcagacgttcgggccagtgacaaaggttctgggatatgctacacttacagctgcagcaaaggtgcctttgttggggtttcactggaagggaatgtggtgacaaccagaatggagaccaatctacgcttctacggagatgcatacctgacggcaaccgatatcctgtttgggagggtggagcggccccgagctgcccagcccttgtactcagctctagatgatctgttctccaaaatggttaggtag

SEQ ID NO: 8284 - protein, 461 aa, Sorghum bicolor
  misc_feature: Ceres ANNOT ID no. 6087295
  misc_feature (146)..(214): Pfam Id: FYVE Pfam Desc: FYVE zinc finger
  misc_feature (27)..(459): NCBI GI: 144924363 NCBI Desc: zinc finger, fyve/phd-type [medicago truncatula]
  misc_feature (48)..(461): NCBI GI: 34394538 NCBI Desc: las17 binding protein-like [oryza sativa (japonica cultivar-group)]
  misc_feature (123)..(461): NCBI GI: 79318859 NCBI Desc: zinc ion binding [arabidopsis thaliana]
  misc_feature (123)..(456): NCBI GI: 50251785 NCBI Desc: las17 binding protein; lsb3p-like [oryza sativa (japonica cultivar-group)]
  misc_feature (119)..(459): NCBI GI: 53792650 NCBI Desc: las17 binding protein-like [oryza sativa (japonica cultivar-group)]
MGTPNEMMAYSSLSKMDTGQKGAALSNVVAGNNYPVQDYLYEPAYEPDFPEYDSRDDPFAPTQASPKVNLKTVLGGLVSIVTGVNKSEDDASQQEGFSTDISFLGSDKNGDVNVHPSVCVPSAPPLLEANALQYSAYREVLLADPPEWLPDSSANACLHCNLPFTALTRGRHHCRFCGGIFCKNCSKGRCLMPMKFRIRDPQRVCDACYERLDPLQGLLINYNSNCMQQAKHDVMDWTSTRSWLNMPVGVSMEYEIYKATNTMKKYCQIARLNPEKSIPSSILKGAKGLAILTVAKAGAVLTYKVGTGLVVARRSDGSWSAPSAILSVGLGWGVQIGGELTDFIIVLHDRKAVKAFSSRIHLSLGAGLSAAAGPIGRAFEADVRASDKGSGICYTYSCSKGAFVGVSLEGNVVTTRMETNLRFYGDAYLTATDILFGRVERPRAAQPLYSALDDLFSKMVR

SEQ ID NO: 8285 - DNA, 1107 bp, Sorghum bicolor
  misc_feature: Ceres ANNOT ID no. 6087299
  misc_feature: Encodes the peptide sequence at SEQ ID NO 8286
atggaggacagtctaccagttaatgtccgagaatatcaaaagctcgccaagaaagcactaccaaagatgcactatgattatatcaatgggggagcagacgatgaatatacactgagggagaatattgcagcatatggaagaattctgttacggccacgggtccttatagatgtgagcaagatagacatgtcaacaagcttgttaggatataatatgccatcgccaataattgtcgctcctacaggggcacacaaattagcaaatccagaaggggaggtggccactgcaagagctgccgcagcatgtaacaccataatggtgctttccttctcatcaagctgcagaatcgaggaggttgcctccagctgcgatgccattcgcttttatcagctatatatgtgcaagagaagggatgtttcggcagcattggtacagcgggctgagagtttaggattcaaggcacttgttttgacagttgacaggcctgtgcttggtaggcgtgaagctgatatcagaaacaagatgatttctccacggtttgtaaacctcgaaggtttaatgtcattagacaaggacatagacagtgctgaaggcggctccaagctggaacgattctcacgggagacgctggatccatcgttgtcgtggaaggacgtggagtggctcaagtccatcaccagcctgccgatcctgctcaagggcatcatcaccgccgaagacgcgaggaaggccgtggaggcgggggtgtccggcgtgatcttgtccaaccacggcggcaggcagctggactatgcgccggccaccatctcggcgctcgaagaggtggttaaggcggtggagggatccgtgccggtgctggtggacggcggcatccggcggggcaccgacgtgctgaaggcgctggcgctcggcgccaaggcagtcatggtggggaggccggtgttgtacgggctggcggcgcgcggggaggccggcgcgaggcacgtgatcgagatgctgaacaaagagctggagctggccatggcgctctgcggctgccggagcgtcgcggaggtcaccagggcgcacgtccagactgagggcgacgggatcagggccctgctgtga

SEQ ID NO: 8286 - protein, 368 aa, Sorghum bicolor
  misc_feature: Ceres ANNOT ID no. 6087299
  misc_feature (16)..(359): Pfam Id: FMN_dh Pfam Desc: FMN-dependent dehydrogenase
  misc_feature (7)..(368): NCBI GI: 9294640 NCBI Desc: glycolate oxidase [arabidopsis thaliana]
  misc_feature (8)..(363): NCBI GI: 121530 NCBI Desc: (s)-2-hydroxy-acid oxidase, peroxisomal (glycolate oxidase) (gox) (short chain alpha-hydroxy acid oxidase)
  misc_feature (8)..(367): NCBI GI: 54043095 NCBI Desc: glycolate oxidase [brassica napus]
  misc_feature (8)..(363): NCBI GI: 999543 NCBI Desc: chain b, glycolate oxidase (e.c.1.1.3.15) mutant with tyr 24 replaced by phe (y24f)
  misc_feature (8)..(362): NCBI GI: 2554675 NCBI Desc: three-dimensional structure of glycolate oxidase with bound active-site inhibitors
  misc_feature (8)..(363): SWISSPROT Homolog: EC 1.1.3.15 Peroxisomal (S)-2-hydroxy-acid oxidase
MEDSLPVNVREYQKLAKKALPKMHYDYINGGADDEYTLRENIAAYGRILLRPRVLIDVSKIDMSTSLLGYNMPSPIIVAPTGAHKLANPEGEVATARAAAACNTIMVLSFSSSCRIEEVASSCDAIRFYQLYMCKRRDVSAALVQRAESLGFKALVLTVDRPVLGRREADIRNKMISPRFVNLEGLMSLDKDIDSAEGGSKLERFSRETLDPSLSWKDVEWLKSITSLPILLKGIITAEDARKAVEAGVSGVILSNHGGRQLDYAPATISALEEVVKAVEGSVPVLVDGGIRRGTDVLKALALGAKAVMVGRPVLYGLAARGEAGARHVIEMLNKELELAMALCGCRSVAEVTRAHVQTEGDGIRALL

SEQ ID NO: 8287 - DNA, 1086 bp, Sorghum bicolor
  misc_feature: Ceres ANNOT ID no. 6087300
  misc_feature: Encodes the peptide sequence at SEQ ID NO 8288
atggaggataatctaccagttaatgtccgggaatatcaagaactcgccaagaaagcactaccaaagatgcactatgattatatcaacgggggagcagaggatgagtatacactgagggagaatattgcagcatatggaagaattctgtactatgtgagcaagatagacatgtcaacaagcttattaggatataatatgccatcaccaataattgtcgctcctacagggtcacacaaatttgcgaatccagaaggggaggtggccacagcaagagctgccgcagcatgtaacaccataatggtgctttccttctcgtcaaactgcagaatcgaggaggttgcctccagttgcgatgccattcgcttttatcagctatatgtgtacaagagaagggatgtttcggcaacattggtacggcgggctgagagtttaggattcagggcaattgttttgacagttgacacgcctgtgcttggcaggcgtgaagctgatataagaaataagatgattgctccacagttgtcaaaccttgaaggtttaatgtcattagacgactttgatggtggtgaaggcggctccaagctggaacgattctcacgggagacgctggatccatcattgtcatggaaggacgtggagtggctcaagtccatcaccagcctgccgatcctgctcaagggcatcgtcactgccgaagacgcgaggaaggccgtggaggtgggggtggccggcgtgatcgtgtccaaccatggcgcccggcagctggactatgcgccgcccaccatctcggcgctcgaagaggtggttaaggcggtggcgggggccgtgccggtgctggtggacggcggcgtccggcggggcaccgacgtgctcaaggcgctggcgctgggcgccaaggcagtcatggtggggaggccggtgttctacgggctggcggcgcgcggggaagccggcgcgaggcacgtgatcgagatgctgaacaaagagctggagctggccatggcgctctgcggctgccggagcgttgcggaggtcaccagggcgcacgtccagaccgagggcgacaggatcagggccctgctgtga

SEQ ID NO: 8288 - protein, 361 aa, Sorghum bicolor
  misc_feature: Ceres ANNOT ID no. 6087300
  misc_feature (16)..(352): Pfam Id: FMN_dh Pfam Desc: FMN-dependent dehydrogenase
  misc_feature (7)..(361): NCBI GI: 9294640 NCBI Desc: glycolate oxidase [arabidopsis thaliana]
  misc_feature (8)..(360): NCBI GI: 54043095 NCBI Desc: glycolate oxidase [brassica napus]
  misc_feature (5)..(358): NCBI GI: 38344169 NCBI Desc: osjnba0053k19.8 [oryza sativa (japonica cultivar-group)]
  misc_feature (5)..(358): NCBI GI: 116309753 NCBI Desc: h0215f08.7 [oryza sativa (indica cultivar-group)]
  misc_feature (8)..(355): NCBI GI: 27549566 NCBI Desc: glycolate oxidase [zantedeschia aethiopica]
  misc_feature (8)..(355): SWISSPROT Homolog: EC 1.1.3.15 Peroxisomal (S)-2-hydroxy-acid oxidase
MEDNLPVNVREYQELAKKALPKMHYDYINGGAEDEYTLRENIAAYGRILYYVSKIDMSTSLLGYNMPSPIIVAPTGSHKFANPEGEVATARAAAACNTIMVLSFSSNCRIEEVASSCDAIRFYQLYVYKRRDVSATLVRRAESLGFRAIVLTVDTPVLGRREADIRNKMIAPQLSNLEGLMSLDDFDGGEGGSKLERFSRETLDPSLSWKDVEWLKSITSLPILLKGIVTAEDARKAVEVGVAGVIVSNHGARQLDYAPPTISALEEVVKAVAGAVPVLVDGGVRRGTDVLKALALGAKAVMVGRPVFYGLAARGEAGARHVIEMLNKELELAMALCGCRSVAEVTRAHVQTEGDRIRALL

SEQ ID NO: 8289 - DNA, 1491 bp, Sorghum bicolor
  misc_feature: Ceres ANNOT ID no. 6087301
  misc_feature: Encodes the peptide sequence at SEQ ID NO 8290
atggcggccgtggcaggcccactctgcacgtggctcgtcgccgcgtgcttatctgcggcatgcgacgccgaagagtacaagcagaagcattgctgccccggcggaagcggcgctgggggcggcgtcatgctcggccagcgccgccgcctcggcgcgcggcgccgcggcttggcgcgctctggaatggctatggctgttgccttacaagctgaaagaagtgtcatcgaaaagaagaaacccgatatcaaacaaaggagggtggttgtcactggcatgggtgtagtgacaccattgggccatgatcctgacgtgttttacaacaatcttcttgatggtgttagcggaataagtgagattgagaggtttgactgttccaacttccccacgagaattgcaggagagataaaatcattttcaactgatggttgggttgcacctaaacttgcaaagcggatggacaagtttatgctatatctgataactgctggaaagaaggcattagaaaatggtggactcaccgaggaactgaggaatgagttggacaaaaccaggtgtggggttctcattggttctgcaatgggcggcatgaaggtttttaatgatgcaattgaagcactgagggtctcttacaagaaaatgaacccattttgtgttccttttgcaactacgaatatgggctctgcaatccttgcaatggatctgggatggatgggaccaaactattctatttccacagcttgtgctaccagtaacttctgtattcttaatgcagcaaaccacatcagaagaggtgaagctgacgttatgctctgtggtggttctgatgcacctcttatcccaatcggattgggaggttttgtggcctgcagagcactttcacagaggaacagtgacccaacgaaagcttctcgcccttgggacatgggtcgtgatggttttgttatgggggaaggggctggtgtcctcgtattggaagaacttgagcacgccaaggaaagaggtgcaacaatatatgctgaatttcttggtggaagcttcacatgtgatgcttaccacatgactgagccacatcctgaaggaagagggattactctctgcatcgaaaaggcactagctgatgcaggggtagcaagggaagaaatcaactacgtgaatgcccatgcaacgtctacacaagcaggtgacttgaaggagtacgaggctatcgtgcgctgttttcgccagaaccctcaactgagggtgaactcgaccaaatcaatgaccgggcatcttataggagcagctggtggaatagaagcagttgcttctgtacaagctataagaactggttgggtccatccaaatttgaatttagaaaatccagaggatactgtggatgtgggcgtcttggtaggatcacagaaggagagatgtgaagtgaaggtggcgttatccaactcatttggatttggtgggcacaactcatcaattctatttgccccctttaagtga

SEQ ID NO: 8290 - protein, 496 aa, Sorghum bicolor
  misc_feature: Ceres ANNOT ID no. 6087301
  misc_feature (85)..(330): Pfam Id: ketoacyl-synt Pfam Desc: Beta-ketoacyl synthase, N-terminal domain
  misc_feature (338)..(452): Pfam Id: Ketoacyl-synt_C Pfam Desc: Beta-ketoacyl synthase, C-terminal domain
  misc_feature (1)..(496): NCBI GI: 498740 NCBI Desc: beta-ketoacyl-acp synthase [hordeum vulgare subsp. vulgare]
  misc_feature (1)..(495): NCBI GI: 498742 NCBI Desc: beta-ketoacyl-acp synthase [hordeum vulgare subsp. vulgare]
  misc_feature (12)..(494): NCBI GI: 1698690 NCBI Desc: beta-ketoacyl-acp synthase ii [cuphea wrightii]
  misc_feature (43)..(495): NCBI GI: 3800747 NCBI Desc: 3-ketoacyl-acp synthase [cuphea pulcherrima]
  misc_feature (35)..(494): NCBI GI: 1698688 NCBI Desc: beta-ketoacyl-acp synthase ii [cuphea wrightii]
  misc_feature (46)..(496): SWISSPROT Homolog: EC 2.3.1.41 3-oxoacyl-[acyl-carrier-protein] synthase I, chloroplast precursor
MAAVAGPLCTWLVAACLSAACDAEEYKQKHCCPGGSGAGGGVMLGQRRRLGARRRGLARSGMAMAVALQAERSVIEKKKPDIKQRRVVVTGMGVVTPLGHDPDVFYNNLLDGVSGISEIERFDCSNFPTRIAGEIKSFSTDGWVAPKLAKRMDKFMLYLITAGKKALENGGLTEELRNELDKTRCGVLIGSAMGGMKVFNDAIEALRVSYKKMNPFCVPFATTNMGSAILAMDLGWMGPNYSISTACATSNFCILNAANHIRRGEADVMLCGGSDAPLIPIGLGGFVACRALSQRNSDPTKASRPWDMGRDGFVMGEGAGVLVLEELEHAKERGATIYAEFLGGSFTCDAYHMTEPHPEGRGITLCIEKALADAGVAREEINYVNAHATSTQAGDLKEYEAIVRCFRQNPQLRVNSTKSMTGHLIGAAGGIEAVASVQAIRTGWVHPNLNLENPEDTVDVGVLVGSQKERCEVKVALSNSFGFGGHNSSILFAPFK

SEQ ID NO: 8291 - DNA, 801 bp, Sorghum bicolor
  misc_feature: Ceres ANNOT ID no. 6087309
  misc_feature: Encodes the peptide sequence at SEQ ID NO 8292
atggcgttttctttcgcaaacgtcaactctgaggcagggctgaaaaagcttgatgagtaccttttgactcgcagctacatcactggctaccaagcttccaaggatgatctggctgtctactcttcattttcggctgctccctcatccaagtatatcaacgtagcaaggtggtttactcacattgatgcactcttgaggctgagtggagttactgcagagggcctaggtgtcaaggttgagtcatcagcagttccttcagcctcaactcctgatgttgctgaggccccagcagctgacgatgacgacgacgatgatgttgacctttttggtgaggagactgaagaggagaagaaggctgctgaagagcgtgctgctgctgccaaggcttctggcaagaagaaagaatctgggaagtcttcagttttacttgatgtgaagccatgggacgatgaaactgacatggccaagctcgaggaagctgttaggagtgtccagatggaaggactgctctggggtgcttccaagcttgtcccagttggatatggcatcaagaagctgcaaatcatgatgaccattgtcgatgaccttgtctctgtcgacacactcattgaggaccatctgtgcgcagagccagtgagcgagtacgtccagagctgcgacatcgttgccttcaacaagatctctctagggcaggcattgcagcgacagagctgttcactgacggattgggctttcatgcggcacagtcgtctgtctattggcaaacgctacctaaaagtgtacctgaaatttgaaaaataa

SEQ ID NO: 8292 - protein, 266 aa, Sorghum bicolor
  misc_feature: Ceres ANNOT ID no. 6087309
  misc_feature (138)..(227): Pfam Id: EF1_GNE Pfam Desc: EF-1 guanine nucleotide exchange domain
  misc_feature (1)..(227): NCBI GI: 23237926 NCBI Desc: elongation factor 1 beta [oryza sativa (japonica cultivar-group)]
  misc_feature (1)..(227): NCBI GI: 6166140 NCBI Desc: elongation factor 1-beta (ef-1-beta)
  misc_feature (1)..(227): NCBI GI: 38232568 NCBI Desc: translational elongation factor 1 subunit bbeta [pisum sativum]
  misc_feature (1)..(227): NCBI GI: 90101284 NCBI Desc: elongation factor 1-delta 2 (ef-1-delta 2) (elongation factor 1b-beta 2) (eef-1b beta 2)
  misc_feature (1)..(227): NCBI GI: 1841870 NCBI Desc: elongation factor 1-beta [pimpinella brachycarpa]
  misc_feature: Useful for making plants with modulated heat sensitivity
  misc_feature: Functional homolog of the protein sequence given in SEQ ID NO 13183
MAFSFANVNSEAGLKKLDEYLLTRSYITGYQASKDDLAVYSSFSAAPSSKYINVARWFTHIDALLRLSGVTAEGLGVKVESSAVPSASTPDVAEAPAADDDDDDDVDLFGEETEEEKKAAEERAAAAKASGKKKESGKSSVLLDVKPWDDETDMAKLEEAVRSVQMEGLLWGASKLVPVGYGIKKLQIMMTIVDDLVSVDTLIEDHLCAEPVSEYVQSCDIVAFNKISLGQALQRQSCSLTDWAFMRHSRLSIGKRYLKVYLKFEK

SEQ ID NO: 8293 - DNA, 2256 bp, Sorghum bicolor
  misc_feature: Ceres ANNOT ID no. 6087311
  misc_feature: Encodes the peptide sequence at SEQ ID NO 8294
atggaggacttcgcgcgcgcggtggaggacgggctcaagctctctaagcggctcgtgctcccgggagggctgcccccgccgcgcccgccggcggggatggagcgcaccgtgtcggccgccgcggcgtcgggtcccgacccgcggctgctccccacggcgccgatggcctacgcggtggtcaccgacccggccgccgtcgacacccccgacgtgcccagctaccagccctacgtctacggcaacctcgacccgcccgcgctcatcccgctgcagatgaaggaggtcgacctgaccgtcgactgcgcggtcgacaccgcgcacgtcaccctgcgcgcgcgctggtggttgcactgcatcacgcgaagccgcgagtgcgacgtgcgcctcgtcgtccccttggtcgagcagggttcaattctaggcgctgaggttgctatcggaagaagatcatataatacccaagtaatcgaagtagaagacactttggagagtcatgcaaaaattgagagcggtggccttctgaagccacatctgtttttcttgacaatacctcaggtcgagggaggagcagatatttatgctacatttcgatggtctcagaagttgctctatgacagtgggcatttctctgttgaaatacctttccgttttccatactttgtcaacccattaccaaaagttttcatgaagagggaaaaaattcagttgactgtgaacagtggtttcagtaaagaggttttgctgcaaggaacaagccatccgttgaaggaaaagagtaggcaaggagataaattgtttttccatcatgaagccattgttgagaattggtcgagcaaagatttcaacttttcatacagtgtttactcaggcgatttgtctggtggtgtgcttgtgcaacctgcaacattacgtgactatgatgaaagagatatgttctgcatttttcttctacctggaagtggcaacagaaaggtattcagaaaagcagttgtgtttattgttgacgcaagtggaagcatgcaaggaaggcctcttgagaatgtcaagcgtgcagtttctaccgctctttcagagcttgtggaaggggattacttcaacattataacatttaatgatgagcttcactcattcacttcctgtttagagcaagtaaatgacaaagcaatagcaagtgcaactgattggatgaatgcaaactttgttgctgagggtggcacagatattatgcatcctttgagtgaggcaatggcattactatcaagtgttcatgacacacttccacaaatttatcttattactgatggttctgttgatgatgagcataacatctgccaaactacaaaaactgagctcaccaacagagggtctaaatctccccgaatttctactttcggactaggatcgtattgcaaccactatttcctgcgcatgttagcttcaattggcaagggacattacgatgctgcacttgagacagcatcaatcgaaaatcggatacttaagtggttcaggagagcatcaagtacaattgtggcaaatatctccattgatgctatgacacatctcgatgaatttgaagtggattctgagtacattccagacctttcagcaaattctcctttgtgtgtatctggaaaataccaagggaaattcccagacacagttaaagctaaaggttacttagctgacatgaaggaaatctcaattgaactgaaggttcaacaactaaaggaaatacctcttgacaaagtattggtgacaaaacagattgatcttatgacagcaaaggcatggctttctgcagacaaacaactggagagaaaggtgattaaattaagcatacaaaatggtgttccatcagagtacacagaaatgaccttacttcaaacaaatctggataaagtagacggaacacaaaaggtcaagcaaaaactaaaaggacagaaaggcagagatgagcaacggatcctgatgcacggcctgaaactgggattcggtaacaaagacgctacaagggaaaatctcatcacaggatttggggacaggaatccggcagaaaaacttgtgatgctccataagggaaagggttgttgcagcagcgtcgctgactgcctctgctgcatgtgctgcatcaaggcatgcaacaggatgaatgaccagtgcgccattctgatggcacagatctgtgccgcactagcgtgccttggctgctatgagtgctgttcagaggtgtgctgtggagggtcagagtcgtag

SEQ ID NO: 8294 - protein, 751 aa, Sorghum bicolor
  misc_feature: Ceres ANNOT ID no. 6087311
  misc_feature (329)..(499): Pfam Id: VWA Pfam Desc: von Willebrand factor type A domain
  misc_feature (2)..(608): NCBI GI: 53370749 NCBI Desc: von willebrand factor type a domain containing protein [oryza sativa (japonica cultivar-group)]
  misc_feature (32)..(750): NCBI GI: 8778285 NCBI Desc: f14d16.26 [arabidopsis thaliana]
  misc_feature (2)..(466): NCBI GI: 92868122 NCBI Desc: imp dehydrogenase/gmp reductase [medicago truncatula]
  misc_feature (409)..(750): NCBI GI: 115453469 NCBI Desc: os03g0407000 [oryza sativa (japonica cultivar-group)]
  misc_feature (310)..(629): NCBI GI: 90019771 NCBI Desc: inter-alpha-trypsin inhibitor domain protein [saccharophagus degradans 2-40]
MEDFARAVEDGLKLSKRLVLPGGLPPPRPPAGMERTVSAAAASGPDPRLLPTAPMAYAVVTDPAAVDTPDVPSYQPYVYGNLDPPALIPLQMKEVDLTVDCAVDTAHVTLRARWWLHCITRSRECDVRLVVPLVEQGSILGAEVAIGRRSYNTQVIEVEDTLESHAKIESGGLLKPHLFFLTIPQVEGGADIYATFRWSQKLLYDSGHFSVEIPFRFPYFVNPLPKVFMKREKIQLTVNSGFSKEVLLQGTSHPLKEKSRQGDKLFFHHEAIVENWSSKDFNFSYSVYSGDLSGGVLVQPATLRDYDERDMFCIFLLPGSGNRKVFRKAVVFIVDASGSMQGRPLENVKRAVSTALSELVEGDYFNIITFNDELHSFTSCLEQVNDKAIASATDWMNANFVAEGGTDIMHPLSEAMALLSSVHDTLPQIYLITDGSVDDEHNICQTTKTELTNRGSKSPRISTFGLGSYCNHYFLRMLASIGKGHYDAALETASIENRILKWFRRASSTIVANISIDAMTHLDEFEVDSEYIPDLSANSPLCVSGKYQGKFPDTVKAKGYLADMKEISIELKVQQLKEIPLDKVLVTKQIDLMTAKAWLSADKQLERKVIKLSIQNGVPSEYTEMTLLQTNLDKVDGTQKVKQKLKGQKGRDEQRILMHGLKLGFGNKDATRENLITGFGDRNPAEKLVMLHKGKGCCSSVADCLCCMCCIKACNRMNDQCAILMAQICAALACLGCYECCSEVCCGGSES

SEQ ID NO: 8295 - DNA, 1170 bp, Sorghum bicolor
  misc_feature: Ceres ANNOT ID no. 6087312
  misc_feature: Encodes the peptide sequence at SEQ ID NO 8296
atggcggcggcgacaacaacggcaatggcggcgcaagataaacgagactggtcgtccctcccgagggatctgctgagccttgtcctgaagcggctgccatggtcgacccacccgagcttcggcgccgcatgcaggaattggcgctccgtggtggcgcccttctatccggcctgggtgaccccggttcttctcagcgccgcagacgtcggctccaccaacctacgcttctacagcccttattaccacaagaacttcgaggtctcctgcaccctagaagcaccaggcgccaagttctgctgcgccgccgggcgccacctgacgctgtgccagctgtccaaggtactggaagccgacctcgtcaccggcgatgtccacgagctgccgccgtccatatacggatggttccacttcgtcgtctacgacggcggcgtagagcccgagaggatgttcggcgtccacacgattggtcatccccggaccgccctcaccgtcaaggacgacgacggcgagtgggacggctggcacttggcgctcgtgcctgactccgggttcatggaagcgtcgcccaataccaacccggtcctccatggtggctcgctctacgtgttgtttgatgacgggaagctggcagtgtacgacgagtccctgcactgcgacgacgacggcttcttcaagattcttgacaagccgtccagcttcgggatccacaagtgtgacgaggagccggaggacaagtatttgttcgagtccgacgacggcgagctcatggccgtcctcatcggccgccgtgggacgccggtccgcatcgtcaagctcgacgagcaagagatggagtggcacgaggtggacagcctcggcgggcgcgcgctcttcaccggcacgctggacacgttgatgagcaagactaaagtcaagtggatgcagaacaaggtcttcttccctagactctaccagtggccggacactgtccatgttgatattgttgatcgccacggcgagctagctttcgtaccgacctctactggagccggaagggacacaaagcccgcgaaagatggcgccaacatctggtctcatcaactagggtcagaaaattcgacacagttctgggacacagaaaagttggattatagtatttgggttgattttaatatacataataagaagtag

SEQ ID NO: 8296 - protein, 389 aa, Sorghum bicolor
  misc_feature: Ceres ANNOT ID no. 6087312
  misc_feature (15)..(62): Pfam Id: F-box Pfam Desc: F-box domain
MAAATTTAMAAQDKRDWSSLPRDLLSLVLKRLPWSTHPSFGAACRNWRSVVAPFYPAWVTPVLLSAADVGSTNLRFYSPYYHKNFEVSCTLEAPGAKFCCAAGRHLTLCQLSKVLEADLVTGDVHELPPSIYGWFHFVVYDGGVEPERMFGVHTIGHPRTALTVKDDDGEWDGWHLALVPDSGFMEASPNTNPVLHGGSLYVLFDDGKLAVYDESLHCDDDGFFKILDKPSSFGIHKCDEEPEDKYLFESDDGELMAVLIGRRGTPVRIVKLDEQEMEWHEVDSLGGRALFTGTLDTLMSKTKVKWMQNKVFFPRLYQWPDTVHVDIVDRHGELAFVPTSTGAGRDTKPAKDGANIWSHQLGSENSTQFWDTEKLDYSIWVDFNIHNKK

SEQ ID NO: 8297 - DNA, 1107 bp, Sorghum bicolor
  misc_feature: Ceres ANNOT ID no. 6087315
  misc_feature: Encodes the peptide sequence at SEQ ID NO 8298
atggcgcctggcctcttggccgccgccggcgtggtagccgcggtggcgtcgctcgcggcccacgtcgcgctcaactgccccgtgcagccggtgccgtcgactccgcggccgcccactccgccccccaacaacctcctccagaggcttgagaagctgggggaaggggcgctggacgcgccggaggacgtgtactttgacgcggcggcgggcggggtgctgtacacggccaccagggacggctggctgcagcggatgcacccgaacaacggctcctgggagcggtggcgcttcgtcggcggcacggggctgctcggggtcgcgccgtccgccgacggcaccatgctcgtctgcgatgccgacaagggacttttgagagtcggggaggaaggagtgacccttcttgcgtcggaggtcgagggcaccacgatcaggttcgcggacgcggcgatcgaggcctccgacggcacggtgtacttcagcgacgccagcaccaggttcggcttcgacaggtggttctacgacttcttggagtcccgcgtcaccggccgactcctccggtacgacccgcgcaacggcgagacgtccgttgtgctcgaccgcctcagttgcgccaacggcgtcgccctgtcgagggacgagacatttgtggtcgtctgcgagacgtggaggttcaggtgcctgaaagtgtggctgaaaggggagaaagccggcaaggcagagacgttcgtcgacctcccgggagctccagataacattcgtctcgggtcagacggtcatttctggattgccctccacctgatcagttcgccatggctggatttcatcacgcgctggaccttcacgaagagagtggtggcctcgttccccgtgctcctcaagtggagcaaggcaacgatcaagggtgccatggtggctcaggtgtcggaggatggcaacatcctccgcgtgcttgacgactccgaagggaaggtgatcaactccgtcacatcggttacggagttcaacggggacatcttcctcggaagcctcgcgaccaacttcgtcgggaaattgtctctggtgcaggtgacacatgagcagggagcagtatcttctttagacgtttga

SEQ ID NO: 8298 - protein, 368 aa, Sorghum bicolor
  misc_feature: Ceres ANNOT ID no. 6087315
  misc_feature (146)..(234): Pfam Id: Str_synth Pfam Desc: Strictosidine synthase
  misc_feature (52)..(332): Pfam Id: SGL Pfam Desc: SMP-30/Gluconolaconase/LRE-like region
  misc_feature (10)..(365): NCBI GI: 23237921 NCBI Desc: abc transporter permease protein-like protein [oryza sativa (japonica cultivar-group)]
  misc_feature (6)..(353): NCBI GI: 92868105 NCBI Desc: soluble quinoprotein glucose dehydrogenase [medicago truncatula]
  misc_feature (6)..(353): NCBI GI: 92868104 NCBI Desc: quinoprotein amine dehydrogenase, beta chain-like [medicago truncatula]
  misc_feature (30)..(353): NCBI GI: 120553445 NCBI Desc: strictosidine synthase [marinobacter aquaeolei vt8]
  misc_feature (1)..(353): NCBI GI: 146306803 NCBI Desc: strictosidine synthase [pseudomonas mendocina ymp]
MAPGLLAAAGVVAAVASLAAHVALNCPVQPVPSTPRPPTPPPNNLLQRLEKLGEGALDAPEDVYFDAAAGGVLYTATRDGWLQRMHPNNGSWERWRFVGGTGLLGVAPSADGTMLVCDADKGLLRVGEEGVTLLASEVEGTTIRFADAAIEASDGTVYFSDASTRFGFDRWFYDFLESRVTGRLLRYDPRNGETSVVLDRLSCANGVALSRDETFVVVCETWRFRCLKVWLKGEKAGKAETFVDLPGAPDNIRLGSDGHFWIALHLISSPWLDFITRWTFTKRVVASFPVLLKWSKATIKGAMVAQVSEDGNILRVLDDSEGKVINSVTSVTEFNGDIFLGSLATNFVGKLSLVQVTHEQGAVSSLDV

SEQ ID NO: 8299 - DNA, 2937 bp, Sorghum bicolor
  misc_feature: Ceres ANNOT ID no. 6087323
  misc_feature: Encodes the peptide sequence at SEQ ID NO 8300
atggacgacctcgagcaggccatcctgctggcctccgactcgcccgctgccgccgcggcgggtccgtccgtccgcgcggaggctctcgccttctgcgcccgcgcccgcgacgagtccccgccgtcgtcgctcctccgcctgtgtctcgccggcatcgcctcctccccgcacgcgcaggtccacttctggtgcctccagtccctccacgacgcgctcctccgccgccgcatagtgcttcccgacgacctcgcgctgctccgctcctctctcctctcgctggcggtttcatctcacgcggcctcgccgccgttcctccgcaacaagctcgcgcagcttgttgcgctcctcatccgcctcgactacccccatgtctacccttcctacttcctggacctcctcccgcccgcgccgccgcagcccggccccacggacatgttcgcgcgggttctaatctccctcgacgacgacctgctctcccaggagtacccccgcacttctgacgaggccgccgatgctatgcgggtgaaggattccatgcgcgcacagtgcgtgtcccagatcgctagccactggcacaccgccgccgtaaccctccgtacagccgaccctgcggctgcggcggtggcccttgatgcggcgcgcaggtgcatctcgtggatcgatgtcggactggtcgccaatgatgtgttcgttcctctactctttgacattgcgatgtccccgggaagcgcgcctccacttgctgctgcagcggtggcgtgcctttctgctgtggcgttgaagaggatggactcaagggcgaaggtgggattgttgaggtcactcctggctgcacagcaggggcttggtagcccagacagtgggttgaagatggcacccttggtgacagcatatgctgccgaggctctcgaatgtcatcgcaggcttggtcctagtgatgctgatggagctgcagcattggagatgctggaagaggtgctaccagctgtatttgcagctgcagagagcggtaacgatgaagatgtggactctggttccgtgcttgagttcttgtctggctatgtgagcataatgaaggcaccgactgagaagcagttggggcacttgggacggatcttggaggtggtgcgggtgcagatgtcatttgatccagtatatagggggcatcttgacgtgtttgacaagatagggaaggaggaggaggacctcatggcggagcatcggaaagatttgattgtattgttccgtagcatttgtcgtgttgcaccagctgccgctcagctgttcataagagggttgattgtgacagctctctcatccgcagaagctagtgtggaggatgttgaggttgctcttaccctgttcttccggcttggagaagccgtgggtgaggaggagattcggactggggcagggctgctaggggagcttgtgcccatgctcctttctgcgaggttctcgtgtcacacacaccgcttagttgcattggtgtatctggagacagttacccgctacatgaagttcatgcaggagcatgtgcagtatgtaccacacctgcttggcgtgttcttggataaccgtggaatacaccatcagaatgcccatgtgagccgtcgtgcaggatacttattcatgagggcagtcaagtcattgaaggcaaagctagtgccttatctggataccatattgcagagcctgcaagatgtactaagtcaattcacttctatggattgggcaaataaagatactaagtttcccagctcagaggatggcagccaaatttttgaggctgttggattattgattggcattgaagaggtatcaccagagaagcaggctcagtgcttgactgcttttctaaatcctctctgtcatcagattgagtcacttgttttggatgccaaagcacgagggcttgaggaatcatcaccaagagctattagtcttcaacaaattattgttgcattgaatatggtcagcaagggctttaatgagcgccttgtgatggtaaataggccagctattggggtcatgttcaagaaaacccttgatgtagttttgcaagtccttgtttcatttcctagcgtgagacctctgcgatctaaggttatatcgtttctgcatcgtatgatcgagatattaggtatctcagtgcttccatgtattccaattgcactgagacaattgcttcttgataacgaggctaaggatatggtggaatttctcgtattggtaaaccaaataatctgcaaatttaaatcatcagctagtgccatattggaggaagtctttcctactattgcaagtcatttgtctgtgatattatcacaagatgcattttcagccggtcctgcaagcaatactgaggaaatgcgagaactgcaagagctgcagaggacgttatacacattcttgcatgctatggcaacgcatgatctttctacagttctccttactcctagctctaggcagtatctggagaccataatgcagttgcttttatttacctcatgcaaacataaagatatactactacgcaaggcatgtgtacagatttttgtgaatcttgttaaagactggtgctctaactctgaagataagcttcctggcttccgagtatttatgattgagaagtttgctactaattgctgtttatacagtgtccttgataaatcatttgatttacgcgatgcaaactcgcttgtcctttttggtgaaattgtgctagcccagaagattatgtatgaaagatttggggaggatttcattgtgaactttgtagcaaaaggtcttcctgaagttcactgcccaccggacctagctgaacagtactaccagaagttaaagggaaatgatatcaaggcattcagatcattttatcaatcgcttgttgagaagataagaccacaagggaatgggagtcttgttttcagatag

SEQ ID NO: 8300 - protein, 978 aa, Sorghum bicolor
  misc_feature: Ceres ANNOT ID no. 6087323
  misc_feature (102)..(255): Pfam Id: Xpo1 Pfam Desc: Exportin 1-like protein
  misc_feature (1)..(978): NCBI GI: 30909319 NCBI Desc: paused [arabidopsis thaliana]
  misc_feature (20)..(969): NCBI GI: 18088259 NCBI Desc: trna exportin [homo sapiens]
  misc_feature (20)..(969): NCBI GI: 8051636 NCBI Desc: trna exportin [homo sapiens]
  misc_feature (20)..(969): NCBI GI: 2873377 NCBI Desc: exportin t [homo sapiens]
  misc_feature (20)..(969): NCBI GI: 122066762 NCBI Desc: exportin-t (trna exportin) (exportin(trna))
MDDLEQAILLASDSPAAAAAGPSVRAEALAFCARARDESPPSSLLRLCLAGIASSPHAQVHFWCLQSLHDALLRRRIVLPDDLALLRSSLLSLAVSSHAASPPFLRNKLAQLVALLIRLDYPHVYPSYFLDLLPPAPPQPGPTDMFARVLISLDDDLLSQEYPRTSDEAADAMRVKDSMRAQCVSQIASHWHTAAVTLRTADPAAAAVALDAARRCISWIDVGLVANDVFVPLLFDIAMSPGSAPPLAAAAVACLSAVALKRMDSRAKVGLLRSLLAAQQGLGSPDSGLKMAPLVTAYAAEALECHRRLGPSDADGAAALEMLEEVLPAVFAAAESGNDEDVDSGSVLEFLSGYVSIMKAPTEKQLGHLGRILEVVRVQMSFDPVYRGHLDVFDKIGKEEEDLMAEHRKDLIVLFRSICRVAPAAAQLFIRGLIVTALSSAEASVEDVEVALTLFFRLGEAVGEEEIRTGAGLLGELVPMLLSARFSCHTHRLVALVYLETVTRYMKFMQEHVQYVPHLLGVFLDNRGIHHQNAHVSRRAGYLFMRAVKSLKAKLVPYLDTILQSLQDVLSQFTSMDWANKDTKFPSSEDGSQIFEAVGLLIGIEEVSPEKQAQCLTAFLNPLCHQIESLVLDAKARGLEESSPRAISLQQIIVALNMVSKGFNERLVMVNRPAIGVMFKKTLDVVLQVLVSFPSVRPLRSKVISFLHRMIEILGISVLPCIPIALRQLLLDNEAKDMVEFLVLVNQIICKFKSSASAILEEVFPTIASHLSVILSQDAFSAGPASNTEEMRELQELQRTLYTFLHAMATHDLSTVLLTPSSRQYLETIMQLLLFTSCKHKDILLRKACVQIFVNLVKDWCSNSEDKLPGFRVFMIEKFATNCCLYSVLDKSFDLRDANSLVLFGEIVLAQKIMYERFGEDFIVNFVAKGLPEVHCPPDLAEQYYQKLKGNDIKAFRSFYQSLVEKIRPQGNGSLVFR

SEQ ID NO: 8301 - DNA, 501 bp, Sorghum bicolor
  misc_feature: Ceres ANNOT ID no. 6087334
  misc_feature: Encodes the peptide sequence at SEQ ID NO 8302
atggcagctgatagcgccgctatcaagagcaccttcttccatccacagcacttgctaacgaggtaccactacaccgacgcatccacgcattcgtgcgccgcgtgcgagctcacagtcacgggcgccggctacagctgcgacgagtgcgggttcaacatccacgaggcttgcctgagcctcccgctgctggtggacttcgacgggcaccccggccaccatctcactctcacccgtctgggagccagccgctggtgcgacgcctgcagggagacctccggcgcagggcgctacatgtacctctgcgcggcgtgcaactacgacgtgcacccgaggtgcacctcccttgttgctgctcagcagggtgagagacgacgacggagaaggggcaaaaccagaactgtcatcaaggtcggcgtcattggcttcagggtcgtcgatttactgaccggtggtttcatgtcgccagtactcgacatcatagacgcagcggttggtaactaa

SEQ ID NO: 8302 - protein, 166 aa, Sorghum bicolor
  misc_feature: Ceres ANNOT ID no. 6087334
  misc_feature (30)..(58): Pfam Id: C1_3 Pfam Desc: C1-like domain
  misc_feature (83)..(113): Pfam Id: C1_3 Pfam Desc: C1-like domain
  misc_feature (31)..(58): Pfam Id: C1_2 Pfam Desc: C1 domain
  misc_feature (84)..(113): Pfam Id: C1_2 Pfam Desc: C1 domain
  misc_feature (17)..(67): Pfam Id: C1_1 Pfam Desc: Phorbol esters/diacylglycerol binding domain (C1 domain)
  misc_feature (72)..(123): Pfam Id: C1_1 Pfam Desc: Phorbol esters/diacylglycerol binding domain (C1 domain)
  misc_feature (10)..(156): NCBI GI: 115473299 NCBI Desc: os07g0609700 [oryza sativa (japonica cultivar-group)]
  misc_feature (14)..(117): NCBI GI: 34394191 NCBI Desc: chp-rich zinc finger protein-like [oryza sativa (japonica cultivar-group)]
  misc_feature (9)..(115): NCBI GI: 34394201 NCBI Desc: chp-rich zinc finger protein-like [oryza sativa (japonica cultivar-group)]
  misc_feature (12)..(115): NCBI GI: 15218093 NCBI Desc: dc1 domain-containing protein [arabidopsis thaliana]
  misc_feature (14)..(114): NCBI GI: 15240138 NCBI Desc: dc1 domain-containing protein [arabidopsis thaliana]
  misc_feature: The sequence is a functional homolog of SEQ ID NO. 295 in the 11/188,298 US application
MAADSAAIKSTFFHPQHLLTRYHYTDASTHSCAACELTVTGAGYSCDECGFNIHEACLSLPLLVDFDGHPGHHLTLTRLGASRWCDACRETSGAGRYMYLCAACNYDVHPRCTSLVAAQQGERRRRRRGKTRTVIKVGVIGFRVVDLLTGGFMSPVLDIIDAAVGN

SEQ ID NO: 8303 - DNA, 780 bp, Sorghum bicolor
  misc_feature: Ceres ANNOT ID no. 6087338
  misc_feature: Encodes the peptide sequence at SEQ ID NO 8304
atgatctgcctcaaagccttctcatcccctctccacctcccgaccctccgccgtctcacccccacttcctccctccgcgtcgccgccgccaccatgtcgtcctcctccgcagtcgccaccccgatcgagcacttcgtgctcttcaaggcccgcccggaggcggtgacctcgggcgccacggcggcgatggtctcctcgctgcaggcgctcgccacggtcgtcccgggcctggcctacatccacgcggggccggtgctccgcctccggtccccggccgcggaggcgctgggccccacgcacctcctccactcccgctacgccaccaaggaggacctggcgtcctacgcgacgcacccggcgcacgtggccgccgtgcagagccacgtcctccccaacgcgctcgacatcaccgccgtcgactgggtcaacgccgcgccgctcccgtcccccgcgggccccggcagcgccgtgcgcctcacgctggccaaggtgaaggaaggcgtggaggtcgcgcagctcgtggagaaagtggccgccgtgaccaaggccgccggggacgccaagggcgccaaggtgagcttcggggagaacttctcccccgcgcgggccaagggttaccagttcgggatggtggcggtgttcgacagcgtggaggagctggacgccgtggagggggacggcaaggtcgaggaggccaaggccgcggtcaggccgctgctggacgaggtgatggtgctggacttcgtcgttggagatgcttcaacgcctgcgagcctctga

SEQ ID NO: 8304 - protein, 259 aa, Sorghum bicolor
  misc_feature: Ceres ANNOT ID no. 6087338
  misc_feature (42)..(143): Pfam Id: Dabb Pfam Desc: Stress responsive A/B Barrel Domain
  misc_feature (156)..(250): Pfam Id: Dabb Pfam Desc: Stress responsive A/B Barrel Domain
  misc_feature (41)..(136): NCBI GI: 119495441 NCBI Desc: stress responsive a/b barrel domain protein [neosartorya fischeri nrrl 181]
  misc_feature (42)..(141): NCBI GI: 116670835 NCBI Desc: stress responsive alpha-beta barrel domain protein [arthrobacter sp. fb24]
  misc_feature (42)..(141): NCBI GI: 118468411 NCBI Desc: stress responsive a/b barrel domain superfamily protein [mycobacterium smegmatis str. mc2 155]
MICLKAFSSPLHLPTLRRLTPTSSLRVAAATMSSSSAVATPIEHFVLFKARPEAVTSGATAAMVSSLQALATVVPGLAYIHAGPVLRLRSPAAEALGPTHLLHSRYATKEDLASYATHPAHVAAVQSHVLPNALDITAVDWVNAAPLPSPAGPGSAVRLTLAKVKEGVEVAQLVEKVAAVTKAAGDAKGAKVSFGENFSPARAKGYQFGMVAVFDSVEELDAVEGDGKVEEAKAAVRPLLDEVMVLDFVVGDASTPASL

SEQ ID NO: 8305 - DNA, 1140 bp, Sorghum bicolor
  misc_feature: Ceres ANNOT ID no. 6087339
  misc_feature: Encodes the peptide sequence at SEQ ID NO 8306
atgcgagcaggcgcccccgccggcgatgcgggccccagctccggggccggcgccgggagcagtacgcccgctcggccacggaggttccccggggcggcgcagccggagatcatgcgggcggcggagaaggacgacagctacgcagcccacgtcacagaggcatgccgcgacgcgtttcggcacctcttcggtaccagggttgctgttgcttaccagaacgagataaaattgcttggtcagtccctttactacttgctaacaactggttcaggccagcaaacacttggcgaggaatattgtgatataactcaggttgctaccttgcatggacttccacctactcctgcaaggcggatcctattcattttgtaccaaactactgtgccctatcttgctgaacggatcagctccagaattgttgcccgtagtattgcactcaatgaatctcagtttgatgatcatcctgaaagtgataattctagtagtgacattgcacaatccgtcacaaataatggcattccttcaacaagcttaagtgtttctgctctgtcaaggttaagaggccgagttcatgctttgtggcaatgggttcttcagaaatggccttcattggctattcggacaaatctaatgttcttctattttgaaggattgtattatcatttgccaaagcgagcagctggtattcgctatgtattcattggcaagccaatgaatcaaaggcctaggtaccagatcttgggtatttttctgttgattcagttgtgtattctcggagctgaaagactccgaagaagtaatatatcgtcaatagctagttccattaatcaaatatcatctggaagctatccatcgtctacaggtcggggcatccctgttctaaatgaagatggaaatatcatcagcgacatccgcagtggtaaagctgcagatatagcttctcattcagaggcttccagtggcaagagcaaatgcaccctctgtctcagcacccggcaaaatcctactgccacaacctgtggacatgttttctgctggaattgcataatggagtggtgcaatgagaagcctgagtgccccctatgcagaactccaattacccattcgagtttgatttgtatatatcattcagatttctag

SEQ ID NO: 8306 - protein, 379 aa, Sorghum bicolor
  misc_feature: Ceres ANNOT ID no. 6087339
  misc_feature (44)..(267): Pfam Id: Pex2_Pex12 Pfam Desc: Pex2 / Pex12 amino terminal region
  misc_feature (325)..(362): Pfam Id: zf-C3HC4 Pfam Desc: Zinc finger, C3HC4 type (RING finger)
  misc_feature (8)..(379): NCBI GI: 7576235 NCBI Desc: pex10p [arabidopsis thaliana]
  misc_feature (12)..(372): NCBI GI: 111609725 NCBI Desc: peroxin 10 [penicillium chrysogenum]
  misc_feature (18)..(162): NCBI GI: 110617774 NCBI Desc: ring-1 [gibberella zeae]
  misc_feature (30)..(263): NCBI GI: 23574769 NCBI Desc: peroxisome assembly protein 10 [macaca fascicularis]
  misc_feature (30)..(257): NCBI GI: 60822939 NCBI Desc: peroxisomal biogenesis factor 10 [synthetic construct]
  misc_feature: The sequence is a functional homolog of SEQ ID NO 1781 in the 11/479,226US patent application
  misc_feature: The sequence is a functional homolog of SEQ ID NO 1844 in the 11/479,226US patent application
  misc_feature: The sequence is a functional homolog of SEQ ID NO 270 in the 10/374,780US patent application
  misc_feature: The sequence is a functional homolog of SEQ ID NO 298 in the 10/374,780US patent application
  misc_feature: The sequence is a functional homolog of SEQ ID NO 4 in the 10/225,066US patent application
  misc_feature: The sequence is a functional homolog of SEQ ID NO 46 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 46 in the 20050160493 US patent application
  misc_feature: The sequence is a functional homolog of SEQ ID NO 1844 in the 11/479,226 US patent application
  misc_feature: The sequence is a functional homolog of SEQ ID NO 298 in the 10/374,780 US patent application
  misc_feature: The sequence is a functional homolog of SEQ ID NO 46 in the 10/225,066 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MRAGAPAGDAGPSSGAGAGSSTPARPRRFPGAAQPEIMRAAEKDDSYAAHVTEACRDAFRHLFGTRVAVAYQNEIKLLGQSLYYLLTTGSGQQTLGEEYCDITQVATLHGLPPTPARRILFILYQTTVPYLAERISSRIVARSIALNESQFDDHPESDNSSSDIAQSVTNNGIPSTSLSVSALSRLRGRVHALWQWVLQKWPSLAIRTNLMFFYFEGLYYHLPKRAAGIRYVFIGKPMNQRPRYQILGIFLLIQLCILGAERLRRSNISSIASSINQISSGSYPSSTGRGIPVLNEDGNIISDIRSGKAADIASHSEASSGKSKCTLCLSTRQNPTATTCGHVFCWNCIMEWCNEKPECPLCRTPITHSSLICIYHSDF

SEQ ID NO: 8307 - DNA, 699 bp, Sorghum bicolor
  misc_feature: Ceres ANNOT ID no. 6087341
  misc_feature: Encodes the peptide sequence at SEQ ID NO 8308
  misc_feature: Down-regulated in shoot tissues in response to salicylic acid treatment
atggcgtcgactcatgcaatcagcaagaagcggaagttcgtggcggatggcgtgttcttcgcggagctgaatgagatgctcacccgcgagctcgcggaggatggctactccggcgtcgaggtccgcgtcacccccatgcgcaccgagatcatcatccgtgccactcgcacccagaacgtcctcggcgagaagggccggagaatcagggagctgacttctgtggttcagaagcgctttaacttcccggagggtggcgttgaactctacgcagagaaggtgaacaaccgtgggctctgcgccatcgcccaggccgagtcgcttcgctacaagcttctgggtggactagccgtgagaagggcatgttatggtgttctcaggtttgtcatggagagtggcgctaagggctgtgaggttattgtaagtggcaagctcagagcccagcgtgctaagtctatgaagttcaaggatgggtacatgatttcttctggtcatcctgtgaacctatatattgattcagctgtgagacatgttctcttgagacagggtgtgcttggtatcaaggttaagattatgcttgactgggatccaaagggcaagcaagggccaaccatgcctttacctgatctggttacaatccacgagcctaaggaagaggatgagtttttgaggcctcttgcagccgaaatcccagttgcctga

SEQ ID NO: 8308 - protein, 232 aa, Sorghum bicolor
  misc_feature: Ceres ANNOT ID no. 6087341
  misc_feature (106)..(190): Pfam Id: Ribosomal_S3_C Pfam Desc: Ribosomal protein S3, C-terminal domain
  misc_feature (47)..(104): Pfam Id: KH_2 Pfam Desc: KH domain
  misc_feature (7)..(231): NCBI GI: 92885944 NCBI Desc: ribosomal protein s3 [medicago truncatula]
  misc_feature (7)..(224): NCBI GI: 20466075 NCBI Desc: at5g35530/mok9_14 [arabidopsis thaliana]
  misc_feature (3)..(224): NCBI GI: 83283961 NCBI Desc: 40s ribosomal protein-like protein [solanum tuberosum]
  misc_feature (7)..(221): NCBI GI: 74272607 NCBI Desc: 40s ribosomal protein s3 [chlamydomonas incerta]
  misc_feature (7)..(218): NCBI GI: 41056077 NCBI Desc: ribosomal protein s3 [danio rerio]
  misc_feature: There is no branching.
  misc_feature: Useful for making plants with modulated biomass
  misc_feature: GREAT-hit functional homolog of the protein sequence given in SEQ ID NO 13020
  misc_feature: Useful for making plants with modulated biomass
  misc_feature: Functional homolog of the protein sequence given in SEQ ID NO 13020
  misc_feature: Useful for making plants with modulated water use efficiency
  misc_feature: Functional homolog of the protein sequence given in SEQ ID NO 14019
  misc_feature: Down-regulated in shoot tissues in response to salicylic acid treatment
MASTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHEPKEEDEFLRPLAAEIPVA

SEQ ID NO: 8309 - DNA, 810 bp, Sorghum bicolor
  misc_feature: Ceres ANNOT ID no. 6087342
  misc_feature: Encodes the peptide sequence at SEQ ID NO 8310
atggactcagggtacaacccccggacggtggaggaggtgttccgggacttcaagggccgccgcgccgggataatccgcgcgctcaccactgatgcggaggatttcttcaagcaatgcgacccggaaaaagaaaatttgtgcctgtatgggtttcctaatgagagctgggaagtgaatttgcctgctgaagaggttccacctgagctcccagaaccagcattaggcataaactttgcaagagatggaatgcaggaaaaagagtggttgtccatggttgctgcacacagtgatgcatggttactttctgttgcattttactttggcgctcgatttggtttcaatagaaatgacaggaagcgcctctatagtttgattgatgatcttcccatggcttttgaaattgttagtgggaagagtgaaaccaaggcaccagcaccagcgccaccaacaccaaacagtagtaaccatagcaatatcaaatcgaagtctaacaacaaaaagaaaccatcggagcctaaggtgaagcagacaaagccgcgtgcccctgcagaggaaggcccgggcggtgaggaggaagatggcagtgcaagcgagggcgagcacggggagacgctgtgcggcgcgtgcaaggaaagctacggccccgatgagttttggatctgctgcgacctctgcgagaagtggttccacggcaagtgcgtcaagatcacggcggccaaggccgagcacatcaagcagtacaagtgcccgtcctgcaccggcggcggtggtgtcggcaacagcggcaccaagcgagcccgcccatcttaa

SEQ ID NO: 8310 - protein, 269 aa, Sorghum bicolor
  misc_feature: Ceres ANNOT ID no. 6087342
  misc_feature (205)..(255): Pfam Id: PHD Pfam Desc: PHD-finger
  misc_feature (5)..(268): NCBI GI: 116563475 NCBI Desc: phd1 [medicago truncatula]
  misc_feature (1)..(268): NCBI GI: 115394660 NCBI Desc: phd1 [glycine max]
  misc_feature (1)..(268): NCBI GI: 115394654 NCBI Desc: phd4 [glycine max]
  misc_feature (5)..(268): NCBI GI: 54261727 NCBI Desc: at5g20510 [arabidopsis thaliana]
  misc_feature (1)..(253): NCBI GI: 115394650 NCBI Desc: phd2 [glycine max]
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO. 482 in the 11/188,298 US application
MDSGYNPRTVEEVFRDFKGRRAGIIRALTTDAEDFFKQCDPEKENLCLYGFPNESWEVNLPAEEVPPELPEPALGINFARDGMQEKEWLSMVAAHSDAWLLSVAFYFGARFGFNRNDRKRLYSLIDDLPMAFEIVSGKSETKAPAPAPPTPNSSNHSNIKSKSNNKKKPSEPKVKQTKPRAPAEEGPGGEEEDGSASEGEHGETLCGACKESYGPDEFWICCDLCEKWFHGKCVKITAAKAEHIKQYKCPSCTGGGGVGNSGTKRARPS

SEQ ID NO: 8311 - DNA, 963 bp, Sorghum bicolor
  misc_feature: Ceres ANNOT ID no. 6087343
  misc_feature: Encodes the peptide sequence at SEQ ID NO 8312
atggcggggtggcttaaggcgctagcgtacagcgccggtggtgtggcggtggccggcctagcggcgctggttgcgctgcaggagcgcctcgtctacgtgcccgtgctcccgggcctgccgcgcgcgtaccccatcacccccgcccgcctcggcctcatctacgaggatatctggctccgcaccgtggacggcgtgcgcctccactcctggttcatccgccactcccccacctgccgaggtccaacctttctgttcttccaagaaaatgctggcaacatcgctcaccgtttggaatttgttcgactaatgatgcagcgactacagtgcaatgtttttatgctttcttatagagggtatggtgagagtgatggttatccttctcagaaagggatcacgtatgatgcacaggctgcacttgatcatctagctcagaggaaggacattgacacaaccaggatagttatctttggaagatctttaggaggtgctgttggagcagttcttgccaaaaacaatcctgacaaggtggccgctctaatactggaaaatacatttacatccatactggacatggctggtattatgcttccattcttaagatggttcataggtgggagctcttctaaaggtccaaaacttctgaactgtgttgttcgctctccatggaatacacttgatattgttggacaggtcaaacaacccattctcttcctttctggattgcaagatgaactagtcccccctccacacatgaagatgctatatgacaaagcctctgatcataacagaaattgcagatttgttgattttcctagtggtatgcatatggatacctggatgtctggaggggaccgctactggaggacaatccaattgttcttggatcaatacgctcctggagtacagaatcgtgatgtcagctttaaaagtgaaattactgaggatggtaatttagtaccttaa

SEQ ID NO: 8312 - protein, 320 aa, Sorghum bicolor
  misc_feature: Ceres ANNOT ID no. 6087343
  misc_feature (95)..(301): Pfam Id: Peptidase_S9 Pfam Desc: Prolyl oligopeptidase family
  misc_feature (5)..(294): NCBI GI: 987287 NCBI Desc: temperature sensitive supressor of saccharomyces cerevisiae bem1/bud5
  misc_feature (5)..(294): NCBI GI: 2257503 NCBI Desc: bem46 protein [schizosaccharomyces pombe]
  misc_feature (5)..(294): NCBI GI: 13872521 NCBI Desc: bem46 [schizosaccharomyces pombe]
  misc_feature (5)..(294): NCBI GI: 19112401 NCBI Desc: supressor of bem1/bud5 [schizosaccharomyces pombe]
  misc_feature (15)..(296): NCBI GI: 47682292 NCBI Desc: mgc83139 protein [xenopus laevis]
MAGWLKALAYSAGGVAVAGLAALVALQERLVYVPVLPGLPRAYPITPARLGLIYEDIWLRTVDGVRLHSWFIRHSPTCRGPTFLFFQENAGNIAHRLEFVRLMMQRLQCNVFMLSYRGYGESDGYPSQKGITYDAQAALDHLAQRKDIDTTRIVIFGRSLGGAVGAVLAKNNPDKVAALILENTFTSILDMAGIMLPFLRWFIGGSSSKGPKLLNCVVRSPWNTLDIVGQVKQPILFLSGLQDELVPPPHMKMLYDKASDHNRNCRFVDFPSGMHMDTWMSGGDRYWRTIQLFLDQYAPGVQNRDVSFKSEITEDGNLVP

SEQ ID NO: 8313 - DNA, 906 bp, Sorghum bicolor
  misc_feature: Ceres ANNOT ID no. 6087344
  misc_feature: Encodes the peptide sequence at SEQ ID NO 8314
atgcctgtgcttctacgggaaatggaggatcattctgtccatcccatgtctaagtctaaccatggctccttgtcaggaaatggttatgagatgaaacattcaggcaaaaaagtttgcgataaggattcatcatcagaatctgatcagtctcaccaagaagcatcggcagtgagtgagagcagtccagctgaacacacatcaactcaatcagacaatgatgaagatcatgggaaggataatcagaacacaatgaaaccagtattgtccttggggaaggaagggtctgcctttttggccccaaaattagattacagcccatcttttgcttatattccttatactgctgatgcttgttatggtggggttggggtcttgacaggatatgctccacatgccattgtccatccccagcaaaacgatacaacaaactctccaggtatcttgcctgtggaacccacagaagaagagccaatatatgttaatgcaaaacaataccatgcaatccttaggaggaggcagacacgtgctaaattggaggcccagaataagatggtgaaaggtcggaagccatatcttcatgagtctcgccatcgtcatgccatgaagcgggctcgtggatcaggagggcggttcctcaacacaaagcagctccaggagcagaaccagcagtaccaggcactgagtagttcaatgtgctcaaagatcattggcaacagcttaatctcccaaagtggccccacctgcacgccctcttctgacactgcaggtgcttcaacagccagccaggaccgcagctgcttgccctcggttggctttcgccccatgacaaacttcagtgagcaaggtggaggaggctcgaagctgattgtgaacagcatgcagcagcgtgtttccaccataaggtga

SEQ ID NO: 8314 - protein, 301 aa, Sorghum bicolor
  misc_feature: Ceres ANNOT ID no. 6087344
  misc_feature (155)..(211): Pfam Id: CBFB_NFYA Pfam Desc: CCAAT-binding transcription factor (CBF-B/NF-YA) subunitB
  misc_feature (1)..(301): NCBI GI: 115473283 NCBI Desc: os07g0608200 [oryza sativa (japonica cultivar-group)]
  misc_feature (24)..(219): NCBI GI: 2826786 NCBI Desc: rapb protein [oryza sativa (indica cultivar-group)]
  misc_feature (27)..(219): NCBI GI: 45861211 NCBI Desc: ccaat-box transcription factor complex whap8 [triticum aestivum]
  misc_feature (27)..(219): NCBI GI: 45861203 NCBI Desc: ccaat-box transcription factor complex whap4 [triticum aestivum]
  misc_feature (27)..(219): NCBI GI: 45861207 NCBI Desc: ccaat-box transcription factor complex whap6 [triticum aestivum]
MPVLLREMEDHSVHPMSKSNHGSLSGNGYEMKHSGKKVCDKDSSSESDQSHQEASAVSESSPAEHTSTQSDNDEDHGKDNQNTMKPVLSLGKEGSAFLAPKLDYSPSFAYIPYTADACYGGVGVLTGYAPHAIVHPQQNDTTNSPGILPVEPTEEEPIYVNAKQYHAILRRRQTRAKLEAQNKMVKGRKPYLHESRHRHAMKRARGSGGRFLNTKQLQEQNQQYQALSSSMCSKIIGNSLISQSGPTCTPSSDTAGASTASQDRSCLPSVGFRPMTNFSEQGGGGSKLIVNSMQQRVSTIR

SEQ ID NO: 8315 - DNA, 762 bp, Sorghum bicolor
  misc_feature: Ceres ANNOT ID no. 6087370
  misc_feature: Encodes the peptide sequence at SEQ ID NO 8316
atggggcgcggaccggtgcagctgcgccggatcgagaacaagatcaaccgccaggtgaccttctccaagcgccggaacgggctgctgaagaaggcccacgagatctccgttctctgcgatgcggaggtcgcgctcatcgtcttctccactaaggggaagctctacgagtactctagccattccagcatggaaggcattcttgagcgttaccagcgttactcatttgaagaaagagcagtacttgacccaactattgaagaccaggcaaattggggagatgaatatgtccggttaaaatccaaacttgatgcacttcagaagagtcaaaggcaactgttaggagaacaattggattcactaaccataaaagaactccagcaactggagcaacaattggacagttctttgaagcatattaggtcaagaaagaatcagctcatgttcgattcaatttccgagcttcagaaaaaggagaaagcacttacagaccaaaatggtgtcctgcaaaagctcatggaggcagagaaggagaaaaacaatgctttaatgaacgcacacctccgggagcagccaaatggagcatcaacaagctccccatcactgtcaccaccagtagttccagattccatgccaactctaaatattgggccatgtcaacctagaggagcaggaaaatctgagcctggtccgtctcctgctcctgcacaagcaaacagcggcaacctgccaccatggatgctccgcactgtcagtaacaggtga

SEQ ID NO: 8316 - protein, 253 aa, Sorghum bicolor
  misc_feature: Ceres ANNOT ID no. 6087370
  misc_feature (75)..(174): Pfam Id: K-box Pfam Desc: K-box region
  misc_feature (9)..(59): Pfam Id: SRF-TF Pfam Desc: SRF-type transcription factor (DNA-binding and dimerisationdomain)
  misc_feature (1)..(253): NCBI GI: 9367307 NCBI Desc: mads-box protein 3 [hordeum vulgare subsp. vulgare]
  misc_feature (1)..(249): NCBI GI: 62510920 NCBI Desc: mads box transcription factor 18 (osmads18) (mads box protein 2) (mads box protein 28) (fdrmads7)
  misc_feature (1)..(249): NCBI GI: 6006607 NCBI Desc: mads box protein, mads28 [oryza sativa (japonica cultivar-group)]
  misc_feature (1)..(249): NCBI GI: 6175371 NCBI Desc: mads box transcription factor mads18 [oryza sativa]
  misc_feature (1)..(253): NCBI GI: 95981859 NCBI Desc: mads-box transcription factor taagl10 [triticum aestivum]
  misc_feature: Abnormal phyllotaxy, leaf number higher than wild-type
  misc_feature: The plant flowers significantly earllier than wild-type.
  misc_feature: The plant is abnormally small.
  misc_feature: The sequence is a functional homolog of SEQ ID NO 1732 in the 10/412,699US patent application
  misc_feature: The sequence is a functional homolog of SEQ ID NO 1969 in the 10/412,699US patent application
  misc_feature: The sequence is a functional homolog of SEQ ID NO 428 in the 10/666,642US patent application
  misc_feature: The sequence is a functional homolog of SEQ ID NO 44 in the 10/666,642US patent application
  misc_feature: The sequence is a functional homolog of SEQ ID NO 66 in the 10/412,699US patent application
  misc_feature: The sequence is a functional homolog of SEQ ID NO 730 in the 10/666,642US patent application
  misc_feature: The sequence is a functional homolog of SEQ ID NO 892 in the 11/435,388US patent application
  misc_feature: Useful for making plants with altered alkaloid content
  misc_feature: Useful for making plants with modulated biomass
  misc_feature: Useful for making plants with modulated endosperm cell number
  misc_feature: Useful for making plants with modulated endosperm cell size
  misc_feature: Useful for making plants with modulated flowering time
  misc_feature: Useful for making plants with modulated growth and phenotype characteristics
  misc_feature: Useful for making plants with modulated phosphate use efficiency
  misc_feature: Functional homolog of the protein sequence given in SEQ ID NO 12958
  misc_feature: Functional homolog of the protein sequence given in SEQ ID NO 13166
  misc_feature: Functional homolog of the protein sequence given in SEQ ID NO 13282
  misc_feature: GREAT-hit functional homolog of the protein sequence given in SEQ ID NO 13523
  misc_feature: GREAT-hit functional homolog of the protein sequence given in SEQ ID NO 13525
  misc_feature: The sequence is a functional homolog of SEQ ID NO 1732 in the 20040045049 US patent application
  misc_feature: The sequence is a functional homolog of SEQ ID NO 1969 in the 20040045049 US patent application
  misc_feature: The sequence is a functional homolog of SEQ ID NO 892 in the 20060272060 US patent application
  misc_feature: The sequence is a functional homolog of SEQ ID NO 730 in the 20070033671 US patent application
  misc_feature: Useful for making plants with altered alkaloid content
  misc_feature: Useful for making plants with modulated flowering time
  misc_feature: Functional homolog of the protein sequence given in SEQ ID NO 13525
  misc_feature: The sequence is a functional homolog of SEQ ID NO 730 in the 10/666,642 US patent application
  misc_feature: The sequence is a functional homolog of SEQ ID NO 6 in US patent 7279615
  misc_feature: The sequence is a functional homolog of SEQ ID NO 46 in the 10/666,642 US patent application
  misc_feature: Useful for making plants with modulated biomass
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 30 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 4 in US patent 7057087
  misc_feature: Useful for making plants with altered terpenoid content
  misc_feature: Functional homolog of the protein sequence given in SEQ ID NO 13021
  misc_feature: The sequence is a functional homolog of SEQ ID NO 1701 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 518 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGPVQLRRIENKINRQVTFSKRRNGLLKKAHEISVLCDAEVALIVFSTKGKLYEYSSHSSMEGILERYQRYSFEERAVLDPTIEDQANWGDEYVRLKSKLDALQKSQRQLLGEQLDSLTIKELQQLEQQLDSSLKHIRSRKNQLMFDSISELQKKEKALTDQNGVLQKLMEAEKEKNNALMNAHLREQPNGASTSSPSLSPPVVPDSMPTLNIGPCQPRGAGKSEPGPSPAPAQANSGNLPPWMLRTVSNR

SEQ ID NO: 8317 - DNA, 669 bp, Sorghum bicolor
  misc_feature: Ceres ANNOT ID no. 6087374
  misc_feature: Encodes the peptide sequence at SEQ ID NO 8318
atgggcacgccggagacgtcgcgcgagccgtgcccggaccggatcctggacgacgtcggcggcgcgttcgggatgggcgccgttggcggctccgccttccacttcatcaagggcatttacaactcccccaacgggatgcgcctgtccggtggcgcacaggccgtgcggatgaacgcgccgcgcgtggggggcagcttcgccgtctggggcggcctcttctccaccttcgactgcgccatggtgtacgctcgccagaaggaggacccctggaactccatcgttgcgggcgccgccacgggcgggttcctctccatgcgccagggcatgggggccgcgggccggtcggcgctcatgggcgggatcctcctggccctcatcgagggcgctggcctcatgctcaatcgcgtcctcgccaacccgcccctgcccgccgacgatcccaaccttacggcggccatgggcggcaaccctttcccgggtctgccgcaggcgccgccggtcgtggcacctccggaagcggcgagctccagcggcgcgggtgggtggttcgggggactgtttggcaagaaggaggaggagaagaaacccagcgcgggcggtggcaagtcggagatcttggagagcttcgacacgcccagcagtccgataccatcgttcgagtacaagtga

SEQ ID NO: 8318 - protein, 222 aa, Sorghum bicolor
  misc_feature: Ceres ANNOT ID no. 6087374
  misc_feature (4)..(133): Pfam Id: Tim17 Pfam Desc: Tim17/Tim22/Tim23 family
  misc_feature (1)..(222): NCBI GI: 34394571 NCBI Desc: translocase inner membrane-like protein [oryza sativa (japonica cultivar-group)]
  misc_feature (1)..(171): NCBI GI: 38678772 NCBI Desc: mitochondrial inner membrane translocase tm17-2 [arabidopsis thaliana]
  misc_feature (1)..(171): NCBI GI: 6103722 NCBI Desc: tim17 [arabidopsis thaliana]
  misc_feature (1)..(222): NCBI GI: 119720834 NCBI Desc: protein translocase [brassica rapa]
  misc_feature (1)..(136): NCBI GI: 145341376 NCBI Desc: mpt family transporter: inner membrane translocase (import) tim17 [ostreococcus lucimarinus cce9901]
MGTPETSREPCPDRILDDVGGAFGMGAVGGSAFHFIKGIYNSPNGMRLSGGAQAVRMNAPRVGGSFAVWGGLFSTFDCAMVYARQKEDPWNSIVAGAATGGFLSMRQGMGAAGRSALMGGILLALIEGAGLMLNRVLANPPLPADDPNLTAAMGGNPFPGLPQAPPVVAPPEAASSSGAGGWFGGLFGKKEEEKKPSAGGGKSEILESFDTPSSPIPSFEYK

SEQ ID NO: 8319 - DNA, 1341 bp, Sorghum bicolor
  misc_feature: Ceres ANNOT ID no. 6087376
  misc_feature: Encodes the peptide sequence at SEQ ID NO 8320
  misc_feature: Up-regulated in root tissues in response to methyl jasmonate treatment
  misc_feature: Up-regulated in shoot tissues in response to methyl jasmonate treatment
atggagccccgatgcttcgtgctggtcctggccctcgccgccgcgctctccgtcgcagtggcttacgacccgttggacccgaacgggaacattaccatcaaatgggacatcatgtcgtggacgcctgacggctatgtcgcggtggtgaccatcaacaacttccagatgtaccggcagatcatggcgccggggtggacggtggggtggacgtgggcgaagcgtgaggtgatctggtccatggtgggcgcgcaggcgacggagcagggcgactgctcccgcttcaaggccaacatcccgcactgctgcaagcgcacgcccaccgtcgtcgacctgctccccggcgtgccctacaaccagcagatcgccaactgctgccgcggcggcgtcatcagcgcctacggccaggacccggcctccgccgtcgccgcgttccaggtcagcgtcggccaggccggcaccaccaaccgcaccgtcaaggttcccaagaacttcacgctgcttgggccagggccagggtacacctgcggccccggcaagattgttccctccaccgtcttcctcacgcccgaccgccggcgcaagacacaagccctcatgacgtggaacgtgacgtgcacctactcgcagcacctggcgtccaagtacccgtcctgctgcgtctccttctcctccttctacaacgacaccatcgtgccctgcgccaagtgcgcctgcggctgcgagcacaagacctgcgtccagggcgactcgaagcggctggcggtgacggggaagcacgagcacgcgcacgcggcggcggcgcgcgggcacagggacaaggaggcgccgctgctgcagtgcacgacgcacatgtgccccgtgcgcgtgcactggcacgtcaagctcaactacaaggagtactggcgggccaagatcgccatcaccaacttcaactaccacatgaactacacgcagtggacgctcgtcgcgcagcaccccaacctcgacaacatcaccgaggtcttcagcttcgactacaagcctgtcgtcgcctacggatccatcaatgacacggcgatgttctacgggctcaagtacttcaacgaccacctgatgcaggcggggccgtacgggaacgtgcagtcggaggtgctgatgcgcaaggacgccagcaccttcaccttcaggcagggctgggcgttcccgcgcaaggtctacttcaacggcgacgagtgccagatgccgccgccggacgagtatccctacttgcccaactcagccctgccggcagccgcggcgtcgtcgtcgctgggcgctgcggtagcggccgtcgtggtgctcttggtgatgatcgtggcatga

SEQ ID NO: 8320 - protein, 446 aa, Sorghum bicolor
  misc_feature: Ceres ANNOT ID no. 6087376
  misc_feature (45)..(209): Pfam Id: Phytochel_synth Pfam Desc: Phytochelatin synthetase-like conserved region
  misc_feature (1)..(446): NCBI GI: 119034672 NCBI Desc: brittle stalk-2-like protein 7 [zea mays]
  misc_feature (7)..(442): NCBI GI: 75133694 NCBI Desc: cobra-like 6 protein precursor (brittle culm1-like 7 protein)
  misc_feature (4)..(242): NCBI GI: 34014148 NCBI Desc: brittle culm1 [oryza sativa (indica cultivar-group)]
  misc_feature (4)..(242): NCBI GI: 75129709 NCBI Desc: cobra-like 5 protein precursor (protein brittle culm1)
  misc_feature (9)..(444): NCBI GI: 116563464 NCBI Desc: brittle stalk-2 [zea mays]
  misc_feature: Useful for making plants with altered cell wall content and/or composition
  misc_feature: Functional homolog of the protein sequence encoded by LOCUS at5g15630
  misc_feature: Useful for making plants with altered carbohydrate content
  misc_feature: Functional homolog of the protein sequence given in SEQ ID NO 14020
  misc_feature: Useful for making plants with altered cell wall content and/or composition
  misc_feature: Functional homolog of the protein sequence given in SEQ ID NO 14021
  misc_feature: The sequence is a functional homolog of SEQ ID NO 4 in US patent 7109001
  misc_feature: Useful for making plants with altered lignin content
  misc_feature: Functional homolog of the protein sequence given in SEQ ID NO 13349
  misc_feature: Up-regulated in root tissues in response to methyl jasmonate treatment
  misc_feature: Up-regulated in shoot tissues in response to methyl jasmonate treatment
MEPRCFVLVLALAAALSVAVAYDPLDPNGNITIKWDIMSWTPDGYVAVVTINNFQMYRQIMAPGWTVGWTWAKREVIWSMVGAQATEQGDCSRFKANIPHCCKRTPTVVDLLPGVPYNQQIANCCRGGVISAYGQDPASAVAAFQVSVGQAGTTNRTVKVPKNFTLLGPGPGYTCGPGKIVPSTVFLTPDRRRKTQALMTWNVTCTYSQHLASKYPSCCVSFSSFYNDTIVPCAKCACGCEHKTCVQGDSKRLAVTGKHEHAHAAAARGHRDKEAPLLQCTTHMCPVRVHWHVKLNYKEYWRAKIAITNFNYHMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDEYPYLPNSALPAAAASSSLGAAVAAVVVLLVMIVA

SEQ ID NO: 8321 - DNA, 1377 bp, Sorghum bicolor
  misc_feature: Ceres ANNOT ID no. 6087378
  misc_feature: Encodes the peptide sequence at SEQ ID NO 8322
atggcgacaccgcggccggcgctcctgctgcccgccgtgcgcttcgcctccaccaccatcgcgctcctcctcctcgtcgccttctcctctctaatgcgttcgtcagatgcatacgatccactcgatccgaatgggaacataacaattaagtgggacgtaatacagtggacttcagatggctatgtggctgttgtttctctatacaattaccagcaataccgccacattcaggcgccaggctggaaactaggctgggtatgggcaaagaaggaggtaatctgggcgatgaccggtggccaggccactgaacaaggcgactgctccaaattcaaaaccaacatcccccattgctgcagaaaggaccctgaggttgtggacttgctgcctgggactccctacaacatgcagattgccaactgctgcaagggaggagtcctcacatcatgggcacaggaccctagcaatgccgtggcatcgttccaagtcagcgttggacaggctgggactaccaacagaaccgtcaaagtgcccaagaatttcactctgaaggcaccaggtcccgggtacacctgtggaactgccaaactagtgacacctaccaagttcatatctccggatgggaggagatcaactcaagcacacatgacatggaatgtgacatgtacgtactcgcagtttcttgctcaaagatctccatcctgctgtgtctcgctctcatcattttacaacgacactattgttaactgcccaacatgctcctgtggctgccagaataacagcactgcgccaggaagctgtgtagagggtaattcgccttacctggcttctgtcgtgaacgatcctaataagaacagcttggcgcctctagtccaatgcacttcacacatgtgcccaataagagtgcattggcatgtcaaggttaactacaaggagtactggagggtaaagatcacggtgacaaacttcaattaccggatgaactactcgcaatggaacctggttgcgcaacaccccaacttcgacaatctgaccaccattttcagcttcaactacaaacctctgaacccctatggagtgataaacgacacggcgatgctatggggcatcaagtactacaacgatctgctcatgacggccgggccagacgggaatgtgcagtctgagcttctgttccggaaggagccctccacgttcaccttccagaaaggctgggccttcccgagacgagtctacttcaatggcgacaactgcgtgatgccgccgccggacgcctacccgtggctgcccaacgcctctccgcggctgtcggcttcacttctcctcccgttcgttgcagcttggacagcatttgcaatcctcttgatgacccatccgtag

SEQ ID NO: 8322 - protein, 458 aa, Sorghum bicolor
  misc_feature: Ceres ANNOT ID no. 6087378
  misc_feature (61)..(225): Pfam Id: Phytochel_synth Pfam Desc: Phytochelatin synthetase-like conserved region
  misc_feature (6)..(453): NCBI GI: 119034655 NCBI Desc: brittle stalk-2-like protein 6 [zea mays]
  misc_feature (20)..(455): NCBI GI: 75133695 NCBI Desc: cobra-like 1 protein precursor (brittle culm1-like 6 protein)
  misc_feature (20)..(455): NCBI GI: 115473241 NCBI Desc: os07g0604300 [oryza sativa (japonica cultivar-group)]
  misc_feature (14)..(450): NCBI GI: 75137855 NCBI Desc: cobra-like 2 protein precursor (brittle culm1-like 2 protein)
  misc_feature (17)..(457): NCBI GI: 38194916 NCBI Desc: phytochelatin synthetase-like protein [phaseolus vulgaris]
  misc_feature: Useful for making plants with altered Lignin content
  misc_feature: Useful for making plants with altered cell wall content and/or composition
  misc_feature: GREAT-hit functional homolog of the protein sequence given in SEQ ID NO 13349
  misc_feature: Functional homolog of the protein sequence encoded by LOCUS at3g29810
  misc_feature: Functional homolog of the protein sequence encoded by LOCUS at5g60920
  misc_feature: Useful for making plants with altered carbohydrate content
  misc_feature: Functional homolog of the protein sequence given in SEQ ID NO 13944
  misc_feature: Useful for making plants with altered cell wall content and/or composition
  misc_feature: Useful for making plants with altered lignin content
  misc_feature: Functional homolog of the protein sequence given in SEQ ID NO 13349
  misc_feature: The sequence is a functional homolog of SEQ ID NO 4 in US patent 7109001
MATPRPALLLPAVRFASTTIALLLLVAFSSLMRSSDAYDPLDPNGNITIKWDVIQWTSDGYVAVVSLYNYQQYRHIQAPGWKLGWVWAKKEVIWAMTGGQATEQGDCSKFKTNIPHCCRKDPEVVDLLPGTPYNMQIANCCKGGVLTSWAQDPSNAVASFQVSVGQAGTTNRTVKVPKNFTLKAPGPGYTCGTAKLVTPTKFISPDGRRSTQAHMTWNVTCTYSQFLAQRSPSCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKPLNPYGVINDTAMLWGIKYYNDLLMTAGPDGNVQSELLFRKEPSTFTFQKGWAFPRRVYFNGDNCVMPPPDAYPWLPNASPRLSASLLLPFVAAWTAFAILLMTHP

SEQ ID NO: 8323 - DNA, 1146 bp, Sorghum bicolor
  misc_feature: Ceres ANNOT ID no. 6087389
  misc_feature: Encodes the peptide sequence at SEQ ID NO 8324
atgggctcgctgatgtcctgcctctccgacccctgcccgtcggggaacaggtccccgccgctgcaggcgaagcggcgctcctccacctcttcccgcggccgtggcgggagagactccgccaaggcctccgtgtcctttgacgaggaggcgctggccgcggcggcagcgctcgtgctggggcagaggggcgccgccggtggcctgggggcattcgagcggtccgcgtcggtgcgatacgctgccaagcgccagagccagggcccgccactgccccggagcagcagcacgcgtccgaggtcgctcgctgaccccgagctccaaccgcagcagctcctcgccaaggatttgaatactaaggatttggaaaccaacgtcattgttcttgttcatggaggtggatttggcgcttggtgttggtacaagactatatcacttcttgaagatagtgggttcaaagttaacgccatcgacttaacaggctctgggattcattcttacgacacaaacaagattagcagtctttcagagtacgctgaaccacttacgtcttaccttaaaggcttaggtggtgctgaaaaggtaattttggtcgctcatgatcttggtggtgtctgtgtatcctatgcaatggagatgttcccatccaaagttgccaaggctgttttcctttgtgcagcaatgctgacaaatggaaacagtgcccttgacatgttccaacagcagatggacacaaacggtactctccaaaaggcgcaagaattcgtctactccaacggcaaggaccgtcctccaactgccatcaacatcgacagggccttgcttagagacctgttgttcaaccagagcccttccaaggacgtgtcgctggcctcggtgtccatgaggcccatccccttcgcccctgtgctggagaagcttgtgctcaccgctgagaactatggctcggtgcggcggttctacgtggagaccacggaggacaatgcaattcctctgcctctccagcagagcatgtgtggtgccaacccaccggagaaggtgctgcggctgaagggggcggaccacgcacccttcttctccaagccgcaggcgctgcacaagaccctggtcgagatcgccaccatgccgccgccggtccaggcttcgtga

SEQ ID NO: 8324 - protein, 381 aa, Sorghum bicolor
  misc_feature: Ceres ANNOT ID no. 6087389
  misc_feature (151)..(370): Pfam Id: Abhydrolase_1 Pfam Desc: alpha/beta hydrolase fold
  misc_feature (102)..(381): NCBI GI: 115473231 NCBI Desc: os07g0603600 [oryza sativa (japonica cultivar-group)]
  misc_feature (82)..(375): NCBI GI: 42562323 NCBI Desc: hydrolase, alpha/beta fold family protein [arabidopsis thaliana]
  misc_feature (74)..(376): NCBI GI: 42563068 NCBI Desc: hydrolase, alpha/beta fold family protein [arabidopsis thaliana]
  misc_feature (74)..(376): NCBI GI: 6730643 NCBI Desc: f4n2.19 [arabidopsis thaliana]
  misc_feature (210)..(381): NCBI GI: 34394932 NCBI Desc: alpha/beta hydrolase-like protein [oryza sativa (japonica cultivar-group)]
MGSLMSCLSDPCPSGNRSPPLQAKRRSSTSSRGRGGRDSAKASVSFDEEALAAAAALVLGQRGAAGGLGAFERSASVRYAAKRQSQGPPLPRSSSTRPRSLADPELQPQQLLAKDLNTKDLETNVIVLVHGGGFGAWCWYKTISLLEDSGFKVNAIDLTGSGIHSYDTNKISSLSEYAEPLTSYLKGLGGAEKVILVAHDLGGVCVSYAMEMFPSKVAKAVFLCAAMLTNGNSALDMFQQQMDTNGTLQKAQEFVYSNGKDRPPTAINIDRALLRDLLFNQSPSKDVSLASVSMRPIPFAPVLEKLVLTAENYGSVRRFYVETTEDNAIPLPLQQSMCGANPPEKVLRLKGADHAPFFSKPQALHKTLVEIATMPPPVQAS

SEQ ID NO: 8325 - DNA, 2112 bp, Sorghum bicolor
  misc_feature: Ceres ANNOT ID no. 6087409
  misc_feature: Encodes the peptide sequence at SEQ ID NO 8326
atgtcggcgccggcgccggctccggctcccccaatggccgcgccgcgggtggggttgctgtacgacgatcggatgcgcgcgcacgcgacgcctgacggggaggaacacccggagaaccccgagcggctgcgcgccatctggcgcaagctcaacgccgagggcgtcgcgcccaggtgtgtggcccttaaggcgaaggaagccgaggacaaatatatagcttctgttcacagcaagagccatataaagctgatgaaggagattagctcaaagaagtatgatgccaccaggaacaagattgctaggaaattcaattccatttacttcaacaagggttcctcggaatctgctgttcttgcagctggttctgtcatagaggtagctgagaaagttgctgcaggtgagttaagttctgctattgctctagtcagacctccaggccaccatgcagaacatgatgaggcaatgggattttgcctcttcaacaatgtggcagttgcagctaattatctcttaaacgagaggcctgatttaggtatcaagaagatattgattgtcgattgggatgttcaccatggaaatggcacgcagaaaatgttctacaatgatcctcgtgtattgttcttctcagttcacagatttgattatggaagcttctatcctgctgaaggggatgcttctcattgtttcatcggggaagaaggtggtaaagggtataacatcaatgttccctgggagcatgggaagtgtggggatgctgattatattgctgcatgggaccatgtactgcttcctgtcactaaagtttttgatcctgatataatactggtatcggctgggtttgatgcagcattgggtgatcctctcggtgggtgctgcattacaccaaatggatatgcactgctactaacaaagttgttaggatttgctcaaggaaggatagtgatggcccttgaaggaggttataaccttaggtccatagcaaattcagtttgtgcttgtgcaaaagttctcttgggagacaaattcacattcaacgctccagagatgcagccatttgaatctacatggagtgttatacaagcggtacgtaatgaattgaagacatgctggcctgttctgagtagcaagctgccagaaaatgtatcattgaggattaggccttcaccaagcgaggtcaacgcttcctctgattccgaatctgatagtgaagatgttgctgagctccttcccactgttgcatctgtcaatgttattgaagttgctggtgatgctataagtgaacacctctcaaagatgaaacttgatgatgacaacctttcagtgaagactacctcaagttgctcagcagcagaacagcatctagttgattcagtaaaagtacaaaacaatgcatctgtggtgctgaccaaaaaaatatctgatttatctctcgcttggcgatcagatttatcaagaactgatgtctggtatgccagttttggttcaaacatgtggagaccaagatttctatgctatgttcaaggagggaaggctgagggtatgagtatagcgtgctacggatcacgtgatacaagctcaccaaaaggaaccatgtggaagactgtacctcacaggttgctttttggtagatcgtctaccccttgttggggaactggtggtgttgcttttctcaaccctgagataaactacaatgagaagtcgtatgtctgcatgtacaaaataacgttggagcagttcaatgacatcttgtttcaggagaatcgtttagtgctgaaggatggcaaagacgggaacgttgtgtatcctgactctcctttgattggttcatctgaaatcaagtttatatctacaaacaaagctattcatcttgaacctattaaggatagctggtactccaatgtactttatcttgggaatgagggtgaacttccaattctaactatgacgtgccccgcatcagatattgagaggttcaaatctggtgagctgcctttagcacctccatcagagacatatgcggccactctgataaggggactagttgaaggaaagcaactggatgcggacggagctgccaactacatcaatgcttgtgctgcaaaaggcctgtga

SEQ ID NO: 8326 - protein, 703 aa, Sorghum bicolor
  misc_feature: Ceres ANNOT ID no. 6087409
  misc_feature (16)..(339): Pfam Id: Hist_deacetyl Pfam Desc: Histone deacetylase domain
  misc_feature (6)..(703): NCBI GI: 32968028 NCBI Desc: hda1 [zea mays]
  misc_feature (13)..(703): NCBI GI: 115473213 NCBI Desc: os07g0602200 [oryza sativa (japonica cultivar-group)]
  misc_feature (16)..(409): NCBI GI: 21105769 NCBI Desc: hda18 [arabidopsis thaliana]
  misc_feature (14)..(382): NCBI GI: 108883594 NCBI Desc: histone deacetylase [aedes aegypti]
  misc_feature (6)..(363): NCBI GI: 123295094 NCBI Desc: histone deacetylase 6 [mus musculus]
MSAPAPAPAPPMAAPRVGLLYDDRMRAHATPDGEEHPENPERLRAIWRKLNAEGVAPRCVALKAKEAEDKYIASVHSKSHIKLMKEISSKKYDATRNKIARKFNSIYFNKGSSESAVLAAGSVIEVAEKVAAGELSSAIALVRPPGHHAEHDEAMGFCLFNNVAVAANYLLNERPDLGIKKILIVDWDVHHGNGTQKMFYNDPRVLFFSVHRFDYGSFYPAEGDASHCFIGEEGGKGYNINVPWEHGKCGDADYIAAWDHVLLPVTKVFDPDIILVSAGFDAALGDPLGGCCITPNGYALLLTKLLGFAQGRIVMALEGGYNLRSIANSVCACAKVLLGDKFTFNAPEMQPFESTWSVIQAVRNELKTCWPVLSSKLPENVSLRIRPSPSEVNASSDSESDSEDVAELLPTVASVNVIEVAGDAISEHLSKMKLDDDNLSVKTTSSCSAAEQHLVDSVKVQNNASVVLTKKISDLSLAWRSDLSRTDVWYASFGSNMWRPRFLCYVQGGKAEGMSIACYGSRDTSSPKGTMWKTVPHRLLFGRSSTPCWGTGGVAFLNPEINYNEKSYVCMYKITLEQFNDILFQENRLVLKDGKDGNVVYPDSPLIGSSEIKFISTNKAIHLEPIKDSWYSNVLYLGNEGELPILTMTCPASDIERFKSGELPLAPPSETYAATLIRGLVEGKQLDADGAANYINACAAKGL

SEQ ID NO: 8327 - DNA, 1026 bp, Sorghum bicolor
  misc_feature: Ceres ANNOT ID no. 6087411
  misc_feature: Encodes the peptide sequence at SEQ ID NO 8328
atgggggcggaggacacggtggtgtgcgtcaccggcggcagcggctacctcgggagctggctcgtccggaagctcctcggcagaggctgcgtcgtccacgccaccctgcggagcctcgcggacgagaagaagacggggctgctccgggcgctccccggcgcggcggagcggctgcggctgttcgaggcggacatgtacgacgccgacaccttcgagccagccatcgccggctgccacttcgtcttcctcgtcgccacgcccatggcgcacgaccccaccagcaccaagtacaagaacacgacggaggcggcagtggacgcggggcgcatcatcctccggcagtgcgagcggtctggcacggtgaagcgcgtcatctacacggcctcggtcacggccgcgtcgccgctcaaggaggacggcagcgggtacaaggacttcaccaacgagtccgactggacgccactcaatctctcctacgaattcagcaacgctcacctggatgactacgtgtggtctaagtctctgtcggagaaggagctgctaaggtacaacgacgagtgctccagggagatccgggcgctggaggtggtgaccctggcgtgcgcgctcgtcggcggcgacaccatccagacgtacctgtggagcagcatccccgtgatcgtggcgccgctgacggggcaggcgatctaccacaactccctcctgttcctgcaggcactgctgggctccgtgccgctggcgcatatagaggacgtctgcgacgcgcacgtcttctgcatggagcaggcgtccatggccggccgcttcctctgcgccgccgggtaccccagcatgaggaacatcgtcgaccacttcgctgctaagcacccagacctcaagatacaactgacggaggtgaccggggaaggagtcaggattgtgcccaacaccagcaagctgcaggacttgggtttcaagttcaagtacggagtggaggagacgctggactgcagcgtcgagtgcgccaagaggctgggagaactctag

SEQ ID NO: 8328 - protein, 341 aa, Sorghum bicolor
  misc_feature: Ceres ANNOT ID no. 6087411
  misc_feature (8)..(272): Pfam Id: Epimerase Pfam Desc: NAD dependent epimerase/dehydratase family
  misc_feature (10)..(256): Pfam Id: NAD_binding_4 Pfam Desc: Male sterility protein
  misc_feature (9)..(296): Pfam Id: 3Beta_HSD Pfam Desc: 3-beta hydroxysteroid dehydrogenase/isomerase family
  misc_feature (8)..(341): NCBI GI: 2911358 NCBI Desc: nadph hc toxin reductase [zea mays]
  misc_feature (2)..(341): NCBI GI: 1929998 NCBI Desc: nadph-dependent hc-toxin reductase [hordeum vulgare]
  misc_feature (8)..(341): NCBI GI: 2911362 NCBI Desc: nadph hc toxin reductase [zea mays]
  misc_feature (8)..(341): NCBI GI: 2911360 NCBI Desc: nadph hc toxin reductase [zea mays]
  misc_feature (8)..(341): NCBI GI: 2911364 NCBI Desc: nadph hc toxin reductase [zea mays]
MGAEDTVVCVTGGSGYLGSWLVRKLLGRGCVVHATLRSLADEKKTGLLRALPGAAERLRLFEADMYDADTFEPAIAGCHFVFLVATPMAHDPTSTKYKNTTEAAVDAGRIILRQCERSGTVKRVIYTASVTAASPLKEDGSGYKDFTNESDWTPLNLSYEFSNAHLDDYVWSKSLSEKELLRYNDECSREIRALEVVTLACALVGGDTIQTYLWSSIPVIVAPLTGQAIYHNSLLFLQALLGSVPLAHIEDVCDAHVFCMEQASMAGRFLCAAGYPSMRNIVDHFAAKHPDLKIQLTEVTGEGVRIVPNTSKLQDLGFKFKYGVEETLDCSVECAKRLGEL

SEQ ID NO: 8329 - DNA, 1035 bp, Sorghum bicolor
  misc_feature: Ceres ANNOT ID no. 6087414
  misc_feature: Encodes the peptide sequence at SEQ ID NO 8330
atgagcgccggcacggcggacacggtggtgtgcgtcaccggcggcagcggctacatcgggagctggctcgtcaggaagctcctcggcagaggctgcgtcgtccacgccaccctgcggagcctcgcggacgagaagaagacggagctgctccgggcgctccccggcgcggcggagcggctgcggctgttcgaggcggacatgtacgacgccgacaccttcgagcccgccatcgccggctgccacttcgtcttcctcgtcgccactcccatggcgcacgaccccaccagcaccaagtacaagaacatgacggaggcgacagtggacgcggtgcgcatcatcctccggcagtgcgagcggtccggcacggtgaagcgcgtcatctacacggcctcggtcacggccgcgtcgccgctcaaggaggacggcagcgggtacaaggacttcaccaacgagtccaactggacaccgctcaacctctcctacgaattcagcaacactcacctggacgattacgtgcggtccaaattgctatcggagaaggagctactgagctacaatgagtcctctaaggatcagccccggacgctagtagaggtggtcgccctggcgtgcgcggtcgtcggcggcgacacgatccagacgtacctgtggagcagcctcgccgtggtcgtggcgccattgacggggcaggcgatcctccacaactccctcatgttcattcaggcgttaatgggctccgtgccgctggcgcacgtggaggacgtctgtgaggcacacgtcttctgcatggagcaggcgtccatgtccggccgcttcctctgcgccgccgggtaccccaacatgcgggacatcgtcgaccacttcgccgccaagcaccccgacctcgagataaagctgacggaggtgactggggaaggcattaggattgtgcccaacaccagcaagcttgaggacttgggattcaggttcaagtacggagtggaggagacgctggactgcagcgtcgagtgcgccaagaggctgggagaactctag

SEQ ID NO: 8330 - protein, 344 aa, Sorghum bicolor
  misc_feature: Ceres ANNOT ID no. 6087414
  misc_feature (10)..(275): Pfam Id: Epimerase Pfam Desc: NAD dependent epimerase/dehydratase family
  misc_feature (12)..(243): Pfam Id: NAD_binding_4 Pfam Desc: Male sterility protein
  misc_feature (11)..(299): Pfam Id: 3Beta_HSD Pfam Desc: 3-beta hydroxysteroid dehydrogenase/isomerase family
  misc_feature (2)..(344): NCBI GI: 1929998 NCBI Desc: nadph-dependent hc-toxin reductase [hordeum vulgare]
  misc_feature (10)..(344): NCBI GI: 2911358 NCBI Desc: nadph hc toxin reductase [zea mays]
  misc_feature (10)..(344): NCBI GI: 2911362 NCBI Desc: nadph hc toxin reductase [zea mays]
  misc_feature (10)..(344): NCBI GI: 2911360 NCBI Desc: nadph hc toxin reductase [zea mays]
  misc_feature (10)..(344): NCBI GI: 2911364 NCBI Desc: nadph hc toxin reductase [zea mays]
MSAGTADTVVCVTGGSGYIGSWLVRKLLGRGCVVHATLRSLADEKKTELLRALPGAAERLRLFEADMYDADTFEPAIAGCHFVFLVATPMAHDPTSTKYKNMTEATVDAVRIILRQCERSGTVKRVIYTASVTAASPLKEDGSGYKDFTNESNWTPLNLSYEFSNTHLDDYVRSKLLSEKELLSYNESSKDQPRTLVEVVALACAVVGGDTIQTYLWSSLAVVVAPLTGQAILHNSLMFIQALMGSVPLAHVEDVCEAHVFCMEQASMSGRFLCAAGYPNMRDIVDHFAAKHPDLEIKLTEVTGEGIRIVPNTSKLEDLGFRFKYGVEETLDCSVECAKRLGEL

SEQ ID NO: 8331 - DNA, 1305 bp, Sorghum bicolor
  misc_feature: Ceres ANNOT ID no. 6087416
  misc_feature: Encodes the peptide sequence at SEQ ID NO 8332
  misc_feature: Down-regulated in shoot tissues in response to salicylic acid treatment
atggacggcgacccctcgcgccaggtgcgcgtgcgcttcgtcacgaagctgccgcctccgctgcgggcgccgcccgctgccatcgccgtccctgcggacctcacccgcatgggcctctccgagatcgtcaacagcctcctcgccgccgccgagccggaccaccagacacagcccttcgacttcattgtggacggcgagctcgtgcggctgccactccaggagttcctcctcgccaagggcatctcggcggagagggtgcttgagctcgagtatgtgaaagcagtggcgccaaggaagcaggaggaaccttgcccccatgatgactgggttagtgctgtggatggatcgaactcaggttttatattatctggatgctatgatggctttgcaagattatggaaagatgcagcagtgtgtacacaaattttggagggacacgctgatgcaattacttctgccagattcataaataaaagatctgaaactgagggcagtctgcatgtagtgactggctcaaaggataggtcgctacggctatacaagtgtgacacatcagtcagtatggactacccaaagcgggttggggcttacaaaattcttcgtggccacacggcatctgttaaaagtatctccgtagacccttctggcgatatgctatgttctggatcctgggataacaccatcaagttgtgggcagttgaacgatctgaagatgatgatgctgtttcattgaagaagagaaggatgaattctgactcatctggacctgaagagtctcagttagagggttcagccacttcaacacttctgggacatacacaaggtgtaacttctgttgcctggcctgaacagaaaacgatatattcagcatcttgggatcattctgtaaggcagtgggatatccaaacagtgaaagaaacatggaatatgttttgtgggaaggccttgaattgcttggactgtggaggtgagggttcttcattgattgctgctggtggctctgatcctgtgttgagggtatgggaccctcgcaaacctggaacattagctcctgtttttcagttctcctcccattctggctggatcactgcttgtaaatggcatccaagttcatgtttccatttggtatcatcttcatttgatgggaaagtgatgttgtgggatctaagaacagcatggccgctggcgtctgtggattcacacgaagataaggttttatgtgccgactggtggaaagggaacagcgtgataagcggcggagctgattccaagctatgtatctcatctggtattcatattgtgtga

SEQ ID NO: 8332 - protein, 434 aa, Sorghum bicolor
  misc_feature: Ceres ANNOT ID no. 6087416
  misc_feature (137)..(181): Pfam Id: WD40 Pfam Desc: WD domain, G-beta repeat
  misc_feature (194)..(232): Pfam Id: WD40 Pfam Desc: WD domain, G-beta repeat
  misc_feature (263)..(300): Pfam Id: WD40 Pfam Desc: WD domain, G-beta repeat
  misc_feature (349)..(388): Pfam Id: WD40 Pfam Desc: WD domain, G-beta repeat
  misc_feature (8)..(76): Pfam Id: NLE Pfam Desc: NLE (NUC135) domain
  misc_feature (2)..(431): NCBI GI: 92874363 NCBI Desc: wd40-like [medicago truncatula]
  misc_feature (1)..(392): NCBI GI: 42573375 NCBI Desc: transducin family protein / wd-40 repeat family protein [arabidopsis thaliana]
  misc_feature (8)..(425): NCBI GI: 45595736 NCBI Desc: wd repeat domain 12 [danio rerio]
  misc_feature (8)..(425): NCBI GI: 28277645 NCBI Desc: wdr12 protein [danio rerio]
  misc_feature (8)..(425): NCBI GI: 40786517 NCBI Desc: wd repeat domain 12 [rattus norvegicus]
  misc_feature: Down-regulated in shoot tissues in response to salicylic acid treatment
  misc_feature: The sequence is a functional homolog of SEQ ID NO. 485 in the 11/188,298 US application
  misc_feature: The sequence is a functional homolog of SEQ ID NO. 502 in the 11/188,298 US application
MDGDPSRQVRVRFVTKLPPPLRAPPAAIAVPADLTRMGLSEIVNSLLAAAEPDHQTQPFDFIVDGELVRLPLQEFLLAKGISAERVLELEYVKAVAPRKQEEPCPHDDWVSAVDGSNSGFILSGCYDGFARLWKDAAVCTQILEGHADAITSARFINKRSETEGSLHVVTGSKDRSLRLYKCDTSVSMDYPKRVGAYKILRGHTASVKSISVDPSGDMLCSGSWDNTIKLWAVERSEDDDAVSLKKRRMNSDSSGPEESQLEGSATSTLLGHTQGVTSVAWPEQKTIYSASWDHSVRQWDIQTVKETWNMFCGKALNCLDCGGEGSSLIAAGGSDPVLRVWDPRKPGTLAPVFQFSSHSGWITACKWHPSSCFHLVSSSFDGKVMLWDLRTAWPLASVDSHEDKVLCADWWKGNSVISGGADSKLCISSGIHIV

SEQ ID NO: 8333 - DNA, 1851 bp, Sorghum bicolor
  misc_feature: Ceres ANNOT ID no. 6087426
  misc_feature: Encodes the peptide sequence at SEQ ID NO 8334
atggctgctgctgcggcggcggccacctcgctccttctacgccacaaccgcaacccccacctcctcctcctccgcgccgcgatctcctcctcccgcgcgctgccccagcagccggagctgtctcctgacccgaccgccggcgcccccgaccccgccccactccccccaaaccccagcacggggagccccttctacagccagaactggcgcaaccccgccgccgccaacccgccctcctcgcttctgcccaccgtcctcgccggcggcgccttcggggcggagcaccgcatggccgccttctacgatacgcccaacgccgcggggctcaaggagacgttcgccaagtatatggcggagcagcggtgggaggacatcaagcatctgttcgaccactgggtgcgctccctcgacgccaccacggggaagcccaaccaccccgacgtcgacctcttcaatcactacctccgcgctaacctcatgtcgggggccctgccgcacgagatgctcgatctcgccgaccacatgcgcgagttcgagctcgagcccaacactgcatcgtacaacctcgtgctcaagagcatggtcgccgggcaggagtccgagggcgccgagaagctcattgaacggatgctgcaaacaggaacatttccagatgatgaatcctacaatttggttgtaggcctgcttattagacagaaccttgttgactcatctctgaagtatttggatctgattcttaaatcaggctacacgctatcactaactgtttacactgattatatccgagcatgtatgagatccgggaggttggacacgttgacatcaattatagagaaatgcaagacaactgataagaacaaagttttgtgtccacaatgggccttgtgcattgacatagcagaagctgcatttgaagctaacaatagcaaattagctctttttgctttggaatttctcgcaaaatggattgctcgcggtgagaatgttaaacctcctgttcagctgtcagttaatgaaggtcttgtaatatcagctctgagtgctgctggcagaacttttagtactgacctcttgaatgctgcttggtcgctattacggaagtccctgcgccagaaaagggcacccaccccagagacatatcttgccaagatatatgcccattcatcaattggccagcttcaaagggcttttggtacattgcgtgaatttgaaaatgcctatgggaactctgaggacattgatttagagctcttctcaccatttacttccttgcatcctcttgttgttgcttgctgcaaagatggctttaccacactggattcggtttatgttcagttggagaatctgagtcgtgcagatccaccatacaaatctgtttctgctctcaactgtgttatattagggtgtgcaaacatttgggacatcaatcgagcttatgaaacttttgtggctattaaggaaaaatttgaactcacgcctgacatccattcatacaatgcccttctgtgtgcatttggaaagttgaaacagacaggagaagcatgtaatgtgttccagcatgtattaactcttggtgttaaaccaaattcaacaacatactccctgcttgtcgatgcccatcttgccaacaaagatccaaaagctgctcttgccataattgatgagatggttgatgctggcttcactccttccaaggataccctaaggaaggttcgaagacggtgctctcgtgaatcagactttgacagtgacgagaaagtccaatccctggctaagcagttcaactaccgactgggtggtgagaatcgaagagagatgctttatagcatagaatataatcctgtgtactga

SEQ ID NO: 8334 - protein, 616 aa, Sorghum bicolor
  misc_feature: Ceres ANNOT ID no. 6087426
  misc_feature (496)..(530): Pfam Id: PPR Pfam Desc: PPR repeat
  misc_feature (531)..(565): Pfam Id: PPR Pfam Desc: PPR repeat
  misc_feature (4)..(613): NCBI GI: 33354185 NCBI Desc: pentatricopeptide (ppr) repeat-containing protein-like protein [oryza sativa (japonica cultivar-group)]
  misc_feature (173)..(586): NCBI GI: 140049648 NCBI Desc: pentatricopeptide repeat [medicago truncatula]
  misc_feature (379)..(565): NCBI GI: 42567647 NCBI Desc: pentatricopeptide (ppr) repeat-containing protein [arabidopsis thaliana]
  misc_feature (379)..(565): NCBI GI: 15983487 NCBI Desc: at5g04810/muk11_13 [arabidopsis thaliana]
  misc_feature (379)..(565): NCBI GI: 9758456 NCBI Desc: membrane-associated salt-inducible protein-like [arabidopsis thaliana]
MAAAAAAATSLLLRHNRNPHLLLLRAAISSSRALPQQPELSPDPTAGAPDPAPLPPNPSTGSPFYSQNWRNPAAANPPSSLLPTVLAGGAFGAEHRMAAFYDTPNAAGLKETFAKYMAEQRWEDIKHLFDHWVRSLDATTGKPNHPDVDLFNHYLRANLMSGALPHEMLDLADHMREFELEPNTASYNLVLKSMVAGQESEGAEKLIERMLQTGTFPDDESYNLVVGLLIRQNLVDSSLKYLDLILKSGYTLSLTVYTDYIRACMRSGRLDTLTSIIEKCKTTDKNKVLCPQWALCIDIAEAAFEANNSKLALFALEFLAKWIARGENVKPPVQLSVNEGLVISALSAAGRTFSTDLLNAAWSLLRKSLRQKRAPTPETYLAKIYAHSSIGQLQRAFGTLREFENAYGNSEDIDLELFSPFTSLHPLVVACCKDGFTTLDSVYVQLENLSRADPPYKSVSALNCVILGCANIWDINRAYETFVAIKEKFELTPDIHSYNALLCAFGKLKQTGEACNVFQHVLTLGVKPNSTTYSLLVDAHLANKDPKAALAIIDEMVDAGFTPSKDTLRKVRRRCSRESDFDSDEKVQSLAKQFNYRLGGENRREMLYSIEYNPVY

SEQ ID NO: 8335 - DNA, 1092 bp, Sorghum bicolor
  misc_feature: Ceres ANNOT ID no. 6087428
  misc_feature: Encodes the peptide sequence at SEQ ID NO 8336
atggaggacgatgatgactgccctcctctcgccgtcgagctgccgccgcaggtgccgtcccctccggcgcaagctccctcggacgcctcgccagttggcgtcaccgtcatcactggctacctcggggccggcaagtcgacgttagtcaattacattttgaatgagcaacatgggaagagaattgccgtgatactaaatgagttcggggaggaaattggggttgagagggcgatgatcaacgaggggcaaggtggtgcacttgtcgaggaatgggtggaactggccaatggatgtgtctgttgctctgtaaaacacagtctggttcaagcacttgagcagcttgtgcaaagaaaggatagaatggatcatatattacttgagacaacaggattggccgatcctgctccacttgtttccgttctttggctagatgatcaattggagtcatcaattagactggattctattattacggttattgatgcaaaaaacttcagggttcagattgatgagcacaaaaactcttcctcattccctgaagcatttcatcaaattgcatttgcggatgttgtgatattgaacaaaattgacctagtggaagacaatcttgaggatttggaaaaacatattcatgatgtgaatgctctggttacagtggtgcggtctgtccgttgccaggttgacttgaatgaagtatttaaccggcaagcatatggtgtgaaggattcatctcatctgcaagaactgctcgactatagtaaatcagtgccacctagtcgccgtcatgataacaatatttccaccttgtgcatctatgagcaggattctgttaacttggctaaggtggagtcttggcttgaagatcttctttgggaaaagaaatctagcatggacatatatcgctgtaaagggattttatatatccatgattcagaccaagttcatacactacaggcagtgagggaagtttatgaagttgtgccggctcgaaaatggtctgagacagagtctcgcatgaacaagatagttgtcataggccgcaatttggacatcaatgttcttcaagattcttttagtgtctgcaagagctga

SEQ ID NO: 8336 - protein, 363 aa, Sorghum bicolor
  misc_feature: Ceres ANNOT ID no. 6087428
  misc_feature (33)..(221): Pfam Id: cobW Pfam Desc: CobW/HypB/UreG, nucleotide-binding domain
  misc_feature (266)..(362): Pfam Id: CobW_C Pfam Desc: Cobalamin synthesis protein cobW C-terminal domain
  misc_feature (1)..(357): NCBI GI: 140060942 NCBI Desc: cobalamin synthesis protein, p47k; cobalamin synthesis cobw, c-terminal [medicago truncatula]
  misc_feature (1)..(342): NCBI GI: 9797748 NCBI Desc: contains similarity to cobw protein from rhodobacter capsulatus gi7448322. [arabidopsis thaliana]
  misc_feature (1)..(358): NCBI GI: 47086079 NCBI Desc: zgc:77617 [danio rerio]
  misc_feature (1)..(363): NCBI GI: 50414748 NCBI Desc: mgc80076 protein [xenopus laevis]
  misc_feature (4)..(358): NCBI GI: 34596562 NCBI Desc: cobw domain containing protein 1 [homo sapiens]
MEDDDDCPPLAVELPPQVPSPPAQAPSDASPVGVTVITGYLGAGKSTLVNYILNEQHGKRIAVILNEFGEEIGVERAMINEGQGGALVEEWVELANGCVCCSVKHSLVQALEQLVQRKDRMDHILLETTGLADPAPLVSVLWLDDQLESSIRLDSIITVIDAKNFRVQIDEHKNSSSFPEAFHQIAFADVVILNKIDLVEDNLEDLEKHIHDVNALVTVVRSVRCQVDLNEVFNRQAYGVKDSSHLQELLDYSKSVPPSRRHDNNISTLCIYEQDSVNLAKVESWLEDLLWEKKSSMDIYRCKGILYIHDSDQVHTLQAVREVYEVVPARKWSETESRMNKIVVIGRNLDINVLQDSFSVCKS

SEQ ID NO: 8337 - DNA, 357 bp, Sorghum bicolor
  misc_feature: Ceres ANNOT ID no. 6087451
  misc_feature: Encodes the peptide sequence at SEQ ID NO 8338
atggcaacaagacgcaatgttcattattcacatcttcctatggaggatatagatggagacaatgctcgtgaagaagctgatgataacctacgattcacctacacaccaaaatcgcacatgagaattccatggaagtcaattgccctagcactttttctcttccttataggaattttactcctctccctgtcatattttatattcacaaatcacatggagggtgatggttctcaggcatatggtctcttattcctgggtgtgcttgctttccttcccggatattatgagactcgagttgcttattattcatggagaggagcacaagggtacacttttgcatccatcccggattattag

SEQ ID NO: 8338 - protein, 118 aa, Sorghum bicolor
  misc_feature: Ceres ANNOT ID no. 6087451
  misc_feature (65)..(118): NCBI GI: 115484003 NCBI Desc: os11g0132400 [oryza sativa (japonica cultivar-group)]
  misc_feature (1)..(118): NCBI GI: 49904255 NCBI Desc: mgc89669 protein [xenopus tropicalis]
  misc_feature (37)..(118): NCBI GI: 49256223 NCBI Desc: mgc84021 protein [xenopus laevis]
  misc_feature (37)..(118): NCBI GI: 51258427 NCBI Desc: mgc84111 protein [xenopus laevis]
  misc_feature (1)..(118): NCBI GI: 89268887 NCBI Desc: novel protein [xenopus tropicalis]
  misc_feature: Useful for making plants with altered protein content
  misc_feature: Functional homolog of the protein sequence given in SEQ ID NO 13449
MATRRNVHYSHLPMEDIDGDNAREEADDNLRFTYTPKSHMRIPWKSIALALFLFLIGILLLSLSYFIFTNHMEGDGSQAYGLLFLGVLAFLPGYYETRVAYYSWRGAQGYTFASIPDY

SEQ ID NO: 8339 - DNA, 873 bp, Sorghum bicolor
  misc_feature: Ceres ANNOT ID no. 6087452
  misc_feature: Encodes the peptide sequence at SEQ ID NO 8340
atggccgagccaaagccagagttcagtgatcttattacgcaagcgaagaaaaaaatagtaccaaagttcactgaaatcttccccgtggaggacgtgaactacccttacggctccttcatcgccgcggtcaggaaagatgtggtcaaatactgcaccgaccataaaggcatcttccagcctgtgctgccgccggagaagaaggtccccgagctctggttctacacccagctcaaaaccaagaccagctccatcacgctcgccatacgcatggacaacctctacctcgtcggcttcaggaccccggccggtgtgtggtgggagttcggcaagaccggcgacacccacctcctcgacgacaacccgaggtggctcggctttggcggccggtaccaggacctcatcggcaataagggcctggagaccgtcaccttgggccgtgccgaaatgacaagagccgtcaacgacctggcgaagaagacgacgatgacattagaggaggagcagctgctgatgctgcaggatgctggtctggcagcggcggctgacccgcaagccgacacgaagagcaagctggcgaagctggtggtcatggtgtgcgagggggtgcggttcaacactgtgtcccgcacggtagaagcggggttcaacaaaggggtgaccataagcgagatgcaggggaagcaggtgcagaaatgggacaggatctcgaaagctgccttcgactgggctaaaaacccgaacgctgtgatccctgacatgcagaagcttggcatcaaagataaaaacgaggctgcgaggatcgttgcgctcgttaagaatcaaactactgctactgctagtgctagtgctacatatgagaagagcgatgtctga

SEQ ID NO: 8340 - protein, 290 aa, Sorghum bicolor
  misc_feature: Ceres ANNOT ID no. 6087452
  misc_feature (18)..(279): Pfam Id: RIP Pfam Desc: Ribosome inactivating protein
  misc_feature (1)..(289): NCBI GI: 75993939 NCBI Desc: ribosome inactivating protein 1 [zea diploperennis]
  misc_feature (1)..(284): NCBI GI: 77862277 NCBI Desc: ribosome inactivating protein 1 [zea mays subsp. parviglumis]
  misc_feature (1)..(284): NCBI GI: 77862293 NCBI Desc: ribosome inactivating protein 1 [zea mays subsp. parviglumis]
  misc_feature (1)..(289): NCBI GI: 75993935 NCBI Desc: ribosome inactivating protein 1 [zea diploperennis]
  misc_feature (1)..(289): NCBI GI: 77862275 NCBI Desc: ribosome inactivating protein 1 [zea mays subsp. parviglumis]
  misc_feature (1)..(289): SWISSPROT Homolog: EC 3.2.2.22 Ribosome-inactivating protein 9
MAEPKPEFSDLITQAKKKIVPKFTEIFPVEDVNYPYGSFIAAVRKDVVKYCTDHKGIFQPVLPPEKKVPELWFYTQLKTKTSSITLAIRMDNLYLVGFRTPAGVWWEFGKTGDTHLLDDNPRWLGFGGRYQDLIGNKGLETVTLGRAEMTRAVNDLAKKTTMTLEEEQLLMLQDAGLAAAADPQADTKSKLAKLVVMVCEGVRFNTVSRTVEAGFNKGVTISEMQGKQVQKWDRISKAAFDWAKNPNAVIPDMQKLGIKDKNEAARIVALVKNQTTATASASATYEKSDV

SEQ ID NO: 8341 - DNA, 471 bp, Sorghum bicolor
  misc_feature: Ceres ANNOT ID no. 6087454
  misc_feature: Encodes the peptide sequence at SEQ ID NO 8342
atggctgcggcagaggcgtgggcacgacaggagaaagtgaggaagttcgaggagttcgtggaccagcggttgaaacctgaccttgctaatgccatcgcacagcgcgacaaggtgtttgagcagcagaagaccttcttggatttgaagaggaacattgaaaatttggagaggaatggtgttaccagcatgcggtccatggtcaacctaggctcggaggtgtacatgcaagcagaagtaccagatacaagacatatttttgtggacattggtctaggttttcatgtggaatttacttggcaagaagctttacagttcatatctgtaagagaggcaaggttgactaggcaaatagatgaatacacgcatctcatcgcaagcataaaagcacagatcaagttggtatgtgaaggtatccgcgaagtgctgcagctgccagcggagaaagagttatcgcctaggaatacgtggtag

SEQ ID NO: 8342 - protein, 156 aa, Sorghum bicolor
  misc_feature: Ceres ANNOT ID no. 6087454
  misc_feature (24)..(144): Pfam Id: Prefoldin Pfam Desc: Prefoldin subunit
  misc_feature (9)..(151): NCBI GI: 9295719 NCBI Desc: t24p13.4 [arabidopsis thaliana]
  misc_feature (11)..(141): NCBI GI: 52219180 NCBI Desc: zgc:101894 [danio rerio]
  misc_feature (17)..(133): NCBI GI: 55244561 NCBI Desc: ensangp00000011027 [anopheles gambiae str. pest]
  misc_feature (10)..(133): NCBI GI: 146180513 NCBI Desc: prefoldin subunit family protein [tetrahymena thermophila sb210]
  misc_feature (4)..(149): NCBI GI: 24584413 NCBI Desc: cg15266-pa [drosophila melanogaster]
MAAAEAWARQEKVRKFEEFVDQRLKPDLANAIAQRDKVFEQQKTFLDLKRNIENLERNGVTSMRSMVNLGSEVYMQAEVPDTRHIFVDIGLGFHVEFTWQEALQFISVREARLTRQIDEYTHLIASIKAQIKLVCEGIREVLQLPAEKELSPRNTW

SEQ ID NO: 8343 - DNA, 2829 bp, Sorghum bicolor
  misc_feature: Ceres ANNOT ID no. 6087455
  misc_feature: Encodes the peptide sequence at SEQ ID NO 8344
atggagggcgacgacttcacgccggagggcggcaagctccccgagttcaagctagatgcgagacaagcgcagggtttcatctccttcttcaagaggctgccgcaggatccccgggccgttcgtctcttcgaccgcagggattattacactgcccatggcgagaatgctacgtttattgcaaggacatactaccacacaatgtctgccttgcgtcaattaggtagcagctctgatggaatatcaagtgttagtgtgagcaaggctatgtttgagaccattgcccgcaacattttgttggaaaggactgactgtacattagagctctatgagggaagtgggtcaaactggaggttaacaaagtctggaacacctggaaatattggtagttttgaagaccttctatttgcaaacaacgacatgcaagattcaccagtcattgttgctttgtttccagtgtgtcgggaaagtcagctgtatgtagggcttagttttttggatatgaccaataggaagcttgggttggctgagttccccgaagatagccgattcacaaatgttgaatcagctcttgttgcattaggttgcaaggagtgtcttctctcagaagattgtgaaaaatccattgatctgaatccccttcgagacgccattagtaattgtaatgttctgttgactgtgaaaaagaaggctgacttcaaatccagggatcttgcacaagatcttggtagaataatcaggggttctgttgagcctgtacgtgatctgctatctcagtttgactatgctcttggtccccttggagctcttttatcgtatgcagagttgctagcagatgatactaactatggaaattacacaattgagaagtacaatttgaactgctacatgcgacttgattctgctgcagtgcgagcattaaacatttcagaaaggaaaactgatgtaaacaagaacttcagtttgtttggtttgatgaacagaacctgtactgttgggatgggaaaaagattgcttaacagatggctgaaacaacctctattagatgttaatgaaattaataaccgattagacatggttcaggcttttgtagaagacccagagcttcgtcagggactcaggcaacaacttaaaaggatatcagatattgatcgtctaacacatgctctccgaaagaaatcagctactctgcagcctgttgttaagctttaccagtcctgttgcagaatctcatacatcaagggcattcttgagcaatataatggccaattttccacattgataaggtcaaagtttcttgaaccattagaagaatggatggcagaggatcgatttggtcggttttcttctcttgttgagacaactattgatcttggtcagctggagaatggagagtacagaatatctcctctatattcttctgacttgggtgtactaaaggatgagctttctgtggttgaaaatcacataaataatctgcacgtggatacagctagtgatctggatctttctgttgataagcaactgaagctagaaaagggacctcttggacatgtgttcagaatgtcaaagaaagaggagcagaaagtcaggaagaagctcactggcagctacttaatcatagaaactcgtaaagatggtgtaaagttcacaagttctaagctgaaaaagctaagtgatcaataccaggctctgtttgctgagtacacaagttgtcagaaaaaggtggttggtgatgtagtgagggtttcaggctcctactcggaggtatttgaaaattttgctgcagttctgtcggagttggatgttttacaaagttttgctgatttagcaactagttgcccagttccttatgttaggccagacatcacagtgtcggatgaaggagatattgttctactaggtagcagacatccttgtctagaggcacaagatggtgttaactttatacccaatgattgcactcttgtgagagggaaaagttggtttcagatcatcactgggccaaacatgggaggaaaatccacatttataagacaggttggtgtaaatgtcttgatggcgcaagttggttcctttgtaccttgtgatcaagcaagtgttagtgtgagagattgtatttttgctcgtgttggtgctggtgattgccaacttcatggtgtatcaacttttatgcaagaaatgcttgaaacagcatccatcctaaaaggcgcctctgataaatctcttataattattgatgagcttggacgtggaacttctacctatgatggatttggtcttgcatgggctatctgtgagcatcttatggaagtgactcgagcacctaccttgtttgccacccatttccatgaattaactgcattagcacataaaaatgatgatgagcaccaacgcgtttcaaatatcggaattgcaaattatcatgtgggtgctcacatagacccatcaagtcggaagttaactatgctttacaaggttgaacctggtgcatgcgaccaaagttttggcattcatgttgcagaatttgctaattttccagaagctgttgttgcccttgcaaagagcaaagcagcagagttagaagacttctctactacacctaccttttctgatgattcaaaagacgaggttggatcaaagcgcaagagggtatttagcccagatgacgtcaccagaggagctgctcgggctcggcttttccttgaggatttcgctgcattgcctgtggatgagatggataggagcaaaatcgtggagatggtcaccaaaatgaaaagtgatttgcagaaagatgcggctgacaatccttggcttcagcagttcttctga

SEQ ID NO: 8344 - protein, 942 aa, Sorghum bicolor
  misc_feature: Ceres ANNOT ID no. 6087455
  misc_feature (617)..(863): Pfam Id: MutS_V Pfam Desc: MutS domain V
  misc_feature (293)..(612): Pfam Id: MutS_III Pfam Desc: MutS domain III
  misc_feature (144)..(286): Pfam Id: MutS_II Pfam Desc: MutS domain II
  misc_feature (470)..(567): Pfam Id: MutS_IV Pfam Desc: MutS family domain IV
  misc_feature (24)..(131): Pfam Id: MutS_I Pfam Desc: MutS domain I
  misc_feature (1)..(942): NCBI GI: 4775576 NCBI Desc: mus1 protein [zea mays]
  misc_feature (1)..(941): NCBI GI: 115462941 NCBI Desc: os05g0274200 [oryza sativa (japonica cultivar-group)]
  misc_feature (9)..(942): NCBI GI: 49615724 NCBI Desc: dna mismatch repair protein [petunia x hybrida]
  misc_feature (1)..(941): NCBI GI: 2522364 NCBI Desc: muts homolog 2 [arabidopsis thaliana]
  misc_feature (1)..(941): NCBI GI: 4139230 NCBI Desc: mismatch repair protein [arabidopsis thaliana]
MEGDDFTPEGGKLPEFKLDARQAQGFISFFKRLPQDPRAVRLFDRRDYYTAHGENATFIARTYYHTMSALRQLGSSSDGISSVSVSKAMFETIARNILLERTDCTLELYEGSGSNWRLTKSGTPGNIGSFEDLLFANNDMQDSPVIVALFPVCRESQLYVGLSFLDMTNRKLGLAEFPEDSRFTNVESALVALGCKECLLSEDCEKSIDLNPLRDAISNCNVLLTVKKKADFKSRDLAQDLGRIIRGSVEPVRDLLSQFDYALGPLGALLSYAELLADDTNYGNYTIEKYNLNCYMRLDSAAVRALNISERKTDVNKNFSLFGLMNRTCTVGMGKRLLNRWLKQPLLDVNEINNRLDMVQAFVEDPELRQGLRQQLKRISDIDRLTHALRKKSATLQPVVKLYQSCCRISYIKGILEQYNGQFSTLIRSKFLEPLEEWMAEDRFGRFSSLVETTIDLGQLENGEYRISPLYSSDLGVLKDELSVVENHINNLHVDTASDLDLSVDKQLKLEKGPLGHVFRMSKKEEQKVRKKLTGSYLIIETRKDGVKFTSSKLKKLSDQYQALFAEYTSCQKKVVGDVVRVSGSYSEVFENFAAVLSELDVLQSFADLATSCPVPYVRPDITVSDEGDIVLLGSRHPCLEAQDGVNFIPNDCTLVRGKSWFQIITGPNMGGKSTFIRQVGVNVLMAQVGSFVPCDQASVSVRDCIFARVGAGDCQLHGVSTFMQEMLETASILKGASDKSLIIIDELGRGTSTYDGFGLAWAICEHLMEVTRAPTLFATHFHELTALAHKNDDEHQRVSNIGIANYHVGAHIDPSSRKLTMLYKVEPGACDQSFGIHVAEFANFPEAVVALAKSKAAELEDFSTTPTFSDDSKDEVGSKRKRVFSPDDVTRGAARARLFLEDFAALPVDEMDRSKIVEMVTKMKSDLQKDAADNPWLQQFF

SEQ ID NO: 8345 - DNA, 1911 bp, Sorghum bicolor
  misc_feature: Ceres ANNOT ID no. 6087466
  misc_feature: Encodes the peptide sequence at SEQ ID NO 8346
atggcgagtcggggccggcctcggccgggctcgctccaggacctcgccgccgccgccatcgccatcctcctcctgtccgccgcgtccggggccgccgctggatcccccgatcggcccgcgccggggccgccgctgttcctcccgctcacgcgctcgtaccccaacgccagccggctcgccgcctcgtcgaggcgcggcctcggcgacggggcgcaccccaacgcgcgcatgcgcctccacgacgatctcctcaccaacgggtactacacgacgaggctgtacatcgggacgcccccgcaggagttcgcgttgatcgttgactccgggagcaccgtcacctacgtgccctgcgcctcctgcgagcagtgcggcaaccaccaggatccacgatttcaacctgatctctccagttcatattcacctgtgaaatgcaacgtcgattgtacttgtgacagtgacaaaaaacagtgcacttatgagaggcagtatgctgaaatgagctccagcagtggggtgcttggtgaggacattgtgtcttttggcagagagagtgaacttaagccacagcgtgctgtttttggctgtgaaaattctgaaactggagatttgttcagtcagcatgctgatggtataatgggcctgggtcgtggtcaacttagcataatggatcagcttgttgaaaagggtgtcataagcgattcattctcattgtgctatggcggtatggatattggtggtggtgctatggtgcttggtggagtgcctgctccttctgacatggttttttcacattctgaccctctccgcagtccatattacaacattgagttaaaggaaatacatgttgctggaaaggcactgcgggtagattcaagggtctttaacagcaaacatgggactgttttggatagtgggaccacatatgcctatttgccagagcaagctttcgtggcttttaaagatgctgtgacaagtaaagtgcattctctcaagaaaattcgtggccctgatccaaattataaggatatctgctttgcaggtgctggaaggaacgtctcaaagctacatgaggtatttccagatgttgacatggtatttggaaatggacagaagctgtctcttacacctgaaaattatttattccgggtaggaggaattcactccaaagttgatggggcttattgcttgggtgtattccaaaatggtaaagatccaacaacactattaggaggcatcattgttcgtaatacacttgtgacctatgaccgtcacaatgaaaagattggcttttggaaaactaactgttcagagttgtgggagaggctacatatcagtgacgctccatcaccagccccttcaagtgatacaaattcagaaactgatatgtcacctgctcctgcccctagtagcttgccagagtttgatgttggtctcattaccgttgatatgtccataaatgttacttacccgaatctgaaacctcatctgcatgagttggccgagctgatagctaaagaactggagattgactctagtcaggttcgagttatgaatatcacgagccaaggaaattctactctgattagatggggtattttcccagcagaatctgataatgctatgtccaacgcaacagcaatgggtatcatctatcggttaactcagcatcatgttcagttgcctgaaaatcttggcagttatcaattgctcgagtggaatgtgcagcctttaccgagaaggtcatggtttcaagaacatgtagtctctatactgcttgggattttactagttgttttggtcactttgtcagcccttttagtagtacttgtttggagaaagaaatttagtggtcaaactgcctacagacctgttgattcagtggctcccgagcaagaactacagccactataa

SEQ ID NO: 8346 - protein, 636 aa, Sorghum bicolor
  misc_feature: Ceres ANNOT ID no. 6087466
  misc_feature (88)..(433): Pfam Id: Asp Pfam Desc: Eukaryotic aspartyl protease
  misc_feature (45)..(636): NCBI GI: 92883685 NCBI Desc: peptidase aspartic, active site [medicago truncatula]
  misc_feature (44)..(636): NCBI GI: 42568291 NCBI Desc: aspartyl protease family protein [arabidopsis thaliana]
  misc_feature (152)..(436): NCBI GI: 42569679 NCBI Desc: aspartyl protease family protein [arabidopsis thaliana]
  misc_feature (8)..(436): NCBI GI: 115440281 NCBI Desc: os01g0777200 [oryza sativa (japonica cultivar-group)]
  misc_feature (7)..(436): NCBI GI: 38344991 NCBI Desc: osjnba0008a08.5 [oryza sativa (japonica cultivar-group)]
MASRGRPRPGSLQDLAAAAIAILLLSAASGAAAGSPDRPAPGPPLFLPLTRSYPNASRLAASSRRGLGDGAHPNARMRLHDDLLTNGYYTTRLYIGTPPQEFALIVDSGSTVTYVPCASCEQCGNHQDPRFQPDLSSSYSPVKCNVDCTCDSDKKQCTYERQYAEMSSSSGVLGEDIVSFGRESELKPQRAVFGCENSETGDLFSQHADGIMGLGRGQLSIMDQLVEKGVISDSFSLCYGGMDIGGGAMVLGGVPAPSDMVFSHSDPLRSPYYNIELKEIHVAGKALRVDSRVFNSKHGTVLDSGTTYAYLPEQAFVAFKDAVTSKVHSLKKIRGPDPNYKDICFAGAGRNVSKLHEVFPDVDMVFGNGQKLSLTPENYLFRVGGIHSKVDGAYCLGVFQNGKDPTTLLGGIIVRNTLVTYDRHNEKIGFWKTNCSELWERLHISDAPSPAPSSDTNSETDMSPAPAPSSLPEFDVGLITVDMSINVTYPNLKPHLHELAELIAKELEIDSSQVRVMNITSQGNSTLIRWGIFPAESDNAMSNATAMGIIYRLTQHHVQLPENLGSYQLLEWNVQPLPRRSWFQEHVVSILLGILLVVLVTLSALLVVLVWRKKFSGQTAYRPVDSVAPEQELQPL

SEQ ID NO: 8347 - DNA, 687 bp, Sorghum bicolor
  misc_feature: Ceres ANNOT ID no. 6087468
  misc_feature: Encodes the peptide sequence at SEQ ID NO 8348
atggccggggagaagaagcagggcctgcagctgctggacttctgggtgagcccgttcgggcagcgctgccgcatcgcgctggacgagaagggcttgccctacgagtacctggaggaggacctactggccgggaacaagagcgagctcctgctccacgcaaacccggtccacaagaagatccccgtgctcctccacgacggccgccccgtctgcgagtccctcctcatcgtgcagtacctcgacgaggcgttcccggcggcgacgccgccgctgctccccgccgccggcgatccgtacgcgcgcgcgcaggcccggttctgggcggactacgtggacaagaagctctacgactgcggcacccggctgtggaagctcaagggggacggccacgcgcaggcgcgcacggagatggtcgagatcctccgcacgctggagggcgcgctcggcgacggcgaattcttcggcggggaggcgttcgggttcgtcgacgtcgcgctcgtgccgttcacgtcgtggttcctcgcctacgagcggttcggggacctcagcgtggagaaggagtgccccaggctcgccgcgtgggccaagcgatgcgcggaacggcctagcgtcgccaagaacctgtactcgtcggagaaggtctacgagttcatctgcgggttgaagaagaggttcggcatcgagtag

SEQ ID NO: 8348 - protein, 228 aa, Sorghum bicolor
  misc_feature: Ceres ANNOT ID no. 6087468
  misc_feature (7)..(82): Pfam Id: GST_N Pfam Desc: Glutathione S-transferase, N-terminal domain
  misc_feature (106)..(202): Pfam Id: GST_C Pfam Desc: Glutathione S-transferase, C-terminal domain
  misc_feature (1)..(228): NCBI GI: 2288969 NCBI Desc: glutathione transferase [zea mays]
  misc_feature (1)..(228): NCBI GI: 6683765 NCBI Desc: glutathione-s-transferase [hordeum vulgare]
  misc_feature (1)..(228): NCBI GI: 75674128 NCBI Desc: glutathione-s-transferase [hordeum vulgare]
  misc_feature (1)..(228): NCBI GI: 20067419 NCBI Desc: glutathione transferase [triticum aestivum]
  misc_feature (1)..(228): NCBI GI: 20067417 NCBI Desc: glutathione transferase [triticum aestivum]
  misc_feature (11)..(223): SWISSPROT Homolog: EC 4.4.1.5 Lactoylglutathione lyase
  misc_feature: Useful for making plants with modulated drought sensitivity
  misc_feature: Functional homolog of the protein sequence given in SEQ ID NO 13370
MAGEKKQGLQLLDFWVSPFGQRCRIALDEKGLPYEYLEEDLLAGNKSELLLHANPVHKKIPVLLHDGRPVCESLLIVQYLDEAFPAATPPLLPAAGDPYARAQARFWADYVDKKLYDCGTRLWKLKGDGHAQARTEMVEILRTLEGALGDGEFFGGEAFGFVDVALVPFTSWFLAYERFGDLSVEKECPRLAAWAKRCAERPSVAKNLYSSEKVYEFICGLKKRFGIE

SEQ ID NO: 8349 - DNA, 2520 bp, Sorghum bicolor
  misc_feature: Ceres ANNOT ID no. 6088373
  misc_feature: Encodes the peptide sequence at SEQ ID NO 8350
  misc_feature: Down-regulated in shoot tissues in response to salicylic acid treatment
atggcggcggctgcaccggcggccggcggcggcggtggtgcggaagcgggatgcggaggaggcggagggaaggacccgctgttcgtcgagctgtggaaggcctgcgcggggccgctgtctagcgtgccgccgctcggggagaaggtctactacttcccgcagggccacatcgagcaggtggaggcatcgacgaaccagattgctgagcagcagggcacgcccctctacaacctgccatggaagattccatgcaagctcatgaacatcgagctgaaggctgagccggatactgatgaggtgtacgcccagctcaccctgctccctgataagaagcaagatgagaatacatctacaacagtggagaatgaggaggcagaggaggaggtggtgcctcatgcgccaccaacaaatgagggacctcggatccattccttttgcaagacattgactgcctcagacacaagcacgcatggtggtttctcagtgttgcgccggcatgcagatgagtgcctcccaccattggatatgagtcaacaccccccaaatcaagaattggtggccaaggacctgcatgggattgagtggcggttccgtcacatctttcgaggtcagccacggagacacctccttcagagtggttggagtgtttttgttagcgccaagcgtcttgttgcaggggatgccttcatatttctcagaggtgagaatggggagttacgtgttggggttcggcgtgcactgaggcaccaaaccactatcccatcttcagtcatatcaagccacagtatgcatcttggtgttcttgcgacagcatggcatgcagtcaacactgggagtatgttcactgtctactacaagccaaggactagtccagctgaatttgtggtctcgcgagataggtactatgaatcactgaaacgaaattattcaatagggatgagatttaagatgagatttgaaggtgaagaagcagcagagcaaagattcactggcacaatagttggaataggtgcttctgatccatctggttgggctgactcaaaatggcgttcccttaaggtgagatgggatgaagcttcttctgttcctcgtcctgaaagagtttctccttggcaaatagaacctgctattagcccatctcctgtgaaccctcttccagtcagattcaagaggtctcgttcaagtgttaatgcttcaccatctgacgtgcctactgtatccagagaagttgcttctaaagtcatggcagagtcgcaacaaagtaatctcccaagggccttgcacaatcaaggaaggacacaattgacaggtcgataccatgatagcagtgatgtgaagactgctcaggatcttaccatgtggtcttcaggaactgagcagcagagaaacaatattgctgcccagacaaagcgaagtctggagggatggacgcaatctagaactcctgaaggttacaatcagctgttctcggcatttcaaccactgaaagatacacataatccactttgtactttccctagtcaaatatctgggactcgctcaaatacctgggacacagccgatgctcgttatccagcccaacaagccaatcacaacatgttacatggcacatggccttttatgcctcatagcagtggttttaggacgaatcaacagaattatctagtgatgcctgaagctgcaaagtttactgggaaatcagctttcacttcacttcagggccatggcactgatcagtgctccacaggctggtttggacatattgagtcaagttcccgcacagaccatgcatcgtcaagttcgatcaggccccagcctttggttattggtaatgatgttcagaaaaccaaaggcacttcattcaaactatttgggattcctcttggcagcccggaaaaatctgaacctctggtatccccaccaagtgtcgcatatgacgggaaacttcaaacttctccatcagaaaaagggaatcagctagacatagttggagtggataattgttctgatccttcgaagactgtgaagccatttgatggtcctcaatcagattcgattacagagaataatcagccttgtccagaagctacccagaatattcagaacaaagtgcaaagtagttccaccagaagctgcaagaaggtccataagcaaggcagtgccctcggcagatcgattgatctaacaaagttcacttgctacgatgagctgattgctgaactggatcagatgtttgactttgatggtgagctgaagaatccatgcaaaaattggctggttgtctacactgacaatgaaggcgatataatgctggttggcgatgacccctggaatgaattctgcgacatggtccacaagatcttcatctacacaagggaggaagtggaaaggatgaacccaggtgccctaaactcaaggtccgaggatagtctgtctgactcgcagggaagagggttggcttccaaagagccgccccgaggtggcccgtctacttcgactcccaattccgagagctgctaa

SEQ ID NO: 8350 - protein, 839 aa, Sorghum bicolor
  misc_feature: Ceres ANNOT ID no. 6088373
  misc_feature (271)..(353): Pfam Id: Auxin_resp Pfam Desc: Auxin response factor
  misc_feature (144)..(249): Pfam Id: B3 Pfam Desc: B3 DNA binding domain
  misc_feature (619)..(802): Pfam Id: AUX_IAA Pfam Desc: AUX/IAA family
  misc_feature (3)..(839): NCBI GI: 23893346 NCBI Desc: auxin response factor 1 [oryza sativa (japonica cultivar-group)]
  misc_feature (12)..(816): NCBI GI: 85069279 NCBI Desc: auxin response factor 2 [lycopersicon esculentum]
  misc_feature (27)..(839): NCBI GI: 30027167 NCBI Desc: auxin response factor-like protein [mangifera indica]
  misc_feature (27)..(833): NCBI GI: 62319903 NCBI Desc: arf1-binding protein [arabidopsis thaliana]
  misc_feature (25)..(816): NCBI GI: 19352039 NCBI Desc: auxin response factor 2 [oryza sativa]
  misc_feature: The sequence is a functional homolog of SEQ ID NO 108 in the 10/225,066US patent application
  misc_feature: The sequence is a functional homolog of SEQ ID NO 296 in the 10/412,699US patent application
  misc_feature: The sequence is a functional homolog of SEQ ID NO 692 in the 11/479,226US patent application
  misc_feature: The sequence is a functional homolog of SEQ ID NO 84 in the 10/374,780US patent application
  misc_feature: Useful for making plants with altered tocopherol content
  misc_feature: Useful for making plants with modulated growth and phenotype characteristics
  misc_feature: Functional homolog of the protein sequence given in SEQ ID NO 13376
  misc_feature: The sequence is a functional homolog of SEQ ID NO 296 in the 20040045049 US patent application
  misc_feature: Useful for making plants with modulated biomass
  misc_feature: Useful for making plants with modulated seed size
  misc_feature: Functional homolog of the protein sequence given in SEQ ID NO 13377
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 298 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Down-regulated in shoot tissues in response to salicylic acid treatment
MAAAAPAAGGGGGAEAGCGGGGGKDPLFVELWKACAGPLSSVPPLGEKVYYFPQGHIEQVEASTNQIAEQQGTPLYNLPWKIPCKLMNIELKAEPDTDEVYAQLTLLPDKKQDENTSTTVENEEAEEEVVPHAPPTNEGPRIHSFCKTLTASDTSTHGGFSVLRRHADECLPPLDMSQHPPNQELVAKDLHGIEWRFRHIFRGQPRRHLLQSGWSVFVSAKRLVAGDAFIFLRGENGELRVGVRRALRHQTTIPSSVISSHSMHLGVLATAWHAVNTGSMFTVYYKPRTSPAEFVVSRDRYYESLKRNYSIGMRFKMRFEGEEAAEQRFTGTIVGIGASDPSGWADSKWRSLKVRWDEASSVPRPERVSPWQIEPAISPSPVNPLPVRFKRSRSSVNASPSDVPTVSREVASKVMAESQQSNLPRALHNQGRTQLTGRYHDSSDVKTAQDLTMWSSGTEQQRNNIAAQTKRSLEGWTQSRTPEGYNQLFSAFQPLKDTHNPLCTFPSQISGTRSNTWDTADARYPAQQANHNMLHGTWPFMPHSSGFRTNQQNYLVMPEAAKFTGKSAFTSLQGHGTDQCSTGWFGHIESSSRTDHASSSSIRPQPLVIGNDVQKTKGTSFKLFGIPLGSPEKSEPLVSPPSVAYDGKLQTSPSEKGNQLDIVGVDNCSDPSKTVKPFDGPQSDSITENNQPCPEATQNIQNKVQSSSTRSCKKVHKQGSALGRSIDLTKFTCYDELIAELDQMFDFDGELKNPCKNWLVVYTDNEGDIMLVGDDPWNEFCDMVHKIFIYTREEVERMNPGALNSRSEDSLSDSQGRGLASKEPPRGGPSTSTPNSESC

SEQ ID NO: 8351 - DNA, 1788 bp, Sorghum bicolor
  misc_feature: Ceres ANNOT ID no. 6088922
  misc_feature: Encodes the peptide sequence at SEQ ID NO 8352
atggtgtcggaggccagcaagaagaaggccgctcagaagaaggccgccgcggccgcgaagaggggaggcaaggccgcggtggcgtcctcatcgtcttcatctgcggccgcggccgccgataaggcggcgaacggcgtcgcggcgctcaaactatcagaccgcacctgcaccggggtcctcgcgtctcacccgctctcccgcgatatccacatagagtctctttctttaacattccatgggcatgaccttattgtggattctgagttggagctgaactatggaaggcgatacggtttgcttgggttgaatggctgtgggaaatctactcttctcacagcaataggctgcagagaacttcctatccctgaacacatggacatataccatctaagccatgagattgaagcttctgacatgtctgcactgcaagccgttgttacttgtgacgaagaaagagtaaagttggaaaaggaagctgaaattttggctgcacaggatgatggtggtggcgaagcactggatcgtgtttatgagcgtctagatgcaatggatgctggaactgcagaaaagcgagctgctgaaatattattcggtctgggttttaacaaagaaatgcaggcaaagaaaactaaagatttctctggaggttggcgtatgaggattgctttggcgagagcactgtttatgaatccaacaatccttttgcttgatgagccaacaaaccatctagatcttgaagcttgtgtctggttggaagagacactaaagaaatttgaccgcatacttgttgtcatatcacactctcaagattttctaaacggagtgtgcactaacattatccatatgcaaagcaagaagctcaagttatacaccggtaactacgatcagtatgttcaaactcgctccgagcttgaagagaatcaaatgaagcagtacaaatgggagcaggaacagattgcatcaatgaaggagtacattgctcgtttcggtcatggttctgcaaagcttgctcgccaggctcagagcaaagagaaaactcttgcaaagatggagcgaggtggtctcactgagaaggttgttagggacagagttctagtgttccggtttacagatgttggcaagcttcctccgcccgtgctgcagtttgttgaagtcaagtttgggtatacaccagataatctcatatacaagagtctggactttggtgttgatcttgactctagaatcgcattggttggtcccaatggggcagggaagagcactcttctgaagcttatgactggtgatcttgttccattagatggcatggttcggcgccataatcacctgcgcattgcacagtaccatcagcatctggcggagaagctggatctggacatgccagccctggcttacatgatgaaggaataccctgggactgaagaagagaagatgcgagctgctgttggcaggtttggcctgtcaggaaaggcgcaggtgatgccgatgaagaatctttctgatgggcaaaggagccgtgtcatctttgcatggctggcatataggcagccgcaactgctactgctcgatgagccgacaaaccatctggatattgagaccattgactccctggccgaggcactgaatgagtgggatggtggtttggttctagtgagccatgatttcaggctgatcaaccaggttgctcaagagatctgggtgtgtgagaatcaggcggtgacaaggtgggaaggtgatatcatggatttcaaggcacacttgaagagcaaggctggtttatctgattag

SEQ ID NO: 8352 - protein, 595 aa, Sorghum bicolor
  misc_feature: Ceres ANNOT ID no. 6088922
  misc_feature (94)..(285): Pfam Id: ABC_tran Pfam Desc: ABC transporter
  misc_feature (406)..(571): Pfam Id: ABC_tran Pfam Desc: ABC transporter
  misc_feature (1)..(593): NCBI GI: 45775249 NCBI Desc: atp-binding cassette transporter [pteris vittata]
  misc_feature (1)..(546): NCBI GI: 7573600 NCBI Desc: abc transporter homolog [populus nigra]
  misc_feature (1)..(590): NCBI GI: 42542861 NCBI Desc: abcf2 protein [danio rerio]
  misc_feature (1)..(592): NCBI GI: 28436765 NCBI Desc: abcf2-prov protein [xenopus laevis]
  misc_feature (1)..(590): NCBI GI: 10179836 NCBI Desc: iron inhibited abc transporter 1 [homo sapiens]
MVSEASKKKAAQKKAAAAAKRGGKAAVASSSSSSAAAAADKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVTCDEERVKLEKEAEILAAQDDGGGEALDRVYERLDAMDAGTAEKRAAEILFGLGFNKEMQAKKTKDFSGGWRMRIALARALFMNPTILLLDEPTNHLDLEACVWLEETLKKFDRILVVISHSQDFLNGVCTNIIHMQSKKLKLYTGNYDQYVQTRSELEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLVPLDGMVRRHNHLRIAQYHQHLAEKLDLDMPALAYMMKEYPGTEEEKMRAAVGRFGLSGKAQVMPMKNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 8353 - DNA, 1767 bp, Sorghum bicolor
  misc_feature: Ceres ANNOT ID no. 6089716
  misc_feature: Encodes the peptide sequence at SEQ ID NO 8354
atgagggatggcggcggcaacagcaagatgagcaagctgtcatggtccaagagcctggtgaggaagtggttcaacatcaggggcaagtcccatgacttccatgccgatgctgcagcagttggaactgggagtgggaggtcaggtggaggggatgatgattggagggatggcagcttcacgaggagggactcgtacgccgccaagaagagcagaacagagcgggcgtcgcggaggagccacgagcggtcgcggcgcagcaagatcgacctcgacgccgccgaggccaccgtcatgctcgactacaggatctttgctgctacgtggaatgtaggtggccgcgcgccgccggggtcgctcagcctcgacgactggctccgcacctcgccgccggccgacatctacgtcctcgggttccaagaaatcgtcccgttgaacgccgggaacgtcctcggcgccgaggacaacgggcccgcgaggaagtgggtgtcgctggtcaggcggacgctcaacagcctgccaggaagtggcggtagcgggagcctgcagacgccgtcgccggcgccgtacctggtggcggagatggacgcggacttcgagcggtcgacgcgaaacgacccgtccttcttccaccggcggtcgttccagtctgggctcagccggagcatgcgggtggacggcgacatcctcgccggccccggtcccgccaggctcgagcgccggtacagcgtcaacgaccgcgtgatgtacggtagcaggcccagcgactatgaggccaactgccgctggggcggcggcggcggcggtcagtcagacgacgaagatgaccatgttggcggcggcgagtcgccgatcacggtgttctctccgatgtcgcatggatacggaaatgctcagcccatggaagaatgcagcggatcagcccgtggccctgctaggtactgccttgttgcaagcaagcagatggttggattgttcctgatgatttgggctcggaaggagatgaagaatgacattagaaatctgaaggtgtcctgtgttgggaggggattaatgggctaccttggaaataagggttcaatttccatcagcatggttttgcaccaaacaagtttctgctttgtctgcagtcatctgacatcgggtcaaaaggacggtgacgagcaccgcaggaactctgatgttatggaaatcctaaggaagaccagattccctagagtttgtggacagtatgagagatcaccggaaactatcctggagcatgatcggataatctggcttggggatctcaattaccggattgcactttcctacagatcagtgaaagcgcttgtggagatgcgtaactggaaagcattgctggaaaaagatcagctgacaagggagcaaagaggtggtcgtgtatttgctggatggaatgaggggagaatatacttcccaccaacctataaatactccaacaattctgacaaatacgcaggagacgacatgaaccagaaggagaagaagcgaactccagcatggtgtgaccgcattttgtggtatgggaggggccttagccaactctcatatgttcgtggagagtctcgtttctcggaccacagacctgtctacagcatgttcattgcagaagtggaatcgatcaatcacacccaaattcagaagatgagttcttggagctcccagctggacatagaagaattgctgccctactcatatggatacactgaaattgatcattatgggtatactgacctcaatttctactga

SEQ ID NO: 8354 - protein, 588 aa, Sorghum bicolor
  misc_feature: Ceres ANNOT ID no. 6089716
  misc_feature (103)..(540): Pfam Id: Exo_endo_phos Pfam Desc: Endonuclease/Exonuclease/phosphatase family
  misc_feature (219)..(578): NCBI GI: 7523406 NCBI Desc: inositol-1, 4, 5-trisphosphate 5-phosphatase-like protein [arabidopsis thaliana]
  misc_feature (48)..(588): NCBI GI: 92883941 NCBI Desc: inositol polyphosphate related phosphatase [medicago truncatula]
  misc_feature (49)..(302): NCBI GI: 115450875 NCBI Desc: os03g0160600 [oryza sativa (japonica cultivar-group)]
  misc_feature (196)..(580): NCBI GI: 15220522 NCBI Desc: endonuclease/exonuclease/phosphatase family protein [arabidopsis thaliana]
  misc_feature (196)..(580): NCBI GI: 8778727 NCBI Desc: t25n20.12 [arabidopsis thaliana]
  misc_feature (196)..(580): SWISSPROT Homolog: EC 3.1.3.56 Type I inositol-1,4,5-trisphosphate 5-phosphatase CVP2
MRDGGGNSKMSKLSWSKSLVRKWFNIRGKSHDFHADAAAVGTGSGRSGGGDDDWRDGSFTRRDSYAAKKSRTERASRRSHERSRRSKIDLDAAEATVMLDYRIFAATWNVGGRAPPGSLSLDDWLRTSPPADIYVLGFQEIVPLNAGNVLGAEDNGPARKWVSLVRRTLNSLPGSGGSGSLQTPSPAPYLVAEMDADFERSTRNDPSFFHRRSFQSGLSRSMRVDGDILAGPGPARLERRYSVNDRVMYGSRPSDYEANCRWGGGGGGQSDDEDDHVGGGESPITVFSPMSHGYGNAQPMEECSGSARGPARYCLVASKQMVGLFLMIWARKEMKNDIRNLKVSCVGRGLMGYLGNKGSISISMVLHQTSFCFVCSHLTSGQKDGDEHRRNSDVMEILRKTRFPRVCGQYERSPETILEHDRIIWLGDLNYRIALSYRSVKALVEMRNWKALLEKDQLTREQRGGRVFAGWNEGRIYFPPTYKYSNNSDKYAGDDMNQKEKKRTPAWCDRILWYGRGLSQLSYVRGESRFSDHRPVYSMFIAEVESINHTQIQKMSSWSSQLDIEELLPYSYGYTEIDHYGYTDLNFY

SEQ ID NO: 8355 - DNA, 1425 bp, Sorghum bicolor
  misc_feature: Ceres ANNOT ID no. 6089726
  misc_feature: Encodes the peptide sequence at SEQ ID NO 8356
atggggaaggcggggcggtggctcaggagcatcttggcggggaggaaggacaaggccaaggcgctgcagccgtatccgcagcagcaaggcgacgccacgccgctcccggccgccgccgccgcgagcagcccccgggagaagaagcgctggagcttcaggcggcccgcgcagcagggcaaggtcaatagtaacacggcgccgtccccgctgtcgtcgtcgctggagccgtcggcgcgcgagctcgaccagagcgagcacgccgtggcggtggccgtggccgcggcggcggccgccgacgccgccgtcatggctgccgccgaggctgctgccgcggtggtccgtctgacggtgacggctgcggaggacagccatctgtccgtgacctgctgccccgtcgaggccgccgccgccaggatcatccaggccaccttcagaggctatctggctcggaaggcgctgtgcgcgctgcgcgggctggtgaagctgcaggcgctggtcagaggccagctggtgcggaggcaggccaccgccacgctccgccgcatgcaggccctcgtcgacgcgcagtcccgcctgcgcgcccagcgcgcgcgcatgctcgacgcagaccacgccacggcgccgccggcagcctaccagccacgccggtcaccgcagcatcccattccaattccaaggcgccgcagctcctacgaggtgatggaccggtcgtcgggggaggagcacgtgaagatcgtggagatggacgtcggcgagccggcgcggcgcgggcggagcagctgctcagcggcggccaccgagtccagggagcggcgcctcgccgagtactaccacggcggaagcggcggcggcggcgttgggcagtgctcgcccgcgccgtcgtccgcggcgttcttcggcgccgagctcagcccgccgcgcacctacagcggccacttcgacgacgtgttcgcgttcgaccccgcggcgacggcgcggagcagcccgtacgtggccccctacgacgacgccgccgacgggtacggcggcgtcgacgtcccgagctacatggccaacaccgagtcgtcccgcgccaaggcccggtcccagagcgcgccaaggcagcgcaccgacgcggcggcgctggagcggcagcccagcagcaggcgccgcggcggccagggcggcggtgcgcccaggaagatgatgcagcggtcgtcgtcgcacatcggcgtgccggcggcggcggccgcgtgcgggtacggctacgggtacggctacggctaccagcatgcgcagccatgggcgggcgtgaggctggaccggtccagcgcgtcggtggtgggcagcgagtgcgggtccaccagctccgtgctcaccgccgccaccgtcggctactgccgctcgctcgtcggattcgagccaggcgagaagcgagatgtgtaa

SEQ ID NO: 8356 - protein, 474 aa, Sorghum bicolor
  misc_feature: Ceres ANNOT ID no. 6089726
  misc_feature (134)..(154): Pfam Id: IQ Pfam Desc: IQ calmodulin-binding motif
  misc_feature (1)..(253): NCBI GI: 115482058 NCBI Desc: os10g0420200 [oryza sativa (japonica cultivar-group)]
  misc_feature (290)..(458): NCBI GI: 30682982 NCBI Desc: calmodulin-binding family protein [arabidopsis thaliana]
  misc_feature (30)..(249): NCBI GI: 92881543 NCBI Desc: iq calmodulin-binding region [medicago truncatula]
  misc_feature (70)..(251): NCBI GI: 145348380 NCBI Desc: iqd25 (iq-domain 25); calmodulin binding [arabidopsis thaliana]
  misc_feature (117)..(387): NCBI GI: 115464961 NCBI Desc: os05g0521900 [oryza sativa (japonica cultivar-group)]
MGKAGRWLRSILAGRKDKAKALQPYPQQQGDATPLPAAAAASSPREKKRWSFRRPAQQGKVNSNTAPSPLSSSLEPSARELDQSEHAVAVAVAAAAAADAAVMAAAEAAAAVVRLTVTAAEDSHLSVTCCPVEAAAARIIQATFRGYLARKALCALRGLVKLQALVRGQLVRRQATATLRRMQALVDAQSRLRAQRARMLDADHATAPPAAYQPRRSPQHPIPIPRRRSSYEVMDRSSGEEHVKIVEMDVGEPARRGRSSCSAAATESRERRLAEYYHGGSGGGGVGQCSPAPSSAAFFGAELSPPRTYSGHFDDVFAFDPAATARSSPYVAPYDDAADGYGGVDVPSYMANTESSRAKARSQSAPRQRTDAAALERQPSSRRRGGQGGGAPRKMMQRSSSHIGVPAAAAACGYGYGYGYGYQHAQPWAGVRLDRSSASVVGSECGSTSSVLTAATVGYCRSLVGFEPGEKRDV

SEQ ID NO: 8357 - DNA, 870 bp, Sorghum bicolor
  misc_feature: Ceres ANNOT ID no. 6089728
  misc_feature: Encodes the peptide sequence at SEQ ID NO 8358
atggaggtcacgacgacccaagacgcggcggccgccgcggagcaggagaggcagagggccccctcggcgctggccttcagaagccttgccgagtacgccaccggtgctatcccaaccctcttctacgtccccgacttcatctcccactccgagcaatcccagctcctccacaacatttatcaggcaccggcgcccaagtggaaaaccctcaagaaccggaggctgcagaactggggaggagtggtgcatgagaaggggctcctgccgcagaccttacctccatggctaacaaggataaccgacagaatctgccagtggactggtttatttccttctgcaatcaatcatgtgctgataaatgagtatcatcctaaccaagggatcatgccacaccaagatggtcctgcctactaccctgttgttgctatcatatctcttgcttcacctgttgtgattgatttcacaccccatcaaaggcttaaagagcagcaggacactgatccacaggacttacaggcccatgagttgctggcgccagctgagacggagagcaatggcactggatcacatgaacgtggagccacaaatgaatctgatccttcatcttcatcacttatgctgatgccctgcagcctgttggtatttaaggatcaggcctatacagactacttgcatggcatacaagataatgagctacataatctggacaaggtcgagaatgtgtcgcagtgcccagaactgaagcatctacattcggactgtagtatgagcacggaagggcagcatggcacgtttcgcaggaccgccacaagagtctcgctgacgtgtcggttggtgctgaaagtccacaaaaagctatttaaaatctag

SEQ ID NO: 8358 - protein, 289 aa, Sorghum bicolor
  misc_feature: Ceres ANNOT ID no. 6089728
  misc_feature (5)..(223): NCBI GI: 115482056 NCBI Desc: os10g0420000 [oryza sativa (japonica cultivar-group)]
  misc_feature (27)..(288): NCBI GI: 92886711 NCBI Desc: picornavirus 2b protein [medicago truncatula]
  misc_feature (36)..(178): NCBI GI: 53292605 NCBI Desc: calpain, small subunit 1 [danio rerio]
  misc_feature (202)..(288): NCBI GI: 20334740 NCBI Desc: at4g20350/f9f13_6 [arabidopsis thaliana]
  misc_feature (38)..(177): NCBI GI: 85726418 NCBI Desc: cg6144-pa, isoform a [drosophila melanogaster]
MEVTTTQDAAAAAEQERQRAPSALAFRSLAEYATGAIPTLFYVPDFISHSEQSQLLHNIYQAPAPKWKTLKNRRLQNWGGVVHEKGLLPQTLPPWLTRITDRICQWTGLFPSAINHVLINEYHPNQGIMPHQDGPAYYPVVAIISLASPVVIDFTPHQRLKEQQDTDPQDLQAHELLAPAETESNGTGSHERGATNESDPSSSSLMLMPCSLLVFKDQAYTDYLHGIQDNELHNLDKVENVSQCPELKHLHSDCSMSTEGQHGTFRRTATRVSLTCRLVLKVHKKLFKI

SEQ ID NO: 8359 - DNA, 1128 bp, Sorghum bicolor
  misc_feature: Ceres ANNOT ID no. 6089780
  misc_feature: Encodes the peptide sequence at SEQ ID NO 8360
atgaacctcgcgtccacggtgctagtgttcctggcctacagcctgctgctccaccggtgcatgggcatggggtccgagaacgccggaggcgtgttcgatcaggggggccacggcgtcagcctcacccgcctcgacgaggccagcagggcgccgtcgaggtgcgccgtgcggccgccgcacccgtccggcgcggccagcctcccgccgaagccgctgctcgtcgccgcgccgcgcgaggccggggagtacccggtcctcctgttcctgcacggctacctcgccgtcaactccttctactcccagctgttccagcacgtcgcctcccatggcttcatcgtcgtcggacctcagctgtacaccatatccgggccggacaccaccgaggagatcaacgcagcggcggccgtcatcgactggctcgccaccgggctcccgtccactctgccacccggcgtccgcgcggacctaaccaaggtgtccgtctccggccacagccgcggcgggaaggtggcgttcgcgctggcgctcgggcgcgccaaggccaagctcgcgcttcctctcgtcgccctcgtcgccgtggaccccgtggacggcatgggcgtgggcaagcagacgccgccgccggtgctcacgggcaggaccacctcgctgcacgtgggggtccccgccatggtcatcggcacggggctcggcgagctgccccggggcccgctgctcccgccgtgcgcgccccggggcgtcagccacgcggccttcttcgacgagctggaccgcgcggcgccggcgtgccacctggtggccagggactacgggcacacggacatgatggacgacgacacgccgggcgccagggggatgctcacgcgcaccgtctgcaggagcggcggggccagggcgcccatgcgacggttcgtggccggcgccaccgtcgcgttcctcaacaagtgggtggccggggacgccgcggcgatggacggcatcaggacgcggccggaccaggcccccgtcgcgctgtccgtggtggagtttcgggatgagaaagcgatagaggatctgcaggcaccagccaggcagcccactcaggcaggaaccaaggtggaggggcggagcctgatgacggaggggtaa

SEQ ID NO: 8360 - protein, 375 aa, Sorghum bicolor
  misc_feature: Ceres ANNOT ID no. 6089780
  misc_feature (24)..(350): Pfam Id: Chlorophyllase Pfam Desc: Chlorophyllase
  misc_feature (23)..(347): NCBI GI: 24210535 NCBI Desc: chlorophyllase 2 [brassica oleracea]
  misc_feature (23)..(342): NCBI GI: 10177956 NCBI Desc: atclh2 [arabidopsis thaliana]
  misc_feature (31)..(355): NCBI GI: 31415500 NCBI Desc: chlorophyllase [ginkgo biloba]
  misc_feature (56)..(338): NCBI GI: 73920035 NCBI Desc: chlorophyllase [piper betle]
  misc_feature (56)..(338): NCBI GI: 90823104 NCBI Desc: chlorophyllase [piper betle]
MNLASTVLVFLAYSLLLHRCMGMGSENAGGVFDQGGHGVSLTRLDEASRAPSRCAVRPPHPSGAASLPPKPLLVAAPREAGEYPVLLFLHGYLAVNSFYSQLFQHVASHGFIVVGPQLYTISGPDTTEEINAAAAVIDWLATGLPSTLPPGVRADLTKVSVSGHSRGGKVAFALALGRAKAKLALPLVALVAVDPVDGMGVGKQTPPPVLTGRTTSLHVGVPAMVIGTGLGELPRGPLLPPCAPRGVSHAAFFDELDRAAPACHLVARDYGHTDMMDDDTPGARGMLTRTVCRSGGARAPMRRFVAGATVAFLNKWVAGDAAAMDGIRTRPDQAPVALSVVEFRDEKAIEDLQAPARQPTQAGTKVEGRSLMTEG

SEQ ID NO: 8361 - DNA, 549 bp, Sorghum bicolor
  misc_feature: Ceres ANNOT ID no. 6089786
  misc_feature: Encodes the peptide sequence at SEQ ID NO 8362
atggctccgcaggcgtgggtcgtggcggagaacggcgaggacctccaacgacccagggaattcgtgcctctttctgagctcgaagatgttggcgtgttgtattggcatttggaccctaagaaatctgaaagcgaggaggagctagcgaaaatccgcaaagacagaggatacagttacatggatcttattgagatatgtcccgacaaactggaaaactatgaggagaaggtgaagaacttcttccgtgagcacatgcatcctgacgaggagatccgctattgcttggagggcagtgggtactttgatgtccgtgacaaagatgacaagtggattcggatctggataaaggaaggagacatgatcatcctaccagctggaatttatcatcgattcacccttgacagtgccaaatacacgaagctcatgaggcttttcattggggtacctgtttggacagcatttaaccggcctcaggaggaccatccggcgaggcaggagtatgtcaagaatgtgagtgcgggcactggatttgctcttgcagcacactga

SEQ ID NO: 8362 - protein, 182 aa, Sorghum bicolor
  misc_feature: Ceres ANNOT ID no. 6089786
  misc_feature (4)..(153): Pfam Id: ARD Pfam Desc: ARD/ARD' family
  misc_feature (73)..(147): Pfam Id: Cupin_2 Pfam Desc: Cupin domain
  misc_feature (1)..(182): NCBI GI: 75232414 NCBI Desc: 1,2-dihydroxy-3-keto-5-methylthiopentene dioxygenase 4 (aci-reductone dioxygenase 4)
  misc_feature (1)..(182): NCBI GI: 21554849 NCBI Desc: submergence induced protein 2a [arabidopsis thaliana]
  misc_feature (4)..(170): NCBI GI: 37791221 NCBI Desc: ard-like protein [brassica juncea]
  misc_feature (4)..(169): NCBI GI: 115511406 NCBI Desc: acireductone dioxygenase [plantago major]
  misc_feature (4)..(171): NCBI GI: 3201969 NCBI Desc: submergence induced protein 2a [oryza sativa]
MAPQAWVVAENGEDLQRPREFVPLSELEDVGVLYWHLDPKKSESEEELAKIRKDRGYSYMDLIEICPDKLENYEEKVKNFFREHMHPDEEIRYCLEGSGYFDVRDKDDKWIRIWIKEGDMIILPAGIYHRFTLDSAKYTKLMRLFIGVPVWTAFNRPQEDHPARQEYVKNVSAGTGFALAAH

SEQ ID NO: 8363 - DNA, 588 bp, Sorghum bicolor
  misc_feature: Ceres ANNOT ID no. 6089787
  misc_feature: Encodes the peptide sequence at SEQ ID NO 8364
atggaggaggaggatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttga

SEQ ID NO: 8364 - protein, 195 aa, Sorghum bicolor
  misc_feature: Ceres ANNOT ID no. 6089787
  misc_feature (12)..(166): Pfam Id: ARD Pfam Desc: ARD/ARD' family
  misc_feature (4)..(195): NCBI GI: 61807497 NCBI Desc: aci-reductone dioxygenase-like protein [oryza sativa (japonica cultivar-group)]
  misc_feature (4)..(195): NCBI GI: 3201969 NCBI Desc: submergence induced protein 2a [oryza sativa]
  misc_feature (2)..(193): NCBI GI: 2952338 NCBI Desc: submergence induced protein 2 [oryza sativa]
  misc_feature (2)..(195): NCBI GI: 14522834 NCBI Desc: iron-deficiency induced gene [hordeum vulgare]
  misc_feature (2)..(193): NCBI GI: 88909689 NCBI Desc: 1,2-dihydroxy-3-keto-5-methylthiopentene dioxygenase 1 (aci-reductone dioxygenase 1) (submergence-induced protein 2)
MEEEDGKQEVIEAWYMDDSEEDQRLPHHRDPKEFIPLDKLSELGIISWRLNPDNWENDENLKKIREARGYSYMDICDVCPEKLPNYEIKIKNFFEEHLHTDEEIRYCLEGSGYFDVRDENDQWIRVAVKKGGMIVLPAGMYHRFTLDNENYIKAMRLFVGEPVWTPYNRPHDHLPARKEYLDKLLKPEGQAVEAR

SEQ ID NO: 8365 - DNA, 1287 bp, Sorghum bicolor
  misc_feature: Ceres ANNOT ID no. 6089791
  misc_feature: Encodes the peptide sequence at SEQ ID NO 8366
atgatgatgatgctctctgatctctcgtctgagcacgagcacgaggccactggatccagctcctatggaggggacatggccagctacgccctcagccctctcttcctcgcaccggcggcgtcggccaccaccgtgctgccgccggcacctcctcatcagcagccggcggaggaggagcccaacaaggcggcggggaccaagaggaagagaagccagcccggcaacccagaccccggcgctgaggtgatcgcgctgtcgccgcgcacgctggtggcgacgaaccggttcgtgtgcgagatctgcaacaaggggttccagcgggaccagaacctgcagctgcaccgccgcggccacaacctcccctggaagctccgccatcgcagcagcctcccgtccggcagctccggcgccaggcagcagggtggtgaggcggcggcgccgcgcaagcgcgtgtacgtctgcccggagccaacgtgcgtgcaccacgacccagcgagagctctgggggatttgactgggatcaagaagcacttctcccggaagcacggggagaagcggtggcgctgcgagcgctgcgggaagcgctacgccgtgcagtcggactggaaggcgcacgtcaaggggtgcggcacgcgcgagtatcgctgcgactgcggcatcctcttctccaggaaggacagcctgctcacgcacagggccttttgtgatgccctagcagaggagagcgcaaggcttcttgcagcagcaaacaacagcagcactatcagtatcaccaccacaaccagcagcagcaacaatgatcttctaaacaccaacaatatcgcaccattattcctcccgttctccaactctcctcctgtcgttgcagcacaacaaaaccctaacaacaccctcttcttcctgcaccaagagctgtctcccttcctgcagccgaggatgatgatgcaacaaccctcgccctatcttgacctccatatgcatgtagacgccagcatcaccaccaccaccaccaccggtggtggcggcatcctcacggactcgccggttctcagctttggtctcgctacggacggctccgtggccaccgtcggccaccggcgcctcacaagggacttcctcggcgtcgatggtggcggtcatcaggtagaggagctgccgcagcttccactgtgcgccacagcagctgctgccagccgcaccgccagctgcgccaccgacctgacagcaaggcagtacctcggcggtcggctgccgccggtcaacgagacatggagccacaacttctag

SEQ ID NO: 8366 - protein, 428 aa, Sorghum bicolor
  misc_feature: Ceres ANNOT ID no. 6089791
  misc_feature (96)..(118): Pfam Id: zf-C2H2 Pfam Desc: Zinc finger, C2H2 type
  misc_feature (2)..(428): NCBI GI: 3170601 NCBI Desc: zinc finger protein id1 [zea mays]
  misc_feature (56)..(347): NCBI GI: 31432121 NCBI Desc: contains similarity to zinc finger protein id1 [oryza sativa (japonica cultivar-group)]
  misc_feature (66)..(369): NCBI GI: 140070279 NCBI Desc: zinc finger, c2h2-type [medicago truncatula]
  misc_feature (50)..(327): NCBI GI: 92870471 NCBI Desc: zinc finger, c2h2-type [medicago truncatula]
  misc_feature (54)..(304): NCBI GI: 92875502 NCBI Desc: zinc finger, c2h2-type [medicago truncatula]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: The sequence is a functional homolog of SEQ ID NO. 455 in the 11/188,298 US application
MMMMLSDLSSEHEHEATGSSSYGGDMASYALSPLFLAPAASATTVLPPAPPHQQPAEEEPNKAAGTKRKRSQPGNPDPGAEVIALSPRTLVATNRFVCEICNKGFQRDQNLQLHRRGHNLPWKLRHRSSLPSGSSGARQQGGEAAAPRKRVYVCPEPTCVHHDPARALGDLTGIKKHFSRKHGEKRWRCERCGKRYAVQSDWKAHVKGCGTREYRCDCGILFSRKDSLLTHRAFCDALAEESARLLAAANNSSTISITTTTSSSNNDLLNTNNIAPLFLPFSNSPPVVAAQQNPNNTLFFLHQELSPFLQPRMMMQQPSPYLDLHMHVDASITTTTTTGGGGILTDSPVLSFGLATDGSVATVGHRRLTRDFLGVDGGGHQVEELPQLPLCATAAAASRTASCATDLTARQYLGGRLPPVNETWSHNF

SEQ ID NO: 8367 - DNA, 654 bp, Sorghum bicolor
  misc_feature: Ceres ANNOT ID no. 6089794
  misc_feature: Encodes the peptide sequence at SEQ ID NO 8368
atggccacgtcgatcaagtcgctggaagctctggccttgatggcgctcgccgtgttcgccaaggccgccgtcgctgcaggcgatgcgtcgtcgtcctgccccaagctcaccctccacaacctctgtccatacccggtctggccgctcgtcaccgccaacgctgggtacccctccgtcaccggcaccgacgcccgcctcgacgggaacggcgagggcctggtgaccatggcgctgccgcaaggcgtgtggtcgggccgcgtggtggcgcgcacggggtgcgctgacgacgactgctctccgaagtgcgagaccggcgacgcgccgccggcgacggtggcgcaggtgagcgtgggtgggtacggcgggctggcggcgtacagcgtgagcctggtggacgggttcaacgtgcccatggtggtgacgccgcacaacttcgcggcgggggcgcagtgcccgacgctggggtgcgccgtggacctcacccaggaccaggagtgctgccccggcacgcaagcggcgctgttcaaggccaagtgtcccgacacgaggacaacctccacggacgtcgaggcaacgccgcaggactgcatcgcgcccggtgagctcaaggtcgtcttctgcccggcacaggactgcacggccagttgtaactag

SEQ ID NO: 8368 - protein, 217 aa, Sorghum bicolor
  misc_feature: Ceres ANNOT ID no. 6089794
  misc_feature (40)..(208): Pfam Id: Thaumatin Pfam Desc: Thaumatin family
  misc_feature (14)..(207): NCBI GI: 77556850 NCBI Desc: thaumatin/pr5-like protein [oryza sativa (japonica cultivar-group)]
  misc_feature (14)..(208): NCBI GI: 62733228 NCBI Desc: osmotin protein homolog - rice (fragment) [oryza sativa (japonica cultivar-group)]
  misc_feature (11)..(168): NCBI GI: 5823278 NCBI Desc: osmotin-like protein [benincasa hispida]
  misc_feature (7)..(168): NCBI GI: 27373045 NCBI Desc: thaumatin-like cytokinin-binding protein [brassica oleracea]
  misc_feature (36)..(168): NCBI GI: 2501182 NCBI Desc: osmotin-like protein precursor
MATSIKSLEALALMALAVFAKAAVAAGDASSSCPKLTLHNLCPYPVWPLVTANAGYPSVTGTDARLDGNGEGLVTMALPQGVWSGRVVARTGCADDDCSPKCETGDAPPATVAQVSVGGYGGLAAYSVSLVDGFNVPMVVTPHNFAAGAQCPTLGCAVDLTQDQECCPGTQAALFKAKCPDTRTTSTDVEATPQDCIAPGELKVVFCPAQDCTASCN

SEQ ID NO: 8369 - DNA, 660 bp, Sorghum bicolor
  misc_feature: Ceres ANNOT ID no. 6089858
  misc_feature: Encodes the peptide sequence at SEQ ID NO 8370
atggccgcgctggggatgagcggaggcgcgattggggtgggtgccggaggaggtggcgcggcagcggttgtggacgcggcgcggccggtggacctcgccaggcacccctctggcatcgtccctgccctccagaacattgtctcaacagtcaatttagactgccagttggatctgaaaatgatcgccctacaggcgcgtaatgcagagtacaatccaaagcgttttgctgcagtcatcatgaggataagggaaccaaaaacaacagcgctagtctttgcttctgggaagatggtttgcactggagcaaagagcgaggaacattcaaagcttgctgcaaggaagtatgcgcgaattgtccagaagcttggatacccagccaagttcaaggatttcaagatccagaatatggttggctcgtgtgatgtgaaatttccaattcgtttggagggccttgctttttctcatggtgccttttctaattatgagccggagctcttccctgggctgatttaccgtatgaaaaaccccaagattgtgctcctcatttttgtctctggcaagatcgttctcactggagccaaggtgcgggaagagatatatactgcctttgagaacatttatcccgtgctaactgagtacagaaagtgtcagaaatggtaa

SEQ ID NO: 8370 - protein, 219 aa, Sorghum bicolor
  misc_feature: Ceres ANNOT ID no. 6089858
  misc_feature (38)..(123): Pfam Id: TBP Pfam Desc: Transcription factor TFIID (or TATA-binding protein, TBP)
  misc_feature (128)..(214): Pfam Id: TBP Pfam Desc: Transcription factor TFIID (or TATA-binding protein, TBP)
  misc_feature (4)..(218): NCBI GI: 21875 NCBI Desc: tata binding protein (tfiid) [triticum aestivum]
  misc_feature (20)..(218): NCBI GI: 73919858 NCBI Desc: tata-binding protein 2 (tata-box factor 2) (tata binding factor 2) (tata sequence-binding protein 2) (tbp-2) (transcription initiation factor tfiid tbp-2 subunit)
  misc_feature (20)..(218): NCBI GI: 18481630 NCBI Desc: tata-binding protein tbp2 [oryza sativa]
  misc_feature (24)..(219): NCBI GI: 974216 NCBI Desc: tata-box binding protein [zea mays]
  misc_feature (24)..(218): NCBI GI: 293906 NCBI Desc: tata-binding protein [zea mays]
  misc_feature: The sequence is a functional homolog of SEQ ID NO. 496 in the 11/188,298 US application
MAALGMSGGAIGVGAGGGGAAAVVDAARPVDLARHPSGIVPALQNIVSTVNLDCQLDLKMIALQARNAEYNPKRFAAVIMRIREPKTTALVFASGKMVCTGAKSEEHSKLAARKYARIVQKLGYPAKFKDFKIQNMVGSCDVKFPIRLEGLAFSHGAFSNYEPELFPGLIYRMKNPKIVLLIFVSGKIVLTGAKVREEIYTAFENIYPVLTEYRKCQKW

SEQ ID NO: 8371 - DNA, 1275 bp, Sorghum bicolor
  misc_feature: Ceres ANNOT ID no. 6089864
  misc_feature: Encodes the peptide sequence at SEQ ID NO 8372
atggtgatgcggccgcgggcgatgggtctgagcagcatccggcgtgaggtgctggtctccgccgtcttcacggcgctcctcgtggcgtccatcctcctcctcccttcgctcctcctcacgggcagcaccggcccggccaggaggtggccgtcgttcctgtccccgtccacggccgccgaagacaaggagcagcaggcgcggtacccagtgaggttcgcgtacctgatctcggcgtcgacgggggacgcgccccgcgcggcgcgcctgctggcggcgctgtaccacccggccaacacctacctgcttcacctggaccgggaggcccccgcggaggagcaccggcggctggcggagctggtgtccggtcccgggcgcggcggcgtgtacgcgcgcgctggcaacgtgtggatcgtcggcaggcccaacctggtcacctaccgtggccccaccatgctgaccaccacgctgcacgccgtcgccgttctcctccgcctccgccgccgctgggactggttcatcaacctcagcgcctccgactacccgctcgtcacccaggacgatttgatggaggcgttcgcggggctgcccagggacctcaacttcatccaaaagaagcgggcgcggccggtgatcctggacacggcgctgtacgaggacgggagggcggagctcatccgcccggtgaacatcaccaccaacctcaggaggctgcccacggccttcaagctctacacagggtcggcgtggacgatgctgtcgcggtcgttcgcggagtacgtgacgatggggtgggacaaccttccccgggcgcttctcctctaccacgccaacatcgtctcgtcgccggagttctacttccagacggtggcgtgcaactcgcggcggttccgcaacgccacggtgaacagcgacctgcacttcatccgctgggacaacccgcccaagcagcacccgctctacctcacgtccagggactaccgccggatgctcctcagcggcgccgccttcgcgcgcaagttcagggagggagacccggtgctggaccggatcgacagggacatcctgcgccgccgggaacccggacacttcgcctacggcggctggtgctccgacgacggcgagcgcggcggcgccggagccggagcgctctgctccaacccgcaggagcatggtaggcgcggggccgttaaggccggcgccggatccaggcggctcaaggcgatgctgaccaagatgctgtcgccaaggaatttcaggaggcagcagtgtaggtga

SEQ ID NO: 8372 - protein, 424 aa, Sorghum bicolor
  misc_feature: Ceres ANNOT ID no. 6089864
  misc_feature (72)..(295): Pfam Id: Branch Pfam Desc: Core-2/I-Branching enzyme
  misc_feature (18)..(424): NCBI GI: 60657604 NCBI Desc: secondary cell wall-related glycosyltransferase family 14 [populus tremula x populus tremuloides]
  misc_feature (68)..(424): NCBI GI: 92894851 NCBI Desc: glycosyl transferase, family 14 [medicago truncatula]
  misc_feature (12)..(358): NCBI GI: 13605509 NCBI Desc: at3g03690/t12j13_3 [arabidopsis thaliana]
  misc_feature (54)..(423): NCBI GI: 45736153 NCBI Desc: n-acetylglucosaminyltransferase-like protein [oryza sativa (japonica cultivar-group)]
  misc_feature (8)..(424): NCBI GI: 42567183 NCBI Desc: glycosyltransferase family 14 protein / core-2/i-branching enzyme family protein [arabidopsis thaliana]
  misc_feature: Useful for making plants with altered carbohydrate content
  misc_feature: Functional homolog of the protein sequence given in SEQ ID NO 14022
MVMRPRAMGLSSIRREVLVSAVFTALLVASILLLPSLLLTGSTGPARRWPSFLSPSTAAEDKEQQARYPVRFAYLISASTGDAPRAARLLAALYHPANTYLLHLDREAPAEEHRRLAELVSGPGRGGVYARAGNVWIVGRPNLVTYRGPTMLTTTLHAVAVLLRLRRRWDWFINLSASDYPLVTQDDLMEAFAGLPRDLNFIQKKRARPVILDTALYEDGRAELIRPVNITTNLRRLPTAFKLYTGSAWTMLSRSFAEYVTMGWDNLPRALLLYHANIVSSPEFYFQTVACNSRRFRNATVNSDLHFIRWDNPPKQHPLYLTSRDYRRMLLSGAAFARKFREGDPVLDRIDRDILRRREPGHFAYGGWCSDDGERGGAGAGALCSNPQEHGRRGAVKAGAGSRRLKAMLTKMLSPRNFRRQQCR

SEQ ID NO: 8373 - DNA, 2688 bp, Sorghum bicolor
  misc_feature: Ceres ANNOT ID no. 6089868
  misc_feature: Encodes the peptide sequence at SEQ ID NO 8374
atggaagcagacgaggcctcgccgcctcccccgccgtgggcgcagaacaagtcggccgcggccatcgaggcctcgtcgggcccgctcgccgccgcgtcctcccgcctctccgcccgctcccgtgcgctcccctcgtcccgcgacttccacttctacaacaacttcccggccttcaaatcccccgtcggcgccgcggccgccaaggccgacgcctccctcggcgtgctcggcgcggccccgcttcttccgacgcggcagcagcagctgttccccgggggcggcgacctcgacgacgcgcacgactggctcgtcgccctcaacgacgacctgctcgagcggttcggcgccgccacggatgagttcaaggcgctccgggagaaggaggaggcctccgggcggagggcggcgcctgaggctggggacgggttccaaatggtgtgcgggaagaagaaaaagaaggtgggcgatggggatgaggaacgcgttggaagagttgaggcatttgggggttctggctctgtgaagatggtaaccaaggacaaggcggccgcaccgggggtgaaggctaaggtgcccttccacatccgcaccatcccacggccgcaggatgtgtaccgcattgtggtggacaactccagcaagccgttcgagcatgtcttgcttgagcgcagcgaggatggtactcgtgtcatgcacccattggaaaaactccctgttgaacaacaaatcaacagaaatgttcttgatagtgagccagtaaagccacctgctttagttgacactccttttacatttgttgaagacctgaaaaccttggaggtgctagccacaaagctgaaggatgcaactgagtttgctgttgatttggaacacaaccattataggacgtttcagggtttgacatgcttgatgcagatttcaacaagaacagaggactttattgttgacactcttaagcttcgtaaatatcttggtgattatcttagagaatttttcagagatccaaccaagaaaaaggtaatgcatggcgcaggtcgtgatattatatggcttcaacgagacttcagcatatatgtctgcaacctttttgacacaggccagatggaccgtaacagcttggagcatcttttgcaccatttctgtggagtaactgcaaacaaagaataccaagctgcagattggagattgaggccccttcctgatgaaatgatcaaatatgctagagaggatacacactatctgctgtatatatatgacctgatgagattgagactagtgaatgagtcatcaggggaaaatgatcttcttttagaggtttgcaagcgcagcaatgaaatttgcttgcaactatatgagaaggagcagctgactgatacatcatatctacatatacatgggttgaaagaaaatgaactgaatgcaagacagctgtcagttctttctagtctatatcgatggagagatggcattgcccgtgctgaggatgagagcactggctatatattacccaataaaactctacttgagatagcaaaggagatgcctgtgacaagtgggaagttaaaaagaattgttaaatcaagaaatttgtttcttgagcgccatctcggccatgttattaacaatataagggatgccatagcagcttctggtgcttttgaaagtgtagcggagcagctgaagaagggaaagcttgaagagttaacagtggcagatgtgaagaacagcagtgaggacattgaaatgattcctgctgttgatgttggtaacattgaagatccgaatgatgaatctgctgtagtttctgcagtgattacaaatgttggtgctgctccctgtatggggactattacaagcgaagcttctttgggtaatatgcatttagaggatgttgtgcctgaaacaaaggactctggtacttcatcagggtttactggactggcagatacagaaaaactgagcaatgaccagcagcaagcagcaaaggctactgttcaagtatcaaagaggcctacagcttttggagctctgtttggaaaaccagctgctggacgaaagccagatcttttcctagggtttccaaatgttcagggtaagactaaggtggacaagataacgtcttctgtggtacttccttttcatcatttctctggtggtgcaaaaccttcatcacccatccttccagcaaaagaatcgttgcattctgaaccagaaaacatccaacacggtgatccagcttgtcggttggaagaagtgatacagttggacatggaaacagacgagccacaaccaccagaaaatggcaacgaggatggacactgtgagactgaagacactgagatgtcaaagtccccttcagatgacccgtctggtactgagcaacgattccgaacactcaacgaagaaagaaacattcagcagaatcagaagacacctcgagaatttgaattgagtgttccggtggtgccttttgattatgcggaagccagaaagaatctcgtgtctagtcagcctaaagctgagaggagaaaagacgatgcggttgcaagggctataaatacagactctggagataagcggattgcttcaaaaaagccaggtgggggagaggacgagggaaatttccagcatccaaggagacggcaggctttcccgccttctggcaatagaagtgctacatatcactag

SEQ ID NO: 8374 - protein, 895 aa, Sorghum bicolor
  misc_feature: Ceres ANNOT ID no. 6089868
  misc_feature (263)..(426): Pfam Id: 3_5_exonuc Pfam Desc: 3'-5' exonuclease
  misc_feature (476)..(545): Pfam Id: HRDC Pfam Desc: HRDC domain
  misc_feature (4)..(405): NCBI GI: 115482166 NCBI Desc: os10g0437200 [oryza sativa (japonica cultivar-group)]
  misc_feature (158)..(849): NCBI GI: 10176710 NCBI Desc: nucleolar protein-like [arabidopsis thaliana]
  misc_feature (158)..(849): NCBI GI: 15239221 NCBI Desc: 3'-5' exonuclease domain-containing protein / helicase and rnase d c-terminal domain-containing protein / hrdc domain-containing protein [arabidopsis thaliana]
  misc_feature (174)..(670): NCBI GI: 4585987 NCBI Desc: similar to nucleolar protein [arabidopsis thaliana]
  misc_feature (287)..(562): NCBI GI: 144923417 NCBI Desc: hrdc; polynucleotidyl transferase, ribonuclease h fold [medicago truncatula]
MEADEASPPPPPWAQNKSAAAIEASSGPLAAASSRLSARSRALPSSRDFHFYNNFPAFKSPVGAAAAKADASLGVLGAAPLLPTRQQQLFPGGGDLDDAHDWLVALNDDLLERFGAATDEFKALREKEEASGRRAAPEAGDGFQMVCGKKKKKVGDGDEERVGRVEAFGGSGSVKMVTKDKAAAPGVKAKVPFHIRTIPRPQDVYRIVVDNSSKPFEHVLLERSEDGTRVMHPLEKLPVEQQINRNVLDSEPVKPPALVDTPFTFVEDLKTLEVLATKLKDATEFAVDLEHNHYRTFQGLTCLMQISTRTEDFIVDTLKLRKYLGDYLREFFRDPTKKKVMHGAGRDIIWLQRDFSIYVCNLFDTGQMDRNSLEHLLHHFCGVTANKEYQAADWRLRPLPDEMIKYAREDTHYLLYIYDLMRLRLVNESSGENDLLLEVCKRSNEICLQLYEKEQLTDTSYLHIHGLKENELNARQLSVLSSLYRWRDGIARAEDESTGYILPNKTLLEIAKEMPVTSGKLKRIVKSRNLFLERHLGHVINNIRDAIAASGAFESVAEQLKKGKLEELTVADVKNSSEDIEMIPAVDVGNIEDPNDESAVVSAVITNVGAAPCMGTITSEASLGNMHLEDVVPETKDSGTSSGFTGLADTEKLSNDQQQAAKATVQVSKRPTAFGALFGKPAAGRKPDLFLGFPNVQGKTKVDKITSSVVLPFHHFSGGAKPSSPILPAKESLHSEPENIQHGDPACRLEEVIQLDMETDEPQPPENGNEDGHCETEDTEMSKSPSDDPSGTEQRFRTLNEERNIQQNQKTPREFELSVPVVPFDYAEARKNLVSSQPKAERRKDDAVARAINTDSGDKRIASKKPGGGEDEGNFQHPRRRQAFPPSGNRSATYH

SEQ ID NO: 8375 - DNA, 777 bp, Sorghum bicolor
  misc_feature: Ceres ANNOT ID no. 6089895
  misc_feature: Encodes the peptide sequence at SEQ ID NO 8376
atgaagcagaagaaacgagtgaaacatgcaaagaacaagtacttgaaacctggtgccctggctcagattcgttatagtaggagtacaagcagggacattgggaagaaaaggattctgttgaatgtgaaagatgagctggagttgcctccacaacctgaggttctcttagaaagcaatacaccaattttgtcccctgcaagactcaattttgagccatttgatagtaacaaggggcaggtattgccaaagactccaaagactcctgatgcatctgtgtttggtggtgattcaaggcttgaatcacttccacttgatttgctgatcaagatcatgtgttgcttgcaccatgaccaactgaaggctgttttccatgtttcaaaaaggattcgaaaagcagttgaactggccaggcagtaccatttcaattacaccactccagatcgaagcagacaggagttgctcctaaacaaaactcctcttccaacggagcattggcctttcttaaggatcgatggcaaggacgtgcgtgtctccaccccaaggacaccaagggctccaaaacatgctgctcgcctttcacgcctcaagctggttgatgtgaagccaatcacagctgttctcttccaggagtctcctactccttttccttcaaagcgtctccgacgctcagtgccaccagggctgccaagacctgtgtgtaaagctgcaccctcacccagagttttactatacgaggaggagctttgcgaagcggtggcacagaataagcttctctga

SEQ ID NO: 8376 - protein, 258 aa, Sorghum bicolor
  misc_feature: Ceres ANNOT ID no. 6089895
  misc_feature (2)..(258): NCBI GI: 140047312 NCBI Desc: cyclin-like f-box [medicago truncatula]
  misc_feature (91)..(208): NCBI GI: 28372904 NCBI Desc: at1g61340 [arabidopsis thaliana]
  misc_feature (69)..(200): NCBI GI: 87240734 NCBI Desc: at1g61340 [medicago truncatula]
  misc_feature (9)..(208): NCBI GI: 18415709 NCBI Desc: f-box family protein [arabidopsis thaliana]
  misc_feature (31)..(214): NCBI GI: 1350541 NCBI Desc: late embryogenesis abundant protein [picea glauca]
MKQKKRVKHAKNKYLKPGALAQIRYSRSTSRDIGKKRILLNVKDELELPPQPEVLLESNTPILSPARLNFEPFDSNKGQVLPKTPKTPDASVFGGDSRLESLPLDLLIKIMCCLHHDQLKAVFHVSKRIRKAVELARQYHFNYTTPDRSRQELLLNKTPLPTEHWPFLRIDGKDVRVSTPRTPRAPKHAARLSRLKLVDVKPITAVLFQESPTPFPSKRLRRSVPPGLPRPVCKAAPSPRVLLYEEELCEAVAQNKLL

SEQ ID NO: 8377 - DNA, 357 bp, Sorghum bicolor
  misc_feature: Ceres ANNOT ID no. 6089898
  misc_feature: Encodes the peptide sequence at SEQ ID NO 8378
atgctggccgtgacggtgagccaggttgtggcgctgctctcctcggctctctccggcgccgaggacggcggcggcggcgtggcggttgggacgacgacgacaaaggcggcggggtactgctgcgtgtgcatatcggcgtgccgcgacgacggggacgacgtccggaggctgccctgcggacacgcctttcaccgggactgcgtcgaccgctggctggcgcgctgccgccggacgtgcccgctctgccgcctgcacatcgccggaggacctgccgtcgctttggtcgaccaccaccagcagcagctcagcgaggatctcgtcatctggttctcgtcgctctttgtcgccggcttgtag

SEQ ID NO: 8378 - protein, 118 aa, Sorghum bicolor
  misc_feature: Ceres ANNOT ID no. 6089898
  misc_feature (40)..(82): Pfam Id: zf-C3HC4 Pfam Desc: Zinc finger, C3HC4 type (RING finger)
  misc_feature (31)..(116): NCBI GI: 140039895 NCBI Desc: zinc finger, ring-type [medicago truncatula]
  misc_feature (40)..(90): NCBI GI: 115445315 NCBI Desc: os02g0249300 [oryza sativa (japonica cultivar-group)]
  misc_feature (12)..(93): NCBI GI: 77556398 NCBI Desc: ring-h2 finger protein rha3b [oryza sativa (japonica cultivar-group)]
  misc_feature (12)..(93): NCBI GI: 115489396 NCBI Desc: os12g0596200 [oryza sativa (japonica cultivar-group)]
  misc_feature (19)..(106): NCBI GI: 115462405 NCBI Desc: os05g0179000 [oryza sativa (japonica cultivar-group)]
  misc_feature: The sequence is a functional homolog of SEQ ID NO 1943 in the 11/479,226US patent application
  misc_feature: Useful for making plants with modulated growth and phenotype characteristics
  misc_feature: The sequence is a functional homolog of SEQ ID NO 1943 in the 20070022495 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
MLAVTVSQVVALLSSALSGAEDGGGGVAVGTTTTKAAGYCCVCISACRDDGDDVRRLPCGHAFHRDCVDRWLARCRRTCPLCRLHIAGGPAVALVDHHQQQLSEDLVIWFSSLFVAGL

SEQ ID NO: 8379 - DNA, 1017 bp, Sorghum bicolor
  misc_feature: Ceres ANNOT ID no. 6089945
  misc_feature: Encodes the peptide sequence at SEQ ID NO 8380
atgagggggatcctcctcgggcgccggcggcagccgccgccgctgcccctcttccccggcgccaagcgctcatcagcacccgcgagcctccttttcgcccgcctctggcgcatcctcccgtccagccccatcctccggctcctcctcctcctcgcactcctctccctcgtcccgccggccttcttccacctccgtctccgccgtttccaccgcatgcgcgagaggaagtgcgggtggatcgcgagcccacccatggtgtgcgcgcacggcggtgactccaccaacgccttccccaactcgatggacgcatttcggatggctctggatgcacgggtcgactgtgtggaggtggatgtttcaaggtcctctgacggtgtgctctttgctctgcatgatagggatctacaaaagatgtctggtaattctacagcaaaagttggccactggaccacagatgagataaaagcgctaagtgcaaggtttcagttgtcaaaaagagtccaaaatgaggaagttctcaaggcagaagatgctgtggtgatgatatcacaatcagttaggcaggtcgttgttgatgtgaaagttggacccccttcatttgagaaaggtttagctgaggatgtattgtctcttctcaggagaacaaattgcaagaattgtcttgtctgggcaaaaagtgatgacctaggaagagatataattaagttgtctaaagatgttattgttggctatattgttatggtggataaatctaccaatagaagaactgagttagtgaggattgaaggggctaaagttgctggcgtatatcatcctttgatccatgagaaggtcatgaaggtcatgcgcagacatgacaggagagtttttgcatggactgttgatgatagtagctccatgaagaagatgctgtttgagcatgttgatgccattgtgaccagcaacccttctctcttgcagcagcttatgcacgagacaagaactgagtgcatggaagatggttttgccttaccatag

SEQ ID NO: 8380 - protein, 338 aa, Sorghum bicolor
  misc_feature: Ceres ANNOT ID no. 6089945
  misc_feature (89)..(318): Pfam Id: GDPD Pfam Desc: Glycerophosphoryl diester phosphodiesterase family
  misc_feature (1)..(338): NCBI GI: 115484849 NCBI Desc: os11g0236000 [oryza sativa (japonica cultivar-group)]
  misc_feature (47)..(337): NCBI GI: 42563134 NCBI Desc: glycerophosphoryl diester phosphodiesterase family protein [arabidopsis thaliana]
  misc_feature (86)..(324): NCBI GI: 106887600 NCBI Desc: glycerophosphoryl diester phosphodiesterase [clostridium phytofermentans isdg]
  misc_feature (85)..(325): NCBI GI: 20807473 NCBI Desc: glycerophosphoryl diester phosphodiesterase [thermoanaerobacter tengcongensis]
  misc_feature (84)..(325): NCBI GI: 76587173 NCBI Desc: glycerophosphodiester phosphodiesterase [thermoanaerobacter ethanolicus atcc 33223]
MRGILLGRRRQPPPLPLFPGAKRSSAPASLLFARLWRILPSSPILRLLLLLALLSLVPPAFFHLRLRRFHRMRERKCGWIASPPMVCAHGGDSTNAFPNSMDAFRMALDARVDCVEVDVSRSSDGVLFALHDRDLQKMSGNSTAKVGHWTTDEIKALSARFQLSKRVQNEEVLKAEDAVVMISQSVRQVVVDVKVGPPSFEKGLAEDVLSLLRRTNCKNCLVWAKSDDLGRDIIKLSKDVIVGYIVMVDKSTNRRTELVRIEGAKVAGVYHPLIHEKVMKVMRRHDRRVFAWTVDDSSSMKKMLFEHVDAIVTSNPSLLQQLMHETRTECMEDGFALP

SEQ ID NO: 8381 - DNA, 1572 bp, Sorghum bicolor
  misc_feature: Ceres ANNOT ID no. 6090015
  misc_feature: Encodes the peptide sequence at SEQ ID NO 8382
atggcgtgcgttgcttacagtatcagataccctctcatgctcgctgcaaggcaccgcgctgatgttctggccaaaaatagcttgtgcattggcttgaagtcttcggtgtcttactccgtagctcagcagtggagcagcaattgctcttccgttatgatgcggcatgccacatcccatcgtcacttgattgttagggcttcagcaaggtggcgctctaactcgaaagcttcagcaaccgaagtgggcgctgcttctgatgagaggataactgtattggtcattggtggtggaggccgggagcatgctctttgttatgccttgaaccgttccccatcttgcagtgcagtgctatgtgcccctggtaatgccggtattgctcagtctggggatgcaacttgtatcgcagatttggacatctccagtagtgctgatgttatctcgttctgtcgtgagaggggagtgggaatggttgtagtgggtcctgaagccccacttgttgcgggtcttgtgaatgaccttgtcaaagttgggataccaacctttggcccttcatcagaggctgcagcgttagaaggatcaaaggatttcatgaagaagctatgtgacaagtacaatatcccaacagccaagtatcgcacattcatggatgctgtggaagctaaacaatatgtcaaacatgaaggagcccctattgttgttaaagctgatggactggccgctggaaagggtgtggttgttgcgatgactttggatgaggcattcgaagccatcgactctatgttggttgaaggctcatttggttctgctggttcacgggttatcattgaagaatttctagagggtgaagaagcatctttctttgcattagtagatggtgaaaatgctttgcctcttgaatcagcacaggatcacaaaagagttggtgatggtgatgttggcccaaatactggcggtatgggtgcatactcccctgcaccaatagtgacagatgagctcaagcgcatagtcatggaaagcataattgtccctaccgttaaaggcatggcggctgaagggtgcaagtttgttggtgtattatatgctggacttatgatcgagaagaaatctgggttgcctaagcttattgagtacaatgtaagatttggtgacccagaatgccaggttttgatgatgcgattagaatctgatttggcgcaagttctgttatccgcttgccggggaggattaagcaatgtttcactaacctggtcacctgaaatggcaatggtggttgtaatggcaagccagggataccctggctcttataagaaggggactgtaataaaaaacctagacaaggctgagcaggtctctccatttgtcaagatattccatgctgggacagcactagacgaagatggcaatcttgtcgccgtggaggccgagttcttgggtgtcactgcccaagggcaaggacttcgaagaaagccaaggggcaaaacttatgatggcggtagaatgctgttgattgggcaaaagggtccttcaggcgtgacatggttggcgagcactgaggcacaagcaagtggctaa

SEQ ID NO: 8382 - protein, 523 aa, Sorghum bicolor
  misc_feature: Ceres ANNOT ID no. 6090015
  misc_feature (192)..(386): Pfam Id: GARS_A Pfam Desc: Phosphoribosylglycinamide synthetase, ATP-grasp (A) domain
  misc_feature (89)..(191): Pfam Id: GARS_N Pfam Desc: Phosphoribosylglycinamide synthetase, N domain
  misc_feature (420)..(496): Pfam Id: GARS_C Pfam Desc: Phosphoribosylglycinamide synthetase, C domain
  misc_feature (1)..(496): NCBI GI: 77553855 NCBI Desc: phosphoribosylamine--glycine ligase [oryza sativa (japonica cultivar-group)]
  misc_feature (45)..(495): NCBI GI: 37992755 NCBI Desc: glycinamide ribonucleotide synthetase [nicotiana tabacum]
  misc_feature (57)..(486): NCBI GI: 92894066 NCBI Desc: phosphoribosylglycinamide synthetase [medicago truncatula]
  misc_feature (86)..(495): NCBI GI: 1071918 NCBI Desc: phosphoribosylamine-glycine ligase (ec 6.3.4.13) - arabidopsis thaliana (fragment)
  misc_feature (57)..(388): NCBI GI: 92877600 NCBI Desc: phosphoribosylglycinamide synthetase [medicago truncatula]
  misc_feature (74)..(495): SWISSPROT Homolog: EC 6.3.4.13 Phosphoribosylamine--glycine ligase, chloroplast precursor
MACVAYSIRYPLMLAARHRADVLAKNSLCIGLKSSVSYSVAQQWSSNCSSVMMRHATSHRHLIVRASARWRSNSKASATEVGAASDERITVLVIGGGGREHALCYALNRSPSCSAVLCAPGNAGIAQSGDATCIADLDISSSADVISFCRERGVGMVVVGPEAPLVAGLVNDLVKVGIPTFGPSSEAAALEGSKDFMKKLCDKYNIPTAKYRTFMDAVEAKQYVKHEGAPIVVKADGLAAGKGVVVAMTLDEAFEAIDSMLVEGSFGSAGSRVIIEEFLEGEEASFFALVDGENALPLESAQDHKRVGDGDVGPNTGGMGAYSPAPIVTDELKRIVMESIIVPTVKGMAAEGCKFVGVLYAGLMIEKKSGLPKLIEYNVRFGDPECQVLMMRLESDLAQVLLSACRGGLSNVSLTWSPEMAMVVVMASQGYPGSYKKGTVIKNLDKAEQVSPFVKIFHAGTALDEDGNLVAVEAEFLGVTAQGQGLRRKPRGKTYDGGRMLLIGQKGPSGVTWLASTEAQASG

SEQ ID NO: 8383 - DNA, 741 bp, Sorghum bicolor
  misc_feature: Ceres ANNOT ID no. 6090039
  misc_feature: Encodes the peptide sequence at SEQ ID NO 8384
atggcgatgggagcggcggttcgcgcggcggccgcggacgccgtggtgacgttcctgtgggtgctgtgcgcctccgcgctcggcgcttccacggcggccgtcacgtcgtgcctgggggtgcaggagggcgccggcggccactacgcgctcctcgtcaccgcgtccctcctcgcggtgctcctcttcgccttcgaccgcctctgcggcgcgctcggcggcgccagcttcaaccccaccgacttcgccgcttcctatgccgccggactcgacagcccctccctcttctccgtcgcgctccgcttcccggcgcaggccgccggcgctgtgggcggcgccctggcgatatcggagctgatgccggcgcagtacaagcacacgctcgcgggcccctcgctcaaggtggatccccacacaggcgcccttgcggaaggggtgctcactttcgtcgtcaccctggccgtgctctgcgtcatcgtcaagggcccccgcaacgccatcctcaggatcttgttgatctcagtctccattgtctccctcatcgtcgcaggcgcagagtacaccggaccgtccatgaacccagctaatgcatttggctgggcatatgttaacaattggcacaacacatgggagcagctttatgtgtactggatatgcccctttattggggccttgcttgctggatggatttttagggcggtgttcctaccaccggcacctaagcccaagaccaagaaagcatga

SEQ ID NO: 8384 - protein, 246 aa, Sorghum bicolor
  misc_feature: Ceres ANNOT ID no. 6090039
  misc_feature (1)..(230): Pfam Id: MIP Pfam Desc: Major intrinsic protein
  misc_feature (1)..(246): NCBI GI: 13447813 NCBI Desc: small basic membrane integral protein zmsip1-1 [zea mays]
  misc_feature (1)..(246): NCBI GI: 13447815 NCBI Desc: small basic membrane integral protein zmsip1-2 [zea mays]
  misc_feature (3)..(246): NCBI GI: 88604775 NCBI Desc: small basic intrinsic protein 1 [vitis vinifera]
  misc_feature (3)..(246): NCBI GI: 140038995 NCBI Desc: major intrinsic protein [medicago truncatula]
  misc_feature (13)..(245): NCBI GI: 13447817 NCBI Desc: small basic membrane integral protein zmsip2-1 [zea mays]
MAMGAAVRAAAADAVVTFLWVLCASALGASTAAVTSCLGVQEGAGGHYALLVTASLLAVLLFAFDRLCGALGGASFNPTDFAASYAAGLDSPSLFSVALRFPAQAAGAVGGALAISELMPAQYKHTLAGPSLKVDPHTGALAEGVLTFVVTLAVLCVIVKGPRNAILRILLISVSIVSLIVAGAEYTGPSMNPANAFGWAYVNNWHNTWEQLYVYWICPFIGALLAGWIFRAVFLPPAPKPKTKKA

SEQ ID NO: 8385 - DNA, 870 bp, Sorghum bicolor
  misc_feature: Ceres ANNOT ID no. 6090309
  misc_feature: Encodes the peptide sequence at SEQ ID NO 8386
atgtccatgagcttcgtgtgcatggtggaggcggagttgcccccagggttccggttccacccaagggatgatgaactcattcgtgaatatctagcaccgaaggtctttggcaagatcggcttctctggacatcgcccgcctatggtggacgtcgatctcaacaaggttgagccatgggatctcccgagggcagcattggtggggcctaggcagtggtatttcttcagccaaagggaccgaaagtatgcgacggggcaacgcacaaaccgggcaacagcatctggcaaggaccgtgtggtggagtgtcatgggatgctggtggggatgaggaaaacccttgtattttacaatgggagagcccccaagggaagcaagacggaatgggaagattgggtactgtgcaaagtcatctgcaagaagaaaccaggagttgccaacttcaaggcaagcagaagcctagccactgatggtcatggcactacaacagcctcaacaccaccaccactgcaaactctcatgggcatcacactaacgcaggtccaggctgccatggcaatgccaagggccagcctcaaaaccaccacagcaaactctcatgtgcaagaagaaatcagggggacactgcaaaacggtgccagcaacaacattgttgttgatggtgttcagcaaccaagctaccttcctgtcatcgcagacgacaataatgccaagggccagcctgatgaaatgggaagctacactgatcctgtaaactgtgaaaaggatttgctcacggtattgttgagtgatctgggaggtgaggtggtgccaagcctgccacctgaaatggctgcatctatgagctcgacctggatgatgaatcacttctag

SEQ ID NO: 8386 - protein, 289 aa, Sorghum bicolor
  misc_feature: Ceres ANNOT ID no. 6090309
  misc_feature (13)..(134): Pfam Id: NAM Pfam Desc: No apical meristem (NAM) protein
  misc_feature (1)..(289): NCBI GI: 138753444 NCBI Desc: nac transcription factor [hordeum vulgare subsp. vulgare]
  misc_feature (1)..(128): NCBI GI: 21554126 NCBI Desc: nac1 [arabidopsis thaliana]
  misc_feature (2)..(128): NCBI GI: 34558777 NCBI Desc: salicylic acid-induced protein 19 [capsicum annuum]
  misc_feature (6)..(128): NCBI GI: 15795128 NCBI Desc: nam (no apical meristem) protein-like [arabidopsis thaliana]
  misc_feature (3)..(264): NCBI GI: 15148912 NCBI Desc: nac domain protein nac1 [phaseolus vulgaris]
  misc_feature: Useful for making plants with altered Lignin content
  misc_feature: Functional homolog of the protein sequence given in SEQ ID NO 12985
  misc_feature: Useful for making plants with altered carbohydrate content
  misc_feature: Functional homolog of the protein sequence given in SEQ ID NO 13622
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MSMSFVCMVEAELPPGFRFHPRDDELIREYLAPKVFGKIGFSGHRPPMVDVDLNKVEPWDLPRAALVGPRQWYFFSQRDRKYATGQRTNRATASGKDRVVECHGMLVGMRKTLVFYNGRAPKGSKTEWEDWVLCKVICKKKPGVANFKASRSLATDGHGTTTASTPPPLQTLMGITLTQVQAAMAMPRASLKTTTANSHVQEEIRGTLQNGASNNIVVDGVQQPSYLPVIADDNNAKGQPDEMGSYTDPVNCEKDLLTVLLSDLGGEVVPSLPPEMAASMSSTWMMNHF

SEQ ID NO: 8387 - DNA, 1116 bp, Sorghum bicolor
  misc_feature: Ceres ANNOT ID no. 6090406
  misc_feature: Encodes the peptide sequence at SEQ ID NO 8388
atgagcttccaaagaagctggtgctccttcgtcttcttcccttccctgctactgctagcgacaattgctcaactggccaccacaaccttagcgcaggccagccctaacagcacggtggtcgaggaagtaccaggctggctccgcatctactccgacggcaccgtcgagcggctgacaccgccgggaggggaggctatcactgccatcgtcccaccgtactcggagccacgcggcggcgtgaccgtccatgacatctccaccgaccgcggcattgacgtccgtctctacctccacgaggcggctgcaactggatcccggcgaccagtcctcgtccacttccacggcggcggcttctgcgtctcccgcccgtcgtgggcactctaccacaacttctacgctcctctcaccgccaagctaaaagtcgccggcatcgtctccgtctacctcccgctcgcgcctgagcaccgcctcccggcggccatcgacgccggcgacgacgcgctcctgtggctccgcgacgtcgcgtgtggcaagaacgtcggatactctgcaccggtggaacgtctccgaaaggcagccgacttctcccgtgtattcctcatcggcgacagttctggcggcaaccttgtgcacctggtagccgcacgtgccggcgaggacggcatgggtgccttgcacccggtgaggctcgccggcggggtgctcctccatccgggcttcgcccgggagaaaaggagccggtcggagcttgagaaccctccgaacccgttattgaccctggagatggtggacaagctcctggctcttggactaccgctgggggccaccaaggacagcccctacacgtcgccggagctcgccgccaaggccgtcgaacatgtcgcgatgccgccattgctgctgatggttgcagaaaaggatttgcttcgtgatccgcaggtggattatggaaaggacatggtgcttgccgggaaggaggtggagacgaagctcagcagaggggctgtcgcgcacgtcttctatctcaacttcgtagcggtggagtcagatcgccttacatcgattcgaacaaagcagttagttcatgcgatcaaaaacttcatcagtcaccattga

SEQ ID NO: 8388 - protein, 371 aa, Sorghum bicolor
  misc_feature: Ceres ANNOT ID no. 6090406
  misc_feature (110)..(342): Pfam Id: Abhydrolase_3 Pfam Desc: alpha/beta hydrolase fold
  misc_feature (11)..(371): NCBI GI: 115487222 NCBI Desc: os12g0135800 [oryza sativa (japonica cultivar-group)]
  misc_feature (39)..(371): NCBI GI: 82697953 NCBI Desc: cxe carboxylesterase [malus pumila]
  misc_feature (39)..(371): NCBI GI: 7417008 NCBI Desc: cell death associated protein [nicotiana tabacum]
  misc_feature (39)..(371): NCBI GI: 82697955 NCBI Desc: cxe carboxylesterase [malus pumila]
  misc_feature (39)..(371): NCBI GI: 444002 NCBI Desc: hsr203j [nicotiana tabacum]
MSFQRSWCSFVFFPSLLLLATIAQLATTTLAQASPNSTVVEEVPGWLRIYSDGTVERLTPPGGEAITAIVPPYSEPRGGVTVHDISTDRGIDVRLYLHEAAATGSRRPVLVHFHGGGFCVSRPSWALYHNFYAPLTAKLKVAGIVSVYLPLAPEHRLPAAIDAGDDALLWLRDVACGKNVGYSAPVERLRKAADFSRVFLIGDSSGGNLVHLVAARAGEDGMGALHPVRLAGGVLLHPGFAREKRSRSELENPPNPLLTLEMVDKLLALGLPLGATKDSPYTSPELAAKAVEHVAMPPLLLMVAEKDLLRDPQVDYGKDMVLAGKEVETKLSRGAVAHVFYLNFVAVESDRLTSIRTKQLVHAIKNFISHH

SEQ ID NO: 8389 - DNA, 1062 bp, Sorghum bicolor
  misc_feature: Ceres ANNOT ID no. 6090494
  misc_feature: Encodes the peptide sequence at SEQ ID NO 8390
atgctgaatctagtatcatttgagacgccgcctctcggaaggcaggagagatcagctaatactaccactgtcactgcagcagcggccatcaggggaaaaaaggaagaaagctccagcaacacttgcttccatgggcacctggacctcagtcttggcatctccttgtctcatggcagcggcggcggctgtgacgcatccagctgtggcggaaacaagcaggcgagctatggtggtcggcagggcagccgtgacgacaaggacgatgttcgttgcatcaccaccgccgccgccacagctgcaaatgtgattacagcaaggcacgaccatgtcggtgatttgacagcatcatcaggaggaggtggctgggcagcggcgttcatgccgagcccgaccagcttcatgcatccatggagcctcgccgcacggcagcagaaggctgctgcggagcaagaccggacgccgcctaccacttacatgtcaagtaatgatgaccgtgtggccacatcaccgtcggccgtcggctggccgccagtgcacacctcccggcgcaacatcgtcaccgccatgcaagtacccaagcctactggcgccaccgccgccgatggacccgaaagcacgaccacgacgcacgccacagccggcggcggcgaaaagaatgtggcgccggcgccgccgacggacagcacggtggtggccacactaatacggccgccgccggcgaacatgttcgccaaggtgcacatggaaggatacgcgattggcaggaagatcaacctcagggcacaaggcggctacgactcgctctccagggtgcttaccaacatgacaacaaacttcttttgtcgtgcaggcacgggagaaaaagatgtgcctaatagtgacaaattcatatttctgtatgaagactttgagggtgaccgaatgctggttggtgacgtcccatgggaattattcctagcgtctgctaaaagattgtacattgtccgcaatccagtatcaagtgacaaaggtcagggtgaaggtgacggaaaatataaaaccgaaaaagcaacaaatgactga

SEQ ID NO: 8390 - protein, 353 aa, Sorghum bicolor
  misc_feature: Ceres ANNOT ID no. 6090494
  misc_feature (78)..(342): Pfam Id: AUX_IAA Pfam Desc: AUX/IAA family
  misc_feature (223)..(353): NCBI GI: 88911334 NCBI Desc: auxin-responsive protein iaa27 (indoleacetic acid-induced protein 27)
  misc_feature (119)..(331): NCBI GI: 88911333 NCBI Desc: auxin-responsive protein iaa25 (indoleacetic acid-induced protein 25)
  misc_feature (169)..(328): NCBI GI: 12083206 NCBI Desc: auxin-induced protein, iaa12 [arabidopsis thaliana]
  misc_feature (243)..(348): NCBI GI: 32400272 NCBI Desc: iaa1 protein [triticum aestivum]
  misc_feature (240)..(329): NCBI GI: 6136834 NCBI Desc: aux/iaa protein [cucumis sativus]
  misc_feature: The sequence is a functional homolog of SEQ ID NO 204 in the 10/225,066US patent application
  misc_feature: The sequence is a functional homolog of SEQ ID NO 292 in the 10/412,699US patent application
  misc_feature: The sequence is a functional homolog of SEQ ID NO 40 in the 10/225,068US patent application
  misc_feature: The sequence is a functional homolog of SEQ ID NO 682 in the 11/479,226US patent application
  misc_feature: The sequence is a functional homolog of SEQ ID NO 739 in the 10/374,780US patent application
  misc_feature: The sequence is a functional homolog of SEQ ID NO 82 in the 10/374,780US patent application
  misc_feature: Useful for making plants with modulated growth and phenotype characteristics
  misc_feature: The sequence is a functional homolog of SEQ ID NO 292 in the 20040045049 US patent application
  misc_feature: The sequence is a functional homolog of SEQ ID NO 739 in the 20060162006 US patent application
  misc_feature: The sequence is a functional homolog of SEQ ID NO 682 in the 20070022495 US patent application
MLNLVSFETPPLGRQERSANTTTVTAAAAIRGKKEESSSNTCFHGHLDLSLGISLSHGSGGGCDASSCGGNKQASYGGRQGSRDDKDDVRCITTAAATAANVITARHDHVGDLTASSGGGGWAAAFMPSPTSFMHPWSLAARQQKAAAEQDRTPPTTYMSSNDDRVATSPSAVGWPPVHTSRRNIVTAMQVPKPTGATAADGPESTTTTHATAGGGEKNVAPAPPTDSTVVATLIRPPPANMFAKVHMEGYAIGRKINLRAQGGYDSLSRVLTNMTTNFFCRAGTGEKDVPNSDKFIFLYEDFEGDRMLVGDVPWELFLASAKRLYIVRNPVSSDKGQGEGDGKYKTEKATND

SEQ ID NO: 8391 - DNA, 927 bp, Sorghum bicolor
  misc_feature: Ceres ANNOT ID no. 6090502
  misc_feature: Encodes the peptide sequence at SEQ ID NO 8392
atggcgtcccgaaggtgtccacgccatgtggcgctcctggccgccctcgcattcgtctcctgcctcgccgccgccggcccgccggtcagggcgaagcagacgaacaaggtgaccgtcttctggggccggaacaaggacgaggggtccctgcgggaggcctgcgacacggggctctacaccaccgtcatcatcgccttctacagcgtgttcggccacggccgctactggcgcggcgacgacctgtcgggccactcgctgcgcggcgtcggcgccgacatcaagcactgccagtccaggggcatcctcgtgctcctctccatcggcggcggcggccacggctactcgctcccatcctcccagtccgcggccgacgtcgccgaccacctgtggaacgcgcacctcggcgggcggcgccgcggcgtgcaccgcccgttcggcgacgccgccgtggacggcatcgacttctacatcgacaacggcgcgccggaccactacgacgagctggcgcgacgcctcgcgcggaaggggaaaggcaaaggggtgcggctcacggcgtcgccgcggtgcgggtgccccgacgagcgcgtcgaccgggcgctgcagacggggctgttcgagcgcatccacgtcaggttctacggcgacgacaagtgctccttcaagaacggcagcacctggggcgtcgtggaggagtggaacaagtggacggcgaggtaccccacgacggaggtgcacctgggcctcgccgcggcggagagcggcgtgccggatggggcgcagggcaccgtcgcggtgtacctcaagtacctctactacctcctgctgccggaggtgcagaaggcgcgcaactatggaggggtcgtggtctgggacaggtactccgacaagaggaccggatacagcggcgtcgtcaagggctgggcgtga

SEQ ID NO: 8392 - protein, 308 aa, Sorghum bicolor
  misc_feature: Ceres ANNOT ID no. 6090502
  misc_feature (35)..(295): Pfam Id: Glyco_hydro_18 Pfam Desc: Glycosyl hydrolases family 18
  misc_feature (10)..(308): NCBI GI: 4884510 NCBI Desc: class iii chitinase homologue (oschib3h-a) [oryza sativa]
  misc_feature (8)..(301): NCBI GI: 2696225 NCBI Desc: chitinase [oryza sativa (japonica cultivar-group)]
  misc_feature (16)..(302): NCBI GI: 77552683 NCBI Desc: chitinase iii c00481 [oryza sativa (japonica cultivar-group)]
  misc_feature (9)..(302): NCBI GI: 62733213 NCBI Desc: glycosyl hydrolases family 18 [oryza sativa (japonica cultivar-group)]
  misc_feature (9)..(302): NCBI GI: 73622089 NCBI Desc: xylanase inhibitor protein 2 precursor (class iii chitinase homolog h)
  misc_feature: Useful for making plants with altered cell wall content and/or composition
  misc_feature: Functional homolog of the protein sequence encoded by LOCUS at5g24090
MASRRCPRHVALLAALAFVSCLAAAGPPVRAKQTNKVTVFWGRNKDEGSLREACDTGLYTTVIIAFYSVFGHGRYWRGDDLSGHSLRGVGADIKHCQSRGILVLLSIGGGGHGYSLPSSQSAADVADHLWNAHLGGRRRGVHRPFGDAAVDGIDFYIDNGAPDHYDELARRLARKGKGKGVRLTASPRCGCPDERVDRALQTGLFERIHVRFYGDDKCSFKNGSTWGVVEEWNKWTARYPTTEVHLGLAAAESGVPDGAQGTVAVYLKYLYYLLLPEVQKARNYGGVVVWDRYSDKRTGYSGVVKGWA

SEQ ID NO: 8393 - DNA, 2904 bp, Sorghum bicolor
  misc_feature: Ceres ANNOT ID no. 6090508
  misc_feature: Encodes the peptide sequence at SEQ ID NO 8394
atgcctccttccaagggcaagaagaaaaacccgtcggcgtcgccgcggccgtccccacgaacgcctccgtctcgctcgtccgccgccgctggctccggaactggcgacggcgagagaagcgtcgacctcccatccgtcgccgccgccgccgcagcgcagttcccggcgctcgtgccacgcggcggcgatggctgcttcgctggcaccgtcgccgaagtggcccccagggacgggagccgcggcggccgcttggggaggctctggctctccgaggccgctatggtcggcgccgggatgcggcccgggtgcctcgtctccgagtgcagcaggttctttgatcttgatctggacaatgatctcctgtatggcgaagctgggaaaaactttgtggttgctacagttctcccctcacgtgaggttcgaaagaatggtatcaagctctcttgggatcttgcttgtgttttgggacaccctttggtaggtcgatcgttgtttattagccccttgtgtacacttcaggccccaaagcgtagtgatgatagtcatattttacgggtaatgaaatgtaaggatctttatcttagcctagttccacctaatgttggatcttccaatggcattgaatcagagtctgaccaccatcctgaaagaagcacaatggttatggagacacctaagaagggtccttcaactccactgcataagaaggaatcccatcactttccttccaacagtggatgttcaatgtgcctggatccaaccactgcgatatcagcactagcagatgagaaagttaatgatttgttacaaacttcagcagtacggtggcttaatggtagacacttgcttaaaggaaactttgttcctctctcagtatgtggaaaactgtctttgtttgtggtcatgggagcagaaccagatagttcttctcatgatgttttgtgtgagaaagggaatacactgtctaatgcagaggattcaactaaatccacggaaaccccagttttgttccttgttgacggaaccacaaaagttcatttatctgattctgtttgcacaaagcagcttgacttagataagctgggtttaccatcagaactttccgagtatggtgacaaaagaaatgaagattccaataatgttccaacacttggtgggttatctaaagagtcggcaaccataaaaggaataatttcattttcactagctgatcaaattggtctgccaagatacaaaggtattcttctttatggtccacctggaacagggaaaacctctcttgcttcttcctgtgcctatgatgcaggggtcaacctatttacaatcaatggaccagagattattagtcatcattacggagaaagcgagcaatctctgtacgatgttttcagttcagccaagcaagcggcacctgctgtgatatttattgatgaattggatgcaattgctccatcaaggaaggatgggagtgaggagttatctattagaatggtagctactctgttaaaactgatggatgagattggccctagtgatcgtgttctcttgattgctgctacaaatcggcctgatagtattgaccctgcattgcgacgtcctggaagattggataaagaaattgaaataggagtgccatctccgggacagaggatggacatacttcgccgccttctgattggagttcatcattctctcagcaatgaagaaatcgagtctattgctctagcgacccatggatttgtgggtgctgatctagcggcactgtgcaatgaggctgcattgagtgctctgcggtgttacatcagcgtaaaagaaaattcaactcaacaacttggtcatcctggctgtagttttgataagtgtaatagtcaagatactgaagatccaagctcattatcgtcatctttctcacagttgaccatgtcatcagatgatgttgcctgcatgaagggcagtaacataaaaagtagcgagtcttatgatgatacaaatgaaataccactattagtaaccattaaggatttcgacaaggctaaaacaaaagttagaccaagtgcgatgcgtgaggttattcttgagcttcccaaggtatgttgggaagatgtcggtggccagttcagtgtcaaggagcagctaattgaagctatccaattaccacaaaaatgcccagaagcatttgaacgtttagggatacgaccccctagaggattgctaatgataggaccaccaggttgcagcaagactttgatggctcgtgctgcagcttccgaagcaaaattgaacttccttgctgttaagggtcctgaacttttcagcaaatgggtcggtgactcagaaaaggcagtgagatccctatttgcaaaggcgagggctaatgcaccagcaatattatttttcgatgaaatagatgggcttgcagtaactcgtgggcaaggaaatgatggcacatctgttgctgatagggtcctcagtcagttgcttgtggaaatggatggtttggaccagagagttggtgttactgttattgcagctacaaatcgtcctgacaaaattgattctgcacttctgaggccaggtcgttttgatagggtgctggatgtgcaaccaccaaacgaagctgaccgcgcagatattttccggattcatatacgcagcatgccatgcagtgctgacatgaatctaaacgaacttgctagactcacagaaggctacactggtgctgatataaagcttatctgcagggaagctgctgttgccgcacttgatgagagctttgacatccgagaagtagcaatgagacatttcaagtctgcagtcagcagaacaagaccatcagatgtcaagttttttgaagagctagcaaagcaattccgccgatcgttggcttcactgaggaagcagtaa

SEQ ID NO: 8394 - protein, 967 aa, Sorghum bicolor
  misc_feature: Ceres ANNOT ID no. 6090508
  misc_feature (413)..(598): Pfam Id: AAA Pfam Desc: ATPase family associated with various cellular activities(AAA)
  misc_feature (736)..(922): Pfam Id: AAA Pfam Desc: ATPase family associated with various cellular activities(AAA)
  misc_feature (603)..(959): NCBI GI: 9662988 NCBI Desc: calmodulin-binding protein [arabidopsis thaliana]
  misc_feature (617)..(959): NCBI GI: 6760430 NCBI Desc: calmodulin-binding protein [arabidopsis thaliana]
  misc_feature (654)..(944): NCBI GI: 119625619 NCBI Desc: spermatogenesis associated 5, isoform cra_b [homo sapiens]
  misc_feature (670)..(944): NCBI GI: 123252474 NCBI Desc: spermatogenesis associated 5 [mus musculus]
  misc_feature (670)..(944): NCBI GI: 10946660 NCBI Desc: spermatogenesis associated 5 [mus musculus]
  misc_feature: The sequence is a functional homolog of SEQ ID NO. 462 in the 11/188,298 US application
  misc_feature: The sequence is a functional homolog of SEQ ID NO. 471 in the 11/188,298 US application
MPPSKGKKKNPSASPRPSPRTPPSRSSAAAGSGTGDGERSVDLPSVAAAAAAQFPALVPRGGDGCFAGTVAEVAPRDGSRGGRLGRLWLSEAAMVGAGMRPGCLVSECSRFFDLDLDNDLLYGEAGKNFVVATVLPSREVRKNGIKLSWDLACVLGHPLVGRSLFISPLCTLQAPKRSDDSHILRVMKCKDLYLSLVPPNVGSSNGIESESDHHPERSTMVMETPKKGPSTPLHKKESHHFPSNSGCSMCLDPTTAISALADEKVNDLLQTSAVRWLNGRHLLKGNFVPLSVCGKLSLFVVMGAEPDSSSHDVLCEKGNTLSNAEDSTKSTETPVLFLVDGTTKVHLSDSVCTKQLDLDKLGLPSELSEYGDKRNEDSNNVPTLGGLSKESATIKGIISFSLADQIGLPRYKGILLYGPPGTGKTSLASSCAYDAGVNLFTINGPEIISHHYGESEQSLYDVFSSAKQAAPAVIFIDELDAIAPSRKDGSEELSIRMVATLLKLMDEIGPSDRVLLIAATNRPDSIDPALRRPGRLDKEIEIGVPSPGQRMDILRRLLIGVHHSLSNEEIESIALATHGFVGADLAALCNEAALSALRCYISVKENSTQQLGHPGCSFDKCNSQDTEDPSSLSSSFSQLTMSSDDVACMKGSNIKSSESYDDTNEIPLLVTIKDFDKAKTKVRPSAMREVILELPKVCWEDVGGQFSVKEQLIEAIQLPQKCPEAFERLGIRPPRGLLMIGPPGCSKTLMARAAASEAKLNFLAVKGPELFSKWVGDSEKAVRSLFAKARANAPAILFFDEIDGLAVTRGQGNDGTSVADRVLSQLLVEMDGLDQRVGVTVIAATNRPDKIDSALLRPGRFDRVLDVQPPNEADRADIFRIHIRSMPCSADMNLNELARLTEGYTGADIKLICREAAVAALDESFDIREVAMRHFKSAVSRTRPSDVKFFEELAKQFRRSLASLRKQ

SEQ ID NO: 8395 - DNA, 324 bp, Sorghum bicolor
  misc_feature: Ceres ANNOT ID no. 6090628
  misc_feature: Encodes the peptide sequence at SEQ ID NO 8396
atggagcacgggtcgttgacggactcgacctcatcgaccttctccatcatggaggaggaccacaccctcgccaactccgccagattcgtcctcaaccaggacccaagggtagcattttgtggatatagcatccctcatcctgctgagaagaaagtcaacataagagttcaaacaacaggagatgcagcaaaggatgtactgaaagatgctttgcagaatctgatgattatgtgccagcatgtcagagggacattggacaacgccgtggctaaccatagagcaaaaaatactactgcagaacaaatggatgttgaccggaaatag

SEQ ID NO: 8396 - protein, 107 aa, Sorghum bicolor
  misc_feature: Ceres ANNOT ID no. 6090628
  misc_feature (8)..(83): Pfam Id: RNA_pol_L Pfam Desc: RNA polymerase Rpb3/Rpb11 dimerisation domain
  misc_feature (43)..(107): NCBI GI: 115484743 NCBI Desc: os11g0218100 [oryza sativa (japonica cultivar-group)]
  misc_feature (4)..(89): NCBI GI: 68491001 NCBI Desc: rna polymerase i and iii shared subunit rpc19 [candida albicans sc5314]
  misc_feature (4)..(81): NCBI GI: 146447645 NCBI Desc: dna-directed rna polymerases i and iii 16 kda polypeptide [lodderomyces elongisporus nrrl yb-4239]
  misc_feature (4)..(97): NCBI GI: 126134273 NCBI Desc: rna polymerase i and iii subunit [pichia stipitis cbs 6054]
  misc_feature (8)..(81): NCBI GI: 6324215 NCBI Desc: rna polymerase subunit, common to rna polymerases i and iii [saccharomyces cerevisiae]
  misc_feature (8)..(81): SWISSPROT Homolog: EC 2.7.7.6 DNA-directed RNA polymerases I and III 16 kDa polypeptide
MEHGSLTDSTSSTFSIMEEDHTLANSARFVLNQDPRVAFCGYSIPHPAEKKVNIRVQTTGDAAKDVLKDALQNLMIMCQHVRGTLDNAVANHRAKNTTAEQMDVDRK

SEQ ID NO: 8397 - DNA, 1077 bp, Sorghum bicolor
  misc_feature: Ceres ANNOT ID no. 6090629
  misc_feature: Encodes the peptide sequence at SEQ ID NO 8398
atgatgatggcgaacccgaagctccataagcaggcgctgctgccgccgcggagcccgttcccgacggcggcggcgccgtcgccgtacgcggaccgcggtccaatcgcgcggccgcaggttggtgcggcgcaccaccggcacggccaccaccagcgcacgtcgtccgagagcttcatcgaggagcagccgccgctgtggctcgatgacctgctgaacgagcccgagacgcccgcggcgcggcagagcggcggccgggctgggcaccgcaggtcgtccagcgactcgtttgcgctgtttgacggtggagctgctggcgccgctggtgcttacgccaatggcttcgaggggatggggagaggaggtgggcagcctgcgccgtggggtggtgtgcaggagtactatgccaagccggcatcgtttgggagggcacatggaaggccgtgggagcaaggcatgccgaattcggcgggtttcaggcatggtggtggcctgccaatgcccatgaaagataaggttggcgggcatcatgggccaccgaacgtgccgagggagcatgaccatggcatggacaagagaactcctgatgatgctggccatgatcaaaaagttggagccaaggagggtgtgctgccgaagcatgcacagtcagaggcggacaacaagcgtgctaaacagcaatatgctcagaggtcccgtgttcggaagctgcagtatattgcagagcttgagggtagagtccaggcattacagtcagaaggggtagaagtgtctgctgaaatggagttccttacccagcagaatattatgctcgacctggaaaacaaagccttgaagcaaagactggagagtctagcacaggaacaacttattaaacgctttcaacaggagatgtttgagcgggaaattggtcgtctcaggtctctatatcagcaacagcagcagcagcagcagcaacaggttcctgctcttgttcgcagtaacagcagagaccttgatgtgcagtttgccaacttgtctctgaaacacaaagaccccaactcaggccgggatgctctctctgggcctcttcgtacttag

SEQ ID NO: 8398 - protein, 358 aa, Sorghum bicolor
  misc_feature: Ceres ANNOT ID no. 6090629
  misc_feature (217)..(275): Pfam Id: bZIP_1 Pfam Desc: bZIP transcription factor
  misc_feature (6)..(357): NCBI GI: 92889087 NCBI Desc: eukaryotic transcription factor, dna-binding [medicago truncatula]
  misc_feature (191)..(353): NCBI GI: 79320199 NCBI Desc: dna binding / transcription factor [arabidopsis thaliana]
  misc_feature (178)..(350): NCBI GI: 145652381 NCBI Desc: transcription factor bzip63 [glycine max]
  misc_feature (206)..(340): NCBI GI: 18399693 NCBI Desc: bzip family transcription factor [arabidopsis thaliana]
  misc_feature (223)..(312): NCBI GI: 113367174 NCBI Desc: bzip transcription factor bzip50 [glycine max]
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 148 in the 10/412,699US patent application
  misc_feature: The sequence is a functional homolog of SEQ ID NO 1483 in the 10/412,699US patent application
  misc_feature: The sequence is a functional homolog of SEQ ID NO 2266 in the 10/374,780US patent application
  misc_feature: The sequence is a functional homolog of SEQ ID NO 341 in the 11/479,226US patent application
  misc_feature: The sequence is a functional homolog of SEQ ID NO 58 in the 11/375,241US patent application
  misc_feature: Useful for making plants with altered terpenoid content
  misc_feature: Useful for making plants with modulated growth and phenotype characteristics
  misc_feature: GREAT-hit functional homolog of the protein sequence given in SEQ ID NO 13333
  misc_feature: The sequence is a functional homolog of SEQ ID NO 148 in the 20040045049 US patent application
  misc_feature: The sequence is a functional homolog of SEQ ID NO 1483 in the 20040045049 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MMMANPKLHKQALLPPRSPFPTAAAPSPYADRGPIARPQVGAAHHRHGHHQRTSSESFIEEQPPLWLDDLLNEPETPAARQSGGRAGHRRSSSDSFALFDGGAAGAAGAYANGFEGMGRGGGQPAPWGGVQEYYAKPASFGRAHGRPWEQGMPNSAGFRHGGGLPMPMKDKVGGHHGPPNVPREHDHGMDKRTPDDAGHDQKVGAKEGVLPKHAQSEADNKRAKQQYAQRSRVRKLQYIAELEGRVQALQSEGVEVSAEMEFLTQQNIMLDLENKALKQRLESLAQEQLIKRFQQEMFEREIGRLRSLYQQQQQQQQQQVPALVRSNSRDLDVQFANLSLKHKDPNSGRDALSGPLRT

SEQ ID NO: 8399 - DNA, 2022 bp, Sorghum bicolor
  misc_feature: Ceres ANNOT ID no. 6090645
  misc_feature: Encodes the peptide sequence at SEQ ID NO 8400
atggatttgaacgcatcgcctgtgcctgacgatgatgagcagcagccttatgatgagccagtggaggttgattatgctcaggaggggcatgttgaatctgctgtcgcaacattgcgccgggagcgtgaagagagacgcaagaaactaaagagagagcagcaggatgatgggtcaaggctacattcccagcagattaggaatgattatgcccctcaacccaaaaggcatagtcgctttaaagaggcacctcagggctggttggactgtcctgcatttggggagccaatagataaaatcataccatctaaagttcctcttgatgaaacattcaatgagtcagtgcctcctgggaagcgatactcctcaaagcaactagttaacaaacaaagaaaagctggccgcgaaataggtctggtgattgatttgacaaataccacccggtattattcaccagcagaatggacgaggcaaggtactaagtatgcgaagattgcatgcaaggggagagatgctgtacctgacaatgaatctgttaataagtttgtctatgaggcaatgatgttccttgatcgacaaaaacaatcaaagaatcctaaatatattctggttcactgtacccatggccataatcgtacgggtttcatgattattcattaccttatgcgcacacacgtctcttgtgttgctgaggcgataaatatatttgctcaaaggcggccacctggcatatacaagagggactatattgaagcactgtattcattttaccatgaggtccctgagaatatgatgctagcatgccctccaacaccagaatggaagagaccagatgatctcgatttaaatggtgaagctaagcaggatgatgatgatgacaatggtgatcctgaaccactgcgtaatgaatcagaggataaaataatcaccaacgacgatgtgttaggggacgaagtgccatatgaccagcaagaagctttgcgtgtcctatgttatcggttgcttgaaatgccccttgtaagggggcattcacaatttcctggatcacatccagtttctcttaacagtgaaaatctacaactacttaggcagcgatactactttgctacatggaaagctgatggaacacgatatatgatgcttataatgagagatggttgtttcttgattgatcggaatttttgcttcagaagggttcagatgcgctttccccataagagccttgaaggtctgcatgatatgaccttgattgatggagagatgattatagacacggtaccagattcaggcttgaagagaaggtacttggcatatgatcttatggcacttggtgcagtgtccaaaactaagttgccattttctgaaaggtggaaaatgctggaagatgaaataatacggccacgttatcatgagaaaaagcaatttgagagtggtgctaagagcaatccgttgtacaaatatgacatggaattattttcggttaggagaaaggatttttggctgctctcaacagtaaaaaaggttcttaaggagttcattccatcgctttgccatgatgctgatggccttatatttcagggctgggatgatccatatgtaactcgtactcatgaaggtcttctgaagtggaagtaccctgagatgaattctgtggacttcctttttgagcttacaaatgataatcgtcaattggttttcctttatgagagaggaaaaaagaaacttatggatggtgctcggatagcatttactgatgatgtagatccatcctctgtcgctgggaggattgttgagtgctcctggaataaggaagaacagtgttgggcctgtatgcgtattagatctgataaatcgactccaaatgacatcaacacataccggaaggtgatgaggagtattacagataacattaccgaggaaaagcttctcgaagagattgatgagataaggcgcctcccaatgtatgccgataggatgcatgctcatacgaagatggcacaacagcggcgaagattgccaccatag

SEQ ID NO: 8400 - protein, 673 aa, Sorghum bicolor
  misc_feature: Ceres ANNOT ID no. 6090645
  misc_feature (349)..(543): Pfam Id: mRNA_cap_enzyme Pfam Desc: mRNA capping enzyme, catalytic domain
  misc_feature (546)..(643): Pfam Id: mRNA_cap_C Pfam Desc: mRNA capping enzyme, C-terminal domain
  misc_feature (109)..(258): Pfam Id: DSPc Pfam Desc: Dual specificity phosphatase, catalytic domain
  misc_feature (1)..(670): NCBI GI: 77553265 NCBI Desc: mrna capping enzyme - like protein [oryza sativa (japonica cultivar-group)]
  misc_feature (1)..(627): NCBI GI: 77553266 NCBI Desc: mrna capping enzyme - like protein [oryza sativa (japonica cultivar-group)]
  misc_feature (1)..(668): NCBI GI: 42572335 NCBI Desc: mrna capping enzyme family protein [arabidopsis thaliana]
  misc_feature (1)..(668): NCBI GI: 23306380 NCBI Desc: mrna capping enzyme - like protein [arabidopsis thaliana]
  misc_feature (15)..(336): NCBI GI: 6759452 NCBI Desc: mrna capping enzyme-like protein [arabidopsis thaliana]
MDLNASPVPDDDEQQPYDEPVEVDYAQEGHVESAVATLRREREERRKKLKREQQDDGSRLHSQQIRNDYAPQPKRHSRFKEAPQGWLDCPAFGEPIDKIIPSKVPLDETFNESVPPGKRYSSKQLVNKQRKAGREIGLVIDLTNTTRYYSPAEWTRQGTKYAKIACKGRDAVPDNESVNKFVYEAMMFLDRQKQSKNPKYILVHCTHGHNRTGFMIIHYLMRTHVSCVAEAINIFAQRRPPGIYKRDYIEALYSFYHEVPENMMLACPPTPEWKRPDDLDLNGEAKQDDDDDNGDPEPLRNESEDKIITNDDVLGDEVPYDQQEALRVLCYRLLEMPLVRGHSQFPGSHPVSLNSENLQLLRQRYYFATWKADGTRYMMLIMRDGCFLIDRNFCFRRVQMRFPHKSLEGLHDMTLIDGEMIIDTVPDSGLKRRYLAYDLMALGAVSKTKLPFSERWKMLEDEIIRPRYHEKKQFESGAKSNPLYKYDMELFSVRRKDFWLLSTVKKVLKEFIPSLCHDADGLIFQGWDDPYVTRTHEGLLKWKYPEMNSVDFLFELTNDNRQLVFLYERGKKKLMDGARIAFTDDVDPSSVAGRIVECSWNKEEQCWACMRIRSDKSTPNDINTYRKVMRSITDNITEEKLLEEIDEIRRLPMYADRMHAHTKMAQQRRRLPP

SEQ ID NO: 8401 - DNA, 2022 bp, Sorghum bicolor; identical to SEQ ID NO: 8399
  misc_feature: Ceres ANNOT ID no. 6090646
  misc_feature: Encodes the peptide sequence at SEQ ID NO 8402

SEQ ID NO: 8402 - protein, 673 aa, Sorghum bicolor; identical to SEQ ID NO: 8400
  misc_feature: Ceres ANNOT ID no. 6090646
  misc_feature (349)..(543): Pfam Id: mRNA_cap_enzyme Pfam Desc: mRNA capping enzyme, catalytic domain
  misc_feature (546)..(643): Pfam Id: mRNA_cap_C Pfam Desc: mRNA capping enzyme, C-terminal domain
  misc_feature (109)..(258): Pfam Id: DSPc Pfam Desc: Dual specificity phosphatase, catalytic domain
  misc_feature (1)..(670): NCBI GI: 77553265 NCBI Desc: mrna capping enzyme - like protein [oryza sativa (japonica cultivar-group)]
  misc_feature (1)..(627): NCBI GI: 77553266 NCBI Desc: mrna capping enzyme - like protein [oryza sativa (japonica cultivar-group)]
  misc_feature (1)..(668): NCBI GI: 42572335 NCBI Desc: mrna capping enzyme family protein [arabidopsis thaliana]
  misc_feature (1)..(668): NCBI GI: 23306380 NCBI Desc: mrna capping enzyme - like protein [arabidopsis thaliana]
  misc_feature (15)..(336): NCBI GI: 6759452 NCBI Desc: mrna capping enzyme-like protein [arabidopsis thaliana]

SEQ ID NO: 8403 - DNA, 741 bp, Sorghum bicolor
  misc_feature: Ceres ANNOT ID no. 6090695
  misc_feature: Encodes the peptide sequence at SEQ ID NO 8404
atggcagcgtccacggcctcgcccaccttcacgcccttcctccaccggcaccagcagcggcgcaccaacgcagtcgtcgtcgttgccgctgcgagcaaccccggcgccgaaccgactccagcgacggcggcggacggcgcgggaccagcagggaagaagaagacggtggacacgaggatacactggtccaaccctgacgaagggtgggtaggaggcaatgccaagaaggaaggcggcggcagtggcggcggcagcaagaacgagccgctgggagggaggttcgccgacctcatcaacaacgcgtccgagtctcactaccagttcctggggatagcgccggaggcggacatcgaggagatcaaggcagcgtaccggcggctgtccaaggagtaccacccggacacgacgacgctgccgctcaaggtggcgtcgcagaagttcatccgcctgcgggaggtgtacaacgtgctgagcaaggaggagacgcggcgcttctacgactggacgctggcacaggaggccgagagccgccgcctgcagcagctcaggtccaggctcgaagacccctacgagcaggacatcatcaactacaagtccgtgccggacatggttgaccgcctcggtggcaagaacatggagctcagcgaccaggccatgactgcgctcacctttgatatcgtcatcatcatcatctcaatctgcagcatcatctatgctgtgtacttcaaggagcagtactga

SEQ ID NO: 8404 - protein, 246 aa, Sorghum bicolor
  misc_feature: Ceres ANNOT ID no. 6090695
  misc_feature (104)..(167): Pfam Id: DnaJ Pfam Desc: DnaJ domain
  misc_feature (102)..(179): NCBI GI: 22297662 NCBI Desc: heat shock protein [thermosynechococcus elongatus bp-1]
  misc_feature (102)..(233): NCBI GI: 126658449 NCBI Desc: heat shock protein dnaj-like [cyanothece sp. ccy0110]
  misc_feature (95)..(172): NCBI GI: 56751256 NCBI Desc: dnaj protein [synechococcus elongatus pcc 6301]
  misc_feature (102)..(172): NCBI GI: 81299077 NCBI Desc: heat shock protein dnaj-like [synechococcus elongatus pcc 7942]
  misc_feature (100)..(171): NCBI GI: 116073719 NCBI Desc: heat shock protein dnaj-like [synechococcus sp. rs9916]
MAASTASPTFTPFLHRHQQRRTNAVVVVAAASNPGAEPTPATAADGAGPAGKKKTVDTRIHWSNPDEGWVGGNAKKEGGGSGGGSKNEPLGGRFADLINNASESHYQFLGIAPEADIEEIKAAYRRLSKEYHPDTTTLPLKVASQKFIRLREVYNVLSKEETRRFYDWTLAQEAESRRLQQLRSRLEDPYEQDIINYKSVPDMVDRLGGKNMELSDQAMTALTFDIVIIIISICSIIYAVYFKEQY

SEQ ID NO: 8405 - DNA, 402 bp, Sorghum bicolor
  misc_feature: Ceres ANNOT ID no. 6090715
  misc_feature: Encodes the peptide sequence at SEQ ID NO 8406
atgcagggccttatgacgcatctcggggccgagatagcgaaggtgcgcgcggggcttgtcacgttgcggctcccgttccgccaagaactcacgcagcagcatggctacttccatgccggcggaacatcggccatcgccgacagcgcaggcggttacgctcatttcctcctcttccccgaaggcagttcggtcctgacggtcgagttcaaactgaacctgatcagcccggcgcaaggagattttaccgaggatgtcggccgcgtgatcaagaatggtcgcacactgaccatctgccagctcgatgtatggggcgttgatggagaacgccgcaaacatgtcgccacggggatgcaaacactgatctgcttgcatgacacgccagacctgcccgcatcgcgctag

SEQ ID NO: 8406 - protein, 133 aa, Sorghum bicolor
  misc_feature: Ceres ANNOT ID no. 6090715
  misc_feature (5)..(133): NCBI GI: 126464859 NCBI Desc: uncharacterized domain 1 [rhodobacter sphaeroides atcc 17029]
  misc_feature (2)..(128): NCBI GI: 114798994 NCBI Desc: thioesterase family protein [hyphomonas neptunium atcc 15444]
  misc_feature (2)..(130): NCBI GI: 89361826 NCBI Desc: phenylacetic acid degradation-related protein [xanthobacter autotrophicus py2]
  misc_feature (2)..(131): NCBI GI: 82947541 NCBI Desc: uncharacterized protein, possibly involved in aromatic compounds catabolism [magnetospirillum magneticum amb-1]
  misc_feature (2)..(131): NCBI GI: 46201787 NCBI Desc: cog2050: uncharacterized protein, possibly involved in aromatic compounds catabolism [magnetospirillum magnetotacticum ms-1]
MQGLMTHLGAEIAKVRAGLVTLRLPFRQELTQQHGYFHAGGTSAIADSAGGYAHFLLFPEGSSVLTVEFKLNLISPAQGDFTEDVGRVIKNGRTLTICQLDVWGVDGERRKHVATGMQTLICLHDTPDLPASR

SEQ ID NO: 8407 - DNA, 1338 bp, Sorghum bicolor
  misc_feature: Ceres ANNOT ID no. 6090743
  misc_feature: Encodes the peptide sequence at SEQ ID NO 8408
atggagatgcgaccaccgccgaccagggagatgcgaccaccgtcgcccatggaagacgaggcgatcgacggctggcttccgatcaacgcgaggaggaacgccaagtggtggtactccgccttccacaacgtcaccgccatggtcggcgccggcgtgctcggccttccctacgccatgtcccagctcggctgggaggtcggcatcacggtgctgatcctgtcgtggatcattacgctgtacacgctgtggcagatggtggagatgcacgagatggtgccgggcaggcggttcgaccggtaccacgagctggggcagcacgcgttcggggagaagctgggcctctggatcgtcgtgccgcagcagctggtggtggaggtgggcctcaacatcgtctacatggtcaccggcggccagtccctgcagaagttccacgacgtggtctgcgacggcaagtgcaaggacatcaagctcacctacttcatcatgatcttcgcctcctgccacttcgtgctctcccagctccccaacttccactccatctccggcgtctccctcgccgccgccgtcatgtcgctttgttactcgatgatcgcgtgggtcgcgtcggcgcacaaggggaagtcgccggaggtgcactacggcttgcgcgcgacgacgacgccggggaaggtgttcggcttcttcggcgcgctcggggacgtggcgttcgcttacgccgggcacaacgtggtgctggagatccaggccaccatcccgtcgacgccggacaagccgtccaagaaacccatgtggaagggtgtcatcgtcgcctacatcatcgtcgccgcgtgctacttccctgtctcgctcgtcggttactgggccttcggcaacagcgtcaatgagaacatccttgtcagcctcagaaaaccaaagtggctcgtcgccatggctaacatgatggtcgtcgttcatctcattggcagctaccagctctatgccatgccggtgtttgatatgatagagacggtgttggtgaggaggtttcggttccgtccaagcctgatgctccgcctgattgctcggagtgtctatgtcgggttcacgatgttcgtggccatcacattccctttcttcagtgcattgctcagcttctttggtggttttgctttcgcgccgacaacttattttcttccttgcatcatgtggctcacaatatgcaagcctagagcttttagcatctcatggtttactaactggatttgcattgttctaggagtgttgttgatggtactatcaccacttggtggacttcgacaaatcattttgacagccaagacatacaacttctatcaataa

SEQ ID NO: 8408 - protein, 445 aa, Sorghum bicolor
  misc_feature: Ceres ANNOT ID no. 6090743
  misc_feature (32)..(432): Pfam Id: Aa_trans Pfam Desc: Transmembrane amino acid transporter protein
  misc_feature (22)..(444): NCBI GI: 2576361 NCBI Desc: lysine and histidine specific transporter [arabidopsis thaliana]
  misc_feature (28)..(443): NCBI GI: 140046054 NCBI Desc: amino acid/polyamine transporter ii [medicago truncatula]
  misc_feature (22)..(444): NCBI GI: 1906549 NCBI Desc: amino acid permease [nicotiana sylvestris]
  misc_feature (11)..(413): NCBI GI: 2443875 NCBI Desc: amino acid permease [arabidopsis thaliana]
  misc_feature (32)..(444): NCBI GI: 92871429 NCBI Desc: amino acid/polyamine transporter ii [medicago truncatula]
  misc_feature: Useful for making plants with altered oil content
  misc_feature: Useful for making plants with modulated biomass
  misc_feature: Useful for making plants with modulated heat sensitivity
  misc_feature: Functional homolog of the protein sequence given in SEQ ID NO 13361
  misc_feature: GREAT-hit functional homolog of the protein sequence given in SEQ ID NO 13434
  misc_feature: GREAT-hit functional homolog of the protein sequence given in SEQ ID NO 13448
  misc_feature: Useful for making plants with altered oil content
  misc_feature: Functional homolog of the protein sequence given in SEQ ID NO 13448
  misc_feature: The sequence is a functional homolog of SEQ ID NO. 313 in the 11/188,298 US application
  misc_feature: The sequence is a functional homolog of SEQ ID NO. 438 in the 11/188,298 US application
MEMRPPPTREMRPPSPMEDEAIDGWLPINARRNAKWWYSAFHNVTAMVGAGVLGLPYAMSQLGWEVGITVLILSWIITLYTLWQMVEMHEMVPGRRFDRYHELGQHAFGEKLGLWIVVPQQLVVEVGLNIVYMVTGGQSLQKFHDVVCDGKCKDIKLTYFIMIFASCHFVLSQLPNFHSISGVSLAAAVMSLCYSMIAWVASAHKGKSPEVHYGLRATTTPGKVFGFFGALGDVAFAYAGHNVVLEIQATIPSTPDKPSKKPMWKGVIVAYIIVAACYFPVSLVGYWAFGNSVNENILVSLRKPKWLVAMANMMVVVHLIGSYQLYAMPVFDMIETVLVRRFRFRPSLMLRLIARSVYVGFTMFVAITFPFFSALLSFFGGFAFAPTTYFLPCIMWLTICKPRAFSISWFTNWICIVLGVLLMVLSPLGGLRQIILTAKTYNFYQ

SEQ ID NO: 8409 - DNA, 3255 bp, Sorghum bicolor
  misc_feature: Ceres ANNOT ID no. 6090745
  misc_feature: Encodes the peptide sequence at SEQ ID NO 8410
atggagcgggtggcgctgctccgcacctcaggccgccgcctcctacaccgctgccgcaggggcaggtccgtcgtcgtgcccaccgccgcggcctcatccttggcacgccggacgtcctcgttctcactcccggcgcgcggctactcggctctgccccgcggcggcgcgcgattcctggccgcggcggcgccgctgcactgctccggccggtactggccggccgctgcgccacagctcgcgcggaggctgtccgcccccgctgtgtctacctcgccctcacctgtgccctatgatacagatgacgtacatgagtatgctgcaaagctcggatttgaaaaggtctctgaacagactatagatgagtgcaaatcaaccgctgttctttacaagcacaagaagacaggtgctgaagtgatgtctgtgtcaaatgatgatgagaataaagtctttggcattgttttccgtacgcctccgaaaaattctactggcataccccacatccttgaacatagcgttctctgtggatcaagaaaataccctttaaaggaaccatttgttgagctcctaaagggtagtttgcatacattcttgaatgcattcacatatccagatcggacatgttatccggttgcatcaacaaacaccaaggatttttacaacttggtagacgtataccttgatgctgtctttttccctaaatgtgttgacgacttccaaacctttcaacaagaaggttggcactatgagcttgacaaccctgaagaagagataacatacaaaggtgtcgtcttcaatgagatgaaaggagtttactctcaacctgataacataatgggacgtgtatcccaacaggcactttcccctgataacacatatggtgttgatagtggtggggacccaaatgaaatcccaaagcttacttttgaagaattcaaggagttccatagtaagtattatcatccaagcaatgctagaatctggttctatggtgatgatgacccaaaagagcggctacgcgtgcttagtgaataccttgaccagtttgaagccagccctgctcctaatgaatcgaaggtttggccacagaggctattcaaagaacctgtgaggatcatagagaaataccctgctggtcaagaaggtgatttgacaaagaaatatatggtgtgcatcaattggcttttgtcagaggagccactagatgtagaaactgagcttgcacttggtttcctggatcatctattgctggggactccagcttcaccgcttagaaggattcttcttgagagtggtttaggagaagctattgtcggaggtggtgttgaggatgagctccttcaaccacaatttagcataggcctgaaaggtgtatcagaggataatattcaaaaagttgaagagttggttatgcaaactttgaataatttggcagaggaaggatttgcaacagaagcggtggaggcttccatgaacacgatcgaattttctcttcgggagaacaacacagggtcatttcctcgaggcttgtcactgatgcttcgttcgattgggaaatggatatatgatatggacccttttgagcctctgaaatatgaacagccactacagcaattgaaagcacgaattgcagaggaggggtcaaaagctgtgttctcaccgctcattgagaaatttattttgaagaatttgcatcgtgtcactgttgaaatgcagcctgatccagagaaatcatcacgtgatgaagcagctgagaaagagatcctaaaacaagtgaaagctagcatgactcaggaggatcttgcagagttggcacgtgctacaaaggagctaaaggaaaaacaagaaacaccagatcctccagaagctctcaaggctgtccctagtctgtcattgcaagatatcccaaaagagcctattcatgtaccaattgaggttggagagataaacggtgtcaaggttttgcaacatgatcttttcaccaatgatgtcgtctactctgaggttgtatttgatatgggttcgatgaagaaagaacatctgcaattgttgccattgttctgccaatccttactggagatgggcacaaaagacatggactttgtgcaacttaatcaattaattggtagaaaaactggaggcatatcagtttacccattcacgtcatcggttaggggaaaagaagatcctcttactcgcatcatcgttcggggaaaggcaatggcaccacgagtagaagatttgtttaatctgatgtacaccattcttcaagatgttcaattcacagaacagcagaggttcaagcagtttgtttctcaaagtaaagcaagaatggagaatcgattgaggggcagtggccatggcatagcagctgctagaatggatgctaagttaaatgcagctggatggatttcggaacaaatgggtggtgttagttatcttgagtatctgcgggacctggaaactaagattgatcaagactgggacagcatatcatcttcactcgaggaaatgagaaaatcactcttttccaagaatggttgcttgatcaacctaacaagtgactggaaaaatcttgaaaaatcaagccaacatattgccaaatttcttgattcactcccaagtaacccatcccttggaagtgatccatggctttctcggctaccttctgtgaatgaagccattgttgtcccaactcaggttaattatgttggaaaagctggaaacctttaccaaactggataccagctcaatggaagcgcctatgtcatctcaaagcacataagcaatacatggctatgggatcgtgttcgagttagcggtggtgcatatggaggattttgtgattttgacaaccattcaggagtgttctcatatttatcatatcgtgatccaaacttacttaaaacacttgaggtctatgacgagacagcaagattcctcagagagctagaaatggatgatgatgcactcacaaaagcaattattggaaccataggcgatgttgacgcctaccagctaccagatgctaaaggttacagcagcctaatgagatatttgctgggcatcacggatgaggagcgccagcagagacgtgaagagatactatcaacaagtctgaaggatttcaaggagttcgctgatgctgttgaaaccatcaaggacaacggggtcgtggttgccgttgcatcaccagatgatgttgaggctgcaaataaggaaaacccggtattccccgaagtaaagaagtgcctgtga

SEQ ID NO: 8410 - protein, 1084 aa, Sorghum bicolor
  misc_feature: Ceres ANNOT ID no. 6090745
  misc_feature (570)..(819): Pfam Id: M16C_assoc Pfam Desc: Peptidase M16C associated
  misc_feature (305)..(493): Pfam Id: Peptidase_M16_C Pfam Desc: Peptidase M16 inactive domain
  misc_feature (829)..(997): Pfam Id: Peptidase_M16_C Pfam Desc: Peptidase M16 inactive domain
  misc_feature (33)..(1084): NCBI GI: 9294618 NCBI Desc: zinc metalloprotease (insulinase family) [arabidopsis thaliana]
  misc_feature (88)..(1084): NCBI GI: 109157628 NCBI Desc: chain b, crystal structure of presequence protease prep from arabidopsis thaliana
  misc_feature (110)..(1084): NCBI GI: 118064507 NCBI Desc: peptidase m16c associated [roseiflexus castenholzii dsm 13941]
  misc_feature (110)..(1084): NCBI GI: 106891928 NCBI Desc: peptidase m16-like [roseiflexus sp. rs-1]
  misc_feature (110)..(1076): NCBI GI: 116749096 NCBI Desc: peptidase m16c associated domain protein [syntrophobacter fumaroxidans mpob]
MERVALLRTSGRRLLHRCRRGRSVVVPTAAASSLARRTSSFSLPARGYSALPRGGARFLAAAAPLHCSGRYWPAAAPQLARRLSAPAVSTSPSPVPYDTDDVHEYAAKLGFEKVSEQTIDECKSTAVLYKHKKTGAEVMSVSNDDENKVFGIVFRTPPKNSTGIPHILEHSVLCGSRKYPLKEPFVELLKGSLHTFLNAFTYPDRTCYPVASTNTKDFYNLVDVYLDAVFFPKCVDDFQTFQQEGWHYELDNPEEEITYKGVVFNEMKGVYSQPDNIMGRVSQQALSPDNTYGVDSGGDPNEIPKLTFEEFKEFHSKYYHPSNARIWFYGDDDPKERLRVLSEYLDQFEASPAPNESKVWPQRLFKEPVRIIEKYPAGQEGDLTKKYMVCINWLLSEEPLDVETELALGFLDHLLLGTPASPLRRILLESGLGEAIVGGGVEDELLQPQFSIGLKGVSEDNIQKVEELVMQTLNNLAEEGFATEAVEASMNTIEFSLRENNTGSFPRGLSLMLRSIGKWIYDMDPFEPLKYEQPLQQLKARIAEEGSKAVFSPLIEKFILKNLHRVTVEMQPDPEKSSRDEAAEKEILKQVKASMTQEDLAELARATKELKEKQETPDPPEALKAVPSLSLQDIPKEPIHVPIEVGEINGVKVLQHDLFTNDVVYSEVVFDMGSMKKEHLQLLPLFCQSLLEMGTKDMDFVQLNQLIGRKTGGISVYPFTSSVRGKEDPLTRIIVRGKAMAPRVEDLFNLMYTILQDVQFTEQQRFKQFVSQSKARMENRLRGSGHGIAAARMDAKLNAAGWISEQMGGVSYLEYLRDLETKIDQDWDSISSSLEEMRKSLFSKNGCLINLTSDWKNLEKSSQHIAKFLDSLPSNPSLGSDPWLSRLPSVNEAIVVPTQVNYVGKAGNLYQTGYQLNGSAYVISKHISNTWLWDRVRVSGGAYGGFCDFDNHSGVFSYLSYRDPNLLKTLEVYDETARFLRELEMDDDALTKAIIGTIGDVDAYQLPDAKGYSSLMRYLLGITDEERQQRREEILSTSLKDFKEFADAVETIKDNGVVVAVASPDDVEAANKENPVFPEVKKCL

SEQ ID NO: 8411 - DNA, 1497 bp, Sorghum bicolor
  misc_feature: Ceres ANNOT ID no. 6090749
  misc_feature: Encodes the peptide sequence at SEQ ID NO 8412
atggcggagaagtcgccggcggccgacgtggaggccggtctcctcgcccacctcaactccgcgggcgaggtccccgactcccgctccttcgcctcctcactcggcgtctcccacctcgagctcgagggcgttattaagagcctctcagctttccgcatcgtcgaaagcacagacatcgtcaaggagacatgggtgctcaccgaagaggccaagggctacgccgccaagggttccccagaggcacagctcgtcgccgcaatcccatcggagggcgcctccaaagacgctctcaaggcaaaattgggagatgctttcgatgttggcatgaaggcagctgcgaggaacaagtggatagggttcgagaaggggaacaaggacttggtccttaggaaggttgagagcgtaaaggatgagttacaagagcagcttagaagactagagaatggggaggttgttcctgataaagtgattgatgatttgaagagaaggaaacttattacgaaagagaaatcaatttggtactctctaaagaagggagctgagtttgttctaaagagaaaaactttggctactgatgtgacaacagaacaccttaggagtggtgactggaaggatcttgaattcaaagactataattatggagctcaaggacaacctatagccaaaggttatgtgcagcctttgatggaggttcgtgaggcaatcgagaacatctttattatgatgggattcactgagatgccaaccaacaatttcgttgaaagcagcttctggaattttgatgcactgttccagcctcaacagcatcctgctcgggattcacatgatacctttttcctgaaagccccagcaagtacaagacagttgcctgaagactatcttgagaaagtaaagcaagttcatcagtctggtggttatggctccaaaggatatggttatgactggaaacgggatgaagcggagaagaatcttctccgtactcatacaactgctgtttccacaagaatgttatacaagcttgctcaggagaaaccttttgctccaaagagatattactcgattgatcgggttttccgcaatgaagctgttgaccggactcatcttgctgaattccaccagatagaaggtcttatctgtgattatggtttgacactaggtgatctgattggtgtattggaggatttcttctcgagtctaggcatgtccaagctgcgtttcaaacctgcctacaatccatatactgaaccaagcatggaaattttcagttaccatgatggtttgaagaaatgggtggaagttggtaattcaggcatgttcaggccagagatgttgcttcccatgggactgccagaaggtgttaatgttattgcgtggggtctttcacttgaaaggccaacgatgatcctttatggtatcgacaacataagggacctgtttggaccaaaggttgatttcaacctcatcaagagcaacccactatgccggttgggactgtag

SEQ ID NO: 8412 - protein, 498 aa, Sorghum bicolor
  misc_feature: Ceres ANNOT ID no. 6090749
  misc_feature (210)..(491): Pfam Id: tRNA-synt_2d Pfam Desc: tRNA synthetases class II core domain (F)
  misc_feature (8)..(498): NCBI GI: 115481904 NCBI Desc: os10g0400800 [oryza sativa (japonica cultivar-group)]
  misc_feature (251)..(498): NCBI GI: 4914440 NCBI Desc: phenylalanyl-trna synthetase-like protein [arabidopsis thaliana]
  misc_feature (26)..(496): NCBI GI: 42793997 NCBI Desc: loc407666 protein [danio rerio]
  misc_feature (26)..(496): NCBI GI: 125628681 NCBI Desc: phenylalanine-trna synthetase-like, alpha subunit [danio rerio]
  misc_feature (26)..(496): NCBI GI: 146345522 NCBI Desc: phenylalanyl-trna synthetase alpha chain (phenylalanine--trna ligase alpha chain) (phers)
  misc_feature (26)..(496): SWISSPROT Homolog: EC 6.1.1.20 Phenylalanyl-tRNA synthetase alpha chain
MAEKSPAADVEAGLLAHLNSAGEVPDSRSFASSLGVSHLELEGVIKSLSAFRIVESTDIVKETWVLTEEAKGYAAKGSPEAQLVAAIPSEGASKDALKAKLGDAFDVGMKAAARNKWIGFEKGNKDLVLRKVESVKDELQEQLRRLENGEVVPDKVIDDLKRRKLITKEKSIWYSLKKGAEFVLKRKTLATDVTTEHLRSGDWKDLEFKDYNYGAQGQPIAKGYVQPLMEVREAIENIFIMMGFTEMPTNNFVESSFWNFDALFQPQQHPARDSHDTFFLKAPASTRQLPEDYLEKVKQVHQSGGYGSKGYGYDWKRDEAEKNLLRTHTTAVSTRMLYKLAQEKPFAPKRYYSIDRVFRNEAVDRTHLAEFHQIEGLICDYGLTLGDLIGVLEDFFSSLGMSKLRFKPAYNPYTEPSMEIFSYHDGLKKWVEVGNSGMFRPEMLLPMGLPEGVNVIAWGLSLERPTMILYGIDNIRDLFGPKVDFNLIKSNPLCRLGL

SEQ ID NO: 8413 - DNA, 297 bp, Sorghum bicolor
  misc_feature: Ceres ANNOT ID no. 6090754
  misc_feature: Encodes the peptide sequence at SEQ ID NO 8414
atggcgttcatgcggtactaccgcgcgctgccggagggggagacgacggtggaggagttcagggcgtggctgagccagttcgacgcggacggcgacggccggatcagccgggacgagctggagcaggcgctgcgcagcctcaacctgtggttcgtgtggtggaaggcgcgggaggcggtgcgcgcggccgacgccaaccgcaacggcgcggtggacggcgacgagatgggcaggctctacgcgttcgcgcacaagcacctccacctcaagatgagccagctggacctggaggagtag

SEQ ID NO: 8414 - protein, 98 aa, Sorghum bicolor
  misc_feature: Ceres ANNOT ID no. 6090754
  misc_feature (19)..(47): Pfam Id: efhand Pfam Desc: EF hand
  misc_feature (8)..(92): NCBI GI: 115473387 NCBI Desc: os07g0619200 [oryza sativa (japonica cultivar-group)]
  misc_feature (19)..(80): NCBI GI: 115447199 NCBI Desc: os02g0606500 [oryza sativa (japonica cultivar-group)]
  misc_feature (10)..(80): NCBI GI: 28301674 NCBI Desc: calcium-binding protein [lotus corniculatus var. japonicus]
  misc_feature (27)..(80): NCBI GI: 38346226 NCBI Desc: oj990528_30.6 [oryza sativa (japonica cultivar-group)]
  misc_feature (1)..(81): NCBI GI: 62897047 NCBI Desc: calmodulin-like skin protein variant [homo sapiens]
MAFMRYYRALPEGETTVEEFRAWLSQFDADGDGRISRDELEQALRSLNLWFVWWKAREAVRAADANRNGAVDGDEMGRLYAFAHKHLHLKMSQLDLEE

SEQ ID NO: 8415 - DNA, 1821 bp, Sorghum bicolor
  misc_feature: Ceres ANNOT ID no. 6090761
  misc_feature: Encodes the peptide sequence at SEQ ID NO 8416
atggtgatggggaggcaaagcaatagctacgggagcgggggcgacgaggagcggctgcccctccgcggcgtgctggagacgcagcagcgggcgccggggacgccgccgccggtccaccacgccgcggagcagctgaaggaggcgaggcgcgggggcagcaggctctggcgcgcgtccgtgcgcgccgggctggtgctctgcctgctgaccgtcccggccgtcctgctgctgctgcggtggcaggccgacgcctcgccgcagtgggtcttcgacttcgaggcccccgaggaagacgacgaccaagatatacaagatgatatgtccgatgatctatctccatcgccacaaatagcgtacgaccgacttctgggtggccttctggttgagggttttgatgagaaatcatgtagaagcaggtatcagtttgcacgctatcacaattcaccaagcataccttctgcatacctcatagagaggttaaggaaacaagaagctttgcagaaaaagtgtggtccaggcaccaaagcatacaaggaagcctcaaagcagctgaagtatggtcaaagcatcaatacgacagattgcaactatctgtatctgattatccatgctggcttagggaaccggatgcttgagatcacttcagcattcctttatgcgctacttacaaaccggattttgctcgtggaccgttataaggagattgcagaccttttttgtgaaccctttcctggaacatcgtggttggttccttcagatttccctctgaacaatgacgagttcagtcagactagtcctgagagctatggcaacatgctccagaataaagttttcggtggaaatacagatcgatctttggctggtaatagacctccctatgtgtatctccaccttgatggcacctatggtttccatgacaaacttttcttctgtgaagacgaccaacagttcctgcaagaggtttcatggttgatcatgagaacagacatgtactttgtgccgtccctatttctcattccagctttccaagatgaactcagcaggctatttcctgagaaagacactgttttccatcacttggcacgctatctttttcatccgacaaataatgtttggtattcagttacaaaatacttccggtcctacctggccaaagctgaaaaaagagtgggaattcagatcagaatatatgaaaccaaaggtatcttacaaagaaatggtccgttcccacacattttgaatcagatcctctcatgtgctcaaaatgaaaagctgcttccagaagttagtatggcagagggagcagcagctgagactcagaataaccgaacagcagctgggactcagaataaccgaacgattgctgttctaacaacttctttgagctcttggtacagtgatcagattcagaagaagtacgatgagcaaccagctgttgatggcataactgtcaaagtgttccagccgagccacgaggagtaccagaggtcaaggaacaagaagcacaacatgaaggcacttgctgagatctatctactgagcatgagcgatgaactgataaccagtggcttttccacgtttgggtacgctgctcaggggctcgctggcctgaagccatggatcatgtttaagtcggagaaccacgtgatgccagacccaccgtgcggccgtgccatgtccattgagccgtgcttccatcaggctcccttctacgactgcaaagcgaagaaggacgctgatttgggcaaggtagtgccttatgtgaggcactgcgaggacgtgagctgggggctgaagattgtaaatcaaactcatttgtag

SEQ ID NO: 8416 - protein, 606 aa, Sorghum bicolor
  misc_feature: Ceres ANNOT ID no. 6090761
  misc_feature (88)..(575): Pfam Id: XG_FTase Pfam Desc: Xyloglucan fucosyltransferase
  misc_feature (120)..(602): NCBI GI: 115467050 NCBI Desc: os06g0212500 [oryza sativa (japonica cultivar-group)]
  misc_feature (106)..(602): NCBI GI: 145323884 NCBI Desc: fut8 (fucosyltransferase 8); galactoside 2-alpha-l-fucosyltransferase [arabidopsis thaliana]
  misc_feature (109)..(603): NCBI GI: 145362118 NCBI Desc: fut4 (fucosyltransferase 4); fucosyltransferase [arabidopsis thaliana]
  misc_feature (119)..(602): NCBI GI: 115458656 NCBI Desc: os04g0449100 [oryza sativa (japonica cultivar-group)]
  misc_feature (119)..(602): NCBI GI: 116310071 NCBI Desc: h0818e04.9 [oryza sativa (indica cultivar-group)]
  misc_feature (293)..(601): SWISSPROT Homolog: EC 2.4.1.69 Galactoside 2-alpha-L-fucosyltransferase
  misc_feature: Useful for making plants with altered cell wall content and/or composition
  misc_feature: Functional homolog of the protein sequence encoded by LOCUS at2g03220
  misc_feature: Useful for making plants with altered carbohydrate content
  misc_feature: Functional homolog of the protein sequence given in SEQ ID NO 14024
  misc_feature: Useful for making plants with altered cell wall content and/or composition
  misc_feature: Functional homolog of the protein sequence given in SEQ ID NO 14025
MVMGRQSNSYGSGGDEERLPLRGVLETQQRAPGTPPPVHHAAEQLKEARRGGSRLWRASVRAGLVLCLLTVPAVLLLLRWQADASPQWVFDFEAPEEDDDQDIQDDMSDDLSPSPQIAYDRLLGGLLVEGFDEKSCRSRYQFARYHNSPSIPSAYLIERLRKQEALQKKCGPGTKAYKEASKQLKYGQSINTTDCNYLYLIIHAGLGNRMLEITSAFLYALLTNRILLVDRYKEIADLFCEPFPGTSWLVPSDFPLNNDEFSQTSPESYGNMLQNKVFGGNTDRSLAGNRPPYVYLHLDGTYGFHDKLFFCEDDQQFLQEVSWLIMRTDMYFVPSLFLIPAFQDELSRLFPEKDTVFHHLARYLFHPTNNVWYSVTKYFRSYLAKAEKRVGIQIRIYETKGILQRNGPFPHILNQILSCAQNEKLLPEVSMAEGAAAETQNNRTAAGTQNNRTIAVLTTSLSSWYSDQIQKKYDEQPAVDGITVKVFQPSHEEYQRSRNKKHNMKALAEIYLLSMSDELITSGFSTFGYAAQGLAGLKPWIMFKSENHVMPDPPCGRAMSIEPCFHQAPFYDCKAKKDADLGKVVPYVRHCEDVSWGLKIVNQTHL

SEQ ID NO: 8417 - DNA, 1737 bp, Sorghum bicolor
  misc_feature: Ceres ANNOT ID no. 6090763
  misc_feature: Encodes the peptide sequence at SEQ ID NO 8418
atggacatcaaggagcggatccgccgctcgccgccgccgacgccgaaggcggtaggggaggcggcgtccgcgcccgggcacccgcgcgggaggaagggccgggtcgcgctgctgcccctgtcgatcgcggcgctcgtggcgtgcggggtcacgctgctgctgctcgcgggcggctccgcggcgaggaggggcggccaattctccggcgcggatcgtaccactctctccggcgccggcaacaacgaccgtggcggccttgaccaggccggaccgcgcgatggagagcatgaaactatggtgtcttccaaagttcaaagggacagactaattggtggcttgttagctcctggttttgatgaacagtcatgtctaagtagataccaatcagcattgtaccgtaaagaatcgccccatttgatatcatcataccttctggaaagactgagagaacatgaggttctccagaagaaatgtggcccgtatacagagtcatacaagaaagctattgagcaactaaaatctggtcaggatgttatggttggagattgcaactttttggtatgggtatcttatagtggtcttgggaacaggatcttgactattgcctcagcatttctctatgccatccttacaaacagagttttacttgtagatggagataaaggcactgcagatcttttctgtgaaccattccctgaaacttcatggttattaccaccggatttccctattattcaatttaagaacttcagtattggctcccccgagagtcacggaaacatggtgaaaactgaagctattcattctgatggttcttttaagggtcctaaacctgcctttctatatcttcacctggctcatgactatgatgattatgataaactttttttctgtgagcatagtcagcaacatcttcagaagatcccatggctgatcttaagatccgataattactttgtaccttcactttttctgatcccatcataccaagaggaactcacgaggctgtttccgcagaaagatgtcgttttccatcacttgggacgttacttgttccaccctaccaatgttgtctggggcttgattacaaggtactacgattcttatcttgccagagctgatgagaagttaggtatccagatcagagtcttcgatactgaaaccggtccatttcagcatgtcttggatcaggtccttgattgcacactgaaggaaaaattactaccagagattaacgcacaacagccgattatctcgacagggaacatcaggtccaaagttgttctgattacttctttgaactcaggatactatgaaagaatcaggaacatgtattgggaacatccaacagagagtggtgagataattagcttccaccagccaagtcacgaggagcatcaggattcagacaagaaaatgcataacatgaaagcattggcagagatttatctgttgagcttatctgatgttatggtaacaagtgcatggtcaacttttgggtatgtagctcaaggtctgagtggttcgaagacgtggctaatgttcaagccggaaaaccgcactgcgcctaatccaccttgccgtcaagttatgtctatagagccgtgctttcatgctccacctttctacgattgcaaaactaggaagggaactgatacaggaaagcttgttccacatgtaagacactgtgaagatatgagctgggggctcaagctagttgatacgggtgagctgtag

SEQ ID NO: 8418 - protein, 578 aa, Sorghum bicolor
  misc_feature: Ceres ANNOT ID no. 6090763
  misc_feature (74)..(547): Pfam Id: XG_FTase Pfam Desc: Xyloglucan fucosyltransferase
  misc_feature (7)..(577): NCBI GI: 115448871 NCBI Desc: os02g0764400 [oryza sativa (japonica cultivar-group)]
  misc_feature (101)..(574): NCBI GI: 7453579 NCBI Desc: xyloglucan fucosyltransferase [pisum sativum]
  misc_feature (102)..(573): NCBI GI: 5231145 NCBI Desc: xyloglucan fucosyltransferase [arabidopsis thaliana]
  misc_feature (99)..(573): NCBI GI: 115467050 NCBI Desc: os06g0212500 [oryza sativa (japonica cultivar-group)]
  misc_feature (102)..(575): NCBI GI: 145323884 NCBI Desc: fut8 (fucosyltransferase 8); galactoside 2-alpha-l-fucosyltransferase [arabidopsis thaliana]
  misc_feature (101)..(574): SWISSPROT Homolog: EC 2.4.1.69 Galactoside 2-alpha-L-fucosyltransferase
  misc_feature: Useful for making plants with altered cell wall content and/or composition
  misc_feature: Functional homolog of the protein sequence encoded by LOCUS at1g14070
  misc_feature: Functional homolog of the protein sequence encoded by LOCUS at1g14080
  misc_feature: Functional homolog of the protein sequence encoded by LOCUS at1g14100
  misc_feature: Functional homolog of the protein sequence encoded by LOCUS at1g14110
  misc_feature: Functional homolog of the protein sequence encoded by LOCUS at1g74420
  misc_feature: Functional homolog of the protein sequence encoded by LOCUS at2g03210
  misc_feature: GREAT-hit functional homolog of the protein sequence encoded by LOCUS at2g03220
  misc_feature: Functional homolog of the protein sequence encoded by LOCUS at2g15350
  misc_feature: Functional homolog of the protein sequence encoded by LOCUS at2g15370
  misc_feature: Functional homolog of the protein sequence encoded by LOCUS at2g15390
  misc_feature: Useful for making plants with altered cell wall content and/or composition
  misc_feature: Functional homolog of the protein sequence given in SEQ ID NO 14023
  misc_feature: Useful for making plants with altered carbohydrate content
  misc_feature: Functional homolog of the protein sequence given in SEQ ID NO 14024
MDIKERIRRSPPPTPKAVGEAASAPGHPRGRKGRVALLPLSIAALVACGVTLLLLAGGSAARRGGQFSGADRTTLSGAGNNDRGGLDQAGPRDGEHETMVSSKVQRDRLIGGLLAPGFDEQSCLSRYQSALYRKESPHLISSYLLERLREHEVLQKKCGPYTESYKKAIEQLKSGQDVMVGDCNFLVWVSYSGLGNRILTIASAFLYAILTNRVLLVDGDKGTADLFCEPFPETSWLLPPDFPIIQFKNFSIGSPESHGNMVKTEAIHSDGSFKGPKPAFLYLHLAHDYDDYDKLFFCEHSQQHLQKIPWLILRSDNYFVPSLFLIPSYQEELTRLFPQKDVVFHHLGRYLFHPTNVVWGLITRYYDSYLARADEKLGIQIRVFDTETGPFQHVLDQVLDCTLKEKLLPEINAQQPIISTGNIRSKVVLITSLNSGYYERIRNMYWEHPTESGEIISFHQPSHEEHQDSDKKMHNMKALAEIYLLSLSDVMVTSAWSTFGYVAQGLSGSKTWLMFKPENRTAPNPPCRQVMSIEPCFHAPPFYDCKTRKGTDTGKLVPHVRHCEDMSWGLKLVDTGEL

SEQ ID NO: 8419 - DNA, 1236 bp, Sorghum bicolor
  misc_feature: Ceres ANNOT ID no. 6090775
  misc_feature: Encodes the peptide sequence at SEQ ID NO 8420
atggcgagcagacgtgcgatcttgttgggtttggccgtcctgtccctagcggccgccgcattcgtgcgaacagcaggccacggcgccggcgagctcgccggcaacgcggccttcgcgaaggcgagcgggacgcgcttcacgctcggcgggcggccgttctactcgaacggcttcaacgcgtactggctcatgtacatggcgtcggacccggcggaccggagcaaggcgacggccgcgctggatgaggcggcccgcgtcggcgcgacgctggtgcggacgtgggcgttcagcgacgggggctaccgggcgttgcaggtgtcgcccggggtgtacaacgagcaggtcttcaggggtctggactatgtgatatccgaagcaaagaagcgcgggatccatttgattctgagcctggtgaacaactgggacgggtacggcggaaagaagcagtacgtgcagtgggcaagaacccaggggcacaatctgaattctgatgatgacttcttcacgaacagtgtaaccaaggggttctacaagaaccatgcagtcctcactcgcgtgaacaagatcaccggagtggcgtacaaggacgaccccaccatcttcgcgtgggagctcatgaacgagcctcgctgccagagcgacctctccgggaaggctctgcaggcgtggatcacggagatggccggctacgtcaagtccgtggatcccaaccatatggtggagatcgggctcgaaggcttctacggcgagtccacgcctgaccgcacgcacaagtttaaccccggcggctacgccgtcggcaccgacttcatctccaacaacctcatccccggcatcgacttcgccacgatccactcctaccccgaccaatgggtgcccggcgcgagcaacgacgcgcaggtggcgttcatgcggcggtggatggcgtcgcacgccggcgacgccgcggcggtgctgcggaagccgctgctggtggcggagttcgggtggtcggcgcggtccaacggctacacggtgtccatgcgggacgcctacttccgcatggtgtacgacgcgatctacgcgtcggcgagcgcgggaggcccgctcgcggggggactcttctggcaggtgatggtgcccgggatggagagctggaccgacggctacgacgtcgtgctcgaccgcagcccgtccacggccgacgtcgtcagccaggagtgcgcccggatcaccggcctcaaccaggtgtcctag

SEQ ID NO: 8420 - protein, 411 aa, Sorghum bicolor
  misc_feature: Ceres ANNOT ID no. 6090775
  misc_feature (44)..(368): Pfam Id: Cellulase Pfam Desc: Cellulase (glycosyl hydrolase family 5)
  misc_feature (32)..(407): NCBI GI: 86169677 NCBI Desc: 1,4-beta-d-mannan endohydrolase precursor [hordeum vulgare subsp. vulgare]
  misc_feature (1)..(407): NCBI GI: 10178872 NCBI Desc: (1-4)-beta-mannan endohydrolase [coffea arabica]
  misc_feature (12)..(409): NCBI GI: 125951434 NCBI Desc: mannan endo-1,4-beta-mannosidase 1 precursor (beta-mannanase 1) (endo-beta-1,4-mannanase 1) (osman1)
  misc_feature (35)..(408): NCBI GI: 29786430 NCBI Desc: endo-beta-1,4-mannanase [lactuca sativa]
  misc_feature (13)..(407): NCBI GI: 110704384 NCBI Desc: endo-1,4-beta-mannanase [glycine max]
  misc_feature (12)..(409): SWISSPROT Homolog: EC 3.2.1.78 Mannan endo-1,4-beta-mannosidase 1 precursor
  misc_feature: The sequence is a functional homolog of SEQ ID NO 2 in US patent 7148399
MASRRAILLGLAVLSLAAAAFVRTAGHGAGELAGNAAFAKASGTRFTLGGRPFYSNGFNAYWLMYMASDPADRSKATAALDEAARVGATLVRTWAFSDGGYRALQVSPGVYNEQVFRGLDYVISEAKKRGIHLILSLVNNWDGYGGKKQYVQWARTQGHNLNSDDDFFTNSVTKGFYKNHAVLTRVNKITGVAYKDDPTIFAWELMNEPRCQSDLSGKALQAWITEMAGYVKSVDPNHMVEIGLEGFYGESTPDRTHKFNPGGYAVGTDFISNNLIPGIDFATIHSYPDQWVPGASNDAQVAFMRRWMASHAGDAAAVLRKPLLVAEFGWSARSNGYTVSMRDAYFRMVYDAIYASASAGGPLAGGLFWQVMVPGMESWTDGYDVVLDRSPSTADVVSQECARITGLNQVS

SEQ ID NO: 8421 - DNA, 1470 bp, Sorghum bicolor
  misc_feature: Ceres ANNOT ID no. 6090779
  misc_feature: Encodes the peptide sequence at SEQ ID NO 8422
atggctggcgccggtggaggaggcggagacgccggcgatagcttctacagcgacttcatggtcctgcggccggacaaaggcgggctctacgccctcttccacctcatgtggtcgtgcaaggtgtccgagaacgcggccgtcgactgccccgccggcacggagatggccgactggcgtaggcggtgggcggttctcgtctcgctggtggcgcaggtgctgctgctgtgggcgaagaagccgatggccctggttgggagagcgacagagtactggatgaacctcgtcaacgagaatggcggcggcgtcctcgtgctcgtcctcagagcgctgcaaggaaagctgaaatttccggacagggcatcccccaacttccgatcctgcctaggactactcgacatgagagtcgaactagacaaggaaattaagcaaggggatagcaactaccacgctgctctatcgatcatggctgcaaagctagcctacgagaatgagctcgtcatcagaaatgtcgtcgagaaacattggcagatgaaattactgtcgtgctacaactgctggaatgatttccaagaggactacaccacccaggcgtttctggtcgccgacaagcaggcgcctgacgcgagcctcgccgtggtggcgttcagcggcacgaggccgttcgacatggagcagtggtgcacggacgtggacttctcgtggtacgaggtccccggcgtgggcaagatccacggcggcttcatgaaggcgctcggcctgcagaggcacggcggctggccgagagacgtcgccgacccggacccgcggaagccgttcgcgtactacgccatccgcgacgcgctgcggcgcttcctgtccgagaacgccggcgccaggttcgtcgtggccgggcacagcctcggcggcgcgctcgccgtgctgttcccggccgtcctggcgctgcaccgggaggacgccgtgctggcgcggctgcggggcgtgtacacgttcggccagcctcgcgtcggggacgaggcgttcgggaggttcatggacgacgcgtgcctcggcaagcccagcaggtacttcaggttcgtgtactgcaacgacatcgtgccgagggtgccgtacgacgactccgcgcttcagttcaagcacttcggaacctgcctctacttcaatagcctctacacaggacaggtgatgcaagaggagccaaacaagaactacttctcggtgctgacggtggcgcccaaggtcgtgaacgcggcgtgggagctcatccggagcttcctcatcggctacctcgccgggccggagtacgcagaggggtggctgatgcgcctcgccagggtcgccgggctcgtgctgccggggctgcccccgcactcgccgcgagattacgttaactccaccacgctcggagcacgtttgctcaggactcaggcagatgagctaaacctcaacagtcacagtacaggaccatcatag

SEQ ID NO: 8422 - protein, 489 aa, Sorghum bicolor
  misc_feature: Ceres ANNOT ID no. 6090779
  misc_feature (212)..(373): Pfam Id: Lipase_3 Pfam Desc: Lipase (class 3)
  misc_feature (1)..(472): NCBI GI: 46806075 NCBI Desc: lipase class 3-like [oryza sativa (japonica cultivar-group)]
  misc_feature (18)..(477): NCBI GI: 51090505 NCBI Desc: lipase class 3-like [oryza sativa (japonica cultivar-group)]
  misc_feature (15)..(469): NCBI GI: 92897162 NCBI Desc: lipase, class 3 [medicago truncatula]
  misc_feature (19)..(467): NCBI GI: 42568828 NCBI Desc: lipase class 3 family protein [arabidopsis thaliana]
  misc_feature (15)..(473): NCBI GI: 79588733 NCBI Desc: triacylglycerol lipase [arabidopsis thaliana]
MAGAGGGGGDAGDSFYSDFMVLRPDKGGLYALFHLMWSCKVSENAAVDCPAGTEMADWRRRWAVLVSLVAQVLLLWAKKPMALVGRATEYWMNLVNENGGGVLVLVLRALQGKLKFPDRASPNFRSCLGLLDMRVELDKEIKQGDSNYHAALSIMAAKLAYENELVIRNVVEKHWQMKLLSCYNCWNDFQEDYTTQAFLVADKQAPDASLAVVAFSGTRPFDMEQWCTDVDFSWYEVPGVGKIHGGFMKALGLQRHGGWPRDVADPDPRKPFAYYAIRDALRRFLSENAGARFVVAGHSLGGALAVLFPAVLALHREDAVLARLRGVYTFGQPRVGDEAFGRFMDDACLGKPSRYFRFVYCNDIVPRVPYDDSALQFKHFGTCLYFNSLYTGQVMQEEPNKNYFSVLTVAPKVVNAAWELIRSFLIGYLAGPEYAEGWLMRLARVAGLVLPGLPPHSPRDYVNSTTLGARLLRTQADELNLNSHSTGPS

SEQ ID NO: 8423 - DNA, 1116 bp, Sorghum bicolor
  misc_feature: Ceres ANNOT ID no. 6090783
  misc_feature: Encodes the peptide sequence at SEQ ID NO 8424
atggcgctctccgaccgctcccgcgagtcgctcctcccgagcttcctctacagctcctcggcgcgctccttcgccgccacaggcgccgccgccgcgcgcctccctgtctcggccccggcgcctgccgcggctggagcaggaggccgcgtgccgttctcgatccaggcgcccagcgagaagatcgagatgtactcgccggccttctacgcagcctgcacagccggaggaatcgccagctgcgggctcacccacatggccgtcacgccgctcgacctcgtcaagtgcaacatgcagatcgatccagcgaaatacaagagtatctcatctggatttggtgtcctgttaaaggagcaaggggctaggggcttcttcaggggatgggtccctaccttgcttggttacagtgctcagggggcttgcaagtttggcttctatgagttctttaagaagtattactcggacattgcagggcctgagtatgcccagaagtacaagactctgatctaccttgcaggatccgcatctgctgaggtaattgctgatgtggctctctgcccttttgaagctgtgaaggtacgtgtgcagacacaacctggatttgctcgtgggttgagtgatgggctccccaaatttgtccgatctgagggtgctcttgggctctacaagggaattgttcctctctggggtcgtcagattccttatacaatgatgaagtttgcttcctttgagaccatcgttgagcttatctacaagcatgctgtgcctgttccgaagtctgagtgcagcaagactacccagttgggtattagctttgctggcggttacattgctggtgtcttctgtgctattgtgtctcacccggctgacaatcttgtgtctttcctgaacaatgccaagggtgctacagtgggcgatgctgttaagaagctgggtctctggggtcttttcactagaggacttcctcttcgtatcgtcatgattggtacccttactggtgctcagtggggaatttacgatgctttcaaagtgatggttggactcccaacaacgggaggacctgcaccagcagcggtggctgccccagcagcagaggctgaatcgaaagccagtgcttga

SEQ ID NO: 8424 - protein, 371 aa, Sorghum bicolor
  misc_feature: Ceres ANNOT ID no. 6090783
  misc_feature (68)..(156): Pfam Id: Mito_carr Pfam Desc: Mitochondrial carrier protein
  misc_feature (165)..(253): Pfam Id: Mito_carr Pfam Desc: Mitochondrial carrier protein
  misc_feature (1)..(371): NCBI GI: 3318613 NCBI Desc: mitochondrial phosphate transporter [zea mays]
  misc_feature (1)..(363): NCBI GI: 46806078 NCBI Desc: mitochondrial phosphate transporter [oryza sativa (japonica cultivar-group)]
  misc_feature (1)..(364): NCBI GI: 3318611 NCBI Desc: mitochondrial phosphate transporter [glycine max]
  misc_feature (3)..(355): NCBI GI: 38344833 NCBI Desc: osjnba0064h22.14 [oryza sativa (japonica cultivar-group)]
  misc_feature (3)..(355): NCBI GI: 116310067 NCBI Desc: h0818e04.5 [oryza sativa (indica cultivar-group)]
  misc_feature: The sequence is a functional homolog of SEQ ID NO. 398 in the 11/188,298 US application
MALSDRSRESLLPSFLYSSSARSFAATGAAAARLPVSAPAPAAAGAGGRVPFSIQAPSEKIEMYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGIVPLWGRQIPYTMMKFASFETIVELIYKHAVPVPKSECSKTTQLGISFAGGYIAGVFCAIVSHPADNLVSFLNNAKGATVGDAVKKLGLWGLFTRGLPLRIVMIGTLTGAQWGIYDAFKVMVGLPTTGGPAPAAVAAPAAEAESKASA

SEQ ID NO: 8425 - DNA, 624 bp, Sorghum bicolor
  misc_feature: Ceres ANNOT ID no. 6090789
  misc_feature: Encodes the peptide sequence at SEQ ID NO 8426
atggcggtggcgctggccctcgcggtggcgcttgccgtcgcgtcgctccacgcggaggcggtgtggctggacgtgccacagtcggggaccaagtgcgtgtctgaggagatccagtccaacgtggtggtgctcgccgactattccatcatgttcgagtcccacccccactcgcatcccaccatcgccgtcaaggttacttcaccatatgggaacaccttgcatcacagtgagaatgctacagttggtcaatttgcattcacaactgcagaagctggaaactaccttgcatgcttctggatagacagtgcagagaaaggatcaggagtatctgtgaatcttgactggaagattgggattgcaacaaaagattgggatgctattgctaagaaggaaaaaattgagggtgtagaactagaacttcggaaacttgaagtggcagtacaggccattcatcagaacttgatatacctcaaagaaagggaagcagagatgcgaactgtgagtgaggcaacaaatgcaagggttgtctggttcagtactctggcactatgggtctgcattgcggtatcagttttgcaagtgtggcatcttcaagggttcttcagaaagaagaagctcatttag

SEQ ID NO: 8426 - protein, 207 aa, Sorghum bicolor
  misc_feature: Ceres ANNOT ID no. 6090789
  misc_feature (45)..(117): Pfam Id: EMP24_GP25L Pfam Desc: emp24/gp25L/p24 family/GOLD
  misc_feature (1)..(207): NCBI GI: 47026935 NCBI Desc: emp24 protein [hyacinthus orientalis]
  misc_feature (5)..(207): NCBI GI: 124360279 NCBI Desc: emp24/gp25l/p24 [medicago truncatula]
  misc_feature (19)..(207): NCBI GI: 38566614 NCBI Desc: at1g09580 [arabidopsis thaliana]
  misc_feature (4)..(207): NCBI GI: 21387055 NCBI Desc: transmembrane protein-like protein [arabidopsis thaliana]
  misc_feature (37)..(207): NCBI GI: 144924891 NCBI Desc: emp24/gp25l/p24 [medicago truncatula]
  misc_feature: Useful for making plants with altered cell wall content and/or composition
  misc_feature: GREAT-hit functional homolog of the protein sequence encoded by LOCUS at1g09580
  misc_feature: Functional homolog of the protein sequence encoded by LOCUS at1g21900
  misc_feature: Functional homolog of the protein sequence encoded by LOCUS at1g57620
  misc_feature: Functional homolog of the protein sequence encoded by LOCUS at3g10780
  misc_feature: Useful for making plants with altered carbohydrate content
  misc_feature: Functional homolog of the protein sequence given in SEQ ID NO 13728
  misc_feature: Useful for making plants with altered cell wall content and/or composition
  misc_feature: Functional homolog of the protein sequence given in SEQ ID NO 13729
MAVALALAVALAVASLHAEAVWLDVPQSGTKCVSEEIQSNVVVLADYSIMFESHPHSHPTIAVKVTSPYGNTLHHSENATVGQFAFTTAEAGNYLACFWIDSAEKGSGVSVNLDWKIGIATKDWDAIAKKEKIEGVELELRKLEVAVQAIHQNLIYLKEREAEMRTVSEATNARVVWFSTLALWVCIAVSVLQVWHLQGFFRKKKLI

SEQ ID NO: 8427 - DNA, 867 bp, Sorghum bicolor
  misc_feature: Ceres ANNOT ID no. 6090796
  misc_feature: Encodes the peptide sequence at SEQ ID NO 8428
atggcgacggcggccacggcgtccgcgacggcggcgacccgcttcacgctcctagcgggcgcggggctccgcagccgcatcagccgccgccccaccgccgtgcggttccagcgccagcgggggctcaccaccaccgcgctactgaagaccgccgacctcctgcccaaggcgcagggccagcccgagacgctcgactaccgcgtcttcctcgtcgacggcgggggccggaaggtgtcgccgtggcacgacgtcccgctgcgcgcaggggacggggtgttccactttgtcgtcgagatccccaaggagagcagcgccaagatggaggtcgccaccgacgaggccttcacgcccatcaagcaggacaccaagaagggcaaccttcgatactacccgtacaacattaactggaattatggattacttcctcaaacatgggaggacccgacttctgcaaattccgatgttgaaggagcatttggggataatgatcctgttgatgttgttgagataggtgaaagacgtgccaatatcggggatgttcttaaggttaagccattggcagctttagcaatgattgatgaaggggagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacagatttggtctcggcaacaagcccgcaagcaaggaatatgccctgaaggtcattgaagagaccaacgaatcatgggagaaattggtaaagaggaatattcctgctggagagctctcgttagcctaa

SEQ ID NO: 8428 - protein, 288 aa, Sorghum bicolor
  misc_feature: Ceres ANNOT ID no. 6090796
  misc_feature (94)..(274): Pfam Id: Pyrophosphatase Pfam Desc: Inorganic pyrophosphatase
  misc_feature (23)..(288): NCBI GI: 115448919 NCBI Desc: os02g0768600 [oryza sativa (japonica cultivar-group)]
  misc_feature (4)..(287): NCBI GI: 92883254 NCBI Desc: inorganic pyrophosphatase [medicago truncatula]
  misc_feature (3)..(287): NCBI GI: 21592878 NCBI Desc: inorganic pyrophosphatase-like protein [arabidopsis thaliana]
  misc_feature (12)..(287): NCBI GI: 14571671 NCBI Desc: inorganic pyrophosphatase precursor [chlamydomonas reinhardtii]
  misc_feature (92)..(285): NCBI GI: 47122952 NCBI Desc: mgc81379 protein [xenopus laevis]
  misc_feature (3)..(287): SWISSPROT Homolog: EC 3.6.1.1 Soluble inorganic pyrophosphatase 1, chloroplast precursor
MATAATASATAATRFTLLAGAGLRSRISRRPTAVRFQRQRGLTTTALLKTADLLPKAQGQPETLDYRVFLVDGGGRKVSPWHDVPLRAGDGVFHFVVEIPKESSAKMEVATDEAFTPIKQDTKKGNLRYYPYNINWNYGLLPQTWEDPTSANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPASKEYALKVIEETNESWEKLVKRNIPAGELSLA

SEQ ID NO: 8429 - DNA, 1290 bp, Sorghum bicolor
  misc_feature: Ceres ANNOT ID no. 6090806
  misc_feature: Encodes the peptide sequence at SEQ ID NO 8430
atggcagagctgcgtggcttcgtgatggcttcggcggcggcggctgtgatggtggtggtggccgtggtgtcagtggcgccacgcggcgcggaggcgaagacgacgatcgagccgtgctccgggtccgactcctgcacggcgctgctgggctacacgctctacgccgacatgaaggtgtccgaggtggccgcgctcttcgccgccgacccggcggcgctgctggccgccaacgcgctcgacttcggggcccccagtgcggcgcaccgcatcctgcccatgggcctcttcgtgcgtgtgcccacccgctgctcctgcaccgacggcgtccgcaagtccgtctccgtccgctacgccgcgcgccccgccgacacgctcgccaccgtcgccgacgtcgtcttcgcggggctcgcctcctccgaccagatccgcaacgagaacggcctcacctccaccgaccccgacgcgccgctcgacgccggccagaagctcgtcgtcccgctgccctgcgtctgtttcaactcatcggactataacctgcccgccgtgtacctctcctacgtcgtgcaggtcggggacaccgtgcccgccatcgccgcaagctacgagaccaccgtcacggatgtcatgaatgtgaatgccatggggagtcccgtcgccgcgccaggcgacattctcgccatcccattgccagcatgtgcatctacatttccaaaatctgcatcggaccatggactcattgtagcaaatgggacttatgcgcttactgctagcaactgtgtgcagtgtagctgtggaccaggcagtctcaatttatattgcacaccaacttcattatcgggatcctgtccaagtatgcaatgtcctaacagcaatgtgatgcttggcaatgtgagcacccatccaactagtgcaggatgcaatgtctcaacttgcagctacggaggttttgttaatggaactataactgcttcgctaaacgcaggtctccaacccaaatgcccagcaccacatcagttccctgcactgacggaaccacctacaacagtgagccatgactcaacttatcttcctccgctatcagcgccaggaccagcagaagctggtggagtcatgcctgaaccaggttcgccaggcccaggctcgtcggcgcaagcagggtccttcacgctcccgaaagtctctacggccaacggccctgctggaatcgtttcagcagcttcgttgatggataaaccacttcaaatcctacccgtcctggtctcttgcctagctttctacttgcagctgtga

SEQ ID NO: 8430 - protein, 429 aa, Sorghum bicolor
  misc_feature: Ceres ANNOT ID no. 6090806
  misc_feature (186)..(228): Pfam Id: LysM Pfam Desc: LysM domain
  misc_feature (4)..(429): NCBI GI: 51243456 NCBI Desc: lysm-domain gpi-anchored protein [oryza sativa (japonica cultivar-group)]
  misc_feature (16)..(429): NCBI GI: 53749174 NCBI Desc: at1g21880 [arabidopsis thaliana]
  misc_feature (32)..(423): NCBI GI: 144924297 NCBI Desc: peptidase s1 and s6, chymotrypsin/hap; peptidoglycan-binding lysm [medicago truncatula]
  misc_feature (4)..(234): NCBI GI: 115448925 NCBI Desc: os02g0769200 [oryza sativa (japonica cultivar-group)]
  misc_feature (16)..(321): NCBI GI: 6552732 NCBI Desc: t26f17.10 [arabidopsis thaliana]
MAELRGFVMASAAAAVMVVVAVVSVAPRGAEAKTTIEPCSGSDSCTALLGYTLYADMKVSEVAALFAADPAALLAANALDFGAPSAAHRILPMGLFVRVPTRCSCTDGVRKSVSVRYAARPADTLATVADVVFAGLASSDQIRNENGLTSTDPDAPLDAGQKLVVPLPCVCFNSSDYNLPAVYLSYVVQVGDTVPAIAASYETTVTDVMNVNAMGSPVAAPGDILAIPLPACASTFPKSASDHGLIVANGTYALTASNCVQCSCGPGSLNLYCTPTSLSGSCPSMQCPNSNVMLGNVSTHPTSAGCNVSTCSYGGFVNGTITASLNAGLQPKCPAPHQFPALTEPPTTVSHDSTYLPPLSAPGPAEAGGVMPEPGSPGPGSSAQAGSFTLPKVSTANGPAGIVSAASLMDKPLQILPVLVSCLAFYLQL

SEQ ID NO: 8431 - DNA, 1035 bp, Sorghum bicolor
  misc_feature: Ceres ANNOT ID no. 6090823
  misc_feature: Encodes the peptide sequence at SEQ ID NO 8432
atggcgagaagtgcaagagctaggaggcatgtggctcgtcagctcaagtccacccatcccattccttcgtaccgatggaaggcaaaggcgatgaaaaaatccaaccgaaagcaagcgtcgccagccttgcaaaagatggactgggaagatgccaattgctctgtgtgcatggaatacccacataacgctgtgctcatcctctgttcatcccatgataagggctgccgtccttacatgtgtggaactagctaccgccactcgaattgcttggatcagttcaagaaagcctacaccaagggggcattgcttcaggaagttcatgcaaatagcattggcactaatctggattcagcgcaattgactgcagaaaaaactgagtccatggaccttgcatgtccattgtgtcgtggcaaggtgaaagggtggacagtggtagaaccagctcgaagctacctcaatggaaaaaggagaacatgcatgcaggatggttgctcatttgtggggacctataaggagctccgcaagcatgtcaagttggaacaccctcttgcaaagccaagggaagttgatcctgttcttgagcaaaaatggagattgcttgagattgaaagagagcggcaagatgctctcagtacgatcactgcaacaatgggcagagctgttgttcttggtgattatgtgctagacttggaggatggagtggacttggaggatgttgatagtgatgctgatgttgatgatggccgtgggacagaaaacactcgtaggatgcttctatttattatgcgccaagttgctcaacatcatcaaaaccaaaggcttcagaatgcgaccggtgcatctgacaatgctgaggacaattatgtggtgagcagtggtgccaatggaaccacaccatacccttaccccttggaaggggaggacgagaatgatatggttgtggccggaggcagaagcactgatgtgctccgaccagagaggaggcgccgccgccgccgcaggaaccgtggaagattatttttaggtgctaattga

SEQ ID NO: 8432 - protein, 344 aa, Sorghum bicolor
  misc_feature: Ceres ANNOT ID no. 6090823
  misc_feature (1)..(336): NCBI GI: 82568695 NCBI Desc: pm27 [prunus mume]
  misc_feature (121)..(336): NCBI GI: 116317899 NCBI Desc: osigba0131j24.4 [oryza sativa (indica cultivar-group)]
  misc_feature (121)..(330): NCBI GI: 38346521 NCBI Desc: osjnba0027h09.16 [oryza sativa (japonica cultivar-group)]
  misc_feature (6)..(119): NCBI GI: 92895183 NCBI Desc: traf-like [medicago truncatula]
  misc_feature (123)..(252): NCBI GI: 3377813 NCBI Desc: t15f16.1 gene product [arabidopsis thaliana]
MARSARARRHVARQLKSTHPIPSYRWKAKAMKKSNRKQASPALQKMDWEDANCSVCMEYPHNAVLILCSSHDKGCRPYMCGTSYRHSNCLDQFKKAYTKGALLQEVHANSIGTNLDSAQLTAEKTESMDLACPLCRGKVKGWTVVEPARSYLNGKRRTCMQDGCSFVGTYKELRKHVKLEHPLAKPREVDPVLEQKWRLLEIERERQDALSTITATMGRAVVLGDYVLDLEDGVDLEDVDSDADVDDGRGTENTRRMLLFIMRQVAQHHQNQRLQNATGASDNAEDNYVVSSGANGTTPYPYPLEGEDENDMVVAGGRSTDVLRPERRRRRRRRNRGRLFLGAN

SEQ ID NO: 8433 - DNA, 2088 bp, Sorghum bicolor
  misc_feature: Ceres ANNOT ID no. 6090827
  misc_feature: Encodes the peptide sequence at SEQ ID NO 8434
  misc_feature: Up-regulated in shoot tissues in response to salicylic acid treatment
atgggcgactcctcggtggccggcgcgctcgtgccgtccgtgcccaagccggagcccgcgcggtccggtgacacctccgtggcggccgcggcgaccacggcggcgctggcgctggcgctgccggaggaggcggggacgcgcgcggcgtcggcgtcgccgcaggggccgccggcggaggacgagggccccgccgatagggacctcctctgcccgatctgcatggccctcatcaaggacgccttcctcaccgcctgcggccacagcttctgctacatgtgcatcgtcacgcacctcagcaacaagagcgactgcccctgctgcgggcactacctcaccaaggcccagctctaccccaactttctccttgacaaggttctgaagaaaatatctgcccggcaaattgcaaaaacagcatcaccgatcgatcaatttcgatgcgcactgcaacagggaaatgaaatgggggttaaagagttagatagccttatgactttgattgctgagaagaagcggcaaatggaacaacaagaatcagagacgaatatgcaaatattattagtcttcttgcactgccttagaaagcaaaagctggaagagttgaatgagattcaaactgatctacagtacatcaaagaggatataagtgctgtggaaagacataggaaagaattatatcgcacaaaagaaaggtactccatgaagctgcgcatgcttttagatgagcctactgcacaaaaaatgtggccctctcctatagacaaagctagctgtcgctttcctcccaactctcggacaccacttagcgcatcatgtccaggaactttacagaataagaagcttgatttgaaagctcaagtaagccatcaaggatttcaaaggagagatgctctaacttcttctgaccctcctaacccccctatacaatcgggtaatgtcattgctaggaagaggcgagttcaagcacagttcaatgaacttcaagaatactacctgcaaagacggcgcaccggagcacaggcacgcaggcaagaagaaagagatatcgttgcaatgaatagagaaggctatcatgcaggtcttcaggatttccagtctgtgctaacaacgttcactcggtacagtcgtctacgtgtcattgcggaactaagacatggagacttgtttcactctgccaatattgtatccagtattgaatttgatcgtgatgatgaactatttgctactgctggagtctcaaaacgtattaaagtctttgaattttctactgttgttaatgaaccatcagatgtgcattgcccggttgttgaaatggctaccagatctaaacttagctgcctaagctggaacaagtactcaaaaaatgttattgcaagcagtgactatgagggtatagtaactgtgtgggatgtccagacccgtcagagtgtgatggaatatgaagaacatgagaagagggcatggagtgttgatttttctcgtacagacccttcaatgctagtatctggtagcgacgattgcaaggtgaaagtgtggtgcacaaaacaagaagcaagcgtgatcaatatcgatatgaaagcaaatatttgctcggttaaatataatcctggatcaaacttctacgttgcagttggatctgctgatcaccatattcattactttgacttacgtaatccaagtgcgcctgtccatatttttggtggccacaagaaagcagtatcgtatgtgaaattcttatctaacaatgagcttgcatctgcatcaacagatagcacattacgcttatgggatgtcaaggataattgtccggtacggacgttcagagggcacaaaaatgaaaagaacttcgttgggttgtctgtgaacaatgagtatattgcttgtggaagtgaaacaaatgaggtttttgtttatcacaaggctatctcaaaaccggcagcaagccatagatttgtatcctctgacctggatgatgccgatgatgatcctggttcttatttcattagtgctgtctgctggaagagtgatagccctaccatgttaaccgctaacagtcagggaaccataaaagttcttgtacttgctccttga

SEQ ID NO: 8434 - protein, 695 aa, Sorghum bicolor
  misc_feature: Ceres ANNOT ID no. 6090827
  misc_feature (473)..(512): Pfam Id: WD40 Pfam Desc: WD domain, G-beta repeat
  misc_feature (559)..(596): Pfam Id: WD40 Pfam Desc: WD domain, G-beta repeat
  misc_feature (70)..(107): Pfam Id: zf-C3HC4 Pfam Desc: Zinc finger, C3HC4 type (RING finger)
  misc_feature (1)..(695): NCBI GI: 46805327 NCBI Desc: cop1, constitutive photomorphogenesis 1 [oryza sativa (japonica cultivar-group)]
  misc_feature (1)..(695): NCBI GI: 16151847 NCBI Desc: copi [oryza sativa]
  misc_feature (1)..(695): NCBI GI: 7592844 NCBI Desc: cop1 [oryza sativa (japonica cultivar-group)]
  misc_feature (177)..(695): NCBI GI: 13925701 NCBI Desc: cop1 [oryza sativa subsp. indica]
  misc_feature (42)..(694): NCBI GI: 4090943 NCBI Desc: cop1 homolog [lycopersicon esculentum]
  misc_feature: The sequence is a functional homolog of SEQ ID NO 1841 in the 11/479,226US patent application
  misc_feature: Useful for making plants with modulated growth and phenotype characteristics
  misc_feature: The sequence is a functional homolog of SEQ ID NO 1841 in the 20070022495 US patent application
  misc_feature: The sequence is a functional homolog of SEQ ID NO 13 in US patent 7208652
  misc_feature: The sequence is a functional homolog of SEQ ID NO 1841 in the 11/479,226 US patent application
  misc_feature: Useful for making plants with modulated light quality sensitivity
  misc_feature: Up-regulated in shoot tissues in response to salicylic acid treatment
  misc_feature: The sequence is a functional homolog of SEQ ID NO. 502 in the 11/188,298 US application
MGDSSVAGALVPSVPKPEPARSGDTSVAAAATTAALALALPEEAGTRAASASPQGPPAEDEGPADRDLLCPICMALIKDAFLTACGHSFCYMCIVTHLSNKSDCPCCGHYLTKAQLYPNFLLDKVLKKISARQIAKTASPIDQFRCALQQGNEMGVKELDSLMTLIAEKKRQMEQQESETNMQILLVFLHCLRKQKLEELNEIQTDLQYIKEDISAVERHRKELYRTKERYSMKLRMLLDEPTAQKMWPSPIDKASCRFPPNSRTPLSASCPGTLQNKKLDLKAQVSHQGFQRRDALTSSDPPNPPIQSGNVIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTDPSMLVSGSDDCKVKVWCTKQEASVINIDMKANICSVKYNPGSNFYVAVGSADHHIHYFDLRNPSAPVHIFGGHKKAVSYVKFLSNNELASASTDSTLRLWDVKDNCPVRTFRGHKNEKNFVGLSVNNEYIACGSETNEVFVYHKAISKPAASHRFVSSDLDDADDDPGSYFISAVCWKSDSPTMLTANSQGTIKVLVLAP

SEQ ID NO: 8435 - DNA, 672 bp, Sorghum bicolor
  misc_feature: Ceres ANNOT ID no. 6090830
  misc_feature: Encodes the peptide sequence at SEQ ID NO 8436
atgaagctggatgttccggcgaggcagaggagcgcccaggatgcagagcagaacggcaaggcagtggccgtgggcgtcctcggcattgagccatggagccacccgaagctccctctccccggccgcggcgcgcgggccgacgccgacgccaacgccctggtgccgccgctcaacttcgccatggtcgacgacggcatcttccgctcgggcctcccggacgccgccaacttccgcttcctgctctccctcaacctgcgctccatcgtgtacctgtgcccggagccgtacccggaggagaacgtgcagttcctgcagcagaacggcatccagcttcaccagttcggcatcgaagggagcaagagtggtccgacagtgccggataccatgttggcgcaggaaccattcgtctacattcctgaagaaacgatcagagaggcgctcaaagtcatccttgacgtaagaaaccagccggtgctcatccactgcaagagaggcaagcaccggactggctgcgtcgtcggatgcctgaggaagctgcagaagtggtgcctgtcttcagtgttcgacgagtacctgcacttcgcggcggcgaaggcaaggagcactgaccagaggttcatggagctgttcgacgcgtcgagcttgatgcacctgacggcctcgcagtattga

SEQ ID NO: 8436 - protein, 223 aa, Sorghum bicolor
  misc_feature: Ceres ANNOT ID no. 6090830
  misc_feature (53)..(222): Pfam Id: Y_phosphatase2 Pfam Desc: Tyrosine phosphatase family
  misc_feature (1)..(221): NCBI GI: 50313187 NCBI Desc: tyrosine-specific protein phosphatase protein [oryza sativa]
  misc_feature (1)..(221): NCBI GI: 115467010 NCBI Desc: os06g0208700 [oryza sativa (japonica cultivar-group)]
  misc_feature (54)..(213): NCBI GI: 60459387 NCBI Desc: tyrosine specific protein phosphatase family protein [capsicum annuum]
  misc_feature (116)..(215): NCBI GI: 3264600 NCBI Desc: hypoxically induced transcript 2 [zea mays]
  misc_feature (1)..(166): NCBI GI: 115448955 NCBI Desc: os02g0771400 [oryza sativa (japonica cultivar-group)]
MKLDVPARQRSAQDAEQNGKAVAVGVLGIEPWSHPKLPLPGRGARADADANALVPPLNFAMVDDGIFRSGLPDAANFRFLLSLNLRSIVYLCPEPYPEENVQFLQQNGIQLHQFGIEGSKSGPTVPDTMLAQEPFVYIPEETIREALKVILDVRNQPVLIHCKRGKHRTGCVVGCLRKLQKWCLSSVFDEYLHFAAAKARSTDQRFMELFDASSLMHLTASQY

SEQ ID NO: 8437 - DNA, 2961 bp, Sorghum bicolor
  misc_feature: Ceres ANNOT ID no. 6090837
  misc_feature: Encodes the peptide sequence at SEQ ID NO 8438
atgcctcgccgcagccgcgaggaggaggaggaggtcgacgacatggaagaggaagaggaggaggaggaggaagagaggggcgggaagagatcgcgagccgggggccgcgggaagcggtcgggcggagtagagagcttcatcgacgacgccgccagcgaggacgaggacgcggatgaggaggaggaggacgacgacgacgatgatgattacgggggcggcggccgtgggcgtgcctctaagaggaggcggtcgtcgatcctgatcgacgacatggcccaggtcgacgacgacgacgacatcgacgacgatagttcggatgtcgagcccggctttatagacgatactgatgctggggttgaaattcgtcacaatgatgcggcaagaaggtctattcctcattctagctctatgttggaagatgatgaggatatgcaagagattgtgaggcgactacaaaatagatataaagaagcatcccattttgattatgacgaggaagttaccgaggttgaacagcaggctctcttaccatcagtgaaggatccaaagctttggatggtgaaatgtgtgatcggacatgagcgggaaacagcagtttgtctaatgcaaaagttcattgataggtcagatctccagataaaatctgttgttgcactagaacacctaaagaatttcatttacattgaagcagagaaagaagcccatgtcaaagaggcttgcaaaggcttgcggaacattattgcttcaacaaaaccaactttagttcctataagagaaatggctgatgtcctctctattgagagcaagtctgttgacctttcaagggactcgtgggttcggatgaagcttggtatgtataaaggtgatcttgctaaggttgttgatgttgacaatgtgggccgaaaggttactgttaagctcgttcctagaattgatttacaagtgctggcaaataaactggatggggagttgcacatccgtgttggcagaaggaggaatagagattctggggaatactttgatgttgttggtggtttgctgttcaaagatggtttcttgcacaaaacattctctataaaatcgatcagcacgcatgatattaagccatcatttgatgaattagagaaattcaaaaaacctggtgatgacctcaatgaggatgtggctagcttgtccactctgtttacaaacagaaaaaagggccacttcatgaaaggtgatgctgtaattgttattaagggtgacctcaagaacttaaaaggctctgttgagaaggtggaggatagtaccgtgcacattcaaccaaaactagctgggcttccgagaacacttgccttcagtgagacggatctctgtaaatatttcaatcctggagaccatgtaaaagtcatatctggagttcaagagggtgcgacaggcatggttgttaaagtggaaggtcatgttttgatcattttatcagacactaccaaagaacatatccgtgtgtttgcagaccatgttgtggagagttctgaggtcaccacaggggttaccaggcttggtgattatgaattgcatgaccttgttctgaaaggtgtgcctgataaacctgaattggtccttgtaaaactgagagaaataaaatgtaagattgatcgacgcacatcggcaaaagatcggtacaataacattgtgtcaactaaggatgttgtgaggattgctgaaggagcatgtaagggaaagcaaggtcctgtggaacatatacacagaggcatactttttatctatgatcgccactaccttgagcattcaggatttatctgtgcaaaagcacaatcatgtttccttgttggggggtcaactggcagccactgtgggaattccatggataaagcagatccacagtttcgcgcttttggctctcaagcaaggattttgcagtctccagggaggctgcccccaaaaggacctcacatgaattctggtggaaggtttggaggtagaggcagtggtggtagagggcacgataccctggtgaacagatgtatcaaaattagatctgggccatataagggatatcgaggccgtgttaaagaagtaactggtgtgcttgtgcgtgtagagcttgactcgctgatgaaaattgtcacagttaagagggaggatatcggcgacacagctgctgttgcaacaccatttcgtgaaacttgttattcaaggggtgttgaaacacctgtgcatccatctcgaacgccactacatcctattcagactccgatgcgggatcctggagcgaccccagttcgagatgtaatgagaactcctatgcctaatcgagcctgggtgccattgagtcctcacagggacaaccgggaagatggagattccacttgggcaagcagtccagcctaccagccaggaactccacgacctcgaccatacgaagctcccactcctgggtcagggtggacaagttggggtgatgcgtcagtgaacaccccaagcacgaatgttccctcaacacctattggtcaaccaatgaccccggatcctgcctcctatttggttggtactcctggtggccagccgatgactccaggctatggtggaatggaactaatgtctcccgtaataggtggcgaggctgcgggaagctggctgctgccagatgttttggtgaacgtctccaggggaggtgatgaggtcagcaatgctgtggtgaaggaagtgctcccggatggatcatgtcgtgtatcccttgggccattgggtgagggagatgaactgatcgtcactgcaaacgagctagaggtggtcaggccgaagaaaaacgagaagctcaagataatgaatggccccttgcgcggagccacaggaaaactcattggacttgatgggtctgatggcatcgtgaaggtggaaggtagcttagacgtgaaaatagtggacatggcgattcttggcaaattggcagcttga

SEQ ID NO: 8438 - protein, 986 aa, Sorghum bicolor
  misc_feature: Ceres ANNOT ID no. 6090837
  misc_feature (405)..(434): Pfam Id: KOW Pfam Desc: KOW motif
  misc_feature (457)..(488): Pfam Id: KOW Pfam Desc: KOW motif
  misc_feature (149)..(193): Pfam Id: Supt5 Pfam Desc: Supt5 repeat
  misc_feature (225)..(272): Pfam Id: Supt5 Pfam Desc: Supt5 repeat
  misc_feature (1)..(526): NCBI GI: 115448965 NCBI Desc: os02g0772000 [oryza sativa (japonica cultivar-group)]
  misc_feature (323)..(894): NCBI GI: 30680726 NCBI Desc: kow domain-containing transcription factor family protein [arabidopsis thaliana]
  misc_feature (707)..(986): NCBI GI: 51091204 NCBI Desc: transcription factor-like [oryza sativa (japonica cultivar-group)]
  misc_feature (26)..(353): NCBI GI: 21358129 NCBI Desc: cg7626-pa, isoform a [drosophila melanogaster]
  misc_feature (294)..(880): NCBI GI: 18859439 NCBI Desc: transcription elongation regulator foggy [danio rerio]
MPRRSREEEEEVDDMEEEEEEEEEERGGKRSRAGGRGKRSGGVESFIDDAASEDEDADEEEEDDDDDDDYGGGGRGRASKRRRSSILIDDMAQVDDDDDIDDDSSDVEPGFIDDTDAGVEIRHNDAARRSIPHSSSMLEDDEDMQEIVRRLQNRYKEASHFDYDEEVTEVEQQALLPSVKDPKLWMVKCVIGHERETAVCLMQKFIDRSDLQIKSVVALEHLKNFIYIEAEKEAHVKEACKGLRNIIASTKPTLVPIREMADVLSIESKSVDLSRDSWVRMKLGMYKGDLAKVVDVDNVGRKVTVKLVPRIDLQVLANKLDGELHIRVGRRRNRDSGEYFDVVGGLLFKDGFLHKTFSIKSISTHDIKPSFDELEKFKKPGDDLNEDVASLSTLFTNRKKGHFMKGDAVIVIKGDLKNLKGSVEKVEDSTVHIQPKLAGLPRTLAFSETDLCKYFNPGDHVKVISGVQEGATGMVVKVEGHVLIILSDTTKEHIRVFADHVVESSEVTTGVTRLGDYELHDLVLKGVPDKPELVLVKLREIKCKIDRRTSAKDRYNNIVSTKDVVRIAEGACKGKQGPVEHIHRGILFIYDRHYLEHSGFICAKAQSCFLVGGSTGSHCGNSMDKADPQFRAFGSQARILQSPGRLPPKGPHMNSGGRFGGRGSGGRGHDTLVNRCIKIRSGPYKGYRGRVKEVTGVLVRVELDSLMKIVTVKREDIGDTAAVATPFRETCYSRGVETPVHPSRTPLHPIQTPMRDPGATPVRDVMRTPMPNRAWVPLSPHRDNREDGDSTWASSPAYQPGTPRPRPYEAPTPGSGWTSWGDASVNTPSTNVPSTPIGQPMTPDPASYLVGTPGGQPMTPGYGGMELMSPVIGGEAAGSWLLPDVLVNVSRGGDEVSNAVVKEVLPDGSCRVSLGPLGEGDELIVTANELEVVRPKKNEKLKIMNGPLRGATGKLIGLDGSDGIVKVEGSLDVKIVDMAILGKLAA

SEQ ID NO: 8439 - DNA, 774 bp, Sorghum bicolor
  misc_feature: Ceres ANNOT ID no. 6090840
  misc_feature: Encodes the peptide sequence at SEQ ID NO 8440
atggcaacggcgcagaacaagagaccgcggatcagcagcggcgtggagaagaggccgagtaggaaggagatattggggagaaagaaggcggtcgaggaatgtataaagagagctgtagctgtgaaggatcatctagagcagtttccagcatttcataagtatcagaaaaatgtctacttggagtccggacgtggggatcagcttacattaccaatgaggaagtacatccaaaatcttctaaaggttaacatggagaaaccatatggaccagagtggccttcagaagagaaaattaagcgccgggaaatggtagccccagaagcacgatatatcttggctaagcaatattcaaatgggtttattcctgaaaatcccatgaagcaagatgcagaggcggaacatatgcatgcagcatgtactgaaagctgcttgcttggttttgtacactatagatttgttgtggaagaggagctgcctgttgtttatgtgtatgagctgcaaatggagccttctgcccagggcaaggggctgggaaattttatgatgcggttggttgaacaggtagcatgcaagaaccaaatgggagctgtgatgctaacagttcagaaagctaacacactagctatggatttctatactaagttgagatacgtaatatccagtacctcaccatcccgagtggatcctcagataggacttgaaaaaagctatgagattttgtgcaagacatttgattctgaagctaagtccaaactagaggatggcgcctattaa

SEQ ID NO: 8440 - protein, 257 aa, Sorghum bicolor
  misc_feature: Ceres ANNOT ID no. 6090840
  misc_feature (136)..(218): Pfam Id: Acetyltransf_1 Pfam Desc: Acetyltransferase (GNAT) family
  misc_feature (1)..(215): NCBI GI: 46805364 NCBI Desc: gcn5-related n-acetyltransferase protein-like [oryza sativa (japonica cultivar-group)]
  misc_feature (21)..(254): NCBI GI: 42570083 NCBI Desc: gcn5-related n-acetyltransferase (gnat) family protein [arabidopsis thaliana]
  misc_feature (12)..(253): NCBI GI: 6714290 NCBI Desc: f15h18.15 [arabidopsis thaliana]
  misc_feature (144)..(242): NCBI GI: 123439472 NCBI Desc: acetyltransferase, gnat family protein [trichomonas vaginalis g3]
  misc_feature (145)..(242): NCBI GI: 121913688 NCBI Desc: acetyltransferase, gnat family protein [trichomonas vaginalis g3]
MATAQNKRPRISSGVEKRPSRKEILGRKKAVEECIKRAVAVKDHLEQFPAFHKYQKNVYLESGRGDQLTLPMRKYIQNLLKVNMEKPYGPEWPSEEKIKRREMVAPEARYILAKQYSNGFIPENPMKQDAEAEHMHAACTESCLLGFVHYRFVVEEELPVVYVYELQMEPSAQGKGLGNFMMRLVEQVACKNQMGAVMLTVQKANTLAMDFYTKLRYVISSTSPSRVDPQIGLEKSYEILCKTFDSEAKSKLEDGAY

SEQ ID NO: 8441 - DNA, 2295 bp, Sorghum bicolor
  misc_feature: Ceres ANNOT ID no. 6090855
  misc_feature: Encodes the peptide sequence at SEQ ID NO 8442
atgactgaccaggagcgagatgacattcccatgttgctaagaaatgttgagctaccaagatttcctctaagaagtacttcaatgtgtataccagtcagggatgatgaatatgaagaagacacctttgtaccccatactggtcctctattcgttcagacgccaactcagacggcaccgggaatttcatttacaagtagagacacacctgataggcttcctagaccttcacagggaaaacaagtcagcaagccacatgcaatcatgcctgaagaaattagaggaaataggtggtcttacagtggacaggttccaaagaatgaacatttgatgatgtctggacctttggggcaatgtgataatcctgattgtgtgaattgccctcctgcttgtaaaaataaaagacatttccagagaggttcgaatgctttagacaataagattcataacattctttatggtcacagtggtggatggaagaagaaaattgagcagatcatggcatacattccgattatgaacccacatgcaaagccggttcagcagtggaatcaattctttgtcatatcatgcctgattgccattttcattgatcccctgttcttcttcttactatcagtacgccaggatggcaactgcatagtgttaaattggaactttgctacaggacttgctgttgtgagaagtgtgactgatgctatttatttcctgcacatgctgcttcagttcagactggcttatgttgcgccagagtcacgagtggtgggagctggagacttggttgatgagccaaagaaagttgctatacattatctttgtggttactttttccttgatttctttgtggtgctcccactccctcaggtgatgatactgctagttgttcctaaagttgggttatctgctgcaaactatgctaagaatttattgcgtgccactgttcttcttcaatatgtgccccgtatcatcagatttgtgccacttcttgatggtcagtccgccaatggattcatatttgagtcagcatgggctaattttgtgatcaatcttctgatgtttgttttggcgggacatgtggttggttcatgttggtatctctttggcttacagagggttaaccaatgtctacgagatgcttgttctgcatcaaccattccatattgtgactcctttatagactgtggacgtggcattgggagtggactgtacagacagcagtggttcaatgacttgggtgcagaagcttgttttaacactggaaataatgctactttccaatatggaatttatgagcaagctgttttgctaactacagaagacagtgctgtaaaacgatatatatattcattattttgggggtttcagcaaataagtaccttagcaggaaaccttgtcccgagttactttgtatgggaagttctgttcacgatggctattattggtctgggactgttgctttttgcattgcttattggaaacatgcaaaattttctccaagctcttggaagacggagattggaaatgcaacttaggcgacgtgatgttgaaaagtggatgagccatagacgattgcctgaagatttgagaaggagggttagacgagctgaaaggttcacctgggcagctactcaaggagtgaatgaagaggagcttttgagtaatttacctgaagatatccaaagggatatacgtcgccacttctttagattccttaataaggtccgattattcaccttgatggattggcctatcttggatgcaatatgtgacaaattaagacaaaacttatatattagtggaagtgacattctttatcaaggtggcactgttgaaaagatggtcttcatagtgagagggaagcttgaaagcatcagtgcagatggtagcaaggctccattacatgatggagatgtatgtggagaggagctcctcacctggtacttggaacactcttcagcgaatagagatggtgggaaaattaaattccaaggtatgcggttggttgctatacgcacagtaagatgtttaacaaacgttgaagctttcgtactcagagcaagtgatctggaagaagtcacctcacagtttgctcgattcttgcgtaatccacgagtgcagggagcgatcagatatgaatccccctactggcgaaccattgctgcaactcgtattcaagttgcatggaggtatcgaaaaaggcggctgaagcgagctgagaagtcgaggttgagcgaagaaacctatacctcacatgggatcttgacacctgattcttttcagcgtggacagaggggatga

SEQ ID NO: 8442 - protein, 764 aa, Sorghum bicolor
  misc_feature: Ceres ANNOT ID no. 6090855
  misc_feature (226)..(493): Pfam Id: Ion_trans Pfam Desc: Ion transport protein
  misc_feature (171)..(737): NCBI GI: 7484881 NCBI Desc: cyclic nucleotide gated channel homolog f3i3.30 - arabidopsis thaliana
  misc_feature (171)..(744): NCBI GI: 38503202 NCBI Desc: probable cyclic nucleotide-gated ion channel 10 (cyclic nucleotide-and calmodulin-regulated ion channel 10) (cam-regulated potassium ion channel)
  misc_feature (171)..(737): NCBI GI: 7267598 NCBI Desc: cyclic nucleotide gated channel (cngc4) like protein [arabidopsis thaliana]
  misc_feature (171)..(755): NCBI GI: 6969231 NCBI Desc: cyclic nucleotide-gated calmodulin-binding ion channel [nicotiana tabacum]
  misc_feature (171)..(745): NCBI GI: 38344883 NCBI Desc: osjnba0033g05.7 [oryza sativa (japonica cultivar-group)]
  misc_feature: The sequence is a functional homolog of SEQ ID NO. 503 in the 11/188,298 US application
MTDQERDDIPMLLRNVELPRFPLRSTSMCIPVRDDEYEEDTFVPHTGPLFVQTPTQTAPGISFTSRDTPDRLPRPSQGKQVSKPHAIMPEEIRGNRWSYSGQVPKNEHLMMSGPLGQCDNPDCVNCPPACKNKRHFQRGSNALDNKIHNILYGHSGGWKKKIEQIMAYIPIMNPHAKPVQQWNQFFVISCLIAIFIDPLFFFLLSVRQDGNCIVLNWNFATGLAVVRSVTDAIYFLHMLLQFRLAYVAPESRVVGAGDLVDEPKKVAIHYLCGYFFLDFFVVLPLPQVMILLVVPKVGLSAANYAKNLLRATVLLQYVPRIIRFVPLLDGQSANGFIFESAWANFVINLLMFVLAGHVVGSCWYLFGLQRVNQCLRDACSASTIPYCDSFIDCGRGIGSGLYRQQWFNDLGAEACFNTGNNATFQYGIYEQAVLLTTEDSAVKRYIYSLFWGFQQISTLAGNLVPSYFVWEVLFTMAIIGLGLLLFALLIGNMQNFLQALGRRRLEMQLRRRDVEKWMSHRRLPEDLRRRVRRAERFTWAATQGVNEEELLSNLPEDIQRDIRRHFFRFLNKVRLFTLMDWPILDAICDKLRQNLYISGSDILYQGGTVEKMVFIVRGKLESISADGSKAPLHDGDVCGEELLTWYLEHSSANRDGGKIKFQGMRLVAIRTVRCLTNVEAFVLRASDLEEVTSQFARFLRNPRVQGAIRYESPYWRTIAATRIQVAWRYRKRRLKRAEKSRLSEETYTSHGILTPDSFQRGQRG

SEQ ID NO: 8443 - DNA, 576 bp, Sorghum bicolor
  misc_feature: Ceres ANNOT ID no. 6090861
  misc_feature: Encodes the peptide sequence at SEQ ID NO 8444
atggcgctcctcgcgccgagcccgcgcgcgctctgcgtgcgggaggccgcggcggcggcggcggcgccgcacccgcactcgctggcggccgccgcctgctcgaccgtcggcggcggcggggtggccggacgggcgctgtggctgtggaacggcggcgggacggggaggaggcgaagggagcgcgaggggaaggtccgggtggaggcgtacttctgggacgtgtccaagccggtggagatggaggagattgatagcatggagaagctcgacgacgcgctcaggtggtccgtcgagaacaaccagcccatcatcatcgactggatggctagctggtgtcggaaatgcatctacctgatgcccagaatggagaagatagcaggagaatatcctggagtgaggttttacttcattgatgtcaataaagttccacaagcggtggtgaaaagagggaatgtaactaaaatgcccactattcagctatggaaggatggggagtggaaagcagaagtaataggaggccacaaagcttggcttgtgatggatgaggttagagaaatgatccagcagaacaagtga

SEQ ID NO: 8444 - protein, 191 aa, Sorghum bicolor
  misc_feature: Ceres ANNOT ID no. 6090861
  misc_feature (85)..(183): Pfam Id: Thioredoxin Pfam Desc: Thioredoxin
  misc_feature (1)..(153): NCBI GI: 115448985 NCBI Desc: os02g0774100 [oryza sativa (japonica cultivar-group)]
  misc_feature (55)..(189): NCBI GI: 4973264 NCBI Desc: thioredoxin-like 5 [arabidopsis thaliana]
  misc_feature (55)..(189): NCBI GI: 18415285 NCBI Desc: thioredoxin family protein [arabidopsis thaliana]
  misc_feature (55)..(189): NCBI GI: 51702145 NCBI Desc: thioredoxin-like 5, chloroplast precursor
  misc_feature (72)..(183): NCBI GI: 5006625 NCBI Desc: thioredoxin-like 5 [arabidopsis thaliana]
  misc_feature: Useful for making plants with modulated nitrogen use efficiency
  misc_feature: Functional homolog of the protein sequence given in SEQ ID NO 13221
MALLAPSPRALCVREAAAAAAAPHPHSLAAAACSTVGGGGVAGRALWLWNGGGTGRRRREREGKVRVEAYFWDVSKPVEMEEIDSMEKLDDALRWSVENNQPIIIDWMASWCRKCIYLMPRMEKIAGEYPGVRFYFIDVNKVPQAVVKRGNVTKMPTIQLWKDGEWKAEVIGGHKAWLVMDEVREMIQQNK

SEQ ID NO: 8445 - DNA, 1305 bp, Sorghum bicolor
  misc_feature: Ceres ANNOT ID no. 6090864
  misc_feature: Encodes the peptide sequence at SEQ ID NO 8446
atggagggcgacgatcggagggccccgctgctggggtccggcgccgacgccgacgccggcggccgccccccctcgctgcggcgccgcgactcggcgcggtcgctgcgcagcagcttcctgtcgcggctgcccgacaaggtgcgcgccgggctcgacccggagcgcctcgccgacctcgacctctcccgcgccaaaggcctatcccaaggtgtgagagactactacgagaagcagttggcgaccctgagaaccttcgagcaggtggaggcgcgctgcatgcccggcgagttcgattccgatgtcgaggcctccgactcggaggaaacggagcagaagcagagcgagttcgccatgaagatttccaactacgccaacatcgtgctgctggttttcaaggtgtatgctacgatcaggacggggtccatggcgatcgcggcgtccacgcttgactcgctgctggatttcatggccgggggtatcctgtggttcacgcacctttccatgaagagggtcaacatttacaagtacccaattgggaagctgcgtgttcagcccgttgggatcatcgtctttgcggccatcatggcaactctaggtttccaggtcttggtccaagctgttgagcagctggtggagaacaagcctggcgagaagatgacacgggagcagctgatatggttgtactccatcatgctttctgcaactgctgtgaaacttgctctctggctctactgcaagagttcagggaatagtattgtccgggcttatgcaaaggaccactattttgatgtgataaccaatgtcgtcggtctggtggccgctgttcttggggacaaattcttgtggtggattgaccccgtgggggctgtaatacttgctgtatataccattgtcaactggtccaaaactgtattagaaaatgcagctacccttgtgggccaatgtgctcctccggagatgctgcagatgctaacgtacctcgccatgaagcacgacccacgagtgaggcgggttgacactgttagagcttacagctttggacctctctactttgttgaggttgacattgaactctcagaggatatgctgctgagagaggcgcacactatcggtgaattgctgcaggagaaaatcgagaagttgcctgaagtcgagcgggcgtttgttcatatcgatttcgagagcactcataagcctgagcacaaagtcaggagcaggctgccgtctactgatccctcacagatttccacatgtttatgggagttactccatccattcacaaataaatacacgtctcgtttttaa

SEQ ID NO: 8446 - protein, 434 aa, Sorghum bicolor
  misc_feature: Ceres ANNOT ID no. 6090864
  misc_feature (118)..(398): Pfam Id: Cation_efflux Pfam Desc: Cation efflux family
  misc_feature (7)..(409): NCBI GI: 28628302 NCBI Desc: cation diffusion facilitator 8 [stylosanthes hamata]
  misc_feature (2)..(412): NCBI GI: 115451677 NCBI Desc: os03g0226400 [oryza sativa (japonica cultivar-group)]
  misc_feature (3)..(409): NCBI GI: 92867396 NCBI Desc: cation efflux protein [medicago truncatula]
  misc_feature (209)..(412): NCBI GI: 115448999 NCBI Desc: os02g0775100 [oryza sativa (japonica cultivar-group)]
  misc_feature (66)..(406): NCBI GI: 145453066 NCBI Desc: mn-specific cation diffusion facilitator transporter [populus trichocarpa]
MEGDDRRAPLLGSGADADAGGRPPSLRRRDSARSLRSSFLSRLPDKVRAGLDPERLADLDLSRAKGLSQGVRDYYEKQLATLRTFEQVEARCMPGEFDSDVEASDSEETEQKQSEFAMKISNYANIVLLVFKVYATIRTGSMAIAASTLDSLLDFMAGGILWFTHLSMKRVNIYKYPIGKLRVQPVGIIVFAAIMATLGFQVLVQAVEQLVENKPGEKMTREQLIWLYSIMLSATAVKLALWLYCKSSGNSIVRAYAKDHYFDVITNVVGLVAAVLGDKFLWWIDPVGAVILAVYTIVNWSKTVLENAATLVGQCAPPEMLQMLTYLAMKHDPRVRRVDTVRAYSFGPLYFVEVDIELSEDMLLREAHTIGELLQEKIEKLPEVERAFVHIDFESTHKPEHKVRSRLPSTDPSQISTCLWELLHPFTNKYTSRF

SEQ ID NO: 8447 - DNA, 1089 bp, Sorghum bicolor
  misc_feature: Ceres ANNOT ID no. 6090865
  misc_feature: Encodes the peptide sequence at SEQ ID NO 8448
atggcgggaaccgccgccgccgctcccatggacatcgacgccgcggcgccgcctccgccgccgcccggggcgcaggccaagggcaaggcgccgctctccgccggcgggagggcggcgccctgggtccaaaaataccggccccagtccctagctgacgtcgccgcccaccgcgacatcgttgacaccattgacaggcttacaaatgagaatagacttccgcacttgttgctatatgggccacctggcactgggaaaacatctacgattctggctgttgcgaggaagctatatgggtctcagtatagcaacatgatcctggagctcaatgcatcagatgaacgtggtattgatgttgtcaggcagcagatccaggattttgctggcgcacgcagcctctcttttggagcgaggccttctgttaagttggtcctcttggatgaagcagatgcaatgacaaaggatgcacaatttgcattgcgaagagtcattgagaagtatacaaggagcacaaggtttgcactcatttgcaaccatgtcaacaaaattatccctgcacttcaatcaaggtgcactaggtttagatttgctccactagacggaagtcatgttagagagcgtcttcaacatataataaaatctgaggggctcagtgtagatgagggtggcttgacagccctagtgcggttaagcaatggtgatatgaggaaggctttgaacatattgcagtcaacacacatggcatcccaacaaatcacagaagaagctgtctatctttgcacaggaaaccccatgccaaatgatattgagcggatagcattttggctattaaatgaaccattttcaactagcttcaaacatatatctgacatgaagatgagaaaaggtctggccttggttgatatcatacgggaggttactatgtttgtgttcaaaatagaaatgccatctgatgttcgtgtaaagctaatcaataacttggctgatatcgaatacaggctaagctttgcatgcaacgataaactgcagctgggcgcactgatctcagctttcacagatactcgcacggctatggttgctgctgccagctaa

SEQ ID NO: 8448 - protein, 362 aa, Sorghum bicolor
  misc_feature: Ceres ANNOT ID no. 6090865
  misc_feature (261)..(350): Pfam Id: Rep_fac_C Pfam Desc: Replication factor C
  misc_feature (74)..(247): Pfam Id: AAA Pfam Desc: ATPase family associated with various cellular activities(AAA)
  misc_feature (1)..(361): NCBI GI: 10798790 NCBI Desc: replication factor c 36kda subunit [oryza sativa (japonica cultivar-group)]
  misc_feature (31)..(361): NCBI GI: 6677723 NCBI Desc: replication factor c 5 isoform 1 [homo sapiens]
  misc_feature (31)..(361): NCBI GI: 47115239 NCBI Desc: rfc5 [homo sapiens]
  misc_feature (18)..(361): NCBI GI: 62087564 NCBI Desc: replication factor c 5 isoform 1 variant [homo sapiens]
  misc_feature (24)..(361): NCBI GI: 27882432 NCBI Desc: rfc5-prov protein [xenopus laevis]
MAGTAAAAPMDIDAAAPPPPPPGAQAKGKAPLSAGGRAAPWVQKYRPQSLADVAAHRDIVDTIDRLTNENRLPHLLLYGPPGTGKTSTILAVARKLYGSQYSNMILELNASDERGIDVVRQQIQDFAGARSLSFGARPSVKLVLLDEADAMTKDAQFALRRVIEKYTRSTRFALICNHVNKIIPALQSRCTRFRFAPLDGSHVRERLQHIIKSEGLSVDEGGLTALVRLSNGDMRKALNILQSTHMASQQITEEAVYLCTGNPMPNDIERIAFWLLNEPFSTSFKHISDMKMRKGLALVDIIREVTMFVFKIEMPSDVRVKLINNLADIEYRLSFACNDKLQLGALISAFTDTRTAMVAAAS

SEQ ID NO: 8449 - DNA, 927 bp, Sorghum bicolor
  misc_feature: Ceres ANNOT ID no. 6090868
  misc_feature: Encodes the peptide sequence at SEQ ID NO 8450
atggcgaagccgcaggaggtgcgcagcgtcgactccttctcgcagctgccgttcatccggccggccccggcgccggcgcagccgagggacgccaccatccggctgttcggctgcgacttctccaacgaccagcagcggcaggccaagcagcagcaagacgccgcgtccgactcccccgacaacgccaacggcagcacggtcacgtccgagagcaacggcggcgccaagagcggcggcgcggctgcggcggccgcggccgctgcggccgccgagaggaagttcgagtgccactactgctgccgcaacttcccgacgtcgcaggcgctgggcgggcaccagaacgcgcacaagcgggagcggcagcacgccaagagggcccacctccaggcctccctcgccatgcaccgctacgtgcccggccacatgtacggcctcttcaactaccaccaccaccacctcggcggcggcggcggcggccgcttcgtcgaccacccgggcgcgccgccgccgcttccgctaccgctgccgcccccgccgccggcgcactacccgatgtggacgagcgccagccccgctgggccctacggcggcggtggcccaggctccatgtcgcagccaatcaacggcagcccggtgccggcggggctctggagggtgccgccccctgctgcgacaaccactactgccatggagaatttcggcatgtccggccggcacggcgctggtggcacggctatcatccagcctaccctggtcgggccggctggtggggaggcggctgcatgcaaggaggagaaggcggcgatgagcttgttgtccccctcgccctcgctctcctcttgctcgtccacgtcgccggagaagaagctaggtaggtgtgaattgggccaccagaaggagagcgttagcttggatctccatttgtaa

SEQ ID NO: 8450 - protein, 308 aa, Sorghum bicolor
  misc_feature: Ceres ANNOT ID no. 6090868
  misc_feature (80)..(308): NCBI GI: 115479419 NCBI Desc: os09g0445500 [oryza sativa (japonica cultivar-group)]
  misc_feature (80)..(308): NCBI GI: 51536147 NCBI Desc: zinc finger protein-like [oryza sativa (japonica cultivar-group)]
  misc_feature (5)..(151): NCBI GI: 6729550 NCBI Desc: zinc finger-like protein [arabidopsis thaliana]
  misc_feature (5)..(151): NCBI GI: 32362299 NCBI Desc: at3g58070 [arabidopsis thaliana]
  misc_feature (30)..(288): NCBI GI: 51091156 NCBI Desc: zinc finger protein-like [oryza sativa (japonica cultivar-group)]
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1090 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1288 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 622 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 635 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 760 in the 10/666,642US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: The sequence is a functional homolog of SEQ ID NO 830 in the 10/666,642US patent application
  misc_feature: Useful for biocontainment applications
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13272
  misc_feature: GREAT-hit functional homolog of the protein sequence given in SEQ ID NO 13309
  misc_feature: The sequence is a functional homolog of SEQ ID NO 10 in the 20040045049 US patent application
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: The sequence is a functional homolog of SEQ ID NO 622 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 830 in the 20070033671 US patent application
  misc_feature: Functional homolog of the protein sequence given in SEQ ID NO 13581
  misc_feature: The sequence is a functional homolog of SEQ ID NO 1094 in the 10/412,699 US patent application
  misc_feature: The sequence is a functional homolog of SEQ ID NO 639 in the 10/374,780 US patent application
  misc_feature: The sequence is a functional homolog of SEQ ID NO 763 in the 10/666,642 US patent application
MAKPQEVRSVDSFSQLPFIRPAPAPAQPRDATIRLFGCDFSNDQQRQAKQQQDAASDSPDNANGSTVTSESNGGAKSGGAAAAAAAAAAAERKFECHYCCRNFPTSQALGGHQNAHKRERQHAKRAHLQASLAMHRYVPGHMYGLFNYHHHHLGGGGGGRFVDHPGAPPPLPLPLPPPPPAHYPMWTSASPAGPYGGGGPGSMSQPINGSPVPAGLWRVPPPAATTTTAMENFGMSGRHGAGGTAIIQPTLVGPAGGEAAACKEEKAAMSLLSPSPSLSSCSSTSPEKKLGRCELGHQKESVSLDLHL

SEQ ID NO: 8451 - DNA, 1881 bp, Sorghum bicolor
  misc_feature: Ceres ANNOT ID no. 6090880
  misc_feature: Encodes the peptide sequence at SEQ ID NO 8452
atggaagttgacaactcacatggcactctaattaataaaagtgaagagaatgactttgaaaagaaaggcacttctgatcctgtggtttatcagctagttcgggttgaaggtgatggaacacttgttcctgctacagaggatgatgttttgcagtttgaacatttccttcataatgatgagaaggttgatcttccttctattgaagatgtaggccatgtggaagagtttttcaacaatgactgcatgttactgaagaagcctgacttggaagatggatcttccaaattggagactgtagaagtacacacacaaaaattgggtgccgacttagaggaaaacagattacagtcattggatgattcccttagtcctccctcagagtgtagagttattcatagtcagcattcagataaattgcttacagaacaaggggacaatgtgactcgacaggacaatgcttcaactgagactacaaaatcaacagtgttaaatgaatcttgcagtgctgaaaaagacaaggcggatgcctgctcaagacctgtgtgcgacacatctacggatccatctgtttctggagttaatagttccatgcctgatttttccatattaagaggagaagtctgtttggatgatcttactattagagaacttcaggaggcatttagagccacgtttggccggcagactactgtcaaagacaagatatggctcaaaagacggattacaatgggcttgactaattcatacgatgttcctagttcaggttgtgtagttaaagactacaaaattgttggcaaggatgccaaaaaagacatatcagacatggatgaaagatctaagattgggcttagagctacttctctagttatatatccaggaaacgatggggactcgccgtctagctcttactatcagagtgaggaccagcaagattcttccaagagagttgaaagagtacaaatccataatgatgaaccacaaggaaatctgctaggcaagcaatgcactaacaagcgaactagaaagccaacaaaaagatacatagaggagctatcagacattgagactcatgactccactgtaaaaatctcttcaccagcaaaaaggcctgcacatgatgaagtgttaatgaaaccgcgggtcgcacctttcaatgaggctgattctctgggcacaatctatcctactagaaaggatacccttggaggatttagtgtacatgttccttacgtttcaaggatgagaagggggcgccctaggaaggacttcatttcatttgcggataaggaaccctcggttgaacctaaagggattcagacagcagttgaggtgatattggagaaagatggtgacaagggaaaccacctgaggaaagcacctgaagttccagtaaaggtaagttctgagaaagggcatatagaagcagttgatagtgaaggggttcggaacctacaagcaaagctttacagtgctgttgccaaacctaaaataaaccggggtttaacgcggaagcatcatcgagcatggacattgtgtgaggtcgtgaagctggttgatggtgtggctcggtttggagctggcaagtggtctgagatcagaaaactgtcctttgcctcatattcttaccgcacttcagtggatctcaaggacaaatggcgtaacctgatcagagcaaccaagacacagcttccggcacaaaaagaccagggtgcctgtccgcggaagattaacccttctatcataccaataccaccatccattttgttgcgagtgaaggagctaaacgagctgcagtcgcaagggggtggcttcacagcccccgtcaagttctctggacaggacaggaaggttctacagggaaaagggtcaggttttttgtga

SEQ ID NO: 8452 - protein, 626 aa, Sorghum bicolor
  misc_feature: Ceres ANNOT ID no. 6090880
  misc_feature (1)..(626): NCBI GI: 46806152 NCBI Desc: myb transcription factor-like [oryza sativa (japonica cultivar-group)]
  misc_feature (214)..(626): NCBI GI: 46806153 NCBI Desc: myb transcription factor-like [oryza sativa (japonica cultivar-group)]
  misc_feature (111)..(600): NCBI GI: 21700907 NCBI Desc: at1g72650/f28p22_16 [arabidopsis thaliana]
  misc_feature (86)..(600): NCBI GI: 42572085 NCBI Desc: myb family transcription factor [arabidopsis thaliana]
  misc_feature (26)..(550): NCBI GI: 8778456 NCBI Desc: f1l3.16 [arabidopsis thaliana]
MEVDNSHGTLINKSEENDFEKKGTSDPVVYQLVRVEGDGTLVPATEDDVLQFEHFLHNDEKVDLPSIEDVGHVEEFFNNDCMLLKKPDLEDGSSKLETVEVHTQKLGADLEENRLQSLDDSLSPPSECRVIHSQHSDKLLTEQGDNVTRQDNASTETTKSTVLNESCSAEKDKADACSRPVCDTSTDPSVSGVNSSMPDFSILRGEVCLDDLTIRELQEAFRATFGRQTTVKDKIWLKRRITMGLTNSYDVPSSGCVVKDYKIVGKDAKKDISDMDERSKIGLRATSLVIYPGNDGDSPSSSYYQSEDQQDSSKRVERVQIHNDEPQGNLLGKQCTNKRTRKPTKRYIEELSDIETHDSTVKISSPAKRPAHDEVLMKPRVAPFNEADSLGTIYPTRKDTLGGFSVHVPYVSRMRRGRPRKDFISFADKEPSVEPKGIQTAVEVILEKDGDKGNHLRKAPEVPVKVSSEKGHIEAVDSEGVRNLQAKLYSAVAKPKINRGLTRKHHRAWTLCEVVKLVDGVARFGAGKWSEIRKLSFASYSYRTSVDLKDKWRNLIRATKTQLPAQKDQGACPRKINPSIIPIPPSILLRVKELNELQSQGGGFTAPVKFSGQDRKVLQGKGSGFL

SEQ ID NO: 8453 - DNA, 1287 bp, Sorghum bicolor
  misc_feature: Ceres ANNOT ID no. 6090893
  misc_feature: Encodes the peptide sequence at SEQ ID NO 8454
atgaaagactggtctattttctccaaacttgatcataacggagcttacctcccgaagttcccaatagactctccagtatctcatgatattgggttaggattgatatcacaagttgggaacttagttgagtgttcatttcaacatccaaggcatatatgtgctacggggagtggagcagttcaggaagcattcagcagtttcaacaagtttgctggagctttctatttctggttttctagagcatcgaatcctaagttattccaaaggctatcagctgccgcaggctcaagttcaagagcttgccggtcacacataaagcaagtgacctcatgcttgcagcatttacctggattgcagtttggttcacaattaagagaagagcacgctgtacagatgcttttagcgaggcttgcaagcgcaacctttggacgcctgtggacggaggtggaggagcgacatgcctgcaacatccttatgctggctgctgctactgtaataccaccatttgaaaacatgtatgaatcgccaaagatgctggctgagtcaatggcactaagaaaagatggtggacacatccaagaacctgctgaacagtcttattcagaggaaaaccgtccaggttgtgcttgtgttgctgtaccaagagtactcttaccagaagatttaacggaaccaaaaactggcatcaagttccccactctactcgaagacaattccaatctgactacagaggtccttgttggaatgggtttcagaagcatgcgaataatgagggtcaaaaatctgaatctttatgcctttggattatatatacaacctgattctgtttgcaagaagcttggtccaaagtacgcctgtattccagatgctgagttgaaggatcacccagatttctatgaagatcttctgagggaaaatattgatatgactgttaggctagtagtaagctacaatggcctcagcattggcacagttcgagatgcatttgagaagtctcttggcttccggttacaaaagatgaatcctaatactgattataattgcttgaagacatttggttcttgttttagtgaagacattcgtatacctgctggtacaaagatagacttccggcaaacatctgatggccagctaataactgaaattgatggcaaacaaattggcactgtccagagcaaggatctttgcagagccttcttcgatatgtatattggtgacccccctgtttcagtggagaccaaacaagacattgcgcaaaatgtggctggactcataagaagatgctag

SEQ ID NO: 8454 - protein, 428 aa, Sorghum bicolor
  misc_feature: Ceres ANNOT ID no. 6090893
  misc_feature (246)..(426): NCBI GI: 115472907 NCBI Desc: os07g0571600 [oryza sativa (japonica cultivar-group)]
  misc_feature (223)..(412): NCBI GI: 113202134 NCBI Desc: chalcone isomerase [camellia sinensis]
  misc_feature (219)..(426): NCBI GI: 133874176 NCBI Desc: chalcone isomerase [clitoria ternatea]
  misc_feature (229)..(421): NCBI GI: 20980 NCBI Desc: chalcone isomerase c-term. (203 aa) [phaseolus vulgaris]
  misc_feature (229)..(425): NCBI GI: 20982 NCBI Desc: chalcone isomerase [phaseolus vulgaris]
  misc_feature: Useful for making plants with modulated salt sensitivity
  misc_feature: Useful for making plants with modulated salt sensitivity
  misc_feature: GREAT-hit functional homolog of the protein sequence given in SEQ ID NO 13296
  misc_feature: Useful for making plants with modulated salt sensitivity
  misc_feature: Functional homolog of the protein sequence given in SEQ ID NO 13296
  misc_feature: The sequence is a functional homolog of SEQ ID NO. 383 in the 11/188,298 US application
MKDWSIFSKLDHNGAYLPKFPIDSPVSHDIGLGLISQVGNLVECSFQHPRHICATGSGAVQEAFSSFNKFAGAFYFWFSRASNPKLFQRLSAAAGSSSRACRSHIKQVTSCLQHLPGLQFGSQLREEHAVQMLLARLASATFGRLWTEVEERHACNILMLAAATVIPPFENMYESPKMLAESMALRKDGGHIQEPAEQSYSEENRPGCACVAVPRVLLPEDLTEPKTGIKFPTLLEDNSNLTTEVLVGMGFRSMRIMRVKNLNLYAFGLYIQPDSVCKKLGPKYACIPDAELKDHPDFYEDLLRENIDMTVRLVVSYNGLSIGTVRDAFEKSLGFRLQKMNPNTDYNCLKTFGSCFSEDIRIPAGTKIDFRQTSDGQLITEIDGKQIGTVQSKDLCRAFFDMYIGDPPVSVETKQDIAQNVAGLIRRC

SEQ ID NO: 8455 - DNA, 1965 bp, Sorghum bicolor
  misc_feature: Ceres ANNOT ID no. 6090909
  misc_feature: Encodes the peptide sequence at SEQ ID NO 8456
atggcgacagcgacaatggcaaccgcagcaggtgctgcggcgctgctttactacacgctgaaccgccgcctgcacacagagaggctgaatcaggaaggggaatgcagcaatagcagggatgtggcgcccagggccgtgccgggttctcccagcaggagccgggtgtcgcggagagacgtccgtgcccctgccacctggcttgagactatctcgacgctgtcagagacgctgcggttcacgtactcggaaacccttgggaagtggccgatcggtgacctggcgttcgggatcagtttcctcctcaagagacagggaaacttatctgtagcaagcatatacgctggaaatgatagtgtggagctcaaaggagctgaagtaattgctgacttaaagtatcttctcaatttgctgacactttgctggcatttctccaaaaagccattcccgttgtttttggaggcgactggctactctgtggaggatgttcttatgcaagagcctaaagcaggaattttgaagccagctttcaccattttgcttgatagagacaaaaaatccatacttctattaataaggggtactcatagcatcagagatacattaacagctgccactggtgctgtggttccattccaccatacaattgtacaggaaggtggtgttagcgacttagtactaggatatgctcattttgggatggttgcagctgctaggtggattgcgaagctctcagggccttgtctggcacaagcattgcacatgtacccagactttaaaataaaggttgttggacattcactgggaggcggtacagctgctctgttgacatacattctgagggagcagaaggagtttgcttctactacttgtctggcgtttgctccagctgcatgtatgacatgggaactggcagagtctggagtgcattttatcactacagtcatcaatggagctgatctggttccaacattttctgctgcgtcagtagatgatcttcgttcagaggttacagcatctgcttggctaaatgatctccgtcaccaaattgaacaaaccagaatcctaagcaccttttatcgttcagcatcagccttgggatcacgacttccttctatggcaaatgctaaagcaagagtagctggtgctggtgccatcttaagacctgtatctaccgggacacaggttgtaatgaggagagctcgcagtgtagcacaggcagcatggacaagacccggactgcaactgtcctcatgggcttgtattgggccaagacggcgaaataatgtttcatctacttcgactgtcacatcagaggaaataagagcatctacaagcggtggatccgaatccacttcgctgttgactgaaacaaccgtagaaacctcagagacagttacatcagaagctgtaccagaagaggttcagagttccgttgctgtggcggtcgatgctattggtttggtagatgacaaggtagatagcgatgatgacatcgatgatcaccatgacgaggacaggatgactgatgtggagctgtggcagcaactcgaaagtgagttgtaccggaagagggagggagaagatgatgacatagtggaagatatgactgaaagtacaattgctgaagaggtgggtggcgtagctgaagatgtgctcagtgagaccaaggaagtgcataggttctatcctcctggaaaaatcatgcatatattaacttccagcagggaagaaacagttcatgaagaggaacctgatgttcatcaggatgatgcgacgaatggggagtcacatagcagcatggggatcttcttgacgccaagatctctgtacggcaagctgaggctttcgaaaatgatgatcaatgatcattacatgcctatatacagaagaaacatcgagcagctgatcgctgagcttgagaaggatacctctgatcctatgggtgataggcttaacactacatag

SEQ ID NO: 8456 - protein, 654 aa, Sorghum bicolor
  misc_feature: Ceres ANNOT ID no. 6090909
  misc_feature (188)..(329): Pfam Id: Lipase_3 Pfam Desc: Lipase (class 3)
  misc_feature (54)..(135): Pfam Id: Lipase3_N Pfam Desc: Lipase 3 N-terminal region
  misc_feature (1)..(653): NCBI GI: 47497398 NCBI Desc: lipase class 3 protein-like [oryza sativa (japonica cultivar-group)]
  misc_feature (1)..(639): NCBI GI: 27764916 NCBI Desc: at3g14070/mag2_2 [arabidopsis thaliana]
  misc_feature (1)..(636): NCBI GI: 20805147 NCBI Desc: lipase class 3-like protein [oryza sativa (japonica cultivar-group)]
  misc_feature (1)..(643): NCBI GI: 22328699 NCBI Desc: lipase class 3 family protein [arabidopsis thaliana]
  misc_feature (2)..(477): NCBI GI: 115489010 NCBI Desc: os12g0554500 [oryza sativa (japonica cultivar-group)]
MATATMATAAGAAALLYYTLNRRLHTERLNQEGECSNSRDVAPRAVPGSPSRSRVSRRDVRAPATWLETISTLSETLRFTYSETLGKWPIGDLAFGISFLLKRQGNLSVASIYAGNDSVELKGAEVIADLKYLLNLLTLCWHFSKKPFPLFLEATGYSVEDVLMQEPKAGILKPAFTILLDRDKKSILLLIRGTHSIRDTLTAATGAVVPFHHTIVQEGGVSDLVLGYAHFGMVAAARWIAKLSGPCLAQALHMYPDFKIKVVGHSLGGGTAALLTYILREQKEFASTTCLAFAPAACMTWELAESGVHFITTVINGADLVPTFSAASVDDLRSEVTASAWLNDLRHQIEQTRILSTFYRSASALGSRLPSMANAKARVAGAGAILRPVSTGTQVVMRRARSVAQAAWTRPGLQLSSWACIGPRRRNNVSSTSTVTSEEIRASTSGGSESTSLLTETTVETSETVTSEAVPEEVQSSVAVAVDAIGLVDDKVDSDDDIDDHHDEDRMTDVELWQQLESELYRKREGEDDDIVEDMTESTIAEEVGGVAEDVLSETKEVHRFYPPGKIMHILTSSREETVHEEEPDVHQDDATNGESHSSMGIFLTPRSLYGKLRLSKMMINDHYMPIYRRNIEQLIAELEKDTSDPMGDRLNTT

SEQ ID NO: 8457 - DNA, 765 bp, Sorghum bicolor
  misc_feature: Ceres ANNOT ID no. 6090914
  misc_feature: Encodes the peptide sequence at SEQ ID NO 8458
atggcgtcgctgcaggtctccggcgcgggggttggcgccgcggccttcgctgcgaaggggaaggcctccatcggtgcgctccggcttccatctacggtgaccgtcggcgaggtctgcccggcccggcgggcgttccgcggcctcgtcgtcagggccgccaccgtcgtcgctcccaagtatacaacacttaagcctttggccgatagagtgcttgtaaagattaactcttccgaggagaagacaactggtggaattttgctccctacaactgctcagtccaaacctcagggtggtgaggtagttgctgttggagaaggaaggataattggggataagaaagttgatgtcagcattcaggttggagctcaagttgtatattcaaagtatgctggaaccgaggttgagttgaatgactacaaccatctggttctcaaagaggatgacattataggtatcttagaaactgatgacgtgaaagacatgaagcctcttaatgaccgtgtactaatcaaggttgctgaagctgaagtcaaaactccaggcggtctattgcttactgaaactagcaaggagaagccatctatcggaacggtcgtagcggttggcccgggccccctggacgaggaaggcaagaggagcccgctgtctgtgtccgcggggagcactgtcctgtactccaagtacgccggcagcgagttcaagggcgctgatggcacgaactacatcgtgctgagggtgtcggatctgatggccgtcctctcctga

SEQ ID NO: 8458 - protein, 254 aa, Sorghum bicolor
  misc_feature: Ceres ANNOT ID no. 6090914
  misc_feature (62)..(153): Pfam Id: Cpn10 Pfam Desc: Chaperonin 10 Kd subunit
  misc_feature (160)..(253): Pfam Id: Cpn10 Pfam Desc: Chaperonin 10 Kd subunit
  misc_feature (13)..(254): NCBI GI: 50660327 NCBI Desc: chloroplast chaperonin 21 [vitis vinifera]
  misc_feature (1)..(254): NCBI GI: 21780187 NCBI Desc: cp10-like protein [gossypium hirsutum]
  misc_feature (1)..(254): NCBI GI: 7331143 NCBI Desc: chaperonin 21 precursor [lycopersicon esculentum]
  misc_feature (1)..(223): NCBI GI: 115466912 NCBI Desc: os06g0196900 [oryza sativa (japonica cultivar-group)]
  misc_feature (1)..(254): NCBI GI: 3057150 NCBI Desc: chaperonin 10 [arabidopsis thaliana]
MASLQVSGAGVGAAAFAAKGKASIGALRLPSTVTVGEVCPARRAFRGLVVRAATVVAPKYTTLKPLADRVLVKINSSEEKTTGGILLPTTAQSKPQGGEVVAVGEGRIIGDKKVDVSIQVGAQVVYSKYAGTEVELNDYNHLVLKEDDIIGILETDDVKDMKPLNDRVLIKVAEAEVKTPGGLLLTETSKEKPSIGTVVAVGPGPLDEEGKRSPLSVSAGSTVLYSKYAGSEFKGADGTNYIVLRVSDLMAVLS

SEQ ID NO: 8459 - DNA, 3063 bp, Sorghum bicolor
  misc_feature: Ceres ANNOT ID no. 6090925
  misc_feature: Encodes the peptide sequence at SEQ ID NO 8460
atggcgtcaaagccttccaataccatcttgaaatattttaaaccactgttagatttgcatcaaccaattttgacaaggagtctgttggacattctgcatgctgttgctgagagtccaacactacagctaaaatcggatgtgttattggatcttctgtgtttgctggggctgtcagtgtcttcagaaaggaaatcaggagatgaaatggcttcgattgcacgacttttacatgttggtactaaaaaagtttacaagcaaaacagggacatttgtgttgtaaagcttccattgatatttacttcacttggagatatattatcaagtgaatttgaagaggcgagattttcttctgtggaggcttttaaaggtttaatagatcactgcattgatgaaaccttggtgtcacagggagttgctcagatgaaggccagacatcaaggggtgaaatcagatcccacaatcatagagaagatatgtgctatcctagaaggcttgctagatttccgctacagtgatgtctgggacagatcatttcatgtaatttcagtggcatttgacaagttaggagagttttcagctgacctactgccggaagcagtcaggaacttggcagacatgcaaaacttgtcagatgacgacttttccttccggaagcagcttgatgcatgtcttggttcagcgattgcagcaatggggccaaagaatgttcttgaaattctccagattcagtcaatatgtgatgaaaatgcgtggattctccctattatggagaagcacattgttggtgccagtttacaatttttcttaagagatattctgggtatggttaaagccattgagaaaagcattcctaagcttttgaagaatgacaaacttttctctgccaagagagctggaggttatgtgtattctctgtggtctttgttaccatcttgttgcaactactcctgtgacacatcaagcaattttagagctttacaagatgtcttatgtgacactctccaaaaccaacctgacttgcgtggcgttgtttgctccagtattcaggttttaatcaaacaaaacaaagaagctctgtcagtttctagggaagaagacattctcgctgaggatgaaataagcaaatctgaaagaagagcaaaggaacattatactcaaaatctggcagaggaaaacttgaaagcgatacgtgctttctcttcgaagcttctggaagtactttgttctatattcttgatgtcttcgaatgatgctattggattattgcagcctgctataagtgagatagcttccatatcagacaaaaacgttgttgggaaattcttccttgatgcaataagagagttgttggatgctacaaaggctgttaatgcagagcctgtggatgatagttcaatggaaattgaagctgattccaacaagaatagcatgaagagggctctacttttggattttgcagcttcattgatgcctggtttagctgcaaagtctatcaatgtgctgttcagttatgtgaaacctgcaattaaggacagtgactctttgattcaaaagagagcatacaaggtcctgtcaatgctgctcaaggatgctgaatttgttgaaaagaatttggatgtcttgttggaattgatgatttcatcgttgccatgtcaatttccctcgaaacgctacagactcgaatgcttatatcaccttattgtttacattttgaaggattcatctacggttagaaagagagaagttattagttcattcatcactgaaatacttcttgcattgaaggaggccaacaagaaaaccagaaacagagcttatgatttgcttattgaaattgcccgtgcatgtgaaaatgctggaaatgacgagaggaaggagggcttgcaccagttctttggcatggttgctggtggtatagtggctggtcaaacgccatatgcaattagtgccgttgtaactgggttggctcggttgacttatgaattctcagagcttattggagtcgcttacaagctccttcctcagactttcttgcttatgcaaaggaacaaccgagaaatagtcaaagcgaacttaggttttgtcaaagctttagtggctaaatctaaagccgacatgctgcatgaacacttgagtggagttgttgaaggcctgttaagctcgcaaagtgatacaaagaattcctttaaagctaaggtcaagtcactcatagaaattcttgtgaagaaatgtggtttagatgctgtgaaagctgtgatgcctgaagagcatatgaaattgctcacgaatattaggaagattaatgagcgaaaaatgcggaagacaaaatcttctgaggatggggatgccatgtctatggcctcaggagctacaaggcaaagtagatggaatcacacacaaatgttttcagattttggaagtgatgatgagtcagatggtcctttttctacccgacacactgttacttctcgatctcgtactgaatcaaaagcttcaactcggctgagccggaggcgccaaggagataagaacctattggagaagttcattgaccattcaactggcgatcccctagatttacttgaccagaaaacggtgcggttggctctcaaatcagccgcaggtaaaaagaggtctgcacccgatgatgacgatgaggagtttgaggtggatactgaaggccgtataatcgtgcgagaagagcgggagaagaggaaaaagaagcaagtctctcgtgacgacgacgatgctgatggaaagagctctgtcagaagccagtccgttaagaagaggaagacttccagctctggatgggcctacactggccacgagtacaccagcaagagggccagtggtgatctgaagaagaaagacaagatggaaccttttgcatactggccgatggatcggaagcttctcaaccgcaggtcggaccgcaaggcgtctgcgcgcaagggcatgtccagtgtcatgaagatcaccaaggggcttcaagggaagagtgcaagtgctgcgctttctgctaatcggtcgggaaaaatgaagcacaaaaagaacaaataa

SEQ ID NO: 8460 - protein, 1020 aa, Sorghum bicolor
  misc_feature: Ceres ANNOT ID no. 6090925
  misc_feature (158)..(352): Pfam Id: NUC173 Pfam Desc: NUC173 domain
  misc_feature (1)..(1020): NCBI GI: 47497411 NCBI Desc: nodulin-like [oryza sativa (japonica cultivar-group)]
  misc_feature (1)..(940): NCBI GI: 3337366 NCBI Desc: nodulin-like protein [arabidopsis thaliana]
  misc_feature (443)..(1020): NCBI GI: 119570333 NCBI Desc: kiaa0690, isoform cra_c [homo sapiens]
  misc_feature (443)..(1020): NCBI GI: 3327194 NCBI Desc: kiaa0690 protein [homo sapiens]
  misc_feature (443)..(1020): NCBI GI: 15987121 NCBI Desc: kiaa0690 [homo sapiens]
MASKPSNTILKYFKPLLDLHQPILTRSLLDILHAVAESPTLQLKSDVLLDLLCLLGLSVSSERKSGDEMASIARLLHVGTKKVYKQNRDICVVKLPLIFTSLGDILSSEFEEARFSSVEAFKGLIDHCIDETLVSQGVAQMKARHQGVKSDPTIIEKICAILEGLLDFRYSDVWDRSFHVISVAFDKLGEFSADLLPEAVRNLADMQNLSDDDFSFRKQLDACLGSAIAAMGPKNVLEILQIQSICDENAWILPIMEKHIVGASLQFFLRDILGMVKAIEKSIPKLLKNDKLFSAKRAGGYVYSLWSLLPSCCNYSCDTSSNFRALQDVLCDTLQNQPDLRGVVCSSIQVLIKQNKEALSVSREEDILAEDEISKSERRAKEHYTQNLAEENLKAIRAFSSKLLEVLCSIFLMSSNDAIGLLQPAISEIASISDKNVVGKFFLDAIRELLDATKAVNAEPVDDSSMEIEADSNKNSMKRALLLDFAASLMPGLAAKSINVLFSYVKPAIKDSDSLIQKRAYKVLSMLLKDAEFVEKNLDVLLELMISSLPCQFPSKRYRLECLYHLIVYILKDSSTVRKREVISSFITEILLALKEANKKTRNRAYDLLIEIARACENAGNDERKEGLHQFFGMVAGGIVAGQTPYAISAVVTGLARLTYEFSELIGVAYKLLPQTFLLMQRNNREIVKANLGFVKALVAKSKADMLHEHLSGVVEGLLSSQSDTKNSFKAKVKSLIEILVKKCGLDAVKAVMPEEHMKLLTNIRKINERKMRKTKSSEDGDAMSMASGATRQSRWNHTQMFSDFGSDDESDGPFSTRHTVTSRSRTESKASTRLSRRRQGDKNLLEKFIDHSTGDPLDLLDQKTVRLALKSAAGKKRSAPDDDDEEFEVDTEGRIIVREEREKRKKKQVSRDDDDADGKSSVRSQSVKKRKTSSSGWAYTGHEYTSKRASGDLKKKDKMEPFAYWPMDRKLLNRRSDRKASARKGMSSVMKITKGLQGKSASAALSANRSGKMKHKKNK

SEQ ID NO: 8461 - DNA, 3534 bp, Sorghum bicolor
  misc_feature: Ceres ANNOT ID no. 6090937
  misc_feature: Encodes the peptide sequence at SEQ ID NO 8462
  misc_feature: Up-regulated in root tissues in response to salicylic acid treatment
atggacgacgtgtgcgaggggaaggacttctccttcccggagcaggaggagcgggtgctccagctgtgggcgaagctagacgccttccacgagcagctccgacgcacggagggcggtgaggagttcgtcttctacgacggacccccgttcgccacgggcctgccccactacggccacatactcgccggcaccatcaaggacgtggtcacccggcaccagtcgatgtggggccgccacgtctcgcgacggttcgggtgggactgtcacggcctccccgtcgagttcgagatcgacagttcgctcggcatcaccaaccggcagcaggtgctcgacctcggcatcggcaagtacaacgaggcctgccgcagcatcgtaacaaagtacgtctctgagtgggaagccgtcgtcacgcgctcggggaggtggattgatttcaaggacggctacaagaccatggatctcaacttcatggagagcgtctggtgggtgtttgcgcagctgtgggagaaggacctcatctataagggcttcaaggtcatgccttacagcacaggatgcaaaactgcactgtcaaactttgaggcaacaaaggaacataggactgttcatgacctggcggtgatggtatccttccctattgttggtgatgtggataattcagctcttgttgcatggactacaacaccctggacacttccgagtaacctagcgctgtgtgttaatgccaatctcacgtatgcaaaggttaaagacaagtcaaatggagcagtatatattattgcggaatctaggcttggacagttaccagttaaggccaaagcttcaggaaagaagcagacaccttcaaagggaagcaatactgaagctgttcaggatggtttggacaaggaatcatatgagctgttggcaaagattcctgggtcatccttggttggcttaaaatatactcctctatttgattttttcatcgaacttcaagagacggcttttagagtgattgcggataactatgtcatggatgatagtggaactggtgttgtccattgtgctcctgcttttggtgaagacgatcatcgtgtttgccttgcttctgggataattgagactgctggacttgttgttgctgttgatgacgatggatgctttattgaaaaaatatctgattttaaagggcgatatgtcaaggaagctgacaaggatatcatcagtgctgttaaggataaaggaagacttgttagtaaaggaagtattgagcactcttatccattttgttggcgatcgggtactcctcttatttatcgggctgttccaagctggtttgttaaggttgagaagattaaggaccagttgctggaatgtaacaaggagacctactgggtgcctgactttgttaaggaaaaaagatttcacaactggcttgaaggtgctcgtgattgggctgttagcagaactagattttggggtactccacttccactgtggatgagtcaagatggtgaagaaattgttgtgatggattctatcgagaagcttgaaaagttatctggagtcaaggtcactgatcttcaccgacactatgttgatgatattacaattccctctaatagaggacctgagtttggggtgctcaaacgtgttgatgatgttttcgactgctggtttgaaagtgggtcaatgccatatgcctacattcattatccatttgagaatcaggaactgtttgaaaagaattttcctggcaattttgtggcagagggtttggatcaaacccgtggatggttctatactctgatggttctctcaacagcactgtttgggaagcctgcatttaagaatcttatatgcaatggtcttgtcttggctgaggatggaaagaaaatgagcaagagtaaaaataactatccttcacccaaaggtctcattgacaagtatggagcggattctttgcggttatatttgataaactctccagttgtacgtgcagagtctctacgattcaaaagcagtggtgtctatgatgttgtaaaatatgtcttcctcccatggtataatgcatacagattctttgtccaaaatgcaaagagactggaattggagggtcttgcctcattttctccgatggaacaagcggtacttctgaattcagccaatgtgttggatcactggataaactctgcaactgaaagtctagtcagctttgttcaccaggagatggatgcatatcggctttacacggttgtgccgtatttggtaaaatacattgactctcttactaacatatatgtgcgtttgaaccgcaaacggttcaaaggacgtactggagacgaagactgcagagtttctctttcaacactctaccatgttcttgtaacaacttgcgtggtgatggctccatttacaccattctttactgaagttctttatcaaaatctgcggaaggtgtcaagtaaatctgaggagagcattcacttttgcaagttcccttccacaactggcgagagagatgatcgtgttgagcaaagtgtaaataggatggtgaccatcattgatcttgcacgtaatattcgtgagcggcataacaaagctctcaaaacaccactcaacattcgactgtgtcatgtggtgactgatttgagtttcagggaaatggtggttgtgcatccagacattcaattccttgaagacatcactggcaaactagaagagtatgtcatggaggaagtcaatgttaagactgtcactccatgtaatgaccccttgatgtatgcttctctgcgagccgaacccaatttcagtgcactaggaaaaaggcttggaaaagacatgggcaaagtagcaaatgtggtgaagaagatgactcaggaacagatcttagcctttgaaaaatgtggagagatttcattcttcggtcattgcttgaaggtagatgatattaaggtggtccgacagttcaagcgtcctgaaaatgtgtcagagaaggagattgacgctgcaggagatggtgatgttttagtcattttagatctacgaactgaccagtcattgtttgaagctggagtggctcgagaggttgtgaacaggatccaaaaattacggaagactgctcagctcaaacctactgatccagttgatgtgtattacgaatctgtgggcaatgacaaaaacacactggaagagattttgaagtcacaaggtcagtatgttagagacacacttggttcgccaatcattcccaaggaaatggcaccaagggatgtggtagtacttggcgaggagtcacacaatgtacatgacatgtcatttgtcatatgcattgcaaggtccacccctattctttcaccagatcttctcccaaatgcctcagcaatcatgtggagaaagtgtattccttggtggcttggtgcttatagcttgtctacattcttccagattacagtcgactgcatcgaaggttatccaccaattaatttacagctaggaaagcatgtcttcctaagtgcgagggatttttatcttgctactagtctatcctag

SEQ ID NO: 8462 - protein, 1177 aa, Sorghum bicolor
  misc_feature: Ceres ANNOT ID no. 6090937
  misc_feature (18)..(665): Pfam Id: tRNA-synt_1 Pfam Desc: tRNA synthetases class I (I, L, M and V)
  misc_feature (720)..(872): Pfam Id: Anticodon_1 Pfam Desc: Anticodon-binding domain
  misc_feature (49)..(659): Pfam Id: tRNA-synt_1g Pfam Desc: tRNA synthetases class I (M)
  misc_feature (1)..(1100): NCBI GI: 4538961 NCBI Desc: isoleucine-trna ligase-like protein [arabidopsis thaliana]
  misc_feature (299)..(1093): NCBI GI: 40352733 NCBI Desc: mgc68929 protein [xenopus laevis]
  misc_feature (297)..(1114): NCBI GI: 108884366 NCBI Desc: isoleucyl trna synthetase [aedes aegypti]
  misc_feature (3)..(1080): NCBI GI: 145343633 NCBI Desc: isoleucine-trna synthetase [ostreococcus lucimarinus cce9901]
  misc_feature (295)..(1093): NCBI GI: 41054027 NCBI Desc: isoleucine-trna synthetase [danio rerio]
  misc_feature (287)..(1093): SWISSPROT Homolog: EC 6.1.1.5 Isoleucyl-tRNA synthetase, cytoplasmic
  misc_feature: Up-regulated in root tissues in response to salicylic acid treatment
MDDVCEGKDFSFPEQEERVLQLWAKLDAFHEQLRRTEGGEEFVFYDGPPFATGLPHYGHILAGTIKDVVTRHQSMWGRHVSRRFGWDCHGLPVEFEIDSSLGITNRQQVLDLGIGKYNEACRSIVTKYVSEWEAVVTRSGRWIDFKDGYKTMDLNFMESVWWVFAQLWEKDLIYKGFKVMPYSTGCKTALSNFEATKEHRTVHDLAVMVSFPIVGDVDNSALVAWTTTPWTLPSNLALCVNANLTYAKVKDKSNGAVYIIAESRLGQLPVKAKASGKKQTPSKGSNTEAVQDGLDKESYELLAKIPGSSLVGLKYTPLFDFFIELQETAFRVIADNYVMDDSGTGVVHCAPAFGEDDHRVCLASGIIETAGLVVAVDDDGCFIEKISDFKGRYVKEADKDIISAVKDKGRLVSKGSIEHSYPFCWRSGTPLIYRAVPSWFVKVEKIKDQLLECNKETYWVPDFVKEKRFHNWLEGARDWAVSRTRFWGTPLPLWMSQDGEEIVVMDSIEKLEKLSGVKVTDLHRHYVDDITIPSNRGPEFGVLKRVDDVFDCWFESGSMPYAYIHYPFENQELFEKNFPGNFVAEGLDQTRGWFYTLMVLSTALFGKPAFKNLICNGLVLAEDGKKMSKSKNNYPSPKGLIDKYGADSLRLYLINSPVVRAESLRFKSSGVYDVVKYVFLPWYNAYRFFVQNAKRLELEGLASFSPMEQAVLLNSANVLDHWINSATESLVSFVHQEMDAYRLYTVVPYLVKYIDSLTNIYVRLNRKRFKGRTGDEDCRVSLSTLYHVLVTTCVVMAPFTPFFTEVLYQNLRKVSSKSEESIHFCKFPSTTGERDDRVEQSVNRMVTIIDLARNIRERHNKALKTPLNIRLCHVVTDLSFREMVVVHPDIQFLEDITGKLEEYVMEEVNVKTVTPCNDPLMYASLRAEPNFSALGKRLGKDMGKVANVVKKMTQEQILAFEKCGEISFFGHCLKVDDIKVVRQFKRPENVSEKEIDAAGDGDVLVILDLRTDQSLFEAGVAREVVNRIQKLRKTAQLKPTDPVDVYYESVGNDKNTLEEILKSQGQYVRDTLGSPIIPKEMAPRDVVVLGEESHNVHDMSFVICIARSTPILSPDLLPNASAIMWRKCIPWWLGAYSLSTFFQITVDCIEGYPPINLQLGKHVFLSARDFYLATSLS

SEQ ID NO: 8463 - DNA, 1470 bp, Sorghum bicolor
  misc_feature: Ceres ANNOT ID no. 6090946
  misc_feature: Encodes the peptide sequence at SEQ ID NO 8464
atggcccccctcgcccgcactctccggagcctcagccaggcggcggccgcgcgggagggccctctcctcgcgtggctcttctcctcgaggtcggccgccttctcctcctccgcgccgccggagtacgacatgccgtcggtgacgtggggcgtgatccaggggcgcaaggagcgcctcgtctcgcgcgtactggcgctcgacttcctccgctccgcgggcgtctccgaccctgccggcgagctcgaggcggtcgagctcccttcctccctcgaggtgctccaggagcgcctcgacttcctcctccgcctcggcctctccaccgacgacctctccaactacccgctcctcctcgcctgctccctccggaagaacgtcatccccgtcctctcctacctcgagaagctcggcgtcacgcgcgcccgcctcgccgctttcgtccgcgcctacccggcctgcctccacgcctctgtcgccgtcgacctcgctcccatggtcaaggcgctccgtggcctggacgtcgatcgccaggacctcccccgcgtgctcgagcggtaccccgacgtcctggggctcaagcccgacggcacaatcagcacctccgtcgcttacctcgtcggcatcgtcggcgtggcgccacgagacatcggtcccatggtaacgcatttccctttcttccttggcatgagggttggcactaccatcaagccgttctgcgactacatcacctccctcgggctgcccatgcggatcctagcgaggatcctagagaagcgaccgtacattctcggctatgatcttgaggaaacggtcaaaccaaacgtggaggcattgctcagctttggcattcagaaggaggccctgccattggtgattgcacagtacccatccatactcgggctgccactgaaagcgaagctagcagcacaacagtacttcttcagcttgaagctccagattgacccagatgggtttgcccgtgcggttgagaagttgccacagcttgtaagcttaaatcaaaatgtgatattgaagcctgtggagttcctccgtggacgagggatctccaatgaggatgttgctcggatggtggtccgctgtcctcagattctactgctgcggatcgagctcatgaagaacagtttgtacttcttcaagagtgagatgaagcgaccaatgagtgaattgttggaatacccagaatattttacttacagcttggagtcaagaatcaagcctaggtatatgagagttacaagtaagggtattaagtgtagcttggattggttcctgaattgcagtgatatgaggtttgaagaaaggatgcaaggggattttattgaaggggatgcaccgggacctttgtttacaatgggtgggaagcttcagatgccaggcagccagctagtgtcggatgatgataacgaggatactgatgatgaggtgctatataggcggacggtcatgatctag

SEQ ID NO: 8464 - protein, 489 aa, Sorghum bicolor
  misc_feature: Ceres ANNOT ID no. 6090946
  misc_feature (91)..(439): Pfam Id: mTERF Pfam Desc: mTERF
  misc_feature (1)..(489): NCBI GI: 47497486 NCBI Desc: mitochondrial transcription termination factor-like [oryza sativa (japonica cultivar-group)]
  misc_feature (98)..(414): NCBI GI: 92891194 NCBI Desc: mitochodrial transcription termination factor-related [medicago truncatula]
  misc_feature (35)..(303): NCBI GI: 92898511 NCBI Desc: mitochodrial transcription termination factor-related [medicago truncatula]
  misc_feature (377)..(489): NCBI GI: 92891195 NCBI Desc: at4g02990/t4i9_13-related [medicago truncatula]
  misc_feature (331)..(480): NCBI GI: 15450557 NCBI Desc: at4g02990/t4i9_13 [arabidopsis thaliana]
MAPLARTLRSLSQAAAAREGPLLAWLFSSRSAAFSSSAPPEYDMPSVTWGVIQGRKERLVSRVLALDFLRSAGVSDPAGELEAVELPSSLEVLQERLDFLLRLGLSTDDLSNYPLLLACSLRKNVIPVLSYLEKLGVTRARLAAFVRAYPACLHASVAVDLAPMVKALRGLDVDRQDLPRVLERYPDVLGLKPDGTISTSVAYLVGIVGVAPRDIGPMVTHFPFFLGMRVGTTIKPFCDYITSLGLPMRILARILEKRPYILGYDLEETVKPNVEALLSFGIQKEALPLVIAQYPSILGLPLKAKLAAQQYFFSLKLQIDPDGFARAVEKLPQLVSLNQNVILKPVEFLRGRGISNEDVARMVVRCPQILLLRIELMKNSLYFFKSEMKRPMSELLEYPEYFTYSLESRIKPRYMRVTSKGIKCSLDWFLNCSDMRFEERMQGDFIEGDAPGPLFTMGGKLQMPGSQLVSDDDNEDTDDEVLYRRTVMI

SEQ ID NO: 8465 - DNA, 3147 bp, Sorghum bicolor
  misc_feature: Ceres ANNOT ID no. 6090948
  misc_feature: Encodes the peptide sequence at SEQ ID NO 8466
atgggttctgctgctactgagagcaatgacaccttgctgggcaatggagttgttgggattcttgctgagacttgtaacatgtgggaaaggagggcaccattaactccttcccattgtgctcgccttctgctcggaggagggaagaacggagctcgagtaaaccggattactgtgcagccaagcacaaagaggatacatcatgacgctcagtatgaggatgtaggatgtgagatttcagaagacctgtcagaatgcggtcttattataggcatcaaacaaccaaagttgcagatgattcttccagatagagcgtacgctttcttttcacacactcacaaggcccaaaaagagaatatgccactgttagataagatccttgaagaaagggtgtccttgtttgattatgagctaattgttggagatgatgggaaaaggtcgctagcatttgggaagtttgctggtagagctggcctgatagatttcttacatggtctcggacagcgatatttgagccttggatactcgactccatttctctctctgggacaatctcatatgtatccttcgctcgctgcagccaaggctgcagtcattgctgttgctgaagagatagcaacattcggacttccatccggaatttgtccgatagtgtttgtattcactggagttggaaatgtctctcagggcgcgcaggagatattcaagttattgccccatacctttgttgatgctgagaaacttcctgaaatttctcagggcaggaatctgtctaaacaatctcagtcaaccaagagagtatttcaactatatggttgtgttgtgacctctagagacatggtttcccacaaggatcccaccagacaatttgacaaagctgactattatgctcatccagaacactacgcccctgtttttcatgaaaggattgctccatatgcatctgtcatcgtaaactgtatgtattgggagaagaggtttccaccattactgagtatggatcagttacagcaactgatggagactggttgtcctttggttggcgtttgtgacataacttgtgatattggaggttccattgaatttgtcaacaagagtacatcaatagagaggcctttcttccggtatgatccttctaataattcataccatgatgatatggaaggtgccggagtgatctgcttggctgttgacattctccctacagagttctctaaagaggcctcccaacatttcggaaacatattatctaaacttgttcctagtttggcctcagtgaagcaactggcagaacttccttcctacttgagaagagcttgcattgcacatgctggcagattaactccgttagatttggcccccacaaaaacaaatccattgcctgacaagaagtacagcaccctggtatctctcagtgggcacctatttgataagttccttataaatgaagctttggacatcattgagacaggtggaggttcatttcacttggttagatgtcaagttggacagagcatggatgatatgtcatactcagagcttgaagtaggagcagatgatactgccacattggataaaattattgattccttgacttctctagctaatgaacatggtggagatcacgatgccgggaaagaaactgaattagctctgaagataggaaaagtcaatgagtgtgaaactgatgccacagttgataaaggaggtccaaaggttttaattcttggagctggaagagtttgtcgaccagctgctgagtttctagcatcttacccaaacatatgtacctatggtgttgatgaccataacacagatcaaattcatgttattgtggcatctttgtatcaaaaagatgcagaagagacagttgatggtattgaaaatacaactgctacccagcttgatgtttctgatattggaagcctttcagatcttgtttctcaggttgaggttgtaattagcttgctgcctactagttttcatgctgccattgcaagagtatgcatagagctcaagaagcacatggtaacggcaagctatgttgatgaatccatgtcaaacttgagccaagctgctaaaggtgcaggtgtaactatactttgtgaaatgggcctagatcctggcatagatcacttgatgtcaatgaagatgattgatgaagctcatgctcgaaagggaaaaataaagacatttacatcttactgtggtggattgccatctccagctgcagcaaacaacccacttgcctataaattcagttggaacccagctggtgccctccgggcagggaaaaatcctgctgtctacaaatttcttggagagacgatccatgtagatggtcataacttgtttgaatcagcaaagaggctcagactaccagagcttccagcttttgctctggaacacttgccaaatcggaattccttgatatatggagacctttatggtatctccaaagaagcatctaccatatacagggctactcttcgttacgaaggttttagtgagataatggcaaccctgtcgaaaattgggttgtttgatgctgcaaatcatccactgctgcaagaaactaatcgcccaacatataagggtttccttgatgaactacttaataatatctccacaactaacacaggcttagatattgaagcctctggtggatatgatgatgaaatcattgccagactgtcgaagctcgggtgttgcagagataaggaaatagctgctaagacagtcaaaaccatcaagttcttgggactacatgaagagactcaaattcctaagggttgttcaagtgcatttgatgtgatttgccaacgaaaggaacagaggatggcctatggccacaatgagcaagacatggtactgctccaccacgaagttgaggtggaatacccagacgggcaacccaccgagaagcaccaagcgacgctactggagttcgggaaggttgaaaatggcagatccaccactgccatggccctgaccgttggtattccagcagcagtaggagccctgctattgctacagaataaggtccagacaaaaggagtgatcaggcctctgcaaccggagatctacattccagcattggagatcttggagtcgtcaggcatcaagctgattgagagtgtggagatttga

SEQ ID NO: 8466 - protein, 1048 aa, Sorghum bicolor
  misc_feature: Ceres ANNOT ID no. 6090948
  misc_feature (572)..(1043): Pfam Id: Saccharop_dh Pfam Desc: Saccharopine dehydrogenase
  misc_feature (463)..(568): Pfam Id: Saccharop_dh_N Pfam Desc: LOR/SDH bifunctional enzyme conserved region
  misc_feature (196)..(401): Pfam Id: AlaDh_PNT_C Pfam Desc: Alanine dehydrogenase/PNT, C-terminal domain
  misc_feature (19)..(156): Pfam Id: AlaDh_PNT_N Pfam Desc: Alanine dehydrogenase/PNT, N-terminal domain
  misc_feature (1)..(1047): NCBI GI: 5016095 NCBI Desc: lysine-ketoglutarate reductase/saccharopine dehydrogenase bifunctional enzyme [zea mays]
  misc_feature (82)..(1047): NCBI GI: 94429048 NCBI Desc: lysine ketoglutarate reductase/saccharopine dehydrogenase biofunctional enzyme [zizania latifolia]
  misc_feature (12)..(591): NCBI GI: 144924377 NCBI Desc: nad(p) transhydrogenase, alpha subunit; saccharopine dehydrogenase; lor/sdh bifunctional enzyme conserved region [medicago truncatula]
  misc_feature (13)..(535): NCBI GI: 2052508 NCBI Desc: lysine-ketoglutarate reductase/saccharopine dehydrogenase bifunctional enzyme [arabidopsis thaliana]
  misc_feature (13)..(535): NCBI GI: 18418158 NCBI Desc: lysine-ketoglutarate reductase/saccharopine dehydrogenase bifunctional enzyme [arabidopsis thaliana]
MGSAATESNDTLLGNGVVGILAETCNMWERRAPLTPSHCARLLLGGGKNGARVNRITVQPSTKRIHHDAQYEDVGCEISEDLSECGLIIGIKQPKLQMILPDRAYAFFSHTHKAQKENMPLLDKILEERVSLFDYELIVGDDGKRSLAFGKFAGRAGLIDFLHGLGQRYLSLGYSTPFLSLGQSHMYPSLAAAKAAVIAVAEEIATFGLPSGICPIVFVFTGVGNVSQGAQEIFKLLPHTFVDAEKLPEISQGRNLSKQSQSTKRVFQLYGCVVTSRDMVSHKDPTRQFDKADYYAHPEHYAPVFHERIAPYASVIVNCMYWEKRFPPLLSMDQLQQLMETGCPLVGVCDITCDIGGSIEFVNKSTSIERPFFRYDPSNNSYHDDMEGAGVICLAVDILPTEFSKEASQHFGNILSKLVPSLASVKQLAELPSYLRRACIAHAGRLTPLDLAPTKTNPLPDKKYSTLVSLSGHLFDKFLINEALDIIETGGGSFHLVRCQVGQSMDDMSYSELEVGADDTATLDKIIDSLTSLANEHGGDHDAGKETELALKIGKVNECETDATVDKGGPKVLILGAGRVCRPAAEFLASYPNICTYGVDDHNTDQIHVIVASLYQKDAEETVDGIENTTATQLDVSDIGSLSDLVSQVEVVISLLPTSFHAAIARVCIELKKHMVTASYVDESMSNLSQAAKGAGVTILCEMGLDPGIDHLMSMKMIDEAHARKGKIKTFTSYCGGLPSPAAANNPLAYKFSWNPAGALRAGKNPAVYKFLGETIHVDGHNLFESAKRLRLPELPAFALEHLPNRNSLIYGDLYGISKEASTIYRATLRYEGFSEIMATLSKIGLFDAANHPLLQETNRPTYKGFLDELLNNISTTNTGLDIEASGGYDDEIIARLSKLGCCRDKEIAAKTVKTIKFLGLHEETQIPKGCSSAFDVICQRKEQRMAYGHNEQDMVLLHHEVEVEYPDGQPTEKHQATLLEFGKVENGRSTTAMALTVGIPAAVGALLLLQNKVQTKGVIRPLQPEIYIPALEILESSGIKLIESVEI

SEQ ID NO: 8467 - DNA, 1017 bp, Sorghum bicolor
  misc_feature: Ceres ANNOT ID no. 6090951
  misc_feature: Encodes the peptide sequence at SEQ ID NO 8468
atgaagcctccgtcttctcctcgagctccgtcgtcggcgtcgtcgccacgcacctcgctcttcctcctccctggtatcctcctggctgcggtcatctaccttgtcctcttccccgacaacttcaggctcccggctgggatgttcatcgggtcgtcctcatgcaacaacgacgactacagcggctcgccgtcgtcggtgttcggccgtctcgccgccggaggctctccagcggaggaggaggaggtggacctgcggctgctgatgggcatcgtgaccatcccaagcacgtacgagcggcgcgcgctcctgcgcctggcctactccctgcagccgcgccccgtgcgcgcggtggtggacgtgcgcttcgtcatgtgccgcatcgagcgcgaggaggaccgcatcctggtggcgctggagatcatcgcgcacggcgacgtggtggtgctcaactgcacggagaacatgaacgacggcaagacgtacgcctacttctcggccgtgccggagctgttcgggcggtacgactacgtgggcaagaccgacgacgacacctactaccgggtggcggcgctggcggagtcgctgcgcgggaaggcgcggcgggacgcgtaccagggcttcctgacgccctgccactggctgcccgagaagcagtacatgtccgggatggggtacgtcgtgtcgtgggacgtggtggagtggatcgccgccacgccggagctccgggacgaccaccacgactgggaggacgtcgacttcggcgggtggctgcgcaagggcggcaggtacaagaacgtgtacaacgaggagcccaggatgtacgactactgggacagggagatggccacggacatcaactgcttccggcacgagcacatcgccgacgccgtggccgtgcacaagctcaaggaccgcctcaagtgggcgcgcacgctccacttcttcaacgccacccaggggctcaagccatccaagctatatcatcttgacttgcaaaacgtctaccacgtcgtctaa

SEQ ID NO: 8468 - protein, 338 aa, Sorghum bicolor
  misc_feature: Ceres ANNOT ID no. 6090951
  misc_feature (98)..(266): Pfam Id: Galactosyl_T Pfam Desc: Galactosyltransferase
  misc_feature (1)..(323): NCBI GI: 115479301 NCBI Desc: os09g0433500 [oryza sativa (japonica cultivar-group)]
  misc_feature (75)..(169): NCBI GI: 74625883 NCBI Desc: beta-1,3-galactosyltransferase pvg3 (pyruvylated gal-beta-1,3-epitope synthesis protein 3) (pvgal synthesis protein 3)
  misc_feature (61)..(257): NCBI GI: 89269053 NCBI Desc: udp-gal:betagal beta 1,3-galactosyltransferase polypeptide 6 [xenopus tropicalis]
  misc_feature (61)..(209): NCBI GI: 61211870 NCBI Desc: beta-1,3-galactosyltransferase-6 (beta 3galt6) (galactosylxylosylprotein 3-beta-galactosyltransferase) (udp-gal:betagal beta 1,3-galactosyltransferase polypeptide 6)
  misc_feature (61)..(209): NCBI GI: 61211870 (continued) (galactosyltransferase ii) (gag galtii)
  misc_feature (61)..(209): NCBI GI: 16024928 NCBI Desc: beta-1,3-galactosyltransferase-6 [homo sapiens]
  misc_feature: The sequence is a functional homolog of SEQ ID NO. 346 in the 11/188,298 US application
MKPPSSPRAPSSASSPRTSLFLLPGILLAAVIYLVLFPDNFRLPAGMFIGSSSCNNDDYSGSPSSVFGRLAAGGSPAEEEEVDLRLLMGIVTIPSTYERRALLRLAYSLQPRPVRAVVDVRFVMCRIEREEDRILVALEIIAHGDVVVLNCTENMNDGKTYAYFSAVPELFGRYDYVGKTDDDTYYRVAALAESLRGKARRDAYQGFLTPCHWLPEKQYMSGMGYVVSWDVVEWIAATPELRDDHHDWEDVDFGGWLRKGGRYKNVYNEEPRMYDYWDREMATDINCFRHEHIADAVAVHKLKDRLKWARTLHFFNATQGLKPSKLYHLDLQNVYHVV

SEQ ID NO: 8469 - DNA, 2541 bp, Sorghum bicolor
  misc_feature: Ceres ANNOT ID no. 6090954
  misc_feature: Encodes the peptide sequence at SEQ ID NO 8470
atgtacctggcgtacgggtggccgcagtcgatcccgctggacccggacgactcggaccgcgtggtcctcctccgcgtgctcggccgcctcctcctcgccgtctgcccggcctcgctccacctctggtccgccacgcagcaccgggtccgcctagcccgctctgaccgctccccggagtccctcgccgcccacggccacaacgcgcacgccgtgtggagccccgacgccaagaccgtcgccgtcctgacctcttccttctacctctacgtttacaaggttcagcactcggggaagcaactgatcgtcggtggcaagcaggtcccggggctatgcctggctagcatatccctgatcatcaccgagaaggttcctctcgccaatggcgttgctataacgagcaatttcgtgtgtgacagcaaaagtatgctcctcggactatccaatgggcatgtgcaggtcgtgtcctggaacgctgagttctcagacagcttcaagcctggttgctctgtgtgttcgtctgagaaacctactgctgtcatagatgcgttggtgtttgatcctcccagtttgcgagaaaactctaatgcaaggcctgctccttgctgcacaggcaattcttctattgtccatgttgagctgtcggtgaagctaaggttgctggttgctttgtactcaggctgtcgcattgccctctgtactattggtaagaagggattaaggcagcctggcagcatcagagtggagagatggttggacactgatgatgcgatgtgtacttctgtggcttcagagcaacagattcttgccgtcgggtgcagtagaggtgttgttgaattgtatgatctggcagaaaacacacggcatatacgaaccatttcgttgtatgattggggttgctggctctcatggctttcaacagtgcgagaactttcaatcatgagtcctaagagcccacctgtttcaatgcgcttcattcctgaacaaaatgacaaaggagtgctgaaacgagatattaatggatcttctgatcttttgtcccagcaaccatcaagatgtttgatcttgcggacaaatggggagctttctgtgcttgacatggacgatggacatgaacatgctctcacaaattcaatcgaactcttttgggtcacctgttcccagtttgaagagaagggtagtcttatcaaagaggtttcatggcttgactatggtcatcggggtatgcaggtgtggtacccatcacatggagcagatccttttaagcaagaggattttttgcagttggatccggagcttgagtttgatcgtgaggtgtatcctcttggtcttcttccaaacgttggtgtggttgttggtgtttctcagagaatgtcattctcaactgcggagtttccatgctttgagccttcacctcaagcccaaacaatactgcattgtttattacgacatctccttcagagggacaagattgaagaagctttgcgcttggcaaatttgtcagcagaaaaacctcacttctctcactgtttagagtggcttctgtttacagtatttgatgcagatatatcaaggccaagtgcttcaaaaaaccaggcttcacaaaaagttgattctcccaagaaatctcttcttgagaaaacttgtgacctgctacggaattttcctgaatatatggatgttgtagtcagtgttgctagaaaaactgatggtcgacactgggctgatcttttctctgcagctggacgatccacagagatgtttgaggaatgcttccaacagaggtggtacaggactgctgcttgctacatactggtcattgctaagctggagggccctgcagtcagccagtattgtgcactccgtttgctacaagctacacttgatgagtctttgtatgagcttgctggggagttggttcgcttcttgctaagatctggaagagattttgagaatgctacttcagactccgagaagctctctccaagatttctaggctattttcttttccgttcaccatataagcggcaatcttctgatttgagaagtaattcaatgaaagaacttagtccacatattgcctctgttatgaacattctagagcgccatgcttgctatttgatgtctggcaaggagctttctaaactcgtcgcttttgtcaaggggactcaatttgatcttgtggaatatctacaacgagaaaggcaagggtctgctcgtctggagaattttgcttctgcacttgaactgattggacaaaagctccaaatggatacactgcaaagccgacttgatgcagagttccttctagctcatatgtgttcagtcaagtttaaggaatggatcgtggtgctagctactttattgcggcgggcagaggttttggtggatctctttcggcatgatttgcgattgtggaaagcatatagcattactctacagtcacatgatgtattcagagaataccttgaccttcttaatatcttggaggagcagctttcgtcggtctctgatcttacattgcaaaatggaccattgtcatga

SEQ ID NO: 8470 - protein, 846 aa, Sorghum bicolor
  misc_feature: Ceres ANNOT ID no. 6090954
  misc_feature (392)..(672): Pfam Id: RIC1 Pfam Desc: RIC1
  misc_feature (1)..(846): NCBI GI: 115449105 NCBI Desc: os02g0786000 [oryza sativa (japonica cultivar-group)]
  misc_feature (304)..(837): NCBI GI: 87162909 NCBI Desc: wd40-like [medicago truncatula]
  misc_feature (410)..(846): NCBI GI: 9502156 NCBI Desc: contains similarity to drosophila melanogaster bcdna.gh03694 (gb:aad55412) [arabidopsis thaliana]
  misc_feature (374)..(642): NCBI GI: 54641642 NCBI Desc: ga21512-pa [drosophila pseudoobscura]
  misc_feature (260)..(642): NCBI GI: 21357697 NCBI Desc: cg9063-pa [drosophila melanogaster]
MYLAYGWPQSIPLDPDDSDRVVLLRVLGRLLLAVCPASLHLWSATQHRVRLARSDRSPESLAAHGHNAHAVWSPDAKTVAVLTSSFYLYVYKVQHSGKQLIVGGKQVPGLCLASISLIITEKVPLANGVAITSNFVCDSKSMLLGLSNGHVQVVSWNAEFSDSFKPGCSVCSSEKPTAVIDALVFDPPSLRENSNARPAPCCTGNSSIVHVELSVKLRLLVALYSGCRIALCTIGKKGLRQPGSIRVERWLDTDDAMCTSVASEQQILAVGCSRGVVELYDLAENTRHIRTISLYDWGCWLSWLSTVRELSIMSPKSPPVSMRFIPEQNDKGVLKRDINGSSDLLSQQPSRCLILRTNGELSVLDMDDGHEHALTNSIELFWVTCSQFEEKGSLIKEVSWLDYGHRGMQVWYPSHGADPFKQEDFLQLDPELEFDREVYPLGLLPNVGVVVGVSQRMSFSTAEFPCFEPSPQAQTILHCLLRHLLQRDKIEEALRLANLSAEKPHFSHCLEWLLFTVFDADISRPSASKNQASQKVDSPKKSLLEKTCDLLRNFPEYMDVVVSVARKTDGRHWADLFSAAGRSTEMFEECFQQRWYRTAACYILVIAKLEGPAVSQYCALRLLQATLDESLYELAGELVRFLLRSGRDFENATSDSEKLSPRFLGYFLFRSPYKRQSSDLRSNSMKELSPHIASVMNILERHACYLMSGKELSKLVAFVKGTQFDLVEYLQRERQGSARLENFASALELIGQKLQMDTLQSRLDAEFLLAHMCSVKFKEWIVVLATLLRRAEVLVDLFRHDLRLWKAYSITLQSHDVFREYLDLLNILEEQLSSVSDLTLQNGPLS

SEQ ID NO: 8471 - DNA, 546 bp, Sorghum bicolor
  misc_feature: Ceres ANNOT ID no. 6090965
  misc_feature: Encodes the peptide sequence at SEQ ID NO 8472
atggcgagttcctcgagctgtagtcggcccagagctcgcttctccggcgccgccgctctgggcattgcgctgctcgtcctgctcgccggctgcgcgggcaatgccggcgcctactacggcggcggtggcggggacatgcggtaccagttcctggcacagcagaacgcggcgcgcgcgtcgatgggcctgccgcctctgatctgggacgagcgcgtggcgtcgtacgcgcggtggtacgcgcagtcccggcgcggggactgcgcgctggtgcactcgtcgggtccctacggcgagaacctcttctggggcagcggcaccgggtgggcgccgtcgcaggccgtcggcgcctggctatccgagcggccacgctacgactactggagcaacagctgctacggcggcatgtgcgggcactacacccagatcatgtggcggagcacccgacgcgtcggctgcgccgaggtcacatgctacaatggcaggggcaccttcatcacctgcaactatgacccgccgggcaactacgtcggcgtccgcccctactga

SEQ ID NO: 8472 - protein, 181 aa, Sorghum bicolor
  misc_feature: Ceres ANNOT ID no. 6090965
  misc_feature (51)..(169): Pfam Id: SCP Pfam Desc: SCP-like extracellular protein
  misc_feature (49)..(181): NCBI GI: 505553 NCBI Desc: pr-1 [medicago truncatula]
  misc_feature (14)..(181): NCBI GI: 7269932 NCBI Desc: pr-1-like protein [arabidopsis thaliana]
  misc_feature (50)..(181): NCBI GI: 228409 NCBI Desc: pathogenesis-related protein 1
  misc_feature (50)..(181): NCBI GI: 75994059 NCBI Desc: pathogenesis-related protein 1 [zea mays subsp. parviglumis]
  misc_feature (50)..(181): NCBI GI: 75994041 NCBI Desc: pathogenesis-related protein 1 [zea mays subsp. parviglumis]
  misc_feature: Useful for making plants with modulated biotic stress sensitivity
  misc_feature: Functional homolog of the protein sequence given in SEQ ID NO 13804
MASSSSCSRPRARFSGAAALGIALLVLLAGCAGNAGAYYGGGGGDMRYQFLAQQNAARASMGLPPLIWDERVASYARWYAQSRRGDCALVHSSGPYGENLFWGSGTGWAPSQAVGAWLSERPRYDYWSNSCYGGMCGHYTQIMWRSTRRVGCAEVTCYNGRGTFITCNYDPPGNYVGVRPY

SEQ ID NO: 8473 - DNA, 525 bp, Sorghum bicolor
  misc_feature: Ceres ANNOT ID no. 6090968
  misc_feature: Encodes the peptide sequence at SEQ ID NO 8474
atggagggcacctcaagaagccgccggctctcgtgctgcctcctcctggcggcggtgtgcgccgtcgtcctactagtgccggcggcggccgcgcctcggcggctgctgcagacgtgcccggggcaggacttcgacgtgccccacgcgcacctccgcgcgcggaacaacgtgaggccgctcaagtacacggaggagatctccgcgcgggcgctgcagtgggcgctgcagttcaagggcaactgcgcggccgccgcgcccgccgccggcatcaacgtcttcctcggcggcgccggcgcgacatggctgcccagcgacgccgtcgccgcgtgggccgaggaggaggagcactacgactacggcgccaactcctgctccacgggcaaggcgtgcggccgctacacgcagatggtgtggaggaacagcaaggagttcggatgcgccgtcgtcgactgcgactccggggagacgctcatggcgtgccactacgagccgcagggcaacgtcatgggacagaagccgttctga

SEQ ID NO: 8474 - protein, 174 aa, Sorghum bicolor
  misc_feature: Ceres ANNOT ID no. 6090968
  misc_feature (44)..(162): Pfam Id: SCP Pfam Desc: SCP-like extracellular protein
  misc_feature (9)..(174): NCBI GI: 75994087 NCBI Desc: pathogenesis-related protein 1 [zea diploperennis]
  misc_feature (9)..(174): NCBI GI: 75994059 NCBI Desc: pathogenesis-related protein 1 [zea mays subsp. parviglumis]
  misc_feature (9)..(174): NCBI GI: 75994079 NCBI Desc: pathogenesis-related protein 1 [zea diploperennis]
  misc_feature (9)..(174): NCBI GI: 75994085 NCBI Desc: pathogenesis-related protein 1 [zea diploperennis]
  misc_feature (9)..(174): NCBI GI: 3290004 NCBI Desc: pathogenesis related protein-1 [zea mays]
MEGTSRSRRLSCCLLLAAVCAVVLLVPAAAAPRRLLQTCPGQDFDVPHAHLRARNNVRPLKYTEEISARALQWALQFKGNCAAAAPAAGINVFLGGAGATWLPSDAVAAWAEEEEHYDYGANSCSTGKACGRYTQMVWRNSKEFGCAVVDCDSGETLMACHYEPQGNVMGQKPF

SEQ ID NO: 8475 - DNA, 1206 bp, Sorghum bicolor
  misc_feature: Ceres ANNOT ID no. 6090973
  misc_feature: Encodes the peptide sequence at SEQ ID NO 8476
atggagcaagcaacaggtgtaagtggtcctgagcacataattgatattccaagggaaattggtccttctgcttcggtttctcgtagtgttggtagagagaaccatgaagaattgaatcccgtggacaggccttcaacaagagctctagtacctgccttgcaggcaccatcagcaataggtgccgtacctaatgcagggcagacttcaggcactaggagaaatgataactatgttcgtcggcacagaagccctttgaattctggactgtggatttcaattgaagttatcgtcaatgtgagccagattgtagctgccattgttgttctttgtctgtcaagaaaggaacacccacaagctccattacttgagtgggttataggttacactgttggttgtttcgccacgttaccacatctctattggcgctatatacaccgtaatattgtaaatggtgagcatgaaccagcacatgcacctcaggggtctgctcataacaactcaaacgaagccactcatgctgcaagtgcatcagaacgccgtagaaatgctgcacgaaatgctgtgcttgctaatcctaggattaatgcgctgtttgaccacttcaagatggccctggattgtttctttgccgtctggtttgttgttggaaacgtgtggatattcggtggccgttcttctgctgctgatgcaccaaacttgtacaggttgtgcattgtgttcctcactttcagttgcattgggtatgccatgccgttcatcctctgtgcaatgatatgctgttgtcttccctgcattatatctgttatgggttttagagaagatacaaacaatacaaggggtgctacctcagaatctatcaatgctttgcctacatataaattcaaaaccaagaaacgccgccatggttcaggaagtgaagctgaaggacaagaaggagggatagtggctgcagggactgacaaggagcgatcgctttctgctgaagacgctgtttgctgcatttgtcttgcaaagtatgcgcacaatgatgagctccgtgaacttccatgtgcacactgtttccacaaggattgtgttgataaatggcttaagataaatgcactttgccctctatgcaaatctgagatagcgggctcgtctggtacttctgatgctcgtcaattagatcagaacgccattcctgtgcaggagatcgaaatgcattag

SEQ ID NO: 8476 - protein, 401 aa, Sorghum bicolor
  misc_feature: Ceres ANNOT ID no. 6090973
  misc_feature (332)..(372): Pfam Id: zf-C3HC4 Pfam Desc: Zinc finger, C3HC4 type (RING finger)
  misc_feature (77)..(401): NCBI GI: 115449125 NCBI Desc: os02g0787500 [oryza sativa (japonica cultivar-group)]
  misc_feature (12)..(385): NCBI GI: 115462405 NCBI Desc: os05g0179000 [oryza sativa (japonica cultivar-group)]
  misc_feature (1)..(387): NCBI GI: 140059785 NCBI Desc: zinc finger, ring-type [medicago truncatula]
  misc_feature (1)..(385): NCBI GI: 55296253 NCBI Desc: atp synthetase alpha chain -like [oryza sativa (japonica cultivar-group)]
  misc_feature (203)..(401): NCBI GI: 47497754 NCBI Desc: ring zinc finger protein-like [oryza sativa (japonica cultivar-group)]
  misc_feature: The sequence is a functional homolog of SEQ ID NO 178 in the 10/666,642US patent application
  misc_feature: The sequence is a functional homolog of SEQ ID NO 404 in the 10/666,642US patent application
  misc_feature: Useful for making plants with modulated growth and phenotype characteristics
  misc_feature: The sequence is a functional homolog of SEQ ID NO 178 in the 20070033671 US patent application
  misc_feature: The sequence is a functional homolog of SEQ ID NO 404 in the 20070033671 US patent application
  misc_feature: The sequence is a functional homolog of SEQ ID NO 178 in the 10/666,642 US patent application
  misc_feature: The sequence is a functional homolog of SEQ ID NO 2 in US patent 7053203
  misc_feature: The sequence is a functional homolog of SEQ ID NO 404 in the 10/666,642 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MEQATGVSGPEHIIDIPREIGPSASVSRSVGRENHEELNPVDRPSTRALVPALQAPSAIGAVPNAGQTSGTRRNDNYVRRHRSPLNSGLWISIEVIVNVSQIVAAIVVLCLSRKEHPQAPLLEWVIGYTVGCFATLPHLYWRYIHRNIVNGEHEPAHAPQGSAHNNSNEATHAASASERRRNAARNAVLANPRINALFDHFKMALDCFFAVWFVVGNVWIFGGRSSAADAPNLYRLCIVFLTFSCIGYAMPFILCAMICCCLPCIISVMGFREDTNNTRGATSESINALPTYKFKTKKRRHGSGSEAEGQEGGIVAAGTDKERSLSAEDAVCCICLAKYAHNDELRELPCAHCFHKDCVDKWLKINALCPLCKSEIAGSSGTSDARQLDQNAIPVQEIEMH

SEQ ID NO: 8477 - DNA, 1404 bp, Sorghum bicolor
  misc_feature: Ceres ANNOT ID no. 6090974
  misc_feature: Encodes the peptide sequence at SEQ ID NO 8478
atggcctcccgcctcttcaccagatcagcggcggcgcgcctcgtctcccacctccaccgcaagaggccaggaactactcactgcctcctcacccatggcgccgccttggcggccctcctggggcccactgatggcctcccccacgccgccaactccactctcctccgcgttccggtgcggtggttctcctctccgtccacggaggcggtggcggaggctccgatgaccgctgacggactgacgatagactcgatcgccgacaaggggtggacgattcttcccgaagccgagagcgattggcgcagccatgccgccgccgtcgcgcagtcagtcaagctcatcaagaagcgcctcaagtggggatggatacttgagagaacaaagcaattggctgtggtgttggagaggccagatctctgggaagatccagtttttgctgggagggttagccgtgagcagggtgagctcatgggcaagattaagtcagtgaaccaacttgagcaggaattgattgaacacattgagatgctacggcttgcacgtgaagaaaatgataatgaacttgagatggaaagcatgagggctttagccgatatgagaataagtgcaaaggagaaagaactcaatgcgttactttctagagacaatgattcttgttcttgcttcattgaggttcaggcaggggctggtggcactgagagcatggactgggctgcaatggtcatgaacatgtataagtcatgggcccagcgacgaggatatacagtcactgtggttgaagagatgcctggtgaagtagcaggaatcaagagggccactatcaaagttgatggtgaatatgcatttggatatgctaaagctgaagtaggagttcaccgattagtgcgaatttctccatttgacagtggaaaacggcggcacacttcctttgcagctgttgctgtaatacctattcttggggatgcctctagccgataccagatcaaagattctgatcttaggatagaacgtttccgttctggtggccctggtggtcagcatgccaacactacagagagtgccattcgaattgtgcacattccaactggtataagtgcaacatctcaaaatgaaagatcacaacacatgaacaaggcatcagcaatggcagtgctccaatctcgtcttgatcagcttgagattgcccgccaagcacagatgaatgcagagcacacacaatcactcaacgaaatcagctggggcaaccaaataagatcttatgttcttcatccataccgtatggtcaaagatctccggacgaactatgaagtatctgatcctgattcagttctagaaggagatctagatgatttcatcttgaactatttgtcttcgtcactggatgaagctgatgtaagtacctga

SEQ ID NO: 8478 - protein, 467 aa, Sorghum bicolor
  misc_feature: Ceres ANNOT ID no. 6090974
  misc_feature (319)..(432): Pfam Id: RF-1 Pfam Desc: Peptidyl-tRNA hydrolase domain
  misc_feature (178)..(288): Pfam Id: PCRF Pfam Desc: PCRF domain
  misc_feature (106)..(466): NCBI GI: 69934478 NCBI Desc: peptide chain release factor 2 [paracoccus denitrificans pd1222]
  misc_feature (106)..(466): NCBI GI: 119384552 NCBI Desc: peptide chain release factor 2 [paracoccus denitrificans pd1222]
  misc_feature (107)..(460): NCBI GI: 83951928 NCBI Desc: peptide chain release factor 2 [roseovarius nubinhibens ism]
  misc_feature (107)..(452): NCBI GI: 85374178 NCBI Desc: protein chain release factor b [erythrobacter litoralis htcc2594]
  misc_feature (101)..(452): NCBI GI: 85708766 NCBI Desc: protein chain release factor b [erythrobacter sp. nap1]
MASRLFTRSAAARLVSHLHRKRPGTTHCLLTHGAALAALLGPTDGLPHAANSTLLRVPVRWFSSPSTEAVAEAPMTADGLTIDSIADKGWTILPEAESDWRSHAAAVAQSVKLIKKRLKWGWILERTKQLAVVLERPDLWEDPVFAGRVSREQGELMGKIKSVNQLEQELIEHIEMLRLAREENDNELEMESMRALADMRISAKEKELNALLSRDNDSCSCFIEVQAGAGGTESMDWAAMVMNMYKSWAQRRGYTVTVVEEMPGEVAGIKRATIKVDGEYAFGYAKAEVGVHRLVRISPFDSGKRRHTSFAAVAVIPILGDASSRYQIKDSDLRIERFRSGGPGGQHANTTESAIRIVHIPTGISATSQNERSQHMNKASAMAVLQSRLDQLEIARQAQMNAEHTQSLNEISWGNQIRSYVLHPYRMVKDLRTNYEVSDPDSVLEGDLDDFILNYLSSSLDEADVST

SEQ ID NO: 8479 - DNA, 1479 bp, Sorghum bicolor
  misc_feature: Ceres ANNOT ID no. 6090977
  misc_feature: Encodes the peptide sequence at SEQ ID NO 8480
atggagcgggcgggggaggcgccggccgccaccgccgtcgtgcggagggctccctcgacggcgccgtcggcgcgtgtttcgatctgggagtcggtgcgcgcgtgcggggtgtggtcgaaggaggtggacaaggccgagctgcggaggcaggtcgtcatgccgctctacctgcgccgcgccgtcgcggccgccgtcaaggcaaaggacgaggccgccggcgtggcggcggcagccgcggatgaccaggcgggggaggacgcggacggccccgcggtggcgcccgtggtggtgttcgtcaactcgcggagcggcgggcggcacgggcccgagctcaaggtgcggctgcacgagctcatcaccgaggagcaggtctttgatctttctgttgtgaagccttcagattttgttcactatggtttgagttgtttggagaagttagctgaccaaggcgataaccgtgcgaaggccgttcgtgagagaatgagaattgtggttgctgggggtgacggcacagttggctgggtgcttggatgtctctcggatctttataagacgaaaagggaaccagttccacctacaggaatcattccacttggtacaggaaatgatcttgctagatcgtttggatggggtggctcttttccctttggctggcgctcagctgtaaagcgttatctcagcaaagcttccactgctcccatttgccgtcttgacagctggcaaactgtaattcagatgccagaaggagaaataaaagagttgccatatgcacttaagaaagtggaacctggagatccgttggagatcagccaggagaatggcacagagttatccgaaaaggcttctttctataaaggagtattctacaactaccttagcattgggatggatgctcaggttgcatatggcttccatcatcttcgtgatgaaaaaccgtatcttgcacaaggaccagttgcaaataagttgatttatgctggatatagctgcactcaggggtggttttgtacaccttgtacagcaagtcctcagctaagggggcttaagaacattttgcgactttccattaaaaaggccaattgttcagagtgggagcaagttcaaatgccttcaagcgttaggtccctagttgtcttaaatttatacaactatggcagtggaaggcatccatggggtgatcttaaacctgagtatcttgaaaagagaggctttgttgaagctcattcagatgatggcttacttgaaatatttggtctgaaggaaggttggcatgcttcatttgttatggccgagcttatcaaagcaaagcacattgcccaggctgcggctatcaaatttgaaatgaggggtggcgagtgggatcgagcatatattcaaatggatggagagccatggaaacaaccactcttacaggagcactcaaccattgtggaaataaacaaagttccctatcattctctcatgataaatggggagtaa

SEQ ID NO: 8480 - protein, 492 aa, Sorghum bicolor
  misc_feature: Ceres ANNOT ID no. 6090977
  misc_feature (94)..(240): Pfam Id: DAGK_cat Pfam Desc: Diacylglycerol kinase catalytic domain
  misc_feature (287)..(464): Pfam Id: DAGK_acc Pfam Desc: Diacylglycerol kinase accessory domain
  misc_feature (39)..(492): NCBI GI: 91807058 NCBI Desc: diacylglycerol kinase [arabidopsis thaliana]
  misc_feature (39)..(492): NCBI GI: 9759266 NCBI Desc: diacylglycerol kinase-like protein [arabidopsis thaliana]
  misc_feature (25)..(346): NCBI GI: 140047794 NCBI Desc: diacylglycerol kinase, catalytic region [medicago truncatula]
  misc_feature (287)..(487): NCBI GI: 42565455 NCBI Desc: diacylglycerol kinase [hyacinthus orientalis]
  misc_feature (1)..(492): NCBI GI: 47497758 NCBI Desc: diacylglycerol kinase-like [oryza sativa (japonica cultivar-group)]
MERAGEAPAATAVVRRAPSTAPSARVSIWESVRACGVWSKEVDKAELRRQVVMPLYLRRAVAAAVKAKDEAAGVAAAAADDQAGEDADGPAVAPVVVFVNSRSGGRHGPELKVRLHELITEEQVFDLSVVKPSDFVHYGLSCLEKLADQGDNRAKAVRERMRIVVAGGDGTVGWVLGCLSDLYKTKREPVPPTGIIPLGTGNDLARSFGWGGSFPFGWRSAVKRYLSKASTAPICRLDSWQTVIQMPEGEIKELPYALKKVEPGDPLEISQENGTELSEKASFYKGVFYNYLSIGMDAQVAYGFHHLRDEKPYLAQGPVANKLIYAGYSCTQGWFCTPCTASPQLRGLKNILRLSIKKANCSEWEQVQMPSSVRSLVVLNLYNYGSGRHPWGDLKPEYLEKRGFVEAHSDDGLLEIFGLKEGWHASFVMAELIKAKHIAQAAAIKFEMRGGEWDRAYIQMDGEPWKQPLLQEHSTIVEINKVPYHSLMINGE

SEQ ID NO: 8481 - DNA, 1656 bp, Sorghum bicolor
  misc_feature: Ceres ANNOT ID no. 6091008
  misc_feature: Encodes the peptide sequence at SEQ ID NO 8482
atggcgccggagaagccccggaaggagcaggagcaggagaaggaagaggaggagatgttgctggaggatggaggcatcgaggagagcccgcgccgcagcttcgaggactgcggcgattccgaggaggaccgcggggaggacgatgacgacgatgacgaggagcggcaccgcgacggcgacggcgtcggttcgccgcgctccttccagtctcaaaagtggccgcagagctacagggaaacaactgacacctacacaatcgctgcatcaccgagctttggttacttgggcccttctacaagcaaatactcactccttgatcttggtcgtagtggtctgggctctgacctgaagttgcctctagtatcggacaaggctgatggaaagcaagattctgtcaaaaacttgccgaaaacccttagttcaataagagatgagagagtctcatttcaattgcaacacacgggagaaatctacattagtcaagggtgcagtgtgacacaaacagtcttcaacgggattaatgtacttgctggtgttggccttctttccaccccgtttacaattcatgaagctggatggactggccttgcagttctagcatgttttgccatcgtttgctgttatactggaattcttctgaaacattgttttgagagcaaagatggtatctcaagttatccagacattggggaggctgcattcggaagaattggccgactgttgatatctattattttgtacaccgagctatatacatattgtgtggaattcattattttggagggcgataacctcacatcaatttttcctaaagctggttttgattggcttgggattcatgttgatgggaagcattttttcggagtgataactgctattttagtcttgccaacagtatggctgcgagatcttcgagtgctctcatacctttcagcgggtggtgtgtttgcaactcttctcgtattcctgtccgttggtttagtcggtgctactgatggtattggcttccattcaactgggaaggtagtaaactggagtggcatgccctttgccattggtatttatggattttgctactccgggcattcagtatttccaaatatctaccagtcaatgtctgatcgctccaagttccctaaggcactgttcatatgtttcgcaatttgcacagcaatgtatggctcttttgctgtcattggctttctcatgtttggagagaacactttatcacaaatcactttaaaccttccaaagcattcagttgcctcaaaagttgcactatggaccacggtgatcaaccctttcaccaaatatgccttgttgttaaacccattagctcgaagtttagaagagttgcgtcctgaaggctttttgaatgaaacatcatgctctataatactgaggactgcccttgttgcatcaactgtatgcattgcgtttcttctgccgttctttggtcttgtgatggcgctcattggatctcttcttagtatacttgtggcagtcataatgccagccttgtgcttcctgaagatcgcacagaataaagcaacttgttcacaggtaattgcaagcattggtatcataatattgggcgtcatcagtgctgccctggggacctattcgtccgtgaaaaggattgcagaaaactactaa

SEQ ID NO: 8482 - protein, 551 aa, Sorghum bicolor
  misc_feature: Ceres ANNOT ID no. 6091008
  misc_feature (161)..(545): Pfam Id: Aa_trans Pfam Desc: Transmembrane amino acid transporter protein
  misc_feature (265)..(551): NCBI GI: 47497766 NCBI Desc: amino acid transporter-like [oryza sativa (japonica cultivar-group)]
  misc_feature (2)..(311): NCBI GI: 47497767 NCBI Desc: amino acid transporter-like [oryza sativa (japonica cultivar-group)]
  misc_feature (27)..(549): NCBI GI: 30687791 NCBI Desc: amino acid transporter family protein [arabidopsis thaliana]
  misc_feature (78)..(438): NCBI GI: 92867258 NCBI Desc: amino acid/polyamine transporter ii [medicago truncatula]
  misc_feature (39)..(547): NCBI GI: 29028738 NCBI Desc: at5g02170/t7h20_220 [arabidopsis thaliana]
  misc_feature: The sequence is a functional homolog of SEQ ID NO. 313 in the 11/188,298 US application
  misc_feature: The sequence is a functional homolog of SEQ ID NO. 438 in the 11/188,298 US application
MAPEKPRKEQEQEKEEEEMLLEDGGIEESPRRSFEDCGDSEEDRGEDDDDDDEERHRDGDGVGSPRSFQSQKWPQSYRETTDTYTIAASPSFGYLGPSTSKYSLLDLGRSGLGSDLKLPLVSDKADGKQDSVKNLPKTLSSIRDERVSFQLQHTGEIYISQGCSVTQTVFNGINVLAGVGLLSTPFTIHEAGWTGLAVLACFAIVCCYTGILLKHCFESKDGISSYPDIGEAAFGRIGRLLISIILYTELYTYCVEFIILEGDNLTSIFPKAGFDWLGIHVDGKHFFGVITAILVLPTVWLRDLRVLSYLSAGGVFATLLVFLSVGLVGATDGIGFHSTGKVVNWSGMPFAIGIYGFCYSGHSVFPNIYQSMSDRSKFPKALFICFAICTAMYGSFAVIGFLMFGENTLSQITLNLPKHSVASKVALWTTVINPFTKYALLLNPLARSLEELRPEGFLNETSCSIILRTALVASTVCIAFLLPFFGLVMALIGSLLSILVAVIMPALCFLKIAQNKATCSQVIASIGIIILGVISAALGTYSSVKRIAENY

SEQ ID NO: 8483 - DNA, 567 bp, Sorghum bicolor
  misc_feature: Ceres ANNOT ID no. 6091009
  misc_feature: Encodes the peptide sequence at SEQ ID NO 8484
atgaggcctctcgacgagaaggagacgacgcaagtattcgagaagctgttcaagttcacggggcccaacctgaagcacctcctggagcggccagcggtggagggccccgacgcggagcccggccgctactgcctccgcctccaccgcaaccgcgtctactacgccgccgaggcgctcgtccgtcgcgccaccgccgtgtcccgcccgcgcctcgccggcgtgggcacgcccatcggcaagttcacccaccacggcgcgttccacctcacggtccacgcgctcgatctcctcgccgcgcacgcgcgccgccgcgtctggctcaagcccgacaccgagcgctccttcctcttcggaaactccgtgcccaagtcctccctcgcgcgcatcaccgagaacaccaaggccggggacggggtggtcgtcatgtccatggccgacgtcccgctcgggttcggcatcgcggcgaggtcggcgcaggactgcaggaaggccgacaccaacgccgtcgtcgtgctgcaccaggcggacgccggggagtacctccgcaaggaggaggagctcatgtga

SEQ ID NO: 8484 - protein, 188 aa, Sorghum bicolor
  misc_feature: Ceres ANNOT ID no. 6091009
  misc_feature (1)..(187): NCBI GI: 45752644 NCBI Desc: at4g15770 [arabidopsis thaliana]
  misc_feature (1)..(187): NCBI GI: 37590769 NCBI Desc: peachy protein [rattus norvegicus]
  misc_feature (1)..(187): NCBI GI: 50368826 NCBI Desc: mgc83122 protein [xenopus laevis]
  misc_feature (1)..(187): NCBI GI: 119603677 NCBI Desc: nuclear import 7 homolog (s. cerevisiae), isoform cra_b [homo sapiens]
  misc_feature (1)..(187): NCBI GI: 123980416 NCBI Desc: nuclear import 7 homolog (s. cerevisiae) [synthetic construct]
  misc_feature: The plant produces a reduced number of seeds.
  misc_feature: The plants are small.
  misc_feature: Useful for biocontainment applications
  misc_feature: Useful for making plants with modulated biomass
  misc_feature: GREAT-hit functional homolog of the protein sequence given in SEQ ID NO 13252
  misc_feature: Useful for biocontainment applications
  misc_feature: Useful for making plants with modulated biomass
  misc_feature: Functional homolog of the protein sequence given in SEQ ID NO 13252
MRPLDEKETTQVFEKLFKFTGPNLKHLLERPAVEGPDAEPGRYCLRLHRNRVYYAAEALVRRATAVSRPRLAGVGTPIGKFTHHGAFHLTVHALDLLAAHARRRVWLKPDTERSFLFGNSVPKSSLARITENTKAGDGVVVMSMADVPLGFGIAARSAQDCRKADTNAVVVLHQADAGEYLRKEEELM

SEQ ID NO: 8485 - DNA, 1569 bp, Sorghum bicolor
  misc_feature: Ceres ANNOT ID no. 6091010
  misc_feature: Encodes the peptide sequence at SEQ ID NO 8486
atggcggcggtgaaggaggagcgttccgtgacgacggaggaggagaacggagacatcgaagacgtcccgccgccgccgctactaggcaggaatggcggcagcgaggacgaggctgagacggaggaggaggcgggctcgttgaagtcccagcggtggccgcggagcttccgggaagcgactgacacctacaccattgctgcacctccgggattcggtcatctcggcggtggtgactgcagtggcctgggctctgacctgaagctgcctcttctatcggacaagccagaggggaagcaagattcagccaagaacttgctggcagaagcagagcccttcggttcagtgctaagtgatgggaaactctcagacagtttgcaacaagccccaatcactccgggatgcaatctgacgcaaaccgtgttcaatggggtcaacgtgcttgctggtattggcattttctctgctccctacacgattcgtgaggccggatgggccagccttgtggttctggcttttttcgctgtggtttgctgctacactggagttctcctcaagtactgctttgagagcaaagatggtgtgaaaaccttcccagacattggggaggctgcctttggaaggatcggtcggcttctcatttctatagttctgtataccgagctctattccttttgtgtggagttcattattttggaaggtgataatctagcgtcaatcttcacgagcaccactttcgattggaatgggattcatgccgacgggaggcatttctttggggttctatttgctcttgttgtcttgcccagcgtgtggttgcgagatcttcgagtaatatcttacctttcagcgggtggtgtgtttgcaactcttctggttttcctatctgttggtttggttggtgctactggcaacgtagggttccatatggcaggaaaagtagtgaagtgggatggtataccatttgcaattggtatttatggtttttgctatgctgggcactcagtatttccaaatatctatcagtcaatgtccgatcgcacaaaattcaatagcgcactctacatatgttttgcaatatgcacagcaatttatggtgctatagctgttatcggctacctcatgtttggagacaagactctgtcacaaataactttgaatcttccaaaagattcatttgcatcaaaagttgcactgtggaccacggtgatcattcctttcacaaaatattctttggtgataaacccattggctcggagcatagaagagttgcgtccagcagggtttctgacagatagagtcttctctgttatgctgcggactacccttgttgcatcaagcgtatgcattgcctttctcctgccattctttggtcttgtgatggctctcattggatctcttcttagtatactcgtggcgctcataatgcccgccctgtgcttcctgaagatcgctcggaataaagcgacacgcttgcaggtcatcgcaagcgtcatgaccgtggttctgggcgctgtctgcgcggttcttgggacgtacaactccatcgccaagatagccgaaagctactag

SEQ ID NO: 8486 - protein, 522 aa, Sorghum bicolor
  misc_feature: Ceres ANNOT ID no. 6091010
  misc_feature (132)..(516): Pfam Id: Aa_trans Pfam Desc: Transmembrane amino acid transporter protein
  misc_feature (113)..(520): NCBI GI: 30687791 NCBI Desc: amino acid transporter family protein [arabidopsis thaliana]
  misc_feature (236)..(522): NCBI GI: 47497766 NCBI Desc: amino acid transporter-like [oryza sativa (japonica cultivar-group)]
  misc_feature (57)..(413): NCBI GI: 92867258 NCBI Desc: amino acid/polyamine transporter ii [medicago truncatula]
  misc_feature (14)..(409): NCBI GI: 92895996 NCBI Desc: amino acid/polyamine transporter ii [medicago truncatula]
  misc_feature (5)..(409): NCBI GI: 92895998 NCBI Desc: amino acid/polyamine transporter ii [medicago truncatula]
  misc_feature: The sequence is a functional homolog of SEQ ID NO. 438 in the 11/188,298 US application
  misc_feature: The sequence is a functional homolog of SEQ ID NO. 313 in the 11/188,298 US application
MAAVKEERSVTTEEENGDIEDVPPPPLLGRNGGSEDEAETEEEAGSLKSQRWPRSFREATDTYTIAAPPGFGHLGGGDCSGLGSDLKLPLLSDKPEGKQDSAKNLLAEAEPFGSVLSDGKLSDSLQQAPITPGCNLTQTVFNGVNVLAGIGIFSAPYTIREAGWASLVVLAFFAVVCCYTGVLLKYCFESKDGVKTFPDIGEAAFGRIGRLLISIVLYTELYSFCVEFIILEGDNLASIFTSTTFDWNGIHADGRHFFGVLFALVVLPSVWLRDLRVISYLSAGGVFATLLVFLSVGLVGATGNVGFHMAGKVVKWDGIPFAIGIYGFCYAGHSVFPNIYQSMSDRTKFNSALYICFAICTAIYGAIAVIGYLMFGDKTLSQITLNLPKDSFASKVALWTTVIIPFTKYSLVINPLARSIEELRPAGFLTDRVFSVMLRTTLVASSVCIAFLLPFFGLVMALIGSLLSILVALIMPALCFLKIARNKATRLQVIASVMTVVLGAVCAVLGTYNSIAKIAESY

SEQ ID NO: 8487 - DNA, 1857 bp, Sorghum bicolor
  misc_feature: Ceres ANNOT ID no. 6091014
  misc_feature: Encodes the peptide sequence at SEQ ID NO 8488
atgggcggctcccacagccgcgaggacatcgacctcacctcctccgacgaagagaaggagtacgaggacgactacgacgcccgatcacccatcgcggaggccgccgcgagcgcggggcagcgcgacgacgacctcctccgcaccgccacaccttcgtcgcttgaggccatcgacgccaagctcaggtcgctggatctcaagtaccagcgtccgacctccgccaagctctacctccacgtcggcggagcctcgccctccgcgcactgggtgcctgccgagcgccgcgcgacctacgccttcgtcgacaaatcgagcgacaacgactcttcgcccaggtggttcctggaggtcggtccggggccgcgggtctccgcgcccgtggactcggcgctccagctgaagacgatccccgcgcagcgccgggcggacttcgccgcgagcggctccgtatgggctctgcgactgcccaccgacgccgaattgcgccggttcagggtggagtacgagcgctgcctcttcgagaacacgtacggggtcgaggccacggacgaggggcggaaggaggtgttcggcgccgacttcgccgcgtgggctcggcccgccgaggccgacgacgctgtttgggccgatgccgaggaaagcctcacccctcccgccgccgcaccagcgaaggacctgcttgaggagttcgaggaagaggccggcgacggcgacagcattcagagcctcgcgcttggggcgcttgacaacagcttcttggtcggtggcgcggggatacaggtggtcaagaacttccgccacggcttgcacgggaagggcgcgtcggtgaagatctcgggagggcgtggcggcagtgggagcgcctattcgacgccgaagaaggcgctgctgatgcgcggtgagactaacatgctgctgatgagcccaggagaggctgtgcgttccaatggtgtccaccatgtcgatatcgagactgggaaggttgtcgctgaatggcggtttgagaaggatggggctgatattacaatgcgagacattgccaacgacagtaagggagcgcagttggaaccctccgggtcgacattcttgggcctggattgcaacaggttgtgtagatgggatatgcgcgactccagaggcagagtgcagacaatcggtagctcatcagagtcaccagtgctgaactggtcacagggtcatcagttctctcggggcaccaacttccagtgctttgcgagtactggggatggatctattgttgttggttctgtggatggcaaaatcaggctctattctaagagctcgatgcgtatggcgaagacagcattcccagggcttgggtccccaattacacacgtggatgttacttatgatgggaaatggattttgggaacaactgacacatacttgatcttgatctgcactatcttcaaggacaaagatgggaaagaaaaaactgggtttagtggccgtatgggaaataagattgctgcaccaaggctgctgaagctgactccacttgattcaattttagcaggaactgacaacaaattccatggtgggcaattctcatgggtaacggagaacggaaagcaggaaaagcaccttgttgctacagtcggcaaattcagtgtcatttggaatttccagcaagtcaaggacagcaaccatgagtgctaccgtgatcagcagggcctcaagagctgctactgctacaaagttgtcctcaaggatgaatcgattgtcgacagccgtttcatgcacgagaagtttgcaagcagcgattctccagaagctccgcttgttgtcgctacaccaatgaaagtcagctccttcagtatagcaaatcgacgctga

SEQ ID NO: 8488 - protein, 618 aa, Sorghum bicolor
  misc_feature: Ceres ANNOT ID no. 6091014
  misc_feature (1)..(598): Pfam Id: VID27 Pfam Desc: VID27 cytoplasmic protein
  misc_feature (1)..(618): NCBI GI: 92871584 NCBI Desc: quinoprotein amine dehydrogenase, beta chain-like [medicago truncatula]
  misc_feature (8)..(618): NCBI GI: 37223342 NCBI Desc: dem2 [lycopersicon esculentum]
  misc_feature (17)..(618): NCBI GI: 2190419 NCBI Desc: dem [lycopersicon esculentum]
  misc_feature (8)..(618): NCBI GI: 37223344 NCBI Desc: dem2 [lycopersicon esculentum]
  misc_feature (139)..(616): NCBI GI: 17959 NCBI Desc: cypro4 [cynara cardunculus]
MGGSHSREDIDLTSSDEEKEYEDDYDARSPIAEAAASAGQRDDDLLRTATPSSLEAIDAKLRSLDLKYQRPTSAKLYLHVGGASPSAHWVPAERRATYAFVDKSSDNDSSPRWFLEVGPGPRVSAPVDSALQLKTIPAQRRADFAASGSVWALRLPTDAELRRFRVEYERCLFENTYGVEATDEGRKEVFGADFAAWARPAEADDAVWADAEESLTPPAAAPAKDLLEEFEEEAGDGDSIQSLALGALDNSFLVGGAGIQVVKNFRHGLHGKGASVKISGGRGGSGSAYSTPKKALLMRGETNMLLMSPGEAVRSNGVHHVDIETGKVVAEWRFEKDGADITMRDIANDSKGAQLEPSGSTFLGLDCNRLCRWDMRDSRGRVQTIGSSSESPVLNWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNKIAAPRLLKLTPLDSILAGTDNKFHGGQFSWVTENGKQEKHLVATVGKFSVIWNFQQVKDSNHECYRDQQGLKSCYCYKVVLKDESIVDSRFMHEKFASSDSPEAPLVVATPMKVSSFSIANRR

SEQ ID NO: 8489 - DNA, 1494 bp, Sorghum bicolor
  misc_feature: Ceres ANNOT ID no. 6091021
  misc_feature: Encodes the peptide sequence at SEQ ID NO 8490
atggggttcctcagccttgtgggcaactcctttgggtgctctgcttccggtgagcggcttgtctcagctgcccgcgacggcgacctgcaggaggctcgtgcgctccttgagtacaatcctcgccttgcccggtactccacatttggcggtcgaaactcaccactgcactatgccgcggcgcaaggccaccatgagattgtctctctgttgcttgaatctggcgttgagatcaaccttaggaattacagggggcagactgctttgatgcaagcatgccaatatggccactgggaggttgttcaaacactgatactcttcaatgcaaatgtgcacaggacagactatctgaatggtggaactgctattcattttgcagcactgcatggtcatgcccgatgcctgcgtcttgtgcttgcagattatgttccaagcataccgaatttctgcacagtaatgaaccataggccatctgaagaagattcagcttctgattttgatcatgatgctttggtcaagatggtaaatcaaaaggcggatggaggcttaaccccacttcatatggcagcattaaatgggcatgtagagtgtgttcaattgttgctggacttaggagcatctgtttctgaggtcactattgaggatggaacaactatagacttaataggagctggtagcaccccacttcactatgctgcttgtggtggaaatgttgtctgttgtcaactcctaattgctcgaggagcttgccttactgtgcaaaatgctagcggatggaccccattaatggtggctcgttcctggcaaagaaattcagttgaggaaatcttaagtaaagaaccagagggccggatacgcactcttccttctccttatctgtgtctcccactcatgagtatcatgaacattgccagggagtgcggttggaggtatctaaaccagtcacctgtttgtattgacccctgtgctgtctgcttagaagggagctgttctgttgccgcagaaggttgcaaacatgaattctgcacaagatgtgctctatacctttgctcaaccagctacacatcagtgagcccagcgggtgcaataccatgtcctctctgcagacatccaatcatctctttcatcactcttcctggcacgagcccgataagagagctaccgagaaacagcctttcactgtcattctgcacgacgtgcccagccgtgaactctgattcttcttctccgattgctgcccacctgtaccggactgaattccagtgcgggcgcatgccaccgatgatgggctcatcctccttccgctcgctgagctgccagaggataccggcgatgaaactgaacccagcattctgtatgggttccatggacacgaacccctgcctcataaggtgctcaaaattcggatccagcctgcggcgctcagcttcccagggagaggaaaccagaagagcttggcctctaacgtttaacccaattgtcgccaccagcagttga

SEQ ID NO: 8490 - protein, 497 aa, Sorghum bicolor
  misc_feature: Ceres ANNOT ID no. 6091021
  misc_feature (50)..(82): Pfam Id: Ank Pfam Desc: Ankyrin repeat
  misc_feature (83)..(115): Pfam Id: Ank Pfam Desc: Ankyrin repeat
  misc_feature (180)..(212): Pfam Id: Ank Pfam Desc: Ankyrin repeat
  misc_feature (223)..(255): Pfam Id: Ank Pfam Desc: Ankyrin repeat
  misc_feature (321)..(367): Pfam Id: zf-C3HC4 Pfam Desc: Zinc finger, C3HC4 type (RING finger)
  misc_feature (1)..(495): NCBI GI: 45773910 NCBI Desc: at5g57740 [arabidopsis thaliana]
  misc_feature (7)..(451): NCBI GI: 42567717 NCBI Desc: ankyrin repeat family protein [arabidopsis thaliana]
  misc_feature (7)..(460): NCBI GI: 63020474 NCBI Desc: pollen ankyrin-like protein [lilium longiflorum]
  misc_feature (224)..(460): NCBI GI: 115482998 NCBI Desc: os10g0521600 [oryza sativa (japonica cultivar-group)]
  misc_feature (91)..(382): NCBI GI: 68248528 NCBI Desc: xb3-related protein [oryza sativa (japonica cultivar-group)]
  misc_feature: The sequence is a functional homolog of SEQ ID NO 1839 in the 10/374,780US patent application
  misc_feature: Useful for making plants with modulated growth and phenotype characteristics
  misc_feature: The sequence is a functional homolog of SEQ ID NO 1839 in the 20060162006 US patent application
MGFLSLVGNSFGCSASGERLVSAARDGDLQEARALLEYNPRLARYSTFGGRNSPLHYAAAQGHHEIVSLLLESGVEINLRNYRGQTALMQACQYGHWEVVQTLILFNANVHRTDYLNGGTAIHFAALHGHARCLRLVLADYVPSIPNFCTVMNHRPSEEDSASDFDHDALVKMVNQKADGGLTPLHMAALNGHVECVQLLLDLGASVSEVTIEDGTTIDLIGAGSTPLHYAACGGNVVCCQLLIARGACLTVQNASGWTPLMVARSWQRNSVEEILSKEPEGRIRTLPSPYLCLPLMSIMNIARECGWRYLNQSPVCIDPCAVCLEGSCSVAAEGCKHEFCTRCALYLCSTSYTSVSPAGAIPCPLCRHPIISFITLPGTSPIRELPRNSLSLSFCTTCPAVNSDSSSPIAAHLYRTEFQCGRMPPMMGSSSFRSLSCQRIPAMKLNPAFCMGSMDTNPCLIRCSKFGSSLRRSASQGEETRRAWPLTFNPIVATSS

SEQ ID NO: 8491 - DNA, 687 bp, Sorghum bicolor
  misc_feature: Ceres ANNOT ID no. 6091022
  misc_feature: Encodes the peptide sequence at SEQ ID NO 8492
atggcgccactcctcttcgtcccgaacaaaacgttcgcaccaccggcaccggcaccggcaccggcaccgaccccccgcgctcgccgccgcctcgcgcccagacccccctccgccgcggccttcttccgcggactttttcccaccaagccgccggcggcgaaggccgacctcctccgcctcatcgccgaccagggtcgtggcctcgagacgcagtccgacccctcccgcctcgccgacatcgtctcctgcatcgacgcgctcgccgccgtatcccccggcgcggacaccgtatccgacgctgccaagctctccggaacctggcgcctcctctggactacggagcaggagcagctcttcattgtgcgtaacgccccattcttccgcactgccgctggcgacgtgctccaggtcatagatgtccccggcggcgcccttaacaacgtcatcacgtttcctccctcaggcgcgttcgttgtcaatggcgaaatcgaggtccagccgccccagcgagtcaatttcaggttcacccgcgctgctctgagaggaaacaagtgggaggttccttttccgccgtttggaaaaggatggtttgacactgtctatctggatgatgacatacgggttgccaaggacataagaggggactatttagtggttgagcgtgctctatattcttggaatggatag

SEQ ID NO: 8492 - protein, 228 aa, Sorghum bicolor
  misc_feature: Ceres ANNOT ID no. 6091022
  misc_feature (51)..(220): Pfam Id: PAP_fibrillin Pfam Desc: PAP_fibrillin
  misc_feature (22)..(228): NCBI GI: 38345467 NCBI Desc: osjnba0010h02.5 [oryza sativa (japonica cultivar-group)]
  misc_feature (22)..(228): NCBI GI: 115459798 NCBI Desc: os04g0551700 [oryza sativa (japonica cultivar-group)]
  misc_feature (31)..(226): NCBI GI: 92894514 NCBI Desc: pap fibrillin [medicago truncatula]
  misc_feature (7)..(222): NCBI GI: 115472009 NCBI Desc: os07g0470700 [oryza sativa (japonica cultivar-group)]
  misc_feature (54)..(180): NCBI GI: 16329838 NCBI Desc: fibrillin [synechocystis sp. pcc 6803]
MAPLLFVPNKTFAPPAPAPAPAPTPRARRRLAPRPPSAAAFFRGLFPTKPPAAKADLLRLIADQGRGLETQSDPSRLADIVSCIDALAAVSPGADTVSDAAKLSGTWRLLWTTEQEQLFIVRNAPFFRTAAGDVLQVIDVPGGALNNVITFPPSGAFVVNGEIEVQPPQRVNFRFTRAALRGNKWEVPFPPFGKGWFDTVYLDDDIRVAKDIRGDYLVVERALYSWNG

SEQ ID NO: 8493 - DNA, 1242 bp, Sorghum bicolor
  misc_feature: Ceres ANNOT ID no. 6091033
  misc_feature: Encodes the peptide sequence at SEQ ID NO 8494
atgtgggcggcgtcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccactttcacaagactcccgaccgcgagtggttcgagaccgacgcggtgctcagggtcagcctcggcaatttcctcttcttcaccatcctcgccgtcatcatggccgggataaaggaccagaaggacccccgtgacaagatccaccacggcgggtggatggccaagatcttctgctgggccgtcatagtcttcctgatgttcttcgtgcccaacggagtcgtcagcttctatgaatctatatccaagttcggatctggcctgttccttctcgttcaggttgttctgctgttggattttgtgcatggatggaatgagaactgggtcgccaaggatgagcagttctggtacatggctctgttggttgtctcagttgtctgttacattgccacagcctctttctcgggtcttctatttcactggttcactccatctggacatgactgcggactcaacatgtttttcattgtcttcacattgattcttgtttttgcatttgctattgttgccctgcacccaaagatcaatggaagcttgttgcctgcatcggttatcggtctgtactgcacatatctgtgctacagtggactctccagtgagccaagggattatgaatgcaatgggcttcacaatcactcgaaagctgtgtcaactggtagccttacattgggactccttactacggtcctttctgtggtctactctgctgtccgtgctggctcctctgcaactgtgctctcgccaccagactcacctcgtggaaccgacaagccattgcttcccttcagcaaggcagatgaacaagaagataagaaggatgtaccaaggccggtgacatactcctactctttctttcacctcatcttctccctggccagcatgtactcggcaatgctcttgactggctggtcaacttccgttggtgagagcggaaagcttgttgatgttgggtggccatctgtctgggtcagaattgcaacccagtgggcgacggcaggtctgttcatatggtcgcttgttgcacccatcctcttccccgacagggaattctag

SEQ ID NO: 8494 - protein, 413 aa, Sorghum bicolor
  misc_feature: Ceres ANNOT ID no. 6091033
  misc_feature (8)..(413): Pfam Id: Serinc Pfam Desc: Serine incorporator (Serinc)
  misc_feature (4)..(304): NCBI GI: 123993433 NCBI Desc: serine incorporator 3 [synthetic construct]
  misc_feature (4)..(304): NCBI GI: 119596321 NCBI Desc: serine incorporator 3, isoform cra_a [homo sapiens]
  misc_feature (28)..(338): NCBI GI: 115459316 NCBI Desc: os04g0506300 [oryza sativa (japonica cultivar-group)]
  misc_feature (4)..(292): NCBI GI: 57529361 NCBI Desc: similar to tde2 protein [gallus gallus]
  misc_feature (79)..(270): NCBI GI: 28279601 NCBI Desc: tde2 protein [danio rerio]
MWAASCLASCCAACACEACRTAVGSIGRRSARIAYCGLFALSLFASWALREVAAPLLQSIPWINHFHKTPDREWFETDAVLRVSLGNFLFFTILAVIMAGIKDQKDPRDKIHHGGWMAKIFCWAVIVFLMFFVPNGVVSFYESISKFGSGLFLLVQVVLLLDFVHGWNENWVAKDEQFWYMALLVVSVVCYIATASFSGLLFHWFTPSGHDCGLNMFFIVFTLILVFAFAIVALHPKINGSLLPASVIGLYCTYLCYSGLSSEPRDYECNGLHNHSKAVSTGSLTLGLLTTVLSVVYSAVRAGSSATVLSPPDSPRGTDKPLLPFSKADEQEDKKDVPRPVTYSYSFFHLIFSLASMYSAMLLTGWSTSVGESGKLVDVGWPSVWVRIATQWATAGLFIWSLVAPILFPDREF

SEQ ID NO: 8495 - DNA, 1515 bp, Sorghum bicolor
  misc_feature: Ceres ANNOT ID no. 6091034
  misc_feature: Encodes the peptide sequence at SEQ ID NO 8496
atggcgggcgaagacgaggacgaggcggcggcgattgagcggcagctggagcagcagctgcaggagcagcggtcctcccttgccgccgtcgacgaggcactcgccgccgacccctccaacgccgacctcctcgaggttcatgaggagcttcttgctgcaattaaggatgcagaggagggtcttctccatctgaagcgctgtaggctactgaagcaagtagatgagatctttccagatgaggcatcaatatcccaatcgcctgaagttgctatcgagccattagatccagatgatgttgagccagaaccactggagccacacgatttttcagttggatcaaagtgtagattccggcacaacaatggccgctggtataatggatgcattataggctttgaaggttcaagcgatgcaaggatctcatttctgactcccacatctgaaaacatgtcgatgtgcaagttcttcctacagcagcgatgtcgatttggtagtaactgccgcatgtcccatggtgttgtaatccctactaaagccttgaagcgattcactccaactaggtgggagcagtccttggtaggctccagcatactggcatcttctggatataactctggcctttggaggagagcagagcttgagtcatgggatgataatctgaagcttggccaagttatttttcaagatgatgggagttctgcaaggctgccaagtgattctctttctgtctcagaatatgctgacatgagcgatgaagatggaggaagctcaggtgaggaagaatctgagttcagtgacgatgccgatcaagaggatggaagtgttcatcagggtcttggccttctagaattcacaaatttcagtggcattcagacagataccatgatctttgcaaaatgggagcaccacacaaggggagttgcctccaaaatgatggcaaaaatgggttaccgagaggggatggggcttggtgtgtctggccaaggcatgcttgatccgattccagttaaggtactacccccaaagcaatcacttgatcatgcacttgctgcaagcgaggctgacggaggcattggcagtgggaaaaagcgcagtaggggtgggaaaaggaagcgtgagaagaagtttgcagaacaggccagggctgctaaagctgaagaagctgagagatctgtcttcaattttatcaacagccatctagtgagccaagatgtccctgaagtttcgaccaccaaagttagaaaagggtcatcagttgagacccatggacatgctaagaaggaggacagaagatccttggttgcatacgatgaggaagtaaaggagctgaggattcgagttgagaaactggaagagatgaagaaccgtaaccgcaaagacaaggcagtctttgaagcagcctcaaggaaactggaagagactcgaaaggcactcgcggatgctgaagctacccatgcttcagcgacgaatgccgttactagaaaggagaaagagaagaaatggttgaaattctga

SEQ ID NO: 8496 - protein, 504 aa, Sorghum bicolor
  misc_feature: Ceres ANNOT ID no. 6091034
  misc_feature (304)..(348): Pfam Id: G-patch Pfam Desc: G-patch domain
  misc_feature (1)..(504): NCBI GI: 47497138 NCBI Desc: zinc finger (ccch-type) protein-like [oryza sativa (japonica cultivar-group)]
  misc_feature (14)..(504): NCBI GI: 108879913 NCBI Desc: zinc finger protein [aedes aegypti]
  misc_feature (98)..(504): NCBI GI: 62858303 NCBI Desc: zgpat [xenopus tropicalis]
  misc_feature (2)..(504): NCBI GI: 56203829 NCBI Desc: rp4-583p15.3 [homo sapiens]
  misc_feature (5)..(500): NCBI GI: 116115871 NCBI Desc: ensangp00000017646 [anopheles gambiae str. pest]
MAGEDEDEAAAIERQLEQQLQEQRSSLAAVDEALAADPSNADLLEVHEELLAAIKDAEEGLLHLKRCRLLKQVDEIFPDEASISQSPEVAIEPLDPDDVEPEPLEPHDFSVGSKCRFRHNNGRWYNGCIIGFEGSSDARISFLTPTSENMSMCKFFLQQRCRFGSNCRMSHGVVIPTKALKRFTPTRWEQSLVGSSILASSGYNSGLWRRAELESWDDNLKLGQVIFQDDGSSARLPSDSLSVSEYADMSDEDGGSSGEEESEFSDDADQEDGSVHQGLGLLEFTNFSGIQTDTMIFAKWEHHTRGVASKMMAKMGYREGMGLGVSGQGMLDPIPVKVLPPKQSLDHALAASEADGGIGSGKKRSRGGKRKREKKFAEQARAAKAEEAERSVFNFINSHLVSQDVPEVSTTKVRKGSSVETHGHAKKEDRRSLVAYDEEVKELRIRVEKLEEMKNRNRKDKAVFEAASRKLEETRKALADAEATHASATNAVTRKEKEKKWLKF

SEQ ID NO: 8497 - DNA, 2364 bp, Sorghum bicolor
  misc_feature: Ceres ANNOT ID no. 6091035
  misc_feature: Encodes the peptide sequence at SEQ ID NO 8498
atggccgccgcaccagaggagcacctcgacgtcctcaacgccgccggggagaagaccggcgtctccaagcccaggtcggaggtgcacagggacggcgactaccaccgggcggtgcacgtgtggatctacagcgagagcaccggggagctgctgctgcagcgccgcgctgactgcaaggactcgtggcctgggcagtgggacatctctagcgccggtcacatctccgccggcgactcctcgctcttctcggcacagagggagcttgaggaagaactaggcatcaaccttccagtcgatgcttttgagctcctatttgtatttcttcaggaatgcgttatcaacaatgggacatacacaaacaatgagtacaatgatgtttaccttgtgactaccttaactccaattccacttgaggccttcactctccaagaaagtgaagtgtctgcagttaggtatatgcgttgtgatgagtacaagagctgccttgcaaaagaaagtggagaatttgttccttatgatgtgaacgggcaatacggtcagctatttagcattattgaagaaaggtacaaagaaaatacagagtcccgctgtttaactttacaaaagcaaatgaaccgttatgctcccatccatttggaaccagatttgactagtctctctgaaggagacagggaagccttgggatatattcttgaagcagcaatagttattgatgacatattctatgaacaagtatggaatagtaacaaaatgcttcgagactggctgaaagcacattctgaatcctcatcattcgataaattgaagtgggcgtatcattccattaataagagtccctggtcctgccttgacgagaataaggcttttctatcgactgcagattctgctgtgaaattactcacagatgccacgaagccagtttcaggatggaaggggattgagtatcgagcagcatttcctctagagaagccacctggtgctaacttctatcctcctgatatggacaaagcggagtttgaactttggaagagtagtctgactgataaagaacaaaaagatgccactgggtttttcaccgtcataaaacggcatgactctctgtcctcttcatcattaacacaattggatggatcagaccagaccaagactaaagatgatctttttattgttccatactccaaggagtatagaccagcccttgagaaagcagctgagcttcttgagaaagcatcagcatgctctgattctccaagcctcaagaatttgctgagaaccaaggcgaatgctttcctttcaaatgattactatgaatccgatatagcttggatggagttggactccaacttagatctcacaattggcccatatgaaacatatgaagatggcctttttagttataaggcaacttttgaagcatttgtcggaatacgtgatgacacagcaacttctcaagttaaactctttggtgatcaactccaggatttggagaaaaatcttccaatggacaatattttcaaatcagacagtatatctgctgctccgattcgtgtgatcaatcttctctacaattctggggtatgcttcatgctactaacagaactgctgctgcaggatgtgaaaggtccacaaaccattgctttcaatttgcccaatgatgaacggattgtgaatgaacgaggaacttgcatggttatgcttaaaaacatttcagaagccaagttcaagcatatcttaaagcctatagctgatgcctgcatcagagaggaacagaaggaatatgttgatttcgagccatattatacgcatatagtctgtcatgaatgctgccatggaattggaccccattctatcacccttccaagtggtaaaaagtcaacagttagaagggaacttcaagaattctattcagcgttggaggaggcaaaagctgatatagttggtctctgggcactgaatttccttattaagaagggattgcttcctaagagcctgtcacaatctatgtatgtctctttcctggctagctgcttccggtcaatccgctttggactggaagaagctcatggaaaaggacaagctctgcagtttaactggttgtatgaaaaaggggctcttgtcttgcactctgacggaaaattctcagttgactttacaaaggttgaggaagctgtagaaagcctgagcagggagatactgacaatacaggcaaagggtgataagccttctgcccagtctcttctccagtcccgtgcgaccttgacacaaccattgagagtggcattggagaagatagaacacatgcaggtacctgttgacattgccccgatattcggcacggcaaacaagctacttgcaaacgtttag

SEQ ID NO: 8498 - protein, 787 aa, Sorghum bicolor
  misc_feature: Ceres ANNOT ID no. 6091035
  misc_feature (34)..(176): Pfam Id: NUDIX Pfam Desc: NUDIX domain
  misc_feature (1)..(786): NCBI GI: 47497142 NCBI Desc: mutt/nudix protein-like [oryza sativa (japonica cultivar-group)]
  misc_feature (216)..(784): NCBI GI: 7715590 NCBI Desc: f20b17.11 [arabidopsis thaliana]
  misc_feature (387)..(783): NCBI GI: 94553302 NCBI Desc: mutt/nudix family protein [acidobacteria bacterium ellin345]
  misc_feature (443)..(784): NCBI GI: 15912329 NCBI Desc: at1g79690/f20b17_11 [arabidopsis thaliana]
  misc_feature (384)..(775): NCBI GI: 116223821 NCBI Desc: mutt/nudix family protein [solibacter usitatus ellin6076]
MAAAPEEHLDVLNAAGEKTGVSKPRSEVHRDGDYHRAVHVWIYSESTGELLLQRRADCKDSWPGQWDISSAGHISAGDSSLFSAQRELEEELGINLPVDAFELLFVFLQECVINNGTYTNNEYNDVYLVTTLTPIPLEAFTLQESEVSAVRYMRCDEYKSCLAKESGEFVPYDVNGQYGQLFSIIEERYKENTESRCLTLQKQMNRYAPIHLEPDLTSLSEGDREALGYILEAAIVIDDIFYEQVWNSNKMLRDWLKAHSESSSFDKLKWAYHSINKSPWSCLDENKAFLSTADSAVKLLTDATKPVSGWKGIEYRAAFPLEKPPGANFYPPDMDKAEFELWKSSLTDKEQKDATGFFTVIKRHDSLSSSSLTQLDGSDQTKTKDDLFIVPYSKEYRPALEKAAELLEKASACSDSPSLKNLLRTKANAFLSNDYYESDIAWMELDSNLDLTIGPYETYEDGLFSYKATFEAFVGIRDDTATSQVKLFGDQLQDLEKNLPMDNIFKSDSISAAPIRVINLLYNSGVCFMLLTELLLQDVKGPQTIAFNLPNDERIVNERGTCMVMLKNISEAKFKHILKPIADACIREEQKEYVDFEPYYTHIVCHECCHGIGPHSITLPSGKKSTVRRELQEFYSALEEAKADIVGLWALNFLIKKGLLPKSLSQSMYVSFLASCFRSIRFGLEEAHGKGQALQFNWLYEKGALVLHSDGKFSVDFTKVEEAVESLSREILTIQAKGDKPSAQSLLQSRATLTQPLRVALEKIEHMQVPVDIAPIFGTANKLLANV

SEQ ID NO: 8499 - DNA, 5316 bp, Sorghum bicolor
  misc_feature: Ceres ANNOT ID no. 6091037
  misc_feature: Encodes the peptide sequence at SEQ ID NO 8500
  misc_feature: Down-regulated in shoot tissues in response to salicylic acid treatment
atggcgcccaaggcagggaaggccaagctcaaggccaagggagacaagaagaagaaggaagagaaagtgctgcccaccgtgctggacgtcaccgttgagacgccggactacacgcatctcacgctcaagggcatatcgacggacaggatcctcgacgtccggaagctcctggccgtccacgtggacacctgccacctcaccagctactccctgtcccacgaggtccgtggggcccagctcaaggacacggtggagatcgcctccctcaagccatgccacctcagcatcgtcgaagaggactacacggaggagctcgccgtcgcgcacgtgcggcggctgctcgacatcgtcgcctgcaccaccgcgttcggggccaagaagaccgagccgaagccctcgtcacccgatgcggccgcggccgcggccgagtccgctaaaaccgggtcgcccggtaagacggcgcccggcggcggtgaggagcccatgtacccgccaccgaagctggagcagttttacgatttcttcacgttctcgcacctcacaccgccgctgcattacattaggaggtcgtctcgcccatttgttgatgacaagagagaagacgacttcttccagatcgatgtgagagtttgtaatgggaaaccagtgaccattgtggcatcccaagaaggattctatcctgcagggaagcgtgcactcatcagccgctcccttgttggactgttgcagcagacaagccgtgcatttgatggagcctacaagtctctgatgaaggcatttgtcgagcacaacaagtttggaaatcttccttatggattccgatcaaacacatgggtagttccccctgttgttgccgattcaccatcagtgttcccacctctcccaactgaagatgaaacctggggtggcagtggtggtggtcaaggaagagatggaaagcacgatcatagaccatgggtgaaagaattttccatccttgctgcaatgccttgcaaaacagctgaggagaggcaagtcagagatagaaaggctttcctactccacagtttatttgtggatgttgcagtcctcaaagctgttgcatctattcagcaactgatttccaaccatgcgagtttacatgaaacaacaaatggcaccatcggttctgttttgcacaccgagcaagtaggtgatatgaaaataatgatcacaaaggacaaaacagatgcaagctccaagctagatgttaaattggatggaagtcaggctccagggatgtcttctgatgagcttgctcagagaaacttgttgaaaggcatcactgctgatgagagtgcaatagtacatgacacagccactcttggtgtggttattgtaaagcattgtgggtatacagctgttgtccaagttccagtaaatactgaactgacaacttctgtcgcacaacaggagatccacattgaagaccagcctgaaggaggtagcaatgctcttaatgtcaatagcttaaggatgctgcttcataaatcatgtgctcaagtacctggagttcaacggttgcagaccagtgatcctcaagacaatgcgactactcaaacttttgtccggaagatattgacggacagcctgcagaagcttgaaagtgaggctccgatagtaacaagacctatcagatgggaacttggtgcttgttgggtacaacatctacagaacccaacttccgaaaagacagagactaagaaaagtgacgagactaaggatgtccctacagtaaagggtctgggtaaacaatttggtcagttaaaggagataaaaaagaagacagatgacaagggtggaaaaaatacatatgtaaaagaaaacacttcacctaatacagataatgggcatacagacaacactgccaacataaaggatgataaggatgttgttcttcagaaactgcttccagaagcagctttccaaaggctgaaggaatcagaaactggacttcatgctaagtcactggatgaactgattgagatgtcacacaagtattatgatgataccgcgctgcccaaattggtcgcagattttggctcacttgagctttcccctgttgatggaaggacattaacagactttatgcacactaggggcctccagatgcggtcactgggacgagtggttgagctttctgataagcttccacatatacagtccctgtgtatacatgagatggtagttcgagcatttaagcacattgttcgggctgttattgcagctgttgatgatgtaaatgacatggcagactcggttgcatcatgtttaaatattttgctgggaccattcctggaggaaaataatgacggtgattgtggtgaggatcataatctcaggaaaaggtggctggaggtctttttgataaagagatttggttggaagtggaaagatgaatattgtcttgatctaagaaaatatgccattctccgtggtctctgccataaggtaggacttgagttagtaacaaaagattatgacatggatatgccacatccattcagaaagtcggatattatcagtgttgttcctatctacaagcatgttgcatgctcatcagctgatggccgcaccctgctggagtcatccaagactttcctggataaagggaaacttgaggatgctgttaactatggcacaaaggctcttgcaaaacttgttgctgtttgtggtccttatcatagaatgacggcaggagcgtacagccttcttgcagtagtgctttatcatactggggatttcaaccaggcaaccatctatcagcagaaggctttagatattaatgagagggaacttggacttgaccatccagatacaatgaaaagctacggagatcttgctgttttctactatcgtctgcaacatacagaactggcattaaagtatgtcaaccgtgccctatatcttttgcaccttacatgtggcccttctcatcctaacaccgctgcaacttatatcaatgttgcaatgatggaagaagggttgggcaatgtccatgttgcactccgttacctgcacgaagctctaaaatgtaaccaacggttgcttggcgctgatcacatacagacggcagcaagttatcatgctattgctattgctttgtctttaatggaagcatactcattgagtgtccaacatgaaaagactactctacggatacttcaagcaaagcttggatcagaggatcttcggacccaggatgcttctgcttggctggaatactttgaatccaaggcactagagcagcaggaagcagcacgtaatggtactccaaagcctgatgcttcaatagcaagcagaggacatctgagtgtatcagatcttttggattatatcaacccggatgatgaactcaaggctaaggaaatgcaaaggaaacaagcccgtgctaagatcaaaggtcgcattgggcaaaaccactctgaacttgttgatgatgaagatcgaaggagccccccacctaaaaatgataatttgttaaccgagaatgaaaactctggagtaaaagagaatggaacctttgttgagtatgtgaaagtgaatgataaaatatcaagtgacactgcaatccgcatacctcaagatgattttactgaagagtacacatctgatgaggggtggcaagcggctgttccaaagggacgatccactggaagccgcagaactggtgcaggcacgaggaggccaaatctggcaaaaattaatactaattcactacacagtgagaatggaagatacaaaggaagaggtacatccaacttctcttcccctcgagtttcacctagtgaggctacagttcctatgggttctagtcctcttgcgaagaaattagcgaagagttcaagcttcaattccaaagcaggtagcccttctgtctcatcgaacagtggtgataattcttccaatcccaactccaagccagcaagccctgccattgccacagctgctgtcaaggtgataccatccacagcaccaagtgccagtcaaacagtaaggaagtcactttcatacaaggaggtagcaatagctgcaccagggactcttgtcaaagcatttagtgatgtacacacagaagaaaaagatgcaggtggccgaggtgcaagtcctgaaagtgccaagtcccaaaaagaaatcaatggtcacccttctggagagaaagatggggcaatagaagtgtcaccaaaggctgatacttcacaagtgactaaatcatctgatggaggtaaaccagagcaaactgatgttttgattggttcaaatcaaccagaaacaggacataaaaagacctcagatccagcagagacatctgtagcacagaagtacacagatcttcctgccccagtcacatcatctgcagcacaaactgaggaggttggcaccccaaatgaggaagcaccaactgtaattgaggcaaatgattcttcctccaatgacgatgaaagagattcaggagaggatacaccaggacagctgtcgagtggaggtgaaaatgagaaatcttcactatctgagagtgaaaagaatgatacaccaagagaaggtgctaaagagacaagtaaactttctgctgctgcggttccattcaatccatccactgtaccagcttttggttcaatggctgtcccaggtttcagagaacatggagggctgttgccatcaccagctaatgtgccccctatgttgtccatccctctacgtaagcaccctcaccaatctgcaactgcaagggtaccttatggtccacgtctggctggaggctacaatagatcagggcaccgaggacttcgtaagaagcctgtgttgacaagtggtgaagcccctacagaaacaaacacgtctgcccccaaggttatgaaccctaatgccccggagtttgttccaggtcaatctcggagtcctaatggtcatccagcatctccaaatggtcctttatcatcaccaggtggtattccatcttcaccacaagaccttctatcatctccagatagtactgtggagtcaccagtaactccatccccacaagtttctgaatgtagccagattagtcctgaaggaaatgatgcatctagtggaataaatgttgagggtgggggtgtaaagcagaacgtggatgacacgaaccacacaaaaagtaaagatggtgaagtggagcctgatcaaaccaaagctcctgaagttacagaagaaggggcggcggtaaaagatgctactgaagagtcgattgcagccgagcagcccaaatcctgggctgactacagcgatggagaggctgaggtcgttgaggttgcaagctaa

SEQ ID NO: 8500 - protein, 1771 aa, Sorghum bicolor
  misc_feature: Ceres ANNOT ID no. 6091037
  misc_feature (905)..(938): Pfam Id: TPR_2 Pfam Desc: Tetratricopeptide repeat
  misc_feature (125)..(1429): NCBI GI: 38344005 NCBI Desc: osjnba0070o11.2 [oryza sativa (japonica cultivar-group)]
  misc_feature (125)..(1155): NCBI GI: 115460926 NCBI Desc: os04g0645100 [oryza sativa (japonica cultivar-group)]
  misc_feature (143)..(1556): NCBI GI: 5103827 NCBI Desc: ests gbf20110 and gbf20109 come from this gene. [arabidopsis thaliana]
  misc_feature (405)..(1531): NCBI GI: 92874825 NCBI Desc: tpr repeat [medicago truncatula]
  misc_feature (124)..(1722): NCBI GI: 42561588 NCBI Desc: tetratricopeptide repeat (tpr)-containing protein [arabidopsis thaliana]
  misc_feature: Down-regulated in shoot tissues in response to salicylic acid treatment
MAPKAGKAKLKAKGDKKKKEEKVLPTVLDVTVETPDYTHLTLKGISTDRILDVRKLLAVHVDTCHLTSYSLSHEVRGAQLKDTVEIASLKPCHLSIVEEDYTEELAVAHVRRLLDIVACTTAFGAKKTEPKPSSPDAAAAAAESAKTGSPGKTAPGGGEEPMYPPPKLEQFYDFFTFSHLTPPLHYIRRSSRPFVDDKREDDFFQIDVRVCNGKPVTIVASQEGFYPAGKRALISRSLVGLLQQTSRAFDGAYKSLMKAFVEHNKFGNLPYGFRSNTWVVPPVVADSPSVFPPLPTEDETWGGSGGGQGRDGKHDHRPWVKEFSILAAMPCKTAEERQVRDRKAFLLHSLFVDVAVLKAVASIQQLISNHASLHETTNGTIGSVLHTEQVGDMKIMITKDKTDASSKLDVKLDGSQAPGMSSDELAQRNLLKGITADESAIVHDTATLGVVIVKHCGYTAVVQVPVNTELTTSVAQQEIHIEDQPEGGSNALNVNSLRMLLHKSCAQVPGVQRLQTSDPQDNATTQTFVRKILTDSLQKLESEAPIVTRPIRWELGACWVQHLQNPTSEKTETKKSDETKDVPTVKGLGKQFGQLKEIKKKTDDKGGKNTYVKENTSPNTDNGHTDNTANIKDDKDVVLQKLLPEAAFQRLKESETGLHAKSLDELIEMSHKYYDDTALPKLVADFGSLELSPVDGRTLTDFMHTRGLQMRSLGRVVELSDKLPHIQSLCIHEMVVRAFKHIVRAVIAAVDDVNDMADSVASCLNILLGPFLEENNDGDCGEDHNLRKRWLEVFLIKRFGWKWKDEYCLDLRKYAILRGLCHKVGLELVTKDYDMDMPHPFRKSDIISVVPIYKHVACSSADGRTLLESSKTFLDKGKLEDAVNYGTKALAKLVAVCGPYHRMTAGAYSLLAVVLYHTGDFNQATIYQQKALDINERELGLDHPDTMKSYGDLAVFYYRLQHTELALKYVNRALYLLHLTCGPSHPNTAATYINVAMMEEGLGNVHVALRYLHEALKCNQRLLGADHIQTAASYHAIAIALSLMEAYSLSVQHEKTTLRILQAKLGSEDLRTQDASAWLEYFESKALEQQEAARNGTPKPDASIASRGHLSVSDLLDYINPDDELKAKEMQRKQARAKIKGRIGQNHSELVDDEDRRSPPPKNDNLLTENENSGVKENGTFVEYVKVNDKISSDTAIRIPQDDFTEEYTSDEGWQAAVPKGRSTGSRRTGAGTRRPNLAKINTNSLHSENGRYKGRGTSNFSSPRVSPSEATVPMGSSPLAKKLAKSSSFNSKAGSPSVSSNSGDNSSNPNSKPASPAIATAAVKVIPSTAPSASQTVRKSLSYKEVAIAAPGTLVKAFSDVHTEEKDAGGRGASPESAKSQKEINGHPSGEKDGAIEVSPKADTSQVTKSSDGGKPEQTDVLIGSNQPETGHKKTSDPAETSVAQKYTDLPAPVTSSAAQTEEVGTPNEEAPTVIEANDSSSNDDERDSGEDTPGQLSSGGENEKSSLSESEKNDTPREGAKETSKLSAAAVPFNPSTVPAFGSMAVPGFREHGGLLPSPANVPPMLSIPLRKHPHQSATARVPYGPRLAGGYNRSGHRGLRKKPVLTSGEAPTETNTSAPKVMNPNAPEFVPGQSRSPNGHPASPNGPLSSPGGIPSSPQDLLSSPDSTVESPVTPSPQVSECSQISPEGNDASSGINVEGGGVKQNVDDTNHTKSKDGEVEPDQTKAPEVTEEGAAVKDATEESIAAEQPKSWADYSDGEAEVVEVAS

SEQ ID NO: 8501 - DNA, 945 bp, Sorghum bicolor
  misc_feature: Ceres ANNOT ID no. 6091053
  misc_feature: Encodes the peptide sequence at SEQ ID NO 8502
  misc_feature: Down-regulated in shoot tissues in response to methyl jasmonate treatment
atggtcggcgtcgccgcaggcttcgccctcgcgccggctgtgtcccgcgtgccttgccgtcccggcgctgccttccacgccccgggcccctcctcgtcggcgcggttcccggcgaggccgtgggcgcgggcgccgccggcgaggctcgtggtggtcgcgcggtactcgccctcgtatgagggcgaggaggaggaggaggaggatgaggaaggcctcggcggcggcgggggctgggggagaagggaccgcgggcccgaccctgactacgaccccgcccttgacattgaacgcatcgagtcatcgactgtaaggctcttggatgaacagaaaagaatggttggtgtagtatctgtaagtgaggcagttaaaattgcagacgataacgatcttatactggcaatattatcattagatggagatcccccagtacttcgactctttgaggagagagattacaaaaaacataggtatgaacaacagaagaagaaaaagattcagcagaagagatctgtcgcgaaacgcatgggcttgaaggagttgaaaatgggatacaacattgacatccatgattacagcgtgaggcttaaagctgcaaaaaagtttcttaaagctggagacaaggttaagataattgtgaacttgaaaggacgggaaaacttgtataaaaaagaagctatcgaacttcttagaagattccaaaatgatgttggtgagctagcgacagaagaaagtaaaaatttcgcggagaggaatatatatttggttctagttcccaataagatagctatacagaaagaacaggatgaattgaacaaaaagggtaccgtgaaagaagagagagaccaatcagacagtgatgaaccagaagaggacagtgatgaacctctgacacaactgctggaggaaagtatggagcctgaggcagaagtctcagcaaatgtttga

SEQ ID NO: 8502 - protein, 314 aa, Sorghum bicolor
  misc_feature: Ceres ANNOT ID no. 6091053
  misc_feature (174)..(260): Pfam Id: IF3_C Pfam Desc: Translation initiation factor IF-3, C-terminal domain
  misc_feature (96)..(168): Pfam Id: IF3_N Pfam Desc: Translation initiation factor IF-3, N-terminal domain
  misc_feature (112)..(314): NCBI GI: 47497598 NCBI Desc: translation initiation factor if-3-like [oryza sativa (japonica cultivar-group)]
  misc_feature (73)..(275): NCBI GI: 92868854 NCBI Desc: initiation factor 3 [medicago truncatula]
  misc_feature (62)..(309): NCBI GI: 547710 NCBI Desc: translation initiation factor if-3, chloroplast precursor (if-3chl)
  misc_feature (83)..(261): NCBI GI: 16329482 NCBI Desc: initiation factor if-3 [synechocystis sp. pcc 6803]
  misc_feature (83)..(272): NCBI GI: 72383053 NCBI Desc: initiation factor 3 [prochlorococcus marinus str. natl2a]
  misc_feature: Down-regulated in shoot tissues in response to methyl jasmonate treatment
MVGVAAGFALAPAVSRVPCRPGAAFHAPGPSSSARFPARPWARAPPARLVVVARYSPSYEGEEEEEEDEEGLGGGGGWGRRDRGPDPDYDPALDIERIESSTVRLLDEQKRMVGVVSVSEAVKIADDNDLILAILSLDGDPPVLRLFEERDYKKHRYEQQKKKKIQQKRSVAKRMGLKELKMGYNIDIHDYSVRLKAAKKFLKAGDKVKIIVNLKGRENLYKKEAIELLRRFQNDVGELATEESKNFAERNIYLVLVPNKIAIQKEQDELNKKGTVKEERDQSDSDEPEEDSDEPLTQLLEESMEPEAEVSANV

SEQ ID NO: 8503 - DNA, 1407 bp, Sorghum bicolor
  misc_feature: Ceres ANNOT ID no. 6091059
  misc_feature: Encodes the peptide sequence at SEQ ID NO 8504
atggcgcctacaccacttcttcaccccgtgactgtactggacaagtttcaggtcacgccgtcgccggcaccggcggcggggctgccacgggcgttgccgctcaccttcttcgacctcgtcttctgggccattccgcccgtgcagcgtctcttcttctacgacaacgccgacctcctcggtgtctccgacttcactctcggcgagctgccacggtttaggaactccctcgccgccgcgctgcaccacttctatccgttggcggggaagctgacgtgcgagttggtcgacgagggcatggcgccgccggaggtcgtgttctccgacggcgactccgtcccgctgatcgtggccgtcagtggcgacgacttccgagacctcgccggcgaccacgcccgcgacaccacgaggatacgtccgctgctccccgcgctgccgaagcacggcgcgtctcggtcgcatcagggagtcctcgccgtccagattacggtgttcccgcgcgccggcatttgcatcggcacgacggtgcaccacgccgttgccgacggctccagctacgcgcacttcctcagcacgtgggctgccgcccaccgcctcggccccgagtacaacagcgcggtggcgatggacgtgcccccgctgttcgaccgcggcgtcgtgcgtgacggcgccgggctccgtgaggcgttcctgcgcgaccaccgagggctcggtacagccggcggcgacgatcgcctcgacgactgggacctcagtcgccgccctggcgtcgtgctcgccacgttccggttcaccgagaagcacctccgcgcgctcgggaggcgcgtcgagtcggagacctcggcgcggtgctcaccctacgcgctggcctgcggcgctgcgtgggccggcatcgtacacgcccgcggcagcggcatggacggagctcctgcacccgacgcgcacttcgggttcgtgacggggtgcaagccccgtgcgagcccgccggtaccggcgaactacttcggcaactgcctcggtctgtgccgcgtccaagcaaagcggggccaactcaccgcggcggccgcctcggctgccatatggcgcgcgatcgaggggctggccgaggcagggagcgtgttccggggatctcgggggtgggtgcgctgggtgcaggagtacgcatcggcgcgggcggtgaccgtggccgggtcgccgaagctgggcgtgtacgcggccgcggatttcggcggggcgtggggcaggccgaggaaggtggagatcgcatccgtggaacgcacgggcgcgctggcgctggcggagagcggccgcgacggggacggcggcatcgaggtcgggctggcgctgccgcgcgctgagatggaggcgttccgtaagttttacgtcgacgtgttggccagcctcggttga

SEQ ID NO: 8504 - protein, 468 aa, Sorghum bicolor
  misc_feature: Ceres ANNOT ID no. 6091059
  misc_feature (8)..(463): Pfam Id: Transferase Pfam Desc: Transferase family
  misc_feature (5)..(467): NCBI GI: 34394044 NCBI Desc: anthocyanin 5-aromatic acyltransferase-like protein [oryza sativa (japonica cultivar-group)]
  misc_feature (18)..(467): NCBI GI: 38346915 NCBI Desc: osjnbb0015n08.15 [oryza sativa (japonica cultivar-group)]
  misc_feature (7)..(464): NCBI GI: 133874170 NCBI Desc: hydroxycinnamoyl-coa:anthocyanin 5-glucoside-6'''-o-hydroxycinnamoyltransferase [eustoma grandiflorum]
  misc_feature (1)..(467): NCBI GI: 92891633 NCBI Desc: anthocyanin acyltransferase [medicago truncatula]
  misc_feature (1)..(456): NCBI GI: 45790002 NCBI Desc: quercetin 3-o-glucoside-6''-o-malonyltransferase [verbena x hybrida]
MAPTPLLHPVTVLDKFQVTPSPAPAAGLPRALPLTFFDLVFWAIPPVQRLFFYDNADLLGVSDFTLGELPRFRNSLAAALHHFYPLAGKLTCELVDEGMAPPEVVFSDGDSVPLIVAVSGDDFRDLAGDHARDTTRIRPLLPALPKHGASRSHQGVLAVQITVFPRAGICIGTTVHHAVADGSSYAHFLSTWAAAHRLGPEYNSAVAMDVPPLFDRGVVRDGAGLREAFLRDHRGLGTAGGDDRLDDWDLSRRPGVVLATFRFTEKHLRALGRRVESETSARCSPYALACGAAWAGIVHARGSGMDGAPAPDAHFGFVTGCKPRASPPVPANYFGNCLGLCRVQAKRGQLTAAAASAAIWRAIEGLAEAGSVFRGSRGWVRWVQEYASARAVTVAGSPKLGVYAAADFGGAWGRPRKVEIASVERTGALALAESGRDGDGGIEVGLALPRAEMEAFRKFYVDVLASLG

SEQ ID NO: 8505 - DNA, 255 bp, Sorghum bicolor
  misc_feature: Ceres ANNOT ID no. 6091064
  misc_feature: Encodes the peptide sequence at SEQ ID NO 8506
atgggcagcgctgaagtcccactgcctgtggccgtgccgtcacctgaaatcccagctatgagcggagggtcagccaccgtcaccgccgctgcagctcctgctaccgaatcgaagccgaaaaagaagatatgctgcgcgtgccctgatacaaagaggctgagagatgagtgcgtcgtcgagcatggtgaacctgcttgcaccaagtggatcgaagctcacaagcgatgcctccgtgctgaggggtttaatgtctga

SEQ ID NO: 8506 - protein, 84 aa, Sorghum bicolor
  misc_feature: Ceres ANNOT ID no. 6091064
  misc_feature (21)..(84): Pfam Id: COX17 Pfam Desc: Cytochrome C oxidase copper chaperone (COX17)
  misc_feature (19)..(84): NCBI GI: 50725970 NCBI Desc: copper chaperone cox17-1-like protein [oryza sativa (japonica cultivar-group)]
  misc_feature (34)..(84): NCBI GI: 14794886 NCBI Desc: copper chaperone cox17-2 [arabidopsis thaliana]
  misc_feature (34)..(84): NCBI GI: 88010824 NCBI Desc: at1g53030 [arabidopsis thaliana]
  misc_feature (3)..(84): NCBI GI: 24642093 NCBI Desc: cg9065-pa [drosophila melanogaster]
  misc_feature (24)..(84): NCBI GI: 116117222 NCBI Desc: ensangp00000025461 [anopheles gambiae str. pest]
  misc_feature: Useful for making plants with modulated drought sensitivity
  misc_feature: Functional homolog of the protein sequence given in SEQ ID NO 13423
  misc_feature: Useful for making plants with modulated water use efficiency
  misc_feature: Functional homolog of the protein sequence given in SEQ ID NO 13907
  misc_feature: Useful for making plants with modulated drought sensitivity
  misc_feature: Functional homolog of the protein sequence given in SEQ ID NO 13423
MGSAEVPLPVAVPSPEIPAMSGGSATVTAAAAPATESKPKKKICCACPDTKRLRDECVVEHGEPACTKWIEAHKRCLRAEGFNV

SEQ ID NO: 8507 - DNA, 1041 bp, Sorghum bicolor
  misc_feature: Ceres ANNOT ID no. 6091076
  misc_feature: Encodes the peptide sequence at SEQ ID NO 8508
atggcgatccacaagcttgcacggacactggcgatcttgtgcctcgccgtcctgctgcttctcctgccgtgcgcggctcgccccatctccgaaacgagcaccatcgacggcagccggagcaagcacctgccacttcgtggatcgatgctgcgcggcccggagagcgtcgccttcgacggcgcgggcgccggcccttacagcggcgtctccgacggccgcgtcctcaagtggaacgggttcgcccgcggctggtcgacatacgcgtacagcccgggctacgacgccgaggcctgcaccgcgtccagggctcggccggcggagctcaccgagagcaagtgcggccgcccgctgggcctgcggttccatcgccggtcgggcaacctttacatcgcggacgcgtacaaggggctgatgcgcgtcggcccgggcggcggcgaggcgacggtgcttgccgcggaggtcgacggcgtgccgctccgcttcaccaatggcgtcgatgtggaccaggtcaccggggacgtgttcttcactgacagcagcatgaactacccgcggtcgcagcacgagagggtgacggccaccggcgactcgtccggccgcctcatgaagtacgaccccaggacgggacaagtcaccgtgctgcaggccggcatcacgtaccccaatggcctcgccattagcgccgacaggacacacctcgtggtggcgctcactgggccgtgcaagctgatgagatattggatcaagggtcccaaggcgggcacgtctgagcacctcgccgacttgccaggctaccctgacaatgtgagggccgacggcagaggcgggttttgggtggcgctgcacagggagaagatggagctgccctttggtccggacagccacctgctcgcggtcagggtcggagccgacggacaggtggtccaggtgatgagagggcccaagagcgtgaggccgacggaggtggtggagagggaaggcggcaagctatacatgggctcggtagaactaccatatgtcgccgttgttagggaatactag

SEQ ID NO: 8508 - protein, 346 aa, Sorghum bicolor
  misc_feature: Ceres ANNOT ID no. 6091076
  misc_feature (163)..(251): Pfam Id: Str_synth Pfam Desc: Strictosidine synthase
  misc_feature (45)..(336): Pfam Id: SGL Pfam Desc: SMP-30/Gluconolaconase/LRE-like region
  misc_feature (17)..(344): NCBI GI: 115478879 NCBI Desc: os09g0374900 [oryza sativa (japonica cultivar-group)]
  misc_feature (22)..(282): NCBI GI: 115455371 NCBI Desc: os03g0750700 [oryza sativa (japonica cultivar-group)]
  misc_feature (48)..(282): NCBI GI: 140040327 NCBI Desc: strictosidine synthase [medicago truncatula]
  misc_feature (35)..(285): NCBI GI: 30694556 NCBI Desc: strictosidine synthase family protein [arabidopsis thaliana]
  misc_feature (52)..(281): NCBI GI: 14028757 NCBI Desc: male fertility protein [zea mays]
MAIHKLARTLAILCLAVLLLLLPCAARPISETSTIDGSRSKHLPLRGSMLRGPESVAFDGAGAGPYSGVSDGRVLKWNGFARGWSTYAYSPGYDAEACTASRARPAELTESKCGRPLGLRFHRRSGNLYIADAYKGLMRVGPGGGEATVLAAEVDGVPLRFTNGVDVDQVTGDVFFTDSSMNYPRSQHERVTATGDSSGRLMKYDPRTGQVTVLQAGITYPNGLAISADRTHLVVALTGPCKLMRYWIKGPKAGTSEHLADLPGYPDNVRADGRGGFWVALHREKMELPFGPDSHLLAVRVGADGQVVQVMRGPKSVRPTEVVEREGGKLYMGSVELPYVAVVREY

SEQ ID NO: 8509 - DNA, 1263 bp, Sorghum bicolor
  misc_feature: Ceres ANNOT ID no. 6091080
  misc_feature: Encodes the peptide sequence at SEQ ID NO 8510
atggcggcgacggaggggcagtggctgctcatggcaacggggcggacgccgaccaacattgcggtgatcaagtactgggggaagcgggacgaggcgctcatcctccccgtcaacgacagcatcagcgtcacgctcgaccctgaccacctctccgccaccaccaccgtcgccgtcagcccctcattcccctccgaccgcatgtggctcaacggcaaggagatctcgctgttaggaggaaggtttcagagctgcctcagagagatcagaaagcgtgctcgtgacttcgaggatgaggagaagggcgtcaagatcaagaaagaggactgggggaagttgcatgttcacatagcctcgtacaacaacttccccactgctgctggtttggcctcttcggctgctggccttgcttgtttcgttttcacccttggaaagctgatgaatgtgaaagaagattatggagaactttcttcaatagcaaggcagggatctgggagtgcatgccgcagtatatatggtggttttgtgaaatggtgtatgggagaaaaagatgatggaagcgacagtattgccgtgcagcttgctgatgaaacacattggaacgatcttgtaattattattgcagtggtcagttcaaagcagaaagaaaccagtagcaccagtgggatgcgagatagtgttgaaacaagtcccctcttgcagtacagggcccagacagtagtgccaagtcgggtgttgaaaatggaagaggctatcaagaatcgtgactttgaatcatttgccaaattaacttgtgcagatagcaaccagtttcatgctgtatgcttagacacgagccctcccatcttctacatgaatgacacgtcacaccggataattagtcttgtggaaaaatggaaccactcagaaggaacaccacaggttgcttacaccttcgatgctgggcctaacgcagtcctaattgcacaaaaccgtaaaactgcagcacatcttctccagaagctcttatactatttccccccacaggataaggatttgagcagctatttggttggcgataaatcaattctaggtgatgctggagtgcattccatggaagatgtggaagctcttccaccacctccagagatgaaggtaccggatctgaaattcaagggtgatgttagctacttcatctgcagcaggcttggggctggtccaaaggtcattgccgacgaaagtcaagcattgatcgattcagtcaccggacttccaaaaggggtgtaa

SEQ ID NO: 8510 - protein, 420 aa, Sorghum bicolor
  misc_feature: Ceres ANNOT ID no. 6091080
  misc_feature (115)..(173): Pfam Id: GHMP_kinases_N Pfam Desc: GHMP kinases N terminal domain
  misc_feature (247)..(340): Pfam Id: GHMP_kinases_C Pfam Desc: GHMP kinases C terminal
  misc_feature (2)..(353): NCBI GI: 115443725 NCBI Desc: os02g0109100 [oryza sativa (japonica cultivar-group)]
  misc_feature (5)..(418): NCBI GI: 118763544 NCBI Desc: mevalonate disphosphate decarboxylase [arnebia euchroma]
  misc_feature (8)..(418): NCBI GI: 16417950 NCBI Desc: mevalonate disphosphate decarboxylase [hevea brasiliensis]
  misc_feature (3)..(418): NCBI GI: 21593243 NCBI Desc: diphosphomevalonate decarboxylase-like protein [arabidopsis thaliana]
  misc_feature (3)..(418): NCBI GI: 6822071 NCBI Desc: diphosphomevalonate decarboxylase-like protein [arabidopsis thaliana]
  misc_feature (3)..(418): SWISSPROT Homolog: EC 4.1.1.33 Diphosphomevalonate decarboxylase
MAATEGQWLLMATGRTPTNIAVIKYWGKRDEALILPVNDSISVTLDPDHLSATTTVAVSPSFPSDRMWLNGKEISLLGGRFQSCLREIRKRARDFEDEEKGVKIKKEDWGKLHVHIASYNNFPTAAGLASSAAGLACFVFTLGKLMNVKEDYGELSSIARQGSGSACRSIYGGFVKWCMGEKDDGSDSIAVQLADETHWNDLVIIIAVVSSKQKETSSTSGMRDSVETSPLLQYRAQTVVPSRVLKMEEAIKNRDFESFAKLTCADSNQFHAVCLDTSPPIFYMNDTSHRIISLVEKWNHSEGTPQVAYTFDAGPNAVLIAQNRKTAAHLLQKLLYYFPPQDKDLSSYLVGDKSILGDAGVHSMEDVEALPPPPEMKVPDLKFKGDVSYFICSRLGAGPKVIADESQALIDSVTGLPKGV

SEQ ID NO: 8511 - DNA, 2028 bp, Sorghum bicolor
  misc_feature: Ceres ANNOT ID no. 6091083
  misc_feature: Encodes the peptide sequence at SEQ ID NO 8512
atgaggccagaggagagaaatgctgccgtggggagggtcagggaccagttccccgtcggcatgcgggttctcgccgtggacgacgaccccgtgtgcctcaaggtgcttgagaacctcctgcgccgctgtcagtatcgtgttacaacgacgaatcaggctgttgtcgccttgaggatgctgaggcaaaacagggacttgtttgatcttgttatcagtgatgtgcacatgccagacatggatggctttaagcttctggagcttgtggggctcgaaatggacctccctgtcattatgttatcggtgaatggagagacaaaaactgtaatgaaggggataactcatggcgcctgtgactatctcttaaaacctgttcggctggaagagcttaggaatatctggcagcatgttgttaggaggaaattcagtaactgtgagcgtgctaacattgatggctatgaggagtgcaccaggccatcaaatgcagattttgatcatgtacacagccaaattacaggtgggacacctgaccaaagtgggaggtccagcaagaagaggaaggaatatcatagtgaagaggaagatgaaggagaagagagtaatggccaagagaacgatgatccttcagctccaaagaaaccaagggttgtttggtcagttgaactacaccgaaaatttgttgctgctgtcaatcagctaggaattgacaaagctgtgccaaaaagaatacttgagctcatgaatgttgagagactcaccagggaaaatgttgcaagtcacctgcagaagtatagactctatcttaaacggctaagtgctgtggcatcgcaacaggctagcattgttgctgctttcggaggcaatgacccctttatgcggatgggtgcatttgaaggactccagggttatcaatcttttgcctcttcagcagctctgccatcttttactccacaggggttgttaaatagaaatagcccaacatcatttgcgctccaagggatgtctgcttccaggccaattcagattgcaagcaattccacaataagtcattccattagcgatccaaataaatatcaccttagcttaccaggtactagtagccgacaaggaaatctggcacaaggtttgactacttcagttgggcaggtccagctgccacaaaagtggatacatgaagaaactgatgatctatctactatcctttctgtgagtggccaggctaataatggtgtgcccggcacactccaaagtgtcacaaacagtcatttgctgcagcaaggcctcgttgaatgtagacaagacaaagttgttatccagccttgttcatctgcaagttcagatcgtcttgaaggcactgttggagtttcctccagtttgatggattcttgtgcatcccagcagaatgttgttccattgtctgccttttctatcagtgcatcgccaatgaatggctcgctttgcagtaacggcgtagctgagttgggtgctacatcctctgtaggtacaaatatttgcccctccaatgatctcagggtagcaagagacaacaatgtgggagctagctcttttggtagtgtgatacttttgtctccagacactgtgccaaaccaaaaatacttgaattttggtggtggaagcaatttgagacaaagcatggatggagggaacacagacaatctgttaaattccaagctaatatggagttgtttgccgacctctcaaccatcgaatcttgttggaagtcatcatcccatgagccaaagactgaataacggaaaccttggtggcacaatggttggacagactacagcagctgctccacagacgaggatcgacatgtttacctccggagacacaccaactccaaagagcgcgtcagatttgagcttccctaaggtccacagtgagcttagctctagcagctgcagcttcgatggcctcctaaactctataatcaaagtggagaaggacgatgcttccttcagcgatgaccttggatgcgacttctactccctgggtgcctgcatatga

SEQ ID NO: 8512 - protein, 675 aa, Sorghum bicolor
  misc_feature: Ceres ANNOT ID no. 6091083
  misc_feature (21)..(134): Pfam Id: Response_reg Pfam Desc: Response regulator receiver domain
  misc_feature (214)..(264): Pfam Id: Myb_DNA-binding Pfam Desc: Myb-like DNA-binding domain
  misc_feature (15)..(460): NCBI GI: 109631194 NCBI Desc: srr391 [striga asiatica]
  misc_feature (14)..(596): NCBI GI: 14189890 NCBI Desc: response regulator 9 [zea mays]
  misc_feature (15)..(404): NCBI GI: 30682677 NCBI Desc: two-component responsive regulator family protein / response regulator family protein [arabidopsis thaliana]
  misc_feature (8)..(336): NCBI GI: 13661174 NCBI Desc: response regulator 8 [zea mays]
  misc_feature (13)..(409): NCBI GI: 33330870 NCBI Desc: type-b response regulator [catharanthus roseus]
  misc_feature: The sequence is a functional homolog of SEQ ID NO 1232 in the 10/666,642US patent application
  misc_feature: The sequence is a functional homolog of SEQ ID NO 1233 in the 10/666,642US patent application
  misc_feature: The sequence is a functional homolog of SEQ ID NO 172 in the 10/666,642US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2510 in the 10/374,780US patent application
  misc_feature: The sequence is a functional homolog of SEQ ID NO 686 in the 10/412,699US patent application
  misc_feature: The sequence is a functional homolog of SEQ ID NO 932 in the 10/666,642US patent application
  misc_feature: The sequence is a functional homolog of SEQ ID NO 933 in the 10/666,642US patent application
  misc_feature: The sequence is a functional homolog of SEQ ID NO 934 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: The sequence is a functional homolog of SEQ ID NO 976 in the 10/225,066US patent application
  misc_feature: Useful for making plants with modulated growth and phenotype characteristics
  misc_feature: The sequence is a functional homolog of SEQ ID NO 686 in the 20040045049 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1232 in the 20070033671 US patent application
  misc_feature: The sequence is a functional homolog of SEQ ID NO 1233 in the 20070033671 US patent application
  misc_feature: The sequence is a functional homolog of SEQ ID NO 932 in the 20070033671 US patent application
  misc_feature: The sequence is a functional homolog of SEQ ID NO 933 in the 20070033671 US patent application
  misc_feature: The sequence is a functional homolog of SEQ ID NO 934 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: The sequence is a functional homolog of SEQ ID NO 936 in the 10/666,642 US patent application
  misc_feature: The sequence is a functional homolog of SEQ ID NO 935 in the 10/666,642 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: Useful for making plants with altered lignin content
  misc_feature: Functional homolog of the protein sequence given in SEQ ID NO 13182
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: The sequence is a functional homolog of SEQ ID NO. 378 in the 11/188,298 US application
MRPEERNAAVGRVRDQFPVGMRVLAVDDDPVCLKVLENLLRRCQYRVTTTNQAVVALRMLRQNRDLFDLVISDVHMPDMDGFKLLELVGLEMDLPVIMLSVNGETKTVMKGITHGACDYLLKPVRLEELRNIWQHVVRRKFSNCERANIDGYEECTRPSNADFDHVHSQITGGTPDQSGRSSKKRKEYHSEEEDEGEESNGQENDDPSAPKKPRVVWSVELHRKFVAAVNQLGIDKAVPKRILELMNVERLTRENVASHLQKYRLYLKRLSAVASQQASIVAAFGGNDPFMRMGAFEGLQGYQSFASSAALPSFTPQGLLNRNSPTSFALQGMSASRPIQIASNSTISHSISDPNKYHLSLPGTSSRQGNLAQGLTTSVGQVQLPQKWIHEETDDLSTILSVSGQANNGVPGTLQSVTNSHLLQQGLVECRQDKVVIQPCSSASSDRLEGTVGVSSSLMDSCASQQNVVPLSAFSISASPMNGSLCSNGVAELGATSSVGTNICPSNDLRVARDNNVGASSFGSVILLSPDTVPNQKYLNFGGGSNLRQSMDGGNTDNLLNSKLIWSCLPTSQPSNLVGSHHPMSQRLNNGNLGGTMVGQTTAAAPQTRIDMFTSGDTPTPKSASDLSFPKVHSELSSSSCSFDGLLNSIIKVEKDDASFSDDLGCDFYSLGACI

SEQ ID NO: 8513 - DNA, 888 bp, Sorghum bicolor
  misc_feature: Ceres ANNOT ID no. 6091084
  misc_feature: Encodes the peptide sequence at SEQ ID NO 8514
atgggcaacgtcacgtcgtcggtggcggcgcggctggccttcttcccgccggagccggcgacgtacggcatcgaggcccaggacggcgccggctccctgctgcggatgacgggggtgtcgccggacaccggcgtcgaggtgcgcgcgctgcccaccagggccggcacgcgcgtcgtctccgccttctggcgccaccccgccgcgcggctcacgctgctctactcccatggcaacgccgccgacctcggccagatgttcggcctcttcctcgagctccgcgcgcacctccgcgtcaacatcatgagctatgattattcaggctatggtgcctctacaggaaaaccatcagagtacaacacatacaatgacatagaggctgtttatgattgcttgaaaaaggagtatgggatagaagaagaggatttaatcctgtatgggcaatcagttggaagtggaccaacattgcatttagcctcgcgtttggagaagttaagaggggttgtccttcacagtggtatactctctggcatacgggttctgtatccagtgaaagtgacactttggttcgacatcttcaagaacatcgacaaaataaagcaggttgcctgtcctgtgttagtcatacatggaacagcggatgacatcgtggacttcactcacggcaagcgcctgtgggagctagccaaggagaagtacgagccgctgtggatcaaaggcggtgggcactgcaacctggagacgtacccggagtacatcaggcacctgcgcaagttcataaacgctatggagaagctggccaaggacagcaaggcggcccaggcgccgccatcgtcgagcttggcggcggaagcaagacactccaagtgcttgagattcgggaagaggtga

SEQ ID NO: 8514 - protein, 295 aa, Sorghum bicolor
  misc_feature: Ceres ANNOT ID no. 6091084
  misc_feature (1)..(295): NCBI GI: 140067578 NCBI Desc: c2; esterase/lipase/thioesterase [medicago truncatula]
  misc_feature (1)..(287): NCBI GI: 51535771 NCBI Desc: cgi67 serine protease-like [oryza sativa (japonica cultivar-group)]
  misc_feature (1)..(264): NCBI GI: 124359459 NCBI Desc: esterase/lipase/thioesterase [medicago truncatula]
  misc_feature (27)..(270): NCBI GI: 56784467 NCBI Desc: cgi67 serine protease-like [oryza sativa (japonica cultivar-group)]
  misc_feature (27)..(270): NCBI GI: 115439289 NCBI Desc: os01g0689800 [oryza sativa (japonica cultivar-group)]
MGNVTSSVAARLAFFPPEPATYGIEAQDGAGSLLRMTGVSPDTGVEVRALPTRAGTRVVSAFWRHPAARLTLLYSHGNAADLGQMFGLFLELRAHLRVNIMSYDYSGYGASTGKPSEYNTYNDIEAVYDCLKKEYGIEEEDLILYGQSVGSGPTLHLASRLEKLRGVVLHSGILSGIRVLYPVKVTLWFDIFKNIDKIKQVACPVLVIHGTADDIVDFTHGKRLWELAKEKYEPLWIKGGGHCNLETYPEYIRHLRKFINAMEKLAKDSKAAQAPPSSSLAAEARHSKCLRFGKR

SEQ ID NO: 8515 - DNA, 2190 bp, Sorghum bicolor
  misc_feature: Ceres ANNOT ID no. 6091093
  misc_feature: Encodes the peptide sequence at SEQ ID NO 8516
atgtcgggctgggacgagggcgccgtgttctatagcgaccaggcgcagttcccccgcggcggccccggcggcgacccagccgccgacctcacccgccactccgccctccgcaagttcaaggagttcctcagaggcttcaccggccccaccggcgacttcccctaccgtgagagcctagtacacaaccgcgaccatgtcaccgtcgccatcgaggacctcgacgccttcgatgccgagctctctgacaggatccgcaagtcgccggccgattatcttccgctgtttgagacggctgcggccgaggttctcgcaagcctccgttcgaaggtcgccggcgagaccggggagatggaggagcccgtcacgggagatgtccagatcttcctctcctccaaggagaactgcctgtccatgagatctgttggggctgattacatgtcgaagctggttaagattgcgggaatcacaattgctgcatcgagagtaaaagccaaggccactcatgtaactcttatctgcaagaattgccggagtgtgaggacagtgccttgcaggccaggcctcggcggggctattgttccacgttcttgtgaccatgttcctcagcctggagaagagccctgccccctggacccttggattgccgtcccggataagagcaagtatgtggatctccagaccctcaaactgcaggagaatcctgaggatgttccaactggtgagcttccaaggaatgtgcttctttctgtagataggcacctagttcagactattgttccagggactagattaactgttgttggcatctacagcgtctaccaagcatccgcaacccagaagggcgctgttggtgttaaacagccttacattagagttgtgggtttggagcaatctcgagacaataactcaaatggcccctcaaacttcactctcgatgaggaaatggaattcaaagaatttgcacagagaccagatgcatatgccaagctttgctcaatgattggtccttcaatttatggtcattctgatgtcaagaaagctattgcatgcttgttatttgggggatctaagaagaggctacctgatggtgtacgtttgagaggggatattcatgtcttgcttctgggtgatccatccacagcaaaatcacagttcctcaaatttgtagagaagactgcacctattgcagtctatacatctggcaaaggatcatctgcagctggtcttacagcatctgtaactcgggatggtagctcgcgtgagttttatttggaaggaggagccatggtactggctgatggtggagtagtctgtatcgatgaatttgacaagatgagacctgaagacagagttgcaattcatgaggccatggagcagcagacaatatctattgccaaagctggcattacaacagttctcaattcaaggacttcagttcttgcagctgccaatccaattgcaggacgctatgatgatcttaagactgcacaagataatattgatctgcagacgaccattctttctagatttgatctaatctttatcgtcaaagatatcagaatgtatgatcaagataagcgaatagcaagccacattatcaaggtgcatgccagtggtgctgcagcttcttccacaggcacagaggcaagtgatggagagaattggctgaaaaggtacattgagtactgccgtgccacatgcagaccacggctttcagaaaaagcagctgagatgctgcagaacaaatatattgagattagacagaaaatgaggcagcaagctcatgagacagggagggcagcagcgatacccatcactgtgaggcagcttgaagccatcatacgtttgagtgaatctcttgcaaagatgagattgacaagtgtggctacaccagaacatgtcgaagaggcattcagactgtttaatgtctccaccgttgatgctgcaagatccggaatcaacgagcatttgaacctgtcaccggagattgctaatgaaatcaagcaagcggaagcacaaataaagagaagaatgggcattggaagccacatatctgagcgacggctgattgatgaactaaataggatgggaatgaatgaatccattgtcagaagagcccttctgatcatgcatcaaagagatgaggtggagtacaagcgagagcgccacgtgattgtccgaaaggcttga

SEQ ID NO: 8516 - protein, 729 aa, Sorghum bicolor
  misc_feature: Ceres ANNOT ID no. 6091093
  misc_feature (313)..(646): Pfam Id: MCM Pfam Desc: MCM2/3/5 family
  misc_feature (371)..(502): Pfam Id: AAA_3 Pfam Desc: ATPase family associated with various cellular activities(AAA)
  misc_feature (1)..(727): NCBI GI: 28703916 NCBI Desc: mcm5-prov protein [xenopus laevis]
  misc_feature (1)..(727): NCBI GI: 13177775 NCBI Desc: minichromosome maintenance deficient protein 5 [homo sapiens]
  misc_feature (1)..(727): NCBI GI: 109451950 NCBI Desc: mcm5 [synthetic construct]
  misc_feature (1)..(727): NCBI GI: 82237688 NCBI Desc: dna replication licensing factor mcm5-b (minichromosome maintenance protein 5-b) (xmcm5-b) (cdc46 homolog-b) (xcdc46-b)
  misc_feature (1)..(727): NCBI GI: 23510448 NCBI Desc: minichromosome maintenance deficient protein 5 [homo sapiens]
MSGWDEGAVFYSDQAQFPRGGPGGDPAADLTRHSALRKFKEFLRGFTGPTGDFPYRESLVHNRDHVTVAIEDLDAFDAELSDRIRKSPADYLPLFETAAAEVLASLRSKVAGETGEMEEPVTGDVQIFLSSKENCLSMRSVGADYMSKLVKIAGITIAASRVKAKATHVTLICKNCRSVRTVPCRPGLGGAIVPRSCDHVPQPGEEPCPLDPWIAVPDKSKYVDLQTLKLQENPEDVPTGELPRNVLLSVDRHLVQTIVPGTRLTVVGIYSVYQASATQKGAVGVKQPYIRVVGLEQSRDNNSNGPSNFTLDEEMEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDGSSREFYLEGGAMVLADGGVVCIDEFDKMRPEDRVAIHEAMEQQTISIAKAGITTVLNSRTSVLAAANPIAGRYDDLKTAQDNIDLQTTILSRFDLIFIVKDIRMYDQDKRIASHIIKVHASGAAASSTGTEASDGENWLKRYIEYCRATCRPRLSEKAAEMLQNKYIEIRQKMRQQAHETGRAAAIPITVRQLEAIIRLSESLAKMRLTSVATPEHVEEAFRLFNVSTVDAARSGINEHLNLSPEIANEIKQAEAQIKRRMGIGSHISERRLIDELNRMGMNESIVRRALLIMHQRDEVEYKRERHVIVRKA

SEQ ID NO: 8517 - DNA, 1380 bp, Sorghum bicolor
  misc_feature: Ceres ANNOT ID no. 6091094
  misc_feature: Encodes the peptide sequence at SEQ ID NO 8518
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atggcctccgccgccttcgccgtctcctcgccggcggcctccgccgtcgccgcgcgatccaaggtgcttggacgtggagctaatctggggagaaatagaactggctgccgcgtcggtatcacgcggaagaactttggccgtgttatgatggcccttgcagtggatgtttctcgttttgaaggagtgccaatggctcctccagacccaattcttggggtttcagaggcttttaaagcggataaaaatgatctgaagctcaatcttggtgttggtgcctataggacagaagagttgcagccctatgtgctcaatgtagtcaagaaggctgaaaagcttatgttggagaaaggagataacaaagagtatcttcccattgaaggtttagccgcgtttaacaaagcaacagcagagctattgcttggagctgataaccctgttattaagcaagggctggttgctacaattcagtctctctcgggcactggatcactgcgtctcgctgcagcattcatacaaagatacttccctgaagctaaagtaatcatatcatcgcccacctggggtaaccacaagaatatcttcaatgatgctagggtaccttggtcagagtaccggtattatgaccccaagactgttgggttggattttgagggaatgatagctgacattgaggctgctcctgaaggatcttttgttctgctacatggttgtgctcacaacccaactggaatagacccaactcctgaacagtgggagaaaattgcagatgtcatccaagagaaaaaacatatgcccttctttgatgttgcatatcagggttttgccagtggaagccttgatgaagatgcattttctgtgaggctttttgttaaacgtggcatggaagtgtttgttgcacaatcttacagcaagaatcttggtctatattctgaaaggattggtgcaataaatgttgtgtgctcagcaccagacattgcagatagggtaaagagccagctgaaacgattggcacgacccatgtactcgaacccccctattcatggtgccaggatagttgccaatgttgttggtgatccgactatgtttggtgaatggaaacaagagatggaggaaatggctgggcggatcaagaatgtaagacagaagctctacgatagtttgtctgcgaaggaccagagtggcaaagactggtctttcattctgaggcagattggcatgttctcctacactgggttgaacaaagcacagagtgataacatgacagataaatggcatgtttacatgaccaaggatgggcggatctcattagctgggctgtccctagctaaatgcgattatcttgccgacgccatcatcgattccttccataacgtcaactag

SEQ ID NO: 8518 - protein, 459 aa, Sorghum bicolor
  misc_feature: Ceres ANNOT ID no. 6091094
  misc_feature (83)..(451): Pfam Id: Aminotran_1_2 Pfam Desc: Aminotransferase class I and II
  misc_feature (1)..(459): NCBI GI: 633095 NCBI Desc: plastidic aspartate aminotransferase [panicum miliaceum]
  misc_feature (46)..(459): NCBI GI: 29468084 NCBI Desc: aspartate aminotransferase [oryza sativa]
  misc_feature (1)..(459): NCBI GI: 445118 NCBI Desc: asp aminotransferase
  misc_feature (1)..(459): NCBI GI: 777387 NCBI Desc: aspartate aminotransferase [medicago sativa]
  misc_feature (43)..(459): NCBI GI: 1017411 NCBI Desc: aspartate aminotransferase [arabidopsis thaliana]
  misc_feature (43)..(459): SWISSPROT Homolog: EC 2.6.1.1 Aspartate aminotransferase, chloroplast precursor
  misc_feature: Useful for making plants with modulated nitrogen use efficiency
  misc_feature: GREAT-hit functional homolog of the protein sequence encoded by LOCUS at4g31990
  misc_feature: Useful for making plants with modulated nitrogen use efficiency
  misc_feature: Functional homolog of the protein sequence given in SEQ ID NO 13735
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MASAAFAVSSPAASAVAARSKVLGRGANLGRNRTGCRVGITRKNFGRVMMALAVDVSRFEGVPMAPPDPILGVSEAFKADKNDLKLNLGVGAYRTEELQPYVLNVVKKAEKLMLEKGDNKEYLPIEGLAAFNKATAELLLGADNPVIKQGLVATIQSLSGTGSLRLAAAFIQRYFPEAKVIISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERIGAINVVCSAPDIADRVKSQLKRLARPMYSNPPIHGARIVANVVGDPTMFGEWKQEMEEMAGRIKNVRQKLYDSLSAKDQSGKDWSFILRQIGMFSYTGLNKAQSDNMTDKWHVYMTKDGRISLAGLSLAKCDYLADAIIDSFHNVN

SEQ ID NO: 8519 - DNA, 1983 bp, Sorghum bicolor
  misc_feature: Ceres ANNOT ID no. 6091096
  misc_feature: Encodes the peptide sequence at SEQ ID NO 8520
  misc_feature: Down-regulated in shoot tissues in response to salicylic acid treatment
atggcccgccccggcgtgctcctcctcgtcgccgtcgcggcggccgcgctgctcgcggccgcggtgccgggcacccaagggttctacctcccggggagctacccgcacaaatacaaccccggggactacctcaacgtgaaggtgaactcgctcacttccatcgacaccgagatgcccttcagctactacagcctccccttctgcgagccccaagacggggtcaaggacagcgccgagaacctcggcgagctcctcatgggcgaccgcatcgagaactcgccctaccgcttccgcatgtacaccaacgagtccgacgtcttcctctgccgctccgcgccgctgggcgccgacgccttcgcgctcctcaagaagcgcatcgacgagatgtaccaagtcaacctcatcctcgacaacctccccgccatccgctacaacaggaaggacgactacctcatgcgctggacggggtaccccgtcgggaaccgcgtcggcgtcgactactcgtcttcacccctccagttcaccgtcctcgtccacaagtacgaggacgccaatgtcgcgcgcgtcatgggagccgctgacgccaccgacgccatcccgtccggggccaaggacgccgcgtcctcccctggctggatggtggtcgggttcgaggtcgtgccctgcagcatcaagcacaacccggaggacgtcaagtcgcgcaagatgtacgaccagtaccccaacaagatcaagtgcgacccgactactgtgtccatgagcatcaaggagaacgagcccattgtctacacctacgaggtgaacttcgtggagagcgatatcaagtggccctccaggtgggatgcctacctcaagatggagggggccaaggtgcactggttctccattctcaactccctcatggtgattgccttccttgctggtattgtgtttgtcattctgctgaggactgtgaggcgtgatctcaccaagtatgaggagcttgacagtgaggcgcaggcgcagatgaatgaggagctgtctgggtggaagcttgtggtcagtgatgtgttccgtgcaccaagcaacccgatgctgctctgtgtcatggttggggacggtgttcagatcctcgggatggcggtcgtgaccattctctttgctgcactcgggtttatgtccccagcctcccggggaaccctgatcactggcatgctgttcttctatctggtccttggaatcctagctggatacgctggggttcgtgtatggaagacgatcaagtgcggggatcactctgggtgggtgggtgtttcatggcgggtggcctgcttcttccccggcattgcattcctgatcctgaccacactcaacttcctgttgtggggaagccacagcactggtgccatccccttctcattgttcgttgtgctgcttctgctctggttctgcatctcggtgccgctcacgcttgttggtgggttccttggtgccaaggcgccacatattgagtaccctgtccgcacgaaccagatccctcgtgaaatccctcctcagaagtacccatcctggttgttggttcttggtgctggcacactgcccttcggcaccctattcatcgagctcttcttcatcatgtcaagcatatggatgggccgtgtgtactatgtctttggattcctcttcattgtcttgctgctgctggttattgtctgcgctgaggtttccctggttctgacttacatgcacctgtgcgttgaggattggaagtggtggtggaagtcattcttctcatcaggatcagtggcaatctacattttcttgtactccatcaactatctcgtttttgacctcaaaagcctgagtggaccagtgtctgcgaccctctacattggttactcgctcttcatggtgattgctatcatgctggcaactggcacagttgggtttatttcttcattctgctttgtccactatcttttcgcatcggtgaaagcagattaa

SEQ ID NO: 8520 - protein, 660 aa, Sorghum bicolor
  misc_feature: Ceres ANNOT ID no. 6091096
  misc_feature (58)..(618): Pfam Id: EMP70 Pfam Desc: Endomembrane protein 70
  misc_feature (27)..(660): NCBI GI: 10176814 NCBI Desc: endosomal protein-like [arabidopsis thaliana]
  misc_feature (11)..(660): NCBI GI: 38175639 NCBI Desc: endosomal protein-like [oryza sativa (japonica cultivar-group)]
  misc_feature (267)..(660): NCBI GI: 115477747 NCBI Desc: os08g0555200 [oryza sativa (japonica cultivar-group)]
  misc_feature (1)..(660): NCBI GI: 51534986 NCBI Desc: endomembrane protein 70-like [oryza sativa (japonica cultivar-group)]
  misc_feature (212)..(660): NCBI GI: 108876379 NCBI Desc: transmembrane 9 superfamily protein member 4 [aedes aegypti]
  misc_feature: Useful for making plants with altered cell wall content and/or composition
  misc_feature: GREAT-hit functional homolog of the protein sequence encoded by LOCUS at5g35160
  misc_feature: Useful for making plants with altered cell wall content and/or composition
  misc_feature: Functional homolog of the protein sequence given in SEQ ID NO 13969
  misc_feature: Down-regulated in shoot tissues in response to salicylic acid treatment
MARPGVLLLVAVAAAALLAAAVPGTQGFYLPGSYPHKYNPGDYLNVKVNSLTSIDTEMPFSYYSLPFCEPQDGVKDSAENLGELLMGDRIENSPYRFRMYTNESDVFLCRSAPLGADAFALLKKRIDEMYQVNLILDNLPAIRYNRKDDYLMRWTGYPVGNRVGVDYSSSPLQFTVLVHKYEDANVARVMGAADATDAIPSGAKDAASSPGWMVVGFEVVPCSIKHNPEDVKSRKMYDQYPNKIKCDPTTVSMSIKENEPIVYTYEVNFVESDIKWPSRWDAYLKMEGAKVHWFSILNSLMVIAFLAGIVFVILLRTVRRDLTKYEELDSEAQAQMNEELSGWKLVVSDVFRAPSNPMLLCVMVGDGVQILGMAVVTILFAALGFMSPASRGTLITGMLFFYLVLGILAGYAGVRVWKTIKCGDHSGWVGVSWRVACFFPGIAFLILTTLNFLLWGSHSTGAIPFSLFVVLLLLWFCISVPLTLVGGFLGAKAPHIEYPVRTNQIPREIPPQKYPSWLLVLGAGTLPFGTLFIELFFIMSSIWMGRVYYVFGFLFIVLLLLVIVCAEVSLVLTYMHLCVEDWKWWWKSFFSSGSVAIYIFLYSINYLVFDLKSLSGPVSATLYIGYSLFMVIAIMLATGTVGFISSFCFVHYLFASVKAD

SEQ ID NO: 8521 - DNA, 612 bp, Sorghum bicolor
  misc_feature: Ceres ANNOT ID no. 6091098
  misc_feature: Encodes the peptide sequence at SEQ ID NO 8522
atggtcatcatggccggcatgctccccggcgtggagagcgcgcggaggcggcgggtgcggcagtcgtcggagtcgggggcggcgcggcggccgtccctgtgcctgtacgccggcgggcttggttcgtcgtcgtcggcagcagcagcagcagcttcgtccaaggcaagaactttgctcgccatcacccatcagtctgttcgttcatgtcgtctgcatgtggtgggtggcgtccttgtgatgctttgcggttgcctgcaggtgtggagcggcgcgtgcggggacacgacggcggcgatggcgtgcgcgtggatgacgacgctgggcagcgacgcccgggaggccaaggagaggctggatcacaagctcaggggacacagacagcctgtggtgctcaagagctggcgccgccgcccgccggcggccgagtcggaggcggaggcggagtgcgcggtgtgcctggaggagctccgcgcgggggacgtggtggcgcgcctgccctgcgcgcaccgtttccactggtcatgcgccgtgccctgggtccaggccgtctctcggtgccccgtctgccgcgcccacgtccacctcgccgccggcgccggccccaccagctga

SEQ ID NO: 8522 - protein, 203 aa, Sorghum bicolor
  misc_feature: Ceres ANNOT ID no. 6091098
  misc_feature (149)..(189): Pfam Id: zf-C3HC4 Pfam Desc: Zinc finger, C3HC4 type (RING finger)
  misc_feature (1)..(203): NCBI GI: 51091319 NCBI Desc: ring-h2 zinc finger protein-like [oryza sativa (japonica cultivar-group)]
  misc_feature (1)..(193): NCBI GI: 55773781 NCBI Desc: ring-h2 zinc finger protein-like [oryza sativa (japonica cultivar-group)]
  misc_feature (1)..(193): NCBI GI: 115466752 NCBI Desc: os06g0180800 [oryza sativa (japonica cultivar-group)]
  misc_feature (140)..(198): NCBI GI: 108708054 NCBI Desc: zinc finger, c3hc4 type family protein [oryza sativa (japonica cultivar-group)]
  misc_feature (140)..(199): NCBI GI: 56201670 NCBI Desc: ring-h2 zinc finger protein-like [oryza sativa (japonica cultivar-group)]
  misc_feature: Useful for making plants with altered terpenoid content
  misc_feature: Functional homolog of the protein sequence given in SEQ ID NO 13241
  misc_feature: The sequence is a functional homolog of SEQ ID NO. 271 in the 11/188,298 US application
MVIMAGMLPGVESARRRRVRQSSESGAARRPSLCLYAGGLGSSSSAAAAAASSKARTLLAITHQSVRSCRLHVVGGVLVMLCGCLQVWSGACGDTTAAMACAWMTTLGSDAREAKERLDHKLRGHRQPVVLKSWRRRPPAAESEAEAECAVCLEELRAGDVVARLPCAHRFHWSCAVPWVQAVSRCPVCRAHVHLAAGAGPTS

SEQ ID NO: 8523 - DNA, 1962 bp, Sorghum bicolor
  misc_feature: Ceres ANNOT ID no. 6091100
  misc_feature: Encodes the peptide sequence at SEQ ID NO 8524
atggcggcctccggtcctccccctaactcccccttcgcaccttgctccactcctacaccagccgccgccgccgctgcgccgatggcggcctccggcccgccgctcgaagactgcctccgcctgctccgcggcgagcgcgacgagcagaagctggcgggcctgctcgtcgccaccaacctctgccgcgcgggcgacagcgacgccgtctccaaggtctaccgtgccgttgggccccgcttcctccgacgcctcctcaacaccgggttagggaaagtggagggcgggaaggaggaggagcgagaggcatacctgcggctcgccgtcaccgtgctcgcagggctcgcgcgcgtcccggaggttgcggccgacgagggggtcgtttccactgtgcccctagtcgccgaggttatcacgaaatcgactgatccagcaatcactgaagaatgctttgaacttctgtcacttattgcaatagcctctgaagatggggcatataagttttgtgagcctggtgtagtagacatgatattccttcaaatcttaagcttaacagatggttctaagtgcatagaacttgccattaacctaatgcagttactagttcataaactcaaagttgacactatgagtgtggagaaactgcaaggcatgactagcatggtaacctgccttgccaggctttttgctgttctccatactgcagttaaatttgatgccctgcacatgcttaccaccctcctgtcccaaaaagaatctccacttcatgattctttgagatcaataccggcatcaatttgggaatctcatattcgagttggaatcactgccattctccaaaatcgtgttgtatcctctgaaaagctgcacacacttcttttggcggagtgcatgatgtccatactaggcgagaattggttgtcagaagattttcatgtcccggataatcaaaatgtgttgcctgttgacaaattcatgttgcttgtcctcgaatccgcaagggttgaagtggcagtcctgctaaatgagcttgcttatctgaagtatgagtcgtcaaaaacttctcagacagatgaagccatctgtcagaaacagagaaacctggctatactattttcattaatagaaaaaataatcaaaatgatatcaaatgccagtagtggtgaaggtgcaccaattcagaccatccatgaaagtaccataatgcaggccattacgggattaaatgagacaatcagtttagtcttagattttcttcaggacgcaaaggatcatggtcaacagaaaggtgatgatcttttggcagctgcaagaatagtaggaagttatctggcagaagcaccatatgcctgcaaggagaagactggaaatctattggaatttatcttttctatagaaggtcaagatgaatcaagccccttctattctatttgcttcatgcttccaatgctatcccaaataacaatggaggttgatgggtgtagaactttggcatcatttggcggctataaggcagttatagattgccttgttaaaatgagtgagcaggatggaatgatgattgacaatggtagcatgtttttggcatgtgacaccatcataaatttcatgtctaataggaagagtgttcatattccagtggattctcgcttcattcgccttctaaaggcacttgttacatgggctggaaccacagatgcctcatcagttaccatgacagcatcctgcttatgtgcaatgctgttggagttgacgtcagaagagtttctattgagctgctctcattttgacgccaagacccttgggagtttggctgagctcattatcagaagtttgcaacaggatatccctgatgatgacagggagcaattcaaccagaagcagatcattgtatcaggttataggcgatgggctgatcggtttccacatgttaaagaagttgtggagcagcatgtgtctgtgtga

SEQ ID NO: 8524 - protein, 653 aa, Sorghum bicolor
  misc_feature: Ceres ANNOT ID no. 6091100
  misc_feature (23)..(649): Pfam Id: Neurochondrin Pfam Desc: Neurochondrin
  misc_feature (16)..(653): NCBI GI: 51091323 NCBI Desc: neurochondrin protein-like [oryza sativa (japonica cultivar-group)]
  misc_feature (24)..(649): NCBI GI: 18086357 NCBI Desc: at4g32050/f10n7_130 [arabidopsis thaliana]
  misc_feature (24)..(649): NCBI GI: 59958338 NCBI Desc: at4g32050 [arabidopsis thaliana]
  misc_feature (34)..(345): NCBI GI: 116128458 NCBI Desc: ensangp00000031374 [anopheles gambiae str. pest]
  misc_feature (34)..(342): NCBI GI: 125776305 NCBI Desc: ga15350-pa [drosophila pseudoobscura]
MAASGPPPNSPFAPCSTPTPAAAAAAPMAASGPPLEDCLRLLRGERDEQKLAGLLVATNLCRAGDSDAVSKVYRAVGPRFLRRLLNTGLGKVEGGKEEEREAYLRLAVTVLAGLARVPEVAADEGVVSTVPLVAEVITKSTDPAITEECFELLSLIAIASEDGAYKFCEPGVVDMIFLQILSLTDGSKCIELAINLMQLLVHKLKVDTMSVEKLQGMTSMVTCLARLFAVLHTAVKFDALHMLTTLLSQKESPLHDSLRSIPASIWESHIRVGITAILQNRVVSSEKLHTLLLAECMMSILGENWLSEDFHVPDNQNVLPVDKFMLLVLESARVEVAVLLNELAYLKYESSKTSQTDEAICQKQRNLAILFSLIEKIIKMISNASSGEGAPIQTIHESTIMQAITGLNETISLVLDFLQDAKDHGQQKGDDLLAAARIVGSYLAEAPYACKEKTGNLLEFIFSIEGQDESSPFYSICFMLPMLSQITMEVDGCRTLASFGGYKAVIDCLVKMSEQDGMMIDNGSMFLACDTIINFMSNRKSVHIPVDSRFIRLLKALVTWAGTTDASSVTMTASCLCAMLLELTSEEFLLSCSHFDAKTLGSLAELIIRSLQQDIPDDDREQFNQKQIIVSGYRRWADRFPHVKEVVEQHVSV

SEQ ID NO: 8525 - DNA, 522 bp, Sorghum bicolor
  misc_feature: Ceres ANNOT ID no. 6091101
  misc_feature: Encodes the peptide sequence at SEQ ID NO 8526
atggacgacggtggcgactggatcacggcgaggtacctcctctcgtcgattcttgggcggaacccgctggtggtggactacgtcgacgaggagtccttccccgtcgacgaccctcctagtcctagtccctcctccccctcttgcgcccgccgcgcggagccgccgccgccgccggtgcgggcgcccgcgggggtggccgggacggtctgcgcggtgtgcacggaggagatcgccgcggcggacgccgtcgtgcgcctgccctgcgcgcactggtaccaccacggctgcatcgcgccctggctcgggatccggcccacctgccccatgtgccgcgccgagctgccgccgagcgaacccgaggccggcggggaaggcgcggggcgtgccaagccggcggcgcccgctcggggtgttgccgccgcggggaccagcaccggtgcgaccgcgaccgcggccgcgcgcgtgcggcgggaagcgtcgcacgagtacctcgccgtcgccggcggcgtgttgtccggctga

SEQ ID NO: 8526 - protein, 173 aa, Sorghum bicolor
  misc_feature: Ceres ANNOT ID no. 6091101
  misc_feature (70)..(110): Pfam Id: zf-C3HC4 Pfam Desc: Zinc finger, C3HC4 type (RING finger)
  misc_feature (37)..(137): NCBI GI: 46390610 NCBI Desc: zinc finger -like [oryza sativa (japonica cultivar-group)]
  misc_feature (44)..(132): NCBI GI: 42408255 NCBI Desc: zinc finger protein family-like [oryza sativa (japonica cultivar-group)]
  misc_feature (36)..(147): NCBI GI: 115482626 NCBI Desc: os10g0487400 [oryza sativa (japonica cultivar-group)]
  misc_feature (36)..(127): NCBI GI: 51090501 NCBI Desc: zinc finger-like [oryza sativa (japonica cultivar-group)]
  misc_feature (63)..(143): NCBI GI: 115469064 NCBI Desc: os06g0633500 [oryza sativa (japonica cultivar-group)]
  misc_feature: The sequence is a functional homolog of SEQ ID NO 1201 in the 10/374,780US patent application
  misc_feature: Useful for making plants with modulated growth and phenotype characteristics
  misc_feature: The sequence is a functional homolog of SEQ ID NO 1201 in the 20060162006 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MDDGGDWITARYLLSSILGRNPLVVDYVDEESFPVDDPPSPSPSSPSCARRAEPPPPPVRAPAGVAGTVCAVCTEEIAAADAVVRLPCAHWYHHGCIAPWLGIRPTCPMCRAELPPSEPEAGGEGAGRAKPAAPARGVAAAGTSTGATATAAARVRREASHEYLAVAGGVLSG

SEQ ID NO: 8527 - DNA, 1518 bp, Sorghum bicolor
  misc_feature: Ceres ANNOT ID no. 6091102
  misc_feature: Encodes the peptide sequence at SEQ ID NO 8528
atggaggatctccaagagccactactggcagaaatcattaagagggttaccaggacaactgatcttaattcaatttcacttgtgtcgaagcgcctctacactgttgatgcagaggaaaggggcacgatctgtgttggctgcggccttcaccctgcgacggaatccttctcattattgtgctcccggttccccaacttgtggaaagtagagatcaattactctggttggacgtccatcgaagcccaagggaagcagttgggcaaccaaggcctctctgtgctgtcatctcactgttcctcactgacggatctcagcttaagcttctgttcagacatcaatgacattggccttggttatttggcacattgcaagaagctgatggccctcaggctgagctttactccagcgataacctcagatggccttttgtcagtagcggttgggtgcaagagtctatctactttccatcttgttgactgcattaaggtagacagcgtcgagtggctggagtaccttggcagagctggatcagtggttgaacttgtggtgaaggattgcaagggaatcagccagtttgacctcctaaagtttggtccaggatggatgaagcttgagaagtttgagtttgagatcaatggcaattattggttatcagggcctccccctgatcctgcgtctgatgctcgctacccctacaaatatgatatctgctgtgagaacttgaaggatttgaggttggcacatattataactatgcgcagcgacgatgagggtctcccagcaccaactgcgcaagagattggactccgttttcttttgagaaagtgcaaagcattagagaaactttgtctggactatgttgttggtctagatgaggacgagatgattgctttgttccagaactgcagcaaccttagaagcctttcacttcgcctcatgcctctgcaccaacgggactggcatttcaggacaccactgactgatgaaagccttaaggcccttggtctcagctgccctatgcttgaggttgttgagctgacctttacgttttgttcgagtgggtatccaacagaaataggcttcacacagaaaggtattgttgcactcattcagacttgtccaattcgtgctttcatgctgaatggagcgaacatgttttttgactcggggttggagggtatttcatcggcgccattcctggagcaacttgagcttttggattgcaaggggataacagatgctgggatgagtttcatcgcgcatgccccgcgcttgagtagtctcaccctccggaaatgccaagatgtgactgataatggaatagccaagctggcacattcagcgaaactggagtctctgaccgttgtaggttgccatcagatctcccgggaaggtgttcagggggctgccagattagttcgctactcagctgattctgaaagccatgatagtctcaaaggaatgaaactcacaggcaaaccaaccgcaccgcctgttctggaaacctttgcagcttag

SEQ ID NO: 8528 - protein, 505 aa, Sorghum bicolor
  misc_feature: Ceres ANNOT ID no. 6091102
  misc_feature (1)..(488): NCBI GI: 116309296 NCBI Desc: osigba0134j07.3 [oryza sativa (indica cultivar-group)]
  misc_feature (1)..(479): NCBI GI: 116309295 NCBI Desc: osigba0134j07.2 [oryza sativa (indica cultivar-group)]
  misc_feature (1)..(478): NCBI GI: 42572201 NCBI Desc: f-box family protein (fbl14) [arabidopsis thaliana]
  misc_feature (202)..(491): NCBI GI: 51091324 NCBI Desc: f-box protein-like [oryza sativa (japonica cultivar-group)]
  misc_feature (32)..(316): NCBI GI: 38605924 NCBI Desc: osjnbb0076a22.3 [oryza sativa (japonica cultivar-group)]
MEDLQEPLLAEIIKRVTRTTDLNSISLVSKRLYTVDAEERGTICVGCGLHPATESFSLLCSRFPNLWKVEINYSGWTSIEAQGKQLGNQGLSVLSSHCSSLTDLSLSFCSDINDIGLGYLAHCKKLMALRLSFTPAITSDGLLSVAVGCKSLSTFHLVDCIKVDSVEWLEYLGRAGSVVELVVKDCKGISQFDLLKFGPGWMKLEKFEFEINGNYWLSGPPPDPASDARYPYKYDICCENLKDLRLAHIITMRSDDEGLPAPTAQEIGLRFLLRKCKALEKLCLDYVVGLDEDEMIALFQNCSNLRSLSLRLMPLHQRDWHFRTPLTDESLKALGLSCPMLEVVELTFTFCSSGYPTEIGFTQKGIVALIQTCPIRAFMLNGANMFFDSGLEGISSAPFLEQLELLDCKGITDAGMSFIAHAPRLSSLTLRKCQDVTDNGIAKLAHSAKLESLTVVGCHQISREGVQGAARLVRYSADSESHDSLKGMKLTGKPTAPPVLETFAA

SEQ ID NO: 8529 - DNA, 1635 bp, Sorghum bicolor
  misc_feature: Ceres ANNOT ID no. 6091108
  misc_feature: Encodes the peptide sequence at SEQ ID NO 8530
atggcattgccggttcccctcgtccgcctggcgctgctgctgctcgtcgcgctgccattctgcggcgcacatcccggaccgggaggcttccctgcccctcgtcactcccagaggcccgcgctccactctgatggatttggcttgctggcaaggaggtcaattgctgaagctcctactgacatcaacgtcactacgaatagctcctttgtattggcggcagataggacatatcgaaaggatcccttgaatggtttcaggaaatacccgggcggctggaatatcagtgaagtgcactattttgcttccgtcggatatacagccattccgctgttcgctattgctctggcgtggtttgtgatctttttcctggttatgcttgggatttgctgccgtcatttctgttgcccgcatcacacctacaagtattctcgaacagcatatgctctgtcattgatacttctaatatttgctggatgtgctatgttatacgatggccagggcaaattccacaagagcacaacaactactctgaagtttgttgttagccaggcaaattatactgttgacaaccttaggaacctatctgatagtttgtcagctgcaaagaggattgacatagcaaattcctttttactgcctcctaatgtccaaagtcagataaatgaaatccaaggaaagctgaacacgtcagctactgatcttgctattaaaacaacagataatgccgcgaggataaaaaagttgctaaacagagtgcgccttgctttaattgtcattgcagcagtgatgcttcttctggcatttattgtgttatccatctttggtctggaattcattgtctctgtcttggttgttattggatggatattggttactgggacgtttatcctgtgcggtgtctttcttcttctgcacaatgttgtttcagatacttgtgttgcgatggaagagtgggttgctcatccaacagaacacaccgccctggatgaggttatcccctgtgtcgagcctgccacagcaaacgaatccctgtacagaagcaggcaggtcaccttcgagctggtgaacgtggtgaaccaggtgatcaccaacgtgtcgaatagaaacttccctccacagttgacacctttctactacaatcagtcagggccattgatgcctctgctctgcaatccattcacacctaatctgagggaccgcaactgcacccgaggggaggttaccttgtacaatgcaacccaggtttggaagaactacgaatgccagagcaaaaccgtctccggagccgagatttgcgccaccgtggggcgagtcacgcccagcatctacaggcagatgacggcgggcgtgacggtgagccaggggctgtaccagtacgggcctttcctcatccagctggaggactgcaccttcgtgcgcgacaccttcacgaccatcaaccagggctactgccctggcctggagcgctacagcaagtgggtgtacgtgggcctggtgatggtctcgtcagcggtgatgctgtcgctcatcttctgggtgatctacgccagggagcggcgccaccgcgtgtacagcaagcagcaccagccgtacccgctggaagacaagccggcgccaacagtcccgggcacctga

SEQ ID NO: 8530 - protein, 544 aa, Sorghum bicolor
  misc_feature: Ceres ANNOT ID no. 6091108
  misc_feature (315)..(522): NCBI GI: 90399088 NCBI Desc: h0413e07.1 [oryza sativa (indica cultivar-group)]
  misc_feature (65)..(510): NCBI GI: 115485019 NCBI Desc: os11g0264500 [oryza sativa (japonica cultivar-group)]
  misc_feature (315)..(522): NCBI GI: 90399088 NCBI Desc: h0413e07.1 [oryza sativa (indica cultivar-group)]
  misc_feature (65)..(510): NCBI GI: 115485019 NCBI Desc: os11g0264500 [oryza sativa (japonica cultivar-group)]
  misc_feature: Abnormal phyllotaxy, leaf number higher than wild-type
  misc_feature: Useful for making plants with modulated biomass
  misc_feature: GREAT-hit functional homolog of the protein sequence given in SEQ ID NO 13555
  misc_feature: Useful for making plants with modulated biomass
  misc_feature: Functional homolog of the protein sequence given in SEQ ID NO 13555
MALPVPLVRLALLLLVALPFCGAHPGPGGFPAPRHSQRPALHSDGFGLLARRSIAEAPTDINVTTNSSFVLAADRTYRKDPLNGFRKYPGGWNISEVHYFASVGYTAIPLFAIALAWFVIFFLVMLGICCRHFCCPHHTYKYSRTAYALSLILLIFAGCAMLYDGQGKFHKSTTTTLKFVVSQANYTVDNLRNLSDSLSAAKRIDIANSFLLPPNVQSQINEIQGKLNTSATDLAIKTTDNAARIKKLLNRVRLALIVIAAVMLLLAFIVLSIFGLEFIVSVLVVIGWILVTGTFILCGVFLLLHNVVSDTCVAMEEWVAHPTEHTALDEVIPCVEPATANESLYRSRQVTFELVNVVNQVITNVSNRNFPPQLTPFYYNQSGPLMPLLCNPFTPNLRDRNCTRGEVTLYNATQVWKNYECQSKTVSGAEICATVGRVTPSIYRQMTAGVTVSQGLYQYGPFLIQLEDCTFVRDTFTTINQGYCPGLERYSKWVYVGLVMVSSAVMLSLIFWVIYARERRHRVYSKQHQPYPLEDKPAPTVPGT

SEQ ID NO: 8531 - DNA, 1362 bp, Sorghum bicolor
  misc_feature: Ceres ANNOT ID no. 6091113
  misc_feature: Encodes the peptide sequence at SEQ ID NO 8532
atggcggcgctctgctccgcctccccagccatctccgcggcggcgtccctcgggtcgcctgcgcgccgggtcgcgtccctcctccgcctgcgcctccgcaccgcctcgtgctcctactccctcgcttcggcaccgcgggcggcggcggcgggggtgccgtcgtggcgagcgcgccggcggttcgtggcgtccgcggcttccaccacggatgcggaggagtgctctggggtggagacgctcatcccgcccgacaatcgcatccccgccacaatcatcaccggcttcctcggttccggcaagacaactttactgaatcacatcttgactgctcaccatggaaagcgaattgctgttattgaaaatgagtttggagaagtagacattgatggttcattagtcgctgcacaaactgctggagctgaggacataatgatgctaaataatggctgcctttgctgcacggtgcgtggcgatttagtccgtatgattggtgaattggtgaacaagaagaaggggaagtttgatcatattgttattgaaaccacaggtctagcaaatccagcacccattatacagacattctatgcagaggatgtagtttttaatgatgtcaagctggatggtgttgtcactttagttgatgcaaagcatgctagacttcatttggatgaagtaaagcccaagggtatagtcaacgaagcagttcagcaaattgcctatgctgacagaattatagttaacaaggttgatctggtcaatgaacctgaagtttcgtccttggttgagcgtataaggggtatcaatcgcatggctaatttgaagcgagctgagtatggtaaagttgatttggattatgttcttggaattggaggatttgatctggagaggattgagagtgctgttgctgagaagtcacatgaagaccacgcagaacatgaccatgaccaccaccatcatgagcatgagcatgaacacgaccatcaccatgatcatgaccatcatcaccatcatgatcatgatcatggacatgatcatcatgcacatgatcacactcatgatcctggtgtttcttctgtgagcattgtttgcgaaggggagatggatcttgaaaaggctgacttttggttggggaacctacttctggaacacagtgaggatatatacaggatgaagggactactttctgtcagtggaatgccacagcgatttgtctttcagggagtgcatgacattttccagggatctcctgagagaatgtgggagccaaatgaacctcgcatcaacaagattgtcttcatcggcaggaacctcaataaagaagagctggagaaggggttcaaggattgcctactgaagaaatag

SEQ ID NO: 8532 - protein, 453 aa, Sorghum bicolor
  misc_feature: Ceres ANNOT ID no. 6091113
  misc_feature (88)..(275): Pfam Id: cobW Pfam Desc: CobW/HypB/UreG, nucleotide-binding domain
  misc_feature (356)..(450): Pfam Id: CobW_C Pfam Desc: Cobalamin synthesis protein cobW C-terminal domain
  misc_feature (2)..(453): NCBI GI: 51090705 NCBI Desc: prli-interacting factor l-like [oryza sativa (japonica cultivar-group)]
  misc_feature (21)..(332): NCBI GI: 38345768 NCBI Desc: osjnba0083n12.6 [oryza sativa (japonica cultivar-group)]
  misc_feature (200)..(451): NCBI GI: 11139268 NCBI Desc: prli-interacting factor l [arabidopsis thaliana]
  misc_feature (86)..(340): NCBI GI: 75675110 NCBI Desc: cobalamin synthesis protein, cobw [nitrobacter winogradskyi nb-255]
  misc_feature (85)..(340): NCBI GI: 86574682 NCBI Desc: cobalamin synthesis protein, p47k [rhodopseudomonas palustris haa2]
MAALCSASPAISAAASLGSPARRVASLLRLRLRTASCSYSLASAPRAAAAGVPSWRARRRFVASAASTTDAEECSGVETLIPPDNRIPATIITGFLGSGKTTLLNHILTAHHGKRIAVIENEFGEVDIDGSLVAAQTAGAEDIMMLNNGCLCCTVRGDLVRMIGELVNKKKGKFDHIVIETTGLANPAPIIQTFYAEDVVFNDVKLDGVVTLVDAKHARLHLDEVKPKGIVNEAVQQIAYADRIIVNKVDLVNEPEVSSLVERIRGINRMANLKRAEYGKVDLDYVLGIGGFDLERIESAVAEKSHEDHAEHDHDHHHHEHEHEHDHHHDHDHHHHHDHDHGHDHHAHDHTHDPGVSSVSIVCEGEMDLEKADFWLGNLLLEHSEDIYRMKGLLSVSGMPQRFVFQGVHDIFQGSPERMWEPNEPRINKIVFIGRNLNKEELEKGFKDCLLKK

SEQ ID NO: 8533 - DNA, 444 bp, Sorghum bicolor
  misc_feature: Ceres ANNOT ID no. 6091114
  misc_feature: Encodes the peptide sequence at SEQ ID NO 8534
atggcgagcggcagcatgaagagggagatcagcgagacccacgacactctccgcttcggcctcaacgccggtgtcaaggctgacctcgcgccgccgcacccgctccagtccaccatccaatcggaggccaagttctgggcggacaagaagaagttcgggacagaggccatctacggatccgccttgaacatccgcaaggatctcgatgcccaaatcctctccagtctttcacttccccctttgcggttccaaagacctcctggtgctttgccatcatctttgcttggatatgaggcactgacaggttccctggatgattttggatttgaagattatcttaacatgcctcaagattctgacagtttccgtcaaccggatatgcaccacggaatggaggttcgccttggtttgtccaaggggcctatctgccctagcttcaattga

SEQ ID NO: 8534 - protein, 147 aa, Sorghum bicolor
  misc_feature: Ceres ANNOT ID no. 6091114
  misc_feature (2)..(138): Pfam Id: UMP1 Pfam Desc: Proteasome maturation factor UMP1
  misc_feature (1)..(147): NCBI GI: 51090706 NCBI Desc: proteasome maturation factor-like [oryza sativa (japonica cultivar-group)]
  misc_feature (1)..(120): NCBI GI: 115449275 NCBI Desc: os02g0801300 [oryza sativa (japonica cultivar-group)]
  misc_feature (14)..(146): NCBI GI: 9828633 NCBI Desc: f1n21.7 [arabidopsis thaliana]
  misc_feature (1)..(74): NCBI GI: 50726391 NCBI Desc: proteasome maturation factor-like protein [oryza sativa (japonica cultivar-group)]
  misc_feature (54)..(139): NCBI GI: 50726392 NCBI Desc: proteasome maturation factor-like protein [oryza sativa (japonica cultivar-group)]
MASGSMKREISETHDTLRFGLNAGVKADLAPPHPLQSTIQSEAKFWADKKKFGTEAIYGSALNIRKDLDAQILSSLSLPPLRFQRPPGALPSSLLGYEALTGSLDDFGFEDYLNMPQDSDSFRQPDMHHGMEVRLGLSKGPICPSFN

SEQ ID NO: 8535 - DNA, 954 bp, Sorghum bicolor
  misc_feature: Ceres ANNOT ID no. 6091116
  misc_feature: Encodes the peptide sequence at SEQ ID NO 8536
atgggcaaggcctccaaggacaagagagacatctactaccggaaggccaaagaggagggatggagagctcgcagcgccttcaagctcctccaaatagaccaggagttcaacatcttccatggagtgaagcgcgtggttgatctgtgtgctgctcccggaagctggagccaggttttgagccggaacttgtatgtaccagcaaaacagtctcctgattgcaaggaaggtgaccttcctctcatcgttgcaattgacttgcaaccaatggccccgatagaaggtgttatacaagtgcagggtgacatcaccaatgctcggacagcggaagtggttattaggcattttgatggatgcaaagcagacttggttgtttgcgatggagctccggatgttactggccttcatgatatggacgaatttgttcagtcccagcttatacttgcggcattgactatcgtgactcatgtactcaaagttggtggaaaatttgtcgcaaagatatttcggggtaaagatacaagtctcctgtactgccagctaaaactgttcttctcacaagttacatttgcgaagccaaaaagtagccggaactcaagcattgaggcatttgcagtttgtgagaactattcacctccagaagggttcaaggaggaagatctataccacctgctagagaaagtagggactccttcaggagttgacgatttagattgcagaagcggatggctcgagggaccaaacaaggtgtatatcccgttccttgcctgtggggatctcagtggctacgactccgaccgctcatacccgctcccaatcacagacggtggctcctaccggagcttggaccccgtccagcctcccatcgccccgccttacaaaaccgcccttcagatgaagaaggcctccagccacagcgccagcagggacgccatgaaaccatccacagactcttga

SEQ ID NO: 8536 - protein, 317 aa, Sorghum bicolor
  misc_feature: Ceres ANNOT ID no. 6091116
  misc_feature (21)..(211): Pfam Id: FtsJ Pfam Desc: FtsJ-like methyltransferase
  misc_feature (1)..(317): NCBI GI: 87162879 NCBI Desc: ribosomal rna methyltransferase rrmj/ftsj [medicago truncatula]
  misc_feature (1)..(305): NCBI GI: 21593533 NCBI Desc: cell division-like protein [arabidopsis thaliana]
  misc_feature (1)..(179): NCBI GI: 6759446 NCBI Desc: cell division-like protein [arabidopsis thaliana]
  misc_feature (1)..(316): NCBI GI: 55250314 NCBI Desc: zgc:101831 [danio rerio]
  misc_feature (1)..(270): NCBI GI: 123229058 NCBI Desc: ftsj homolog 1 (e. coli) [mus musculus]
MGKASKDKRDIYYRKAKEEGWRARSAFKLLQIDQEFNIFHGVKRVVDLCAAPGSWSQVLSRNLYVPAKQSPDCKEGDLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQLKLFFSQVTFAKPKSSRNSSIEAFAVCENYSPPEGFKEEDLYHLLEKVGTPSGVDDLDCRSGWLEGPNKVYIPFLACGDLSGYDSDRSYPLPITDGGSYRSLDPVQPPIAPPYKTALQMKKASSHSASRDAMKPSTDS

SEQ ID NO: 8537 - DNA, 2142 bp, Sorghum bicolor
  misc_feature: Ceres ANNOT ID no. 6091120
  misc_feature: Encodes the peptide sequence at SEQ ID NO 8538
atggaggcgagatcctcgtcctctgcggccgccgtgccgccgcccccctccataccctcgtccagcgaccagggcgtctgggctgacgtctcgccgctcctcgccgccgcttatctccaggatggggaacttgtacatggagaaaactttagtctatttgctgcaatgtctgcattggaaataatggatccaaaaatggattctggaattgagagaagtcgatacaactccgttgaagaggccatagaagatggtgttgcaccaatcccacttagcttggacaggacacttgatgttcaacgctctattgatgtcatggatcatcttttctcatgtgaggcaacatggcacaaggggcacactctagctcagactgtatttacatgtatctaccttatgagaatggagagaacttcatcgcatgctgtactaaatagcttttgcaggattttgcgtgctacttgtaatgctgtcatttctgttgtttctactgcccgaactcatgaggaagaggatctctttactatgtcttttgggctgcctttgagagatgaaggtgatgaaaagtgcctgtcaattctaaactcggttgaagagacaatatctcgtcaattacgtgcatgtcttgaatccctgcaggataatcctgatctggaagaggattactgcagagctctgttatgcagattacgttttcgtaagcatttctaccatgttgttatgtgcatgaggaaacctcatggaagaggattggagttggcccggaagcatgttgcttcatgcttgacagagcttaatttgatgcttaagtctcgggagtttctcaagtcccagtccagcactacgttacagcaaggtgatggaaactgcaccactgcttctggttgtcaacctgttggctttgatgttagcttaaacagcagacttttgagtcccacaccaccacgtgcggtaaaagtacttagctggagcgatgccatcaggtactttgagaggcttctgcatgatcttgatgtcatctgcacttcgtcgctcgatcctgtgcttgagaatgtgctttactttattgtacagttccaaaaaacagtgccagatttggttcctagagcatttcttcagactttattggtccaagatggcaaactttatggtgaacacttgttttctgatgtcatttcaagggctttatcactaccggacattattggagataaggaatttcagatgaatgagtttgttgtgcagctaggtcagttagttgtcaacttgataaaaattctttgtacaaacactgcatggcaacggcgcaagcttgggaagagtttacaggattggagtactatttccatacagttggagcttgctctgaaaagagagttcggtgaaactagaaatgtcttgcagaatgagaatatgtgcatgagagtatcaaagcaacttcttatttggactcaggagcatgcatactgggttgcttttcggtttctcacattgggtttcgaacttgacctatattctccaggcgaatattgtatggtgtactggtacatgtatgtggtgcttacaaagctaatagaaaagatgcagttacgagttcttgctattagcgaaacctcacgaagaaaggggaaaaagaagaaggatcactcaaaggattcagctcgggatataacattttcatcctcttgtttattgcttcaatgctatctcttgctatcagagggactctcaatgatgctagctgttctcagaaacgaaagtaggtcattccaattaccaagtatctttaacactgaacaagagagattcatgcagcactttgatcttcttctgaaagctcgagtccctgagcacatttccttctatagttttaaggaatcatcttcccgggcaggcatatcggatttggtgaaatacaacttcttcaaggaaattcagaagatagccccctctctaaggggcagtttcgcaagtgaatcagaaaaacttgccgaggtccgtcgtatagagcaggtagctgagcacaacaggatagccctaaatattatcaaccaagttggagctggcgatccatctctgagggtctcgtttgagtttacacaccaccctcactttgcagtggcagttgtgaagagatcatga

SEQ ID NO: 8538 - protein, 713 aa, Sorghum bicolor
  misc_feature: Ceres ANNOT ID no. 6091120
  misc_feature (27)..(213): Pfam Id: Mak10 Pfam Desc: Mak10 subunit, NatC N(alpha)-terminal acetyltransferase
  misc_feature (33)..(672): NCBI GI: 51090585 NCBI Desc: natc n(alpha)-terminal acetyltransferase, mak10 subunit-like [oryza sativa (japonica cultivar-group)]
  misc_feature (17)..(713): NCBI GI: 79554506 NCBI Desc: atmak10; acetyltransferase [arabidopsis thaliana]
  misc_feature (3)..(603): NCBI GI: 144925064 NCBI Desc: mak10 subunit, natc n(alpha)-terminal acetyltransferase [medicago truncatula]
  misc_feature (3)..(208): NCBI GI: 92895977 NCBI Desc: mak10 subunit, natc n(alpha)-terminal acetyltransferase [medicago truncatula]
  misc_feature (15)..(707): NCBI GI: 33989783 NCBI Desc: embryonic growth-associated [mus musculus]
MEARSSSSAAAVPPPPSIPSSSDQGVWADVSPLLAAAYLQDGELVHGENFSLFAAMSALEIMDPKMDSGIERSRYNSVEEAIEDGVAPIPLSLDRTLDVQRSIDVMDHLFSCEATWHKGHTLAQTVFTCIYLMRMERTSSHAVLNSFCRILRATCNAVISVVSTARTHEEEDLFTMSFGLPLRDEGDEKCLSILNSVEETISRQLRACLESLQDNPDLEEDYCRALLCRLRFRKHFYHVVMCMRKPHGRGLELARKHVASCLTELNLMLKSREFLKSQSSTTLQQGDGNCTTASGCQPVGFDVSLNSRLLSPTPPRAVKVLSWSDAIRYFERLLHDLDVICTSSLDPVLENVLYFIVQFQKTVPDLVPRAFLQTLLVQDGKLYGEHLFSDVISRALSLPDIIGDKEFQMNEFVVQLGQLVVNLIKILCTNTAWQRRKLGKSLQDWSTISIQLELALKREFGETRNVLQNENMCMRVSKQLLIWTQEHAYWVAFRFLTLGFELDLYSPGEYCMVYWYMYVVLTKLIEKMQLRVLAISETSRRKGKKKKDHSKDSARDITFSSSCLLLQCYLLLSEGLSMMLAVLRNESRSFQLPSIFNTEQERFMQHFDLLLKARVPEHISFYSFKESSSRAGISDLVKYNFFKEIQKIAPSLRGSFASESEKLAEVRRIEQVAEHNRIALNIINQVGAGDPSLRVSFEFTHHPHFAVAVVKRS

SEQ ID NO: 8539 - DNA, 1653 bp, Sorghum bicolor
  misc_feature: Ceres ANNOT ID no. 6091122
  misc_feature: Encodes the peptide sequence at SEQ ID NO 8540
atggcgggaggtggcacgggcatcagaaaatacatgggtgctctcaaggacaccacaacagttagcatagcaaaagtgaacagcgattacaaggagttggacattgctattgtgaaggccacaaaccatgtcgagaatccaacaaaggagaaatacataagagaaatcttctaccatctgtcacctggaaggcctcgggcggatgtagcctactgcatccgcacccttggtagacgtctttcaaagacacgcaactgggcggttgctctgaagacattaattgtcatacaccgtgctcttctggaagttggtcctgctttccgtgaagagcttatcagttatggaagatcaagctcccatatgctctatctgtcctactttaaggacgattccagtgcagaagcctgggattactctgcttgggtgcgcaactatgctttatatttggaggagaaacttgaatctttccgtgtactgaactatgatgttgaaaaggatccatcgaaaattcaggatcttgatacaagtggattgctcaatcagttgccagctttacagcagcttctttttcgactacttggttgccagccacaaggggcatcatcttataacatcataattcagcatgcgctttcaatggttgctctagagagtgttaggatccaaacagccatcaatgatgggatactcaatcttgttgacaagttctttgagatgaagagagatgatgcaataagggcacttgacatgtataaaagagcaattgaacaggcagaacaactttcagaattttatgaagtgtgtaaaagtatacatattgggcggggtgagagattcctaaaaatcgaacagccgcctgcatcgttcttggcaactatggaggaatatgtgagcaatgctccgcttgcttcaacagttcagagaaatcaggctgtactggccatagagtacaacaaaaaatcagaagttgaagaaccatcaacgttgcctcctcccccacctccagctcaagaacctgagcctgagcctgagccagttaaacaagtcccacctgtggctgaaccaacagatttactgggaatcaatgaatcaacccctgacacatctgaaatagatcaaaagaatgcagcggccttggccattgttccacaggataatgcgctcaaagctgctcctaccagtactgaaagtgttgccactagctgggagctggccctagtcactgcacccagttcaaatgggaatgctgttacatcaagcaaaatggccggtggactggacctgcttacacttgacagtctatacaatgaggcacaccaaagagcgcagcagaacgcaagctacaacccttgggagaccaatccagcatcaggtccagtgattcagcagccaatgtacgacccgttctatgcctccaatcccatggctgcagcccgcagcgttcagatggctgccatggagcagcagcaacatgccttcatgctccagcagcaacagcaacagcagcagcagatgatgatgatggcacagcagcagcaacaagcttcttcaaatcctttcgccaacctatatatgcacgctggcgcccacccttacgctgcaggggtgcagctccatgcaggcaacgcatactctggaactgggatgatgtag

SEQ ID NO: 8540 - protein, 550 aa, Sorghum bicolor
  misc_feature: Ceres ANNOT ID no. 6091122
  misc_feature (30)..(300): Pfam Id: ANTH Pfam Desc: ANTH domain
  misc_feature (30)..(159): Pfam Id: ENTH Pfam Desc: ENTH domain
  misc_feature (1)..(536): NCBI GI: 51090587 NCBI Desc: clathrin assembly protein ap180 short form-like [oryza sativa (japonica cultivar-group)]
  misc_feature (1)..(546): NCBI GI: 144925059 NCBI Desc: anth [medicago truncatula]
  misc_feature (5)..(504): NCBI GI: 50251206 NCBI Desc: synaptosomal-associated protein 91-like [oryza sativa (japonica cultivar-group)]
  misc_feature (9)..(550): NCBI GI: 56785152 NCBI Desc: clathrin assembly protein ap180 short form-like [oryza sativa (japonica cultivar-group)]
  misc_feature (3)..(532): NCBI GI: 52077380 NCBI Desc: phosphoprotein-like [oryza sativa (japonica cultivar-group)]
MAGGGTGIRKYMGALKDTTTVSIAKVNSDYKELDIAIVKATNHVENPTKEKYIREIFYHLSPGRPRADVAYCIRTLGRRLSKTRNWAVALKTLIVIHRALLEVGPAFREELISYGRSSSHMLYLSYFKDDSSAEAWDYSAWVRNYALYLEEKLESFRVLNYDVEKDPSKIQDLDTSGLLNQLPALQQLLFRLLGCQPQGASSYNIIIQHALSMVALESVRIQTAINDGILNLVDKFFEMKRDDAIRALDMYKRAIEQAEQLSEFYEVCKSIHIGRGERFLKIEQPPASFLATMEEYVSNAPLASTVQRNQAVLAIEYNKKSEVEEPSTLPPPPPPAQEPEPEPEPVKQVPPVAEPTDLLGINESTPDTSEIDQKNAAALAIVPQDNALKAAPTSTESVATSWELALVTAPSSNGNAVTSSKMAGGLDLLTLDSLYNEAHQRAQQNASYNPWETNPASGPVIQQPMYDPFYASNPMAAARSVQMAAMEQQQHAFMLQQQQQQQQQMMMMAQQQQQASSNPFANLYMHAGAHPYAAGVQLHAGNAYSGTGMM

SEQ ID NO: 8541 - DNA, 420 bp, Sorghum bicolor
  misc_feature: Ceres ANNOT ID no. 6091127
  misc_feature: Encodes the peptide sequence at SEQ ID NO 8542
atggcactatcacgaagtatgagaacatgtttgcagagtggaaggcttgcccttcttgccatattggtctctagtggaattgtcttgcaaatcttggcttgtgctctctataacaactggtggccaatgctaacagttctgatgtatcttatcctaccaatgcccctcatatttttcctgggttcggatacttcctcaatcatgtctaatgggggagacagttgggtgaacttcacaaaattcttgacgggcgcatcaatagtggggagcattgccattccgtcgatcctgaagcacgctggcgtcattggatggggagccctgacgatggagctatcatcctttgtggtctttggcgtggcaatcctgtggttcatccagatgaacggtgaagaggacgagtacagcggtgtgttctag

SEQ ID NO: 8542 - protein, 139 aa, Sorghum bicolor
  misc_feature: Ceres ANNOT ID no. 6091127
  misc_feature (16)..(134): Pfam Id: Vps55 Pfam Desc: Vacuolar protein sorting 55
  misc_feature (7)..(136): NCBI GI: 92896112 NCBI Desc: vacuolar protein sorting 55 [medicago truncatula]
  misc_feature (14)..(133): NCBI GI: 115442447 NCBI Desc: os01g0966500 [oryza sativa (japonica cultivar-group)]
  misc_feature (22)..(133): NCBI GI: 57900172 NCBI Desc: vacuolar protein sorting 55 family-like [oryza sativa (japonica cultivar-group)]
  misc_feature (22)..(133): NCBI GI: 18399269 NCBI Desc: vacuolar protein sorting 55 family protein / vps55 family protein [arabidopsis thaliana]
  misc_feature (15)..(134): NCBI GI: 44984898 NCBI Desc: afr351cp [eremothecium gossypii]
MALSRSMRTCLQSGRLALLAILVSSGIVLQILACALYNNWWPMLTVLMYLILPMPLIFFLGSDTSSIMSNGGDSWVNFTKFLTGASIVGSIAIPSILKHAGVIGWGALTMELSSFVVFGVAILWFIQMNGEEDEYSGVF

SEQ ID NO: 8543 - DNA, 2433 bp, Sorghum bicolor
  misc_feature: Ceres ANNOT ID no. 6091145
  misc_feature: Encodes the peptide sequence at SEQ ID NO 8544
atgtacgtggtgaagcgcgacggccggcaggagtcggtccacttcgacaagatcaccgcgcggctcacgaggcttagctacggcctcagcgcggagcactgcgaccccgtccttgtcgcccagaaggtctgcgccggcgtctacaagggcatcaccaccggcgagattggtgagctcgccgccgagaccgccgccgccatgaccacctcgcatcccgactacgcatcgctggcggcgaggatcgcggtctccaatctgcacaagaacaccatgacgtccttttcagcgacggtaaaggctctctatacgcattatgacgagaggtctggtttgatggctcccctgattgctgatgatgtcttcacgatcattatgaagaatactgctcgcttggagtgtgagataaattatgaccgagatttcgactatgattattttggttttaagactcttcagaggtcctatctgttgaaaattggtggaaaggtcgcggaaaggccgcaacatatgttgatgagagtttctgtcggcatacataaggatgatattgaatctgctatcaaaacataccacatgatgtctcaacgctggtttactcatgcttccccaaccctgttcaacgctggcactccaaggccgcaattaagtagctgcttccttatctgcatgaaagatgatagtattgaaggaatttatgatactctctcagaatgtgctgccataagcaaatctgctggaggaattggtgtctcaattcacaatattcgagctactgggagttatattcgaggaacaaatggaacttctaatggaattgttcctatgctacgtgttttcaatgatactgcccgttatgttgatcaaggcggaggcaagagaaaaggtgcatttgctgtttatttggagccttggcatcctgatatctttgagttccttgatctaaaaaagaaccatggaaaggaggagaatcgtgcaagggatcttttctatgctttgtgggttcctgatctatttatggaaagggtacaacataatgaacagtggtcactattttgccccagtgaagctcctggtctggctgattgctggggtgatgagtttcagaatctgtaccagaaatatgaaagagaaggcaaggcaaagaaagtggttgcagcgcaggccctctggttcgatattttaaaggcacagatagaaactggaactccctatatgctttacaaggatgcttgcaacagaaaaagtaaccaacaaaatcttggcacaattaagtcctccaacttgtgtactgagataattgagtatacaagtccttctgaaactgctgtgtgcaatcttgcgtcaattgctttaccacgttttgtgagggaaaagggtgttcctatagaatctcatccagctaagcttgttggtagcagcggatcgaaaaatagatactttgactttgataaattagctgagattacttcaattgttacatgtaatctcaacaaaatcattgatattagctattatcccattgagaatgcaaggaggtcaaatatgaggcatagaccaattgggataggcgttcaaggcttggcagatacttttattctacttggaatgccatttgattcaccagaggcccagcagttaaataaagatatttttgaaactatttattatcactcgttgaaagcttctgctgaacttgctgcaaaagaaggcccttatgaaacatatgctgggagccctgtcagcaagggcattcttcaacctgatatgtggaatgtagtgccatctagtaggtggaactggtcagcaataagggaaatgatttctcaggtgggattgaggaactctcttcttgttgctcctatgccaactgcttccactagtcaaattcttggcaacaatgagtgctttgaaccatacacctcaaatatatacagtcgacgagttttgagcggtgaatttgttgtagtaaataagcatcttctccatgatttgagtgagatgggtgtctggtctcctgttctaaagaacaagattatctatgaggatggttctgtccaaaaaattaccgaagttccagatgatctaaaagcaatttacaagactgtttgggagatcaagcagaaaactattgttgacatggccattgaccgtggttgctatatcgatcagagccagagccttaatatccacatggaacaaccaaactctgggaagctaacttcattgcacttccatggttggtcaaagggcctcaaaacagggatgtattacttaagaactcgagctgctgctgatgcaatcaagtttacagttgatactactcttctcaaggataagcagccgacttcagaagaagaggatgcccaggttaaaatggcacaagtggcctgttccttgaacaaccgggaggagtgcttagcatgtggaagttag

SEQ ID NO: 8544 - protein, 810 aa, Sorghum bicolor
  misc_feature: Ceres ANNOT ID no. 6091145
  misc_feature (215)..(762): Pfam Id: Ribonuc_red_lgC Pfam Desc: Ribonucleotide reductase, barrel domain
  misc_feature (141)..(213): Pfam Id: Ribonuc_red_lgN Pfam Desc: Ribonucleotide reductase, all-alpha domain
  misc_feature (1)..(91): Pfam Id: ATP-cone Pfam Desc: ATP cone domain
  misc_feature (1)..(810): NCBI GI: 27261142 NCBI Desc: ribonucleotide reductase large subunit a [glycine max]
  misc_feature (1)..(810): NCBI GI: 4151068 NCBI Desc: ribonucleotide reductase [nicotiana tabacum]
  misc_feature (1)..(810): NCBI GI: 4151066 NCBI Desc: ribonucleotide reductase [nicotiana tabacum]
  misc_feature (1)..(810): NCBI GI: 27261144 NCBI Desc: ribonucleotide reductase large subunit b [glycine max]
  misc_feature (1)..(810): NCBI GI: 92895493 NCBI Desc: ribonucleotide reductase r1 subunit, n-terminal [medicago truncatula]
  misc_feature (1)..(810): SWISSPROT Homolog: EC 1.17.4.1 Ribonucleoside-diphosphate reductase large subunit
MYVVKRDGRQESVHFDKITARLTRLSYGLSAEHCDPVLVAQKVCAGVYKGITTGEIGELAAETAAAMTTSHPDYASLAARIAVSNLHKNTMTSFSATVKALYTHYDERSGLMAPLIADDVFTIIMKNTARLECEINYDRDFDYDYFGFKTLQRSYLLKIGGKVAERPQHMLMRVSVGIHKDDIESAIKTYHMMSQRWFTHASPTLFNAGTPRPQLSSCFLICMKDDSIEGIYDTLSECAAISKSAGGIGVSIHNIRATGSYIRGTNGTSNGIVPMLRVFNDTARYVDQGGGKRKGAFAVYLEPWHPDIFEFLDLKKNHGKEENRARDLFYALWVPDLFMERVQHNEQWSLFCPSEAPGLADCWGDEFQNLYQKYEREGKAKKVVAAQALWFDILKAQIETGTPYMLYKDACNRKSNQQNLGTIKSSNLCTEIIEYTSPSETAVCNLASIALPRFVREKGVPIESHPAKLVGSSGSKNRYFDFDKLAEITSIVTCNLNKIIDISYYPIENARRSNMRHRPIGIGVQGLADTFILLGMPFDSPEAQQLNKDIFETIYYHSLKASAELAAKEGPYETYAGSPVSKGILQPDMWNVVPSSRWNWSAIREMISQVGLRNSLLVAPMPTASTSQILGNNECFEPYTSNIYSRRVLSGEFVVVNKHLLHDLSEMGVWSPVLKNKIIYEDGSVQKITEVPDDLKAIYKTVWEIKQKTIVDMAIDRGCYIDQSQSLNIHMEQPNSGKLTSLHFHGWSKGLKTGMYYLRTRAAADAIKFTVDTTLLKDKQPTSEEEDAQVKMAQVACSLNNREECLACGS

SEQ ID NO: 8545 - DNA, 831 bp, Sorghum bicolor
  misc_feature: Ceres ANNOT ID no. 6091146
  misc_feature: Encodes the peptide sequence at SEQ ID NO 8546
atgacggcgacggaggcggcgctcaggctcgggctctcagcgacggcggggcagtcccaggctcggcggcggcatcagcggctcctcctcccgcctctctccagtagcctcacgacctcgcctccgtcctccgcacaccggccggcgaccctgcgattcaaatctgtatcacatggtgtttcttcacagcatgctgagaggatacactgccgttcttctctcaggcaaaacacaatagttgcatctgagaacgaaaatccacctttaatgccggcaatcatgactcctggtggtgctcttgatctcgcaactgtactactgggaaatcgtgtaatctttattggtcaatatattaactcccaggtggcacaacgtgtgatatcacagcttgtcacacttgctgccgtcgatgaagaggctgatattctgatctatcttaattgccctggtggaagtctctattcgatcttagcgatttatgattgcatgtcctggataaagcccaaagttgggacagtgtgctttggtgttgttgctagtcaagcagcaatcatccttgcaggcggcgaaaagggaatgcgctatgcgatgccaaatgctagagtaatgattcatcaacctcaaggtggatcagagggtaatgtggaggaggtgaggcgacaggttggagaaaccgtctatgctcgtgataaagttgataaaatgtttgctgctttcaccgggcaaccacttgacatggtgcaacagtggacagagagggatcggttcatgtcttcttcagaggccatggatttcggattggttgatgccttactggaaacaagatactag

SEQ ID NO: 8546 - protein, 276 aa, Sorghum bicolor
  misc_feature: Ceres ANNOT ID no. 6091146
  misc_feature (96)..(275): Pfam Id: CLP_protease Pfam Desc: Clp protease
  misc_feature (13)..(276): NCBI GI: 602758 NCBI Desc: clp-like energy-dependent protease
  misc_feature (70)..(276): NCBI GI: 2921510 NCBI Desc: clp-like energy-dependent protease [fritillaria agrestis]
  misc_feature (79)..(276): NCBI GI: 2827888 NCBI Desc: atp-dependent clp protease proteolytic subunit [arabidopsis thaliana]
  misc_feature (68)..(272): NCBI GI: 16332068 NCBI Desc: atp-dependent clp protease proteolytic subunit [synechocystis sp. pcc 6803]
  misc_feature (89)..(272): NCBI GI: 16080507 NCBI Desc: atp-dependent clp protease proteolytic subunit (class iii heat-shock protein) [bacillus subtilis subsp. subtilis str. 168]
MTATEAALRLGLSATAGQSQARRRHQRLLLPPLSSSLTTSPPSSAHRPATLRFKSVSHGVSSQHAERIHCRSSLRQNTIVASENENPPLMPAIMTPGGALDLATVLLGNRVIFIGQYINSQVAQRVISQLVTLAAVDEEADILIYLNCPGGSLYSILAIYDCMSWIKPKVGTVCFGVVASQAAIILAGGEKGMRYAMPNARVMIHQPQGGSEGNVEEVRRQVGETVYARDKVDKMFAAFTGQPLDMVQQWTERDRFMSSSEAMDFGLVDALLETRY

SEQ ID NO: 8547 - DNA, 2568 bp, Sorghum bicolor
  misc_feature: Ceres ANNOT ID no. 6091147
  misc_feature: Encodes the peptide sequence at SEQ ID NO 8548
  misc_feature: Up-regulated in shoot tissues in response to methyl jasmonate treatment
  misc_feature: Up-regulated in root tissues in response to methyl jasmonate treatment
atggacacggtcgagaagatcgtcgaggacttcgcctcggacatcgccctgagccccttctcctccgggacgagcctccgggagatgatacgcgcgatacgcacgtgcaagacggcggcggaggagcgcgcggtggtgcggcgggaatgcgcggcgatacgcacggccatcagcgagaatgagccggtgctccggcacagaaacatggccaagctcatgttcatccacatgctcggctaccccacccatttcgcccagatggagtgcctcaagctcatcgcggccacggggtacccggagaagcgggtgggctacctcggcctcatgctgctcctcgacgagcgtcaggaggtgctcatgctcgtcaccaactccctcaaacaagatctcaaccacacgaaccagttcatcgtgggtcttgcactgtgtgctcttgggaacatctgctctgctgaaatggcacgggatctttcacctgaagtggagagcttgatgcgcactagggatgtcaatacaaagaaaaaggctgctttgtgctctataaggattgtcaggaaagtgccagatttggcagagaacttcatgggactggctgcatcattgttgaaggaaaaacaccatggggttcttatatcagcaattcagctctgcacagaactatgcaaagcaagcagagatgctctagagtacctgagaaagaactgcattgaaggtttggtgcgcatactgagagatgtgtccaatagttcatatgctcctgagtatgatgtttctggcattgttgatccattcttgcatattcgagtccttaaacttttgcggatcctgggtcaaggagatgcagattgcagtgaatatatgaatgatattcttgctcaggttgcaacaaaaactgagtccaacaagaatgctggaaatgccattctgtacgagtgtgttcagactataatgggtattgaagctactagtggtttgcgtgttctggcaatcaatattttgggtagattcttgtctaaccgtgacaacaatataagatatgttgctcttaacatgcttatgagggccattgcagttgatgcactagcagttcagaggcacagaacaacaatattagagtgtgtaaaggatgccgatgcctccattcgcaaaagggctcttgagcttgtttatttgttagtcaatgatacaaacgtaaagcctttgactaaagagctcattgattacttaaacatagcggatccagactttataggagatctcacagtaaagatatgctctatagttgaaaagttttctcaagagaagttatggtaccttgaccagatgttcaaggttttatctctggctggaaatcatgtgaaggatgatatatgttatgcccttattgttgtactaagtaatacagcagagcttcaaggatattcagtgaggtcattgtataaggccttacaatcatttggtaaacagggaagtttagtaagagtagctgtttggtgcattggtgaatatggtgaaatgctggtgaacaatgttggcatgctggacggggaggagccagttaaggtaacagaatctgatgctgtgggtatcgtagaggtcgctcttaaccgctactcagcagatgtgacaactggagctatgtgtctggttgctcttctgaagctctcctcacgatttccttcgatgtcagagagggtaaaacaaatagttgcccagaataaagagaatgttgtgcttgaactacagcaaagatcaattgaattcacttccattatacaaagacatcagtctatcagatcatccttgcttgaacgcatgcctgtattggatgaagctagttatctggtgaagcgggctactgctacacaagcaactatttcagcagataaacttgccccaacagtcactcctggaagccttaagcttccgaatggtgtagcaaaacccacctcagctcctttagctgatttgcttgatttgagttctgatggtgccccagcttcaaccgttgcttctactacaacacctaatgattttttgcaagatcttctgggtattggtggagtgagttcatcaacgacaggtgtaacttcgaccgcaagcacggatattcttatggatcttctgtccattgggtcatctccatcacagaatggcactcccgtaacagacttccatcatcctggacaaggacttgagaatacaacccatccatcaataacagctttccagagtgcaaccttgaagatcacgttcgatttcaaaaggaagcctggaaacccacgagagactacaattcatgccacttttacaaatttgacatctagtacttttacagattttatttttcaggctgctgttccaaagttcatcgaattgagactggatccggctagtggcaacactgttccagcaaatggaaatggttcggtcacacaagggctcaacgtgaccaataaccaacagggacagaaaccgcttgcaatgcgtatccggatgtcgtacaaagtgaatggcaaggacagattggaacaaggccaagtcagcaattttccttctggactatag

SEQ ID NO: 8548 - protein, 855 aa, Sorghum bicolor
  misc_feature: Ceres ANNOT ID no. 6091147
  misc_feature (42)..(596): Pfam Id: Adaptin_N Pfam Desc: Adaptin N terminal region
  misc_feature (732)..(852): Pfam Id: Alpha_adaptinC2 Pfam Desc: Adaptin C-terminal domain
  misc_feature (17)..(720): NCBI GI: 145336886 NCBI Desc: clathrin binding [arabidopsis thaliana]
  misc_feature (17)..(720): NCBI GI: 4249386 NCBI Desc: strong similarity to gbaf061286 gamma-adaptin 1 from arabidopsis thaliana. est gbh37393 comes from this gene
  misc_feature (17)..(720): NCBI GI: 4538987 NCBI Desc: adaptor protein complex ap-1 large subunit; gamma-adaptin 2 [arabidopsis thaliana]
  misc_feature (17)..(720): NCBI GI: 4704741 NCBI Desc: gamma-adaptin 1 [arabidopsis thaliana]
  misc_feature (29)..(539): NCBI GI: 9369391 NCBI Desc: t23e23.7 [arabidopsis thaliana]
  misc_feature: Up-regulated in shoot tissues in response to methyl jasmonate treatment
  misc_feature: Up-regulated in root tissues in response to methyl jasmonate treatment
MDTVEKIVEDFASDIALSPFSSGTSLREMIRAIRTCKTAAEERAVVRRECAAIRTAISENEPVLRHRNMAKLMFIHMLGYPTHFAQMECLKLIAATGYPEKRVGYLGLMLLLDERQEVLMLVTNSLKQDLNHTNQFIVGLALCALGNICSAEMARDLSPEVESLMRTRDVNTKKKAALCSIRIVRKVPDLAENFMGLAASLLKEKHHGVLISAIQLCTELCKASRDALEYLRKNCIEGLVRILRDVSNSSYAPEYDVSGIVDPFLHIRVLKLLRILGQGDADCSEYMNDILAQVATKTESNKNAGNAILYECVQTIMGIEATSGLRVLAINILGRFLSNRDNNIRYVALNMLMRAIAVDALAVQRHRTTILECVKDADASIRKRALELVYLLVNDTNVKPLTKELIDYLNIADPDFIGDLTVKICSIVEKFSQEKLWYLDQMFKVLSLAGNHVKDDICYALIVVLSNTAELQGYSVRSLYKALQSFGKQGSLVRVAVWCIGEYGEMLVNNVGMLDGEEPVKVTESDAVGIVEVALNRYSADVTTGAMCLVALLKLSSRFPSMSERVKQIVAQNKENVVLELQQRSIEFTSIIQRHQSIRSSLLERMPVLDEASYLVKRATATQATISADKLAPTVTPGSLKLPNGVAKPTSAPLADLLDLSSDGAPASTVASTTTPNDFLQDLLGIGGVSSSTTGVTSTASTDILMDLLSIGSSPSQNGTPVTDFHHPGQGLENTTHPSITAFQSATLKITFDFKRKPGNPRETTIHATFTNLTSSTFTDFIFQAAVPKFIELRLDPASGNTVPANGNGSVTQGLNVTNNQQGQKPLAMRIRMSYKVNGKDRLEQGQVSNFPSGL

SEQ ID NO: 8549 - DNA, 1179 bp, Sorghum bicolor
  misc_feature: Ceres ANNOT ID no. 6091155
  misc_feature: Encodes the peptide sequence at SEQ ID NO 8550
atgggctccttgtactgcgacgtggccgcctcgccgtccttctccagcaccggaagcagcagcggcagcagcggcaatgttgccgccggcggcgacggcagcgtcaggatatacgtgtgctttgcgctgggcagctccaacagcctcgagtgctacgagccttgcgccaacacgtggcgccgcgtgggcgcgctcccgggcgtccctgacggccacatactgaaggggttcgccgtggcggcgctgggcgaatccgtgtacatcatcggcggccggctctgccggagggagcgttgtgacgaggccggcgagtaccatgacaccgacgtcgacgtgagggcagacgtgctgcggtacgacgcgcgccggggcgagtggcaccactgcgcgccgctcctggtcccgcgattcgactttgcctgtgcgccgtgccgaggcaggatctgtgtggccggcggccagtgctcgctgtccggtgcccggggcacggcggcggccgaggtgtacgatgcggagaaggggcagtggtccgcgctccccgacatgagcacgctgcgctacaagtgcgtcggcgtgacgtggcagggcagcttccacgtcgtggggggcttcgcggagagcacgctgacggccagcgacgccaccctcctggcgcccggagccaccgtgctgcagtcatcggcgctggagcggagctcggccgaggtgttccactgcgcgaggggcatgtgggagatcctcccggggatgtggcagctcgacgtgcccccgaaccagatcgtggcggtggccaacaggctgttcagctccggcgactgccttaacagctggaagggccatgtcgaggtctacgacggcgagctcaacatctggagcatcttggaccactccgccctgcctgacctgtcgctgctcgccagcctcccgtcttcagcccagcggctctacctcaccatggccgccgtcggcacgcagctctacttcctcgccgggtaccaggtgccgtcgagcgatgacagcttcagaacagtctcgctggtgcacagcttcgacaccagcgctgcacctgggctggtgcccgcgtggagcagcttccggcccgagatgagtcaggaggacgccgaggacggcggcaaggagctcttcagccagtgctgctcggtgcagctctccagctaa

SEQ ID NO: 8550 - protein, 392 aa, Sorghum bicolor
  misc_feature: Ceres ANNOT ID no. 6091155
  misc_feature (135)..(183): Pfam Id: Kelch_1 Pfam Desc: Kelch motif
  misc_feature (45)..(206): NCBI GI: 4966346 NCBI Desc: contains two pf01344 kelch motif domains. [arabidopsis thaliana]
  misc_feature (52)..(191): NCBI GI: 22328264 NCBI Desc: kelch repeat-containing f-box family protein [arabidopsis thaliana]
  misc_feature (44)..(217): NCBI GI: 3176664 NCBI Desc: contains similarity to beta scruin gbz47541 from limulus polyphemus. ests gbt04493 and gbaa585955 come from this gene. [arabidopsis thaliana]
  misc_feature (37)..(209): NCBI GI: 48716191 NCBI Desc: kelch repeat-containing f-box protein-like [oryza sativa (japonica cultivar-group)]
  misc_feature (39)..(201): NCBI GI: 42572771 NCBI Desc: kelch repeat-containing f-box family protein [arabidopsis thaliana]
  misc_feature: The sequence is a functional homolog of SEQ ID NO. 315 in the 11/188,298 US application
  misc_feature: The sequence is a functional homolog of SEQ ID NO. 440 in the 11/188,298 US application
MGSLYCDVAASPSFSSTGSSSGSSGNVAAGGDGSVRIYVCFALGSSNSLECYEPCANTWRRVGALPGVPDGHILKGFAVAALGESVYIIGGRLCRRERCDEAGEYHDTDVDVRADVLRYDARRGEWHHCAPLLVPRFDFACAPCRGRICVAGGQCSLSGARGTAAAEVYDAEKGQWSALPDMSTLRYKCVGVTWQGSFHVVGGFAESTLTASDATLLAPGATVLQSSALERSSAEVFHCARGMWEILPGMWQLDVPPNQIVAVANRLFSSGDCLNSWKGHVEVYDGELNIWSILDHSALPDLSLLASLPSSAQRLYLTMAAVGTQLYFLAGYQVPSSDDSFRTVSLVHSFDTSAAPGLVPAWSSFRPEMSQEDAEDGGKELFSQCCSVQLSS

SEQ ID NO: 8551 - DNA, 1344 bp, Sorghum bicolor
  misc_feature: Ceres ANNOT ID no. 6091156
  misc_feature: Encodes the peptide sequence at SEQ ID NO 8552
atgggcagcctccgcgtcgccggcttggcatgggccgctgccgcctcgccggaatggggagtgcgccgcagccgtcgctgctgccgcggggtgccgctggcccgcccccgcgcggcggcggcctccctcggggcggggcagctccgggtcgggacggagcacgggtggctctgggactgccgcagcggcggcgcgagggattacgccagggagatggaggtggcggtgcgcatcgtgcaggtcgcctgcaccttgtgccagcgcgtgcaggactcgcttctccgccccggccccgacgccggcggcggcggccgcgtccatgccaagcttgaccgctcccccgtcaccgtcgctgattggggtgttcaagcaacagtaagctggctgctttccagttcctttcatgatgagaacatatctatcgttgccgaagaagatgatgagacactgtctagtagtgatggtgcaactttgcttgaatctgttgttgaggctgtcaatggctgcctggttgaagctcctaactatgggctgagatcccctgagaaagatctcggagctcatgatgttattcaagccatacggaaatgcagctcaactggaggccctaaaggaagattttgggtgcttgatcctgtcgacggcacccttggttttgtgagaggggaccaatatgctattgctcttgccttgattgaagatggagaagttatacttggtgttcttgggtgcccaaattatccaatgaagaaggagtggctcaactatcatcaaaagtactacaggttgatgtctaaggttgctcctcctccactggggtcctggaataagggttgtgtgatgtatgcccagaaaggttgtggccaagcttggatgcagccactggtccatgacttcggtaagctaaattggcaccacccaagggagattcaagtatcatccatcagtgatccaatctcagctacgttctgtgaaccagttgagaaagccaactcaagccattccttcacagcaggacttgctcaaagtgtaggattaaggaatcaacctctgcgcgtgtacagcatggtgaaatatgctgcaatagcacgaggtgatgctgagatcttcatgaaatttgcaagagctggatacaaagagaagatatgggatcatgctgcaggggtggttatcattaaggaggctggtggagtggtcacagatgctggaggccacccattggacttctcaaggggtgtttacctggaaggtttggatagaggcataatagcttgttctggagcattgcttcatcgtagaattttagatgctgttgatgcgagttggaactcatcaacactatga

SEQ ID NO: 8552 - protein, 447 aa, Sorghum bicolor
  misc_feature: Ceres ANNOT ID no. 6091156
  misc_feature (67)..(443): Pfam Id: Inositol_P Pfam Desc: Inositol monophosphatase family
  misc_feature (15)..(447): NCBI GI: 115449335 NCBI Desc: os02g0805500 [oryza sativa (japonica cultivar-group)]
  misc_feature (71)..(447): NCBI GI: 2736075 NCBI Desc: pap-specific phosphatase; hal2-like protein [arabidopsis thaliana]
  misc_feature (68)..(249): NCBI GI: 29029098 NCBI Desc: at5g63980 [arabidopsis thaliana]
  misc_feature (68)..(249): NCBI GI: 145359623 NCBI Desc: sal1 (fiery1); 3'(2'),5'-bisphosphate nucleotidase/ inositol or phosphatidylinositol phosphatase [arabidopsis thaliana]
  misc_feature (68)..(249): NCBI GI: 14268820 NCBI Desc: diphosphonucleotide phosphatase 1 [zea mays]
  misc_feature (71)..(447): SWISSPROT Homolog: EC 3.1.3.7 PAP-specific phosphatase HAL2-like (3'(2'),5'-bisphosphate nucleotidase)
MGSLRVAGLAWAAAASPEWGVRRSRRCCRGVPLARPRAAAASLGAGQLRVGTEHGWLWDCRSGGARDYAREMEVAVRIVQVACTLCQRVQDSLLRPGPDAGGGGRVHAKLDRSPVTVADWGVQATVSWLLSSSFHDENISIVAEEDDETLSSSDGATLLESVVEAVNGCLVEAPNYGLRSPEKDLGAHDVIQAIRKCSSTGGPKGRFWVLDPVDGTLGFVRGDQYAIALALIEDGEVILGVLGCPNYPMKKEWLNYHQKYYRLMSKVAPPPLGSWNKGCVMYAQKGCGQAWMQPLVHDFGKLNWHHPREIQVSSISDPISATFCEPVEKANSSHSFTAGLAQSVGLRNQPLRVYSMVKYAAIARGDAEIFMKFARAGYKEKIWDHAAGVVIIKEAGGVVTDAGGHPLDFSRGVYLEGLDRGIIACSGALLHRRILDAVDASWNSSTL

SEQ ID NO: 8553 - DNA, 987 bp, Sorghum bicolor
  misc_feature: Ceres ANNOT ID no. 6091158
  misc_feature: Encodes the peptide sequence at SEQ ID NO 8554
  misc_feature: Up-regulated in shoot tissues in response to salicylic acid treatment
atgagggcggtggtgatcacgcgcggcggcggcggcccggaggtgctggaggcgcaggaggtggaggaacccgcgccgctgggagacggcgaggtcctcctccaggtggccgccgcgggcgttaaccgcgccgacacgctccagcgccacggccgccatccgccgccccccggcgcgcccccttacccggggctcgagtgctccggcactatcctcgcgctcggccccaacgtcccaccgcggtggtccgtcggcgacaaggtctgcgcgctgcttagcggaggcgggtacgcggagaaggtggtggtgccggcgggccagctgttgccggtgccggagggcgtgtcccttacggacgcggccggcttacccgaggtggcctgcaccgtctggtccaccgtgttcatgaccagccacctctctcccggcgaatcgttccttatacatggaggatcaagtggaattggtacgtttgctatacagattgcaaagcacctcggaataaaggtttttatcacagcaggaagtgaagaaaaactagcagcctgcaaagatttgggtgctgatgtatgcattaactacaaaactgaagactttgttgagcgtgtcaaacaggaaactgatgggaaaggtgtcgatgtaattctcgacaacattggaggaccatatctccagcgcaatctgaacagcttaggtgttgatggcagacttttcatcattggcttccaaggcggtgctgtaactgaagtgaacctgcaagctgtgcttgcacggcgtttgaccatacaagctgctggactgcgcaacagaagccttgctaataaagcagagattgttggtgaggtcgaaaagaatgtgtggcctgctgtcgctgctggcaaggtgaagccggtgatttacaagacgtttccgttgtctgaagctgctgaggctcataggttgatggaagctagcacccacatcggcaagatactgctgcttccatga

SEQ ID NO: 8554 - protein, 328 aa, Sorghum bicolor
  misc_feature: Ceres ANNOT ID no. 6091158
  misc_feature (142)..(284): Pfam Id: ADH_zinc_N Pfam Desc: Zinc-binding dehydrogenase
  misc_feature (29)..(111): Pfam Id: ADH_N Pfam Desc: Alcohol dehydrogenase GroES-like domain
  misc_feature (1)..(326): NCBI GI: 76160992 NCBI Desc: nadph quinone oxidoreductase-like protein [solanum tuberosum]
  misc_feature (1)..(326): NCBI GI: 145333616 NCBI Desc: oxidoreductase, zinc-binding dehydrogenase family protein [arabidopsis thaliana]
  misc_feature (41)..(326): NCBI GI: 79325213 NCBI Desc: oxidoreductase/ zinc ion binding [arabidopsis thaliana]
  misc_feature (1)..(326): NCBI GI: 119535108 NCBI Desc: alcohol dehydrogenase, zinc-binding domain protein [nocardioides sp. js614]
  misc_feature (1)..(327): NCBI GI: 67987324 NCBI Desc: zinc-containing alcohol dehydrogenase superfamily [kineococcus radiotolerans srs30216]
  misc_feature: Up-regulated in shoot tissues in response to salicylic acid treatment
  misc_feature: The sequence is a functional homolog of SEQ ID NO. 530 in the 11/188,298 US application
MRAVVITRGGGGPEVLEAQEVEEPAPLGDGEVLLQVAAAGVNRADTLQRHGRHPPPPGAPPYPGLECSGTILALGPNVPPRWSVGDKVCALLSGGGYAEKVVVPAGQLLPVPEGVSLTDAAGLPEVACTVWSTVFMTSHLSPGESFLIHGGSSGIGTFAIQIAKHLGIKVFITAGSEEKLAACKDLGADVCINYKTEDFVERVKQETDGKGVDVILDNIGGPYLQRNLNSLGVDGRLFIIGFQGGAVTEVNLQAVLARRLTIQAAGLRNRSLANKAEIVGEVEKNVWPAVAAGKVKPVIYKTFPLSEAAEAHRLMEASTHIGKILLLP

SEQ ID NO: 8555 - DNA, 2976 bp, Sorghum bicolor
  misc_feature: Ceres ANNOT ID no. 6091167
  misc_feature: Encodes the peptide sequence at SEQ ID NO 8556
atgaagaaagtgttcgatcagacggtccgggacctaaaaagagaggtgaacaagaaggtcctcaaggtgcctggaatagaacaaaagatccttgatgccacaagcaacgaaccgtggggcccacatggatctctcctggcagacattgctcaagcaacgcacaaccatcacgagtaccagatgatcatgaacattgtgtggaagagggtcagtgacactggtaaaaattggcgtcatgtttacaagggattgattgtcttggattacctggtggcgcatggtactgaacgagttattgatgacataagagaacatgcttatcagatatcagcactagctgacttccagtacattgattcttctgggagagatcaaggtagcaatgtgcgaaggaaatcccagagccttgtcagtttagttaatgataaagaaaggatacaggaagttagacagaaagcactcgctaccagggacaagagtgcatttgcccccagtggcaggagcccaggtggatatggtggtggttatgataatgaccgctatgaagggagctatggcagtagatatgacaacagaaatggaaatgggagggaaagagactatggatacagggacgatgacagatatggtggacctggagatacacccaatagggaaggagatcgttattccagagattctaatgaacgctacggcagagattatagagaagatgaatacaaaggaagtcatagcaaccacgagtattctgaaggagcaggtcgcaggagctatggccgggaaagggattcatatggggatgatgaagcttattcatctcgtggccgtggcagcaatgctgatgcgcctactcaggatgataggcctatagagcgaaagctttctaaccagcaaattgcttcaccaccaccgaactatgaagatgttacaagagatagccaggacaatcttcaggatgacagaaatggaggaagtgttcctgctgctgtaccaagggtgtcctctccttcagttcctgcaacaactgttcctgcaggacaggtgaatggggttcaggacactactgttgaagatgtacctgcaccaccaactgttcatgctgagcctaatggatttgatgagtttgatccacgtggatctgtgccaggtatagtttgttctgtttcagcaataaatacagcttgtgtaaatggaagtaatgaaaagatcagtatggatgattcttcccctcctgtaaaccctgcaccagtagcggatagcttggagatggatttgtttggatcagatcctattagttcattggctttggtgtctgtgcctcaaccaacgaccacatcaaatgttgaagcaccggcaaattcaggttttgagacaaatagtttcgtgggcatgcctcctgcttccactggatttggcgagattgatgcctcaaatccttttggggatcctacacctttcaaggcagttcttgatgaaagtccagcactacctcagacacatgctgcaccagctggttctttccagtccagtggacctggtgcggatgtgaaccctttccagcccgcttcagccgcaagctttggttttggagacactcttggtgatctcacttttgcatcaaacgctgcacctgagcagcaagatatttttgcaaacacagcctccttcccttcagagttagcaccagcaaacccgtctgtggttctgcagcagccagttcctacaaatttcccctctcagccacctcagccagttgctggcccattgcatgctgctcccacagcatttgctccttctcaggccgctcccacatcattcgctccttctcaggctgctcccacatcatttgctcctcctcaggcacctcaggctgcccctgtgtttgcttattcacaagcgccgcctcatcctggtgctgccaaccattctcaatttccccagactgctgccccgtcttttcctccttcgcaggtgcctcaatctgtagcacccagtctgccatcaggccaatcagatttctttatgcaaccagcatcagggtctggtattgacagcttgtctggggttcctacacagaatggggcaccgtcctacattccttcacagacctctcagttcactgctccggcaaatcaacaaccatctcagccaagcttcctcccacaaactagcacgccagcactccagcctgccttgatctctcgtggggcatcccagccccttagtgtgccaaattcagtgcctactggtggcagcttcccattgcagtcaagttcatcagctccctcagaaactatcatttctgctttgcaagttaatcagactgagccagtgaagaagtttgagcccaaatctaaactgtggtctgacactttgagccgaggtcttgtcaatctggacatttctggaccaaaagcgaatcctcatgctgatattggagttgactttgattcaattaatcgcaaggagaaaaggcaggaaaagaaaatcaaccaagcacctgttgtgtctacagtcaccatgggcaaagccatgggagctggttccggcattggtcgggctggtgcaggtgcaatggcacctcctcccaacccaatgggtgctggcaggggcatgggtatgggtcctggtgctggtgccggtgctggttatggtggtggaatgggaatgaaccggccaatgggcatggggatgggaatgggaatgggaatgaatcaacaacagatgcggatggggatgaaccaacagccgatgggaatggggatggggatggggatggggatgaaccagcaaccgatgggaatggggatggggatgaaccaacaacagatgggaggaatgaatatggggatggggatgaaccaggggatgccgatgcgtcctatggggatgggtcctggtggaatgcccggtgctggctacaatcagatgggtgcagcatacggtggtcagcagccatatggaggatacaggtga

SEQ ID NO: 8556 - protein, 991 aa, Sorghum bicolor
  misc_feature: Ceres ANNOT ID no. 6091167
  misc_feature (23)..(146): Pfam Id: ENTH Pfam Desc: ENTH domain
  misc_feature (423)..(991): NCBI GI: 47497348 NCBI Desc: epsin-like [oryza sativa (japonica cultivar-group)]
  misc_feature (1)..(963): NCBI GI: 124360685 NCBI Desc: epsin, n-terminal; enth/vhs [medicago truncatula]
  misc_feature (1)..(988): NCBI GI: 7801679 NCBI Desc: epsin-like protein [arabidopsis thaliana]
  misc_feature (1)..(988): NCBI GI: 30725538 NCBI Desc: at3g59290 [arabidopsis thaliana]
  misc_feature (1)..(736): NCBI GI: 15215854 NCBI Desc: at2g43170/f14b2.11 [arabidopsis thaliana]
  misc_feature: The sequence is a functional homolog of SEQ ID NO. 322 in the 11/188,298 US application
MKKVFDQTVRDLKREVNKKVLKVPGIEQKILDATSNEPWGPHGSLLADIAQATHNHHEYQMIMNIVWKRVSDTGKNWRHVYKGLIVLDYLVAHGTERVIDDIREHAYQISALADFQYIDSSGRDQGSNVRRKSQSLVSLVNDKERIQEVRQKALATRDKSAFAPSGRSPGGYGGGYDNDRYEGSYGSRYDNRNGNGRERDYGYRDDDRYGGPGDTPNREGDRYSRDSNERYGRDYREDEYKGSHSNHEYSEGAGRRSYGRERDSYGDDEAYSSRGRGSNADAPTQDDRPIERKLSNQQIASPPPNYEDVTRDSQDNLQDDRNGGSVPAAVPRVSSPSVPATTVPAGQVNGVQDTTVEDVPAPPTVHAEPNGFDEFDPRGSVPGIVCSVSAINTACVNGSNEKISMDDSSPPVNPAPVADSLEMDLFGSDPISSLALVSVPQPTTTSNVEAPANSGFETNSFVGMPPASTGFGEIDASNPFGDPTPFKAVLDESPALPQTHAAPAGSFQSSGPGADVNPFQPASAASFGFGDTLGDLTFASNAAPEQQDIFANTASFPSELAPANPSVVLQQPVPTNFPSQPPQPVAGPLHAAPTAFAPSQAAPTSFAPSQAAPTSFAPPQAPQAAPVFAYSQAPPHPGAANHSQFPQTAAPSFPPSQVPQSVAPSLPSGQSDFFMQPASGSGIDSLSGVPTQNGAPSYIPSQTSQFTAPANQQPSQPSFLPQTSTPALQPALISRGASQPLSVPNSVPTGGSFPLQSSSSAPSETIISALQVNQTEPVKKFEPKSKLWSDTLSRGLVNLDISGPKANPHADIGVDFDSINRKEKRQEKKINQAPVVSTVTMGKAMGAGSGIGRAGAGAMAPPPNPMGAGRGMGMGPGAGAGAGYGGGMGMNRPMGMGMGMGMGMNQQQMRMGMNQQPMGMGMGMGMGMNQQPMGMGMGMNQQQMGGMNMGMGMNQGMPMRPMGMGPGGMPGAGYNQMGAAYGGQQPYGGYR

SEQ ID NO: 8557 - DNA, 1167 bp, Sorghum bicolor
  misc_feature: Ceres ANNOT ID no. 6091176
  misc_feature: Encodes the peptide sequence at SEQ ID NO 8558
atgtcccccgcggcccccgccctcctccaccaccgcggggtctcaggcagagcaaccttacctgtgcatcatggagaaagcagagtccctccaggagcttgtttcatgggcacatcgcctatgttggggccaatgagggtatccttggtatgtggtgcaagccccaaccaccataggccaaggaattcggatacatcgcgacaacaaaaaggggggtcctccagagggaaaggcaagtcataccaggataaagatgattctgagaacattgatgaatttgatagcgatatcatgttctccaagaacggaccaccaatatctttggcaagcaattcccgtcctcaagccacatcagctcctggggaaagagagaaggagatcgtggagctctttaaaagggttcaagcacagctgcgagctagagggaaaggcagggaagacaagaagcctgaacctgcaaaagtgcagggtgaaaggggcagtgttgattcacttcttaagctgcttaggaaacactctgtggaccagagaaggaagagcagtgacgacaaagaacagaattttgatgtaatgaggagaaacaacgattctggaaatagacaaagttcaaccatctttggcacaaaaagtgacatccaggaagagcagaggaagccacctccggcacccttcaaaaggccagcttcaaatttcaggcgaaggtctcctgttcctggagtgaagttccagcctgctatcaatacggacgtagacagagatgccgatcgcaagtccatcggcagtaatgtcgccgatgctgtacagaaagctaagacagttcttgatgagaggactgttacagatgagcctgactccatgtctccgtatgaacctgattctgtaatagaaccagaaaatatttctttggaagaccttgatgacattttagatgacgatgaagaatctgatacagatgaaccagacgatgagtatccagaaccttctttggaaatcactgatgttacagatacagatgaattgcacgagaacaactccacggaaagttcagatctaacctctctgaaggttgcagagctgagagagcttgcaaagtcccgaggaatcaaaggctattcaaagatgaagaaaaacgagctgattgaagtggtgagcagcagcatggcttga

SEQ ID NO: 8558 - protein, 388 aa, Sorghum bicolor
  misc_feature: Ceres ANNOT ID no. 6091176
  misc_feature (350)..(388): Pfam Id: Rho_N Pfam Desc: Rho termination factor, N-terminal domain
  misc_feature (16)..(385): NCBI GI: 62510454 NCBI Desc: sap-like protein bp-73 (osbp-73) (riaa1)
  misc_feature (16)..(385): NCBI GI: 115451155 NCBI Desc: os03g0183100 [oryza sativa (japonica cultivar-group)]
  misc_feature (96)..(362): NCBI GI: 102139988 NCBI Desc: dna-binding protein-related [musa acuminata]
  misc_feature (44)..(253): NCBI GI: 145323754 NCBI Desc: atp binding / atpase, coupled to transmembrane movement of ions, phosphorylative mechanism [arabidopsis thaliana]
  misc_feature (310)..(385): NCBI GI: 19347613 NCBI Desc: riaa1 [oryza sativa]
MSPAAPALLHHRGVSGRATLPVHHGESRVPPGACFMGTSPMLGPMRVSLVCGASPNHHRPRNSDTSRQQKGGSSRGKGKSYQDKDDSENIDEFDSDIMFSKNGPPISLASNSRPQATSAPGEREKEIVELFKRVQAQLRARGKGREDKKPEPAKVQGERGSVDSLLKLLRKHSVDQRRKSSDDKEQNFDVMRRNNDSGNRQSSTIFGTKSDIQEEQRKPPPAPFKRPASNFRRRSPVPGVKFQPAINTDVDRDADRKSIGSNVADAVQKAKTVLDERTVTDEPDSMSPYEPDSVIEPENISLEDLDDILDDDEESDTDEPDDEYPEPSLEITDVTDTDELHENNSTESSDLTSLKVAELRELAKSRGIKGYSKMKKNELIEVVSSSMA

SEQ ID NO: 8559 - DNA, 1290 bp, Sorghum bicolor
  misc_feature: Ceres ANNOT ID no. 6091183
  misc_feature: Encodes the peptide sequence at SEQ ID NO 8560
atgaggctcctggcctgctgctacaatgatccggagatgcagatcgatccggacaccgtctaccctatccgccccgactgccgcgacgacgcccccaagacgcgcttcaagccccggcctggcctgaccctcagtccaaggagatggaagcttctccacaatgaggaaggtgttttggacatagctggaatgatcaaaagagtgcaacatgggggagtccacccaacaatcaaaggagaggtttgggaatttttgctgggctgctatgaccctaaaagcactactgaacagcgcagccaattgcgacagaagcgaaggttagagtacgagcaactgaaagcgaagtgccgagaaatggacacaacagtcggtagtggaagggtaatcactatgcctgtaataacagaagatggtcaacctatcgaaaatcctaactccgatggaggggcagcaggttctgaacagcaaaacaatggcgcaccactcccaaaagaagttattgattggaagcttactctacaccagattggtcttgatgttaaccgtactgatcgtgtgcttgtttattatgagagacaagagaatttggcaaggttgtgggatattcttgcagtgtattcatggattgataaagacataggttattgtcagggaatgagtgatctttgttcaccaatatcaatcattctggaacatgaagcagatgctttttggtgctttgagcgtctaatgcgcagggtgcgaggaaatttcaaaagtacttctacttccattggagttcgagctcagctgactaccttgtcaaccataatgaaatctgttgatccaaagctgcatgaacatttagaaaatcttgatggaggggaatacttatttgccttccgaatgctgatggttcttttccgtagggaattctcatttgttgatacgatgtacctttgggagctcatgtggtctatggagtacaatccaaatctcttttcaatgttggagagtggtactggcacatcaagcgcatacacaaaggatgaaagtgttctaggacagtgtggaaagtttgagcggaagatattgcaagcagctaagaaagatgaccagatccctctatctgtctttgttgttgctagtgttatagaggctagaaacaagcagttactgggtgaggcaaaaggtctagacgatgttgtcaagattttaaatgaaatcactggtagtctggatgcaaaaaaggcatgcagaggagcattgcagattcatgagaagtaccttaacacggtaaaagcatcataa

SEQ ID NO: 8560 - protein, 429 aa, Sorghum bicolor
  misc_feature: Ceres ANNOT ID no. 6091183
  misc_feature (146)..(360): Pfam Id: TBC Pfam Desc: TBC domain
  misc_feature (18)..(427): NCBI GI: 50508504 NCBI Desc: gtpase activating protein-like [oryza sativa (japonica cultivar-group)]
  misc_feature (21)..(423): NCBI GI: 42567218 NCBI Desc: rabgap/tbc domain-containing protein [arabidopsis thaliana]
  misc_feature (21)..(429): NCBI GI: 42569183 NCBI Desc: rabgap/tbc domain-containing protein [arabidopsis thaliana]
  misc_feature (18)..(247): NCBI GI: 115486059 NCBI Desc: os11g0587500 [oryza sativa (japonica cultivar-group)]
  misc_feature (154)..(331): NCBI GI: 42566063 NCBI Desc: rabgap/tbc domain-containing protein [arabidopsis thaliana]
MRLLACCYNDPEMQIDPDTVYPIRPDCRDDAPKTRFKPRPGLTLSPRRWKLLHNEEGVLDIAGMIKRVQHGGVHPTIKGEVWEFLLGCYDPKSTTEQRSQLRQKRRLEYEQLKAKCREMDTTVGSGRVITMPVITEDGQPIENPNSDGGAAGSEQQNNGAPLPKEVIDWKLTLHQIGLDVNRTDRVLVYYERQENLARLWDILAVYSWIDKDIGYCQGMSDLCSPISIILEHEADAFWCFERLMRRVRGNFKSTSTSIGVRAQLTTLSTIMKSVDPKLHEHLENLDGGEYLFAFRMLMVLFRREFSFVDTMYLWELMWSMEYNPNLFSMLESGTGTSSAYTKDESVLGQCGKFERKILQAAKKDDQIPLSVFVVASVIEARNKQLLGEAKGLDDVVKILNEITGSLDAKKACRGALQIHEKYLNTVKAS

SEQ ID NO: 8561 - DNA, 1401 bp, Sorghum bicolor
  misc_feature: Ceres ANNOT ID no. 6091185
  misc_feature: Encodes the peptide sequence at SEQ ID NO 8562
atggatcatgtggtcgggggcaagttcaagctcggcaagaagatcgggagtggatcgttcggggagctcttcctcgctgtgaatgtgcagactggagaggaggtcgccgtcaagctggaaaatgtcaagacaaagcacccgcagcttcattatgagtcgaagctatacatgcttctccaaggaggaactggcattccacacctgaagtggttcggtgttgagggggagtataatgtgatggtgattgatcttcttggccctagccttgaggacttgttcaactattgcagtaggaagttctctctgaagactgtgctcatgcttgctgatcaaatgattaatcgggttgagtacatgcatcaaaaggggtttcttcatcgtgatataaagcctgataatttccttatggggcttggtaggaaagccaatcaggtatatataatagactatggacttgcgaagaaatatagggaccttcaaactcataagcacatcccatacagagagaacaagaacctcactggaactgcacgatatgcaagtgtcaatacccaccttggcgttgagcaaagcaggagagatgatttagaatctcttggttatgttcttatgtacttccttaggggcagcctaccatggcaggggctgaaagcaggaaccaagaagcagaaatatgacaaaatcagtgagaaaaagatgcttactcctgtcgaggtactctgcaaatcgtatccatcagagtttatctcctatttccactactgtcgttcgttgcggtttgaagacaagcctgattattcttacctgaagagactattccgcgatctctttatccgggaaggataccagtttgactacgtgtttgactggaccattttgaagtatcctcagataagctccaacccgcggatgagggcaggggaaagaactagtggagctgctggaccctcaatggataagattgagaagaccccaggagaagcgtccggtagaaggaatcctagtggttctgtgaatccgagtgacaattatgcacaacggccacgtgagaccgtatctatgtcattaaaggaaattatgcatagcactgaccggtctggggaaaggactgtggagagaccacgtacatcctcacgtacaggcagtgcatcccgtagagctgttgcatcaagcagcaggccagcctcatctgtggaaccaagtgagcagtataaccggacaagcagattgttctctagcaacagtggcagtcgtccatctagcacccagagagttaatccatcgccaggcgagtcaagggctacctccctttcacgggctgcagttgcgagaggctcccgcgacgagccactccaccgcagcctggagcttctgtccctcggtggtggtaaaaggaaatag

SEQ ID NO: 8562 - protein, 466 aa, Sorghum bicolor
  misc_feature: Ceres ANNOT ID no. 6091185
  misc_feature (9)..(278): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(460): NCBI GI: 18087640 NCBI Desc: at5g44100/mln1_2 [arabidopsis thaliana]
  misc_feature (1)..(466): NCBI GI: 1103318 NCBI Desc: casein kinase i [arabidopsis thaliana]
  misc_feature (1)..(460): NCBI GI: 21536851 NCBI Desc: protein kinase adk1-like protein [arabidopsis thaliana]
  misc_feature (1)..(466): NCBI GI: 2341031 NCBI Desc: f19p19.10 [arabidopsis thaliana]
  misc_feature (27)..(447): NCBI GI: 1197461 NCBI Desc: casein kinase i [arabidopsis thaliana]
  misc_feature (1)..(445): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 332 in the 11/188,298 US application
  misc_feature: The sequence is a functional homolog of SEQ ID NO. 310 in the 11/188,298 US application
  misc_feature: The sequence is a functional homolog of SEQ ID NO. 340 in the 11/188,298 US application
  misc_feature: The sequence is a functional homolog of SEQ ID NO. 312 in the 11/188,298 US application
  misc_feature: The sequence is a functional homolog of SEQ ID NO. 399 in the 11/188,298 US application
  misc_feature: The sequence is a functional homolog of SEQ ID NO. 498 in the 11/188,298 US application
  misc_feature: The sequence is a functional homolog of SEQ ID NO. 464 in the 11/188,298 US application
  misc_feature: The sequence is a functional homolog of SEQ ID NO. 311 in the 11/188,298 US application
  misc_feature: The sequence is a functional homolog of SEQ ID NO. 520 in the 11/188,298 US application
  misc_feature: The sequence is a functional homolog of SEQ ID NO. 358 in the 11/188,298 US application
  misc_feature: The sequence is a functional homolog of SEQ ID NO. 446 in the 11/188,298 US application
  misc_feature: The sequence is a functional homolog of SEQ ID NO. 323 in the 11/188,298 US application
  misc_feature: The sequence is a functional homolog of SEQ ID NO. 441 in the 11/188,298 US application
MDHVVGGKFKLGKKIGSGSFGELFLAVNVQTGEEVAVKLENVKTKHPQLHYESKLYMLLQGGTGIPHLKWFGVEGEYNVMVIDLLGPSLEDLFNYCSRKFSLKTVLMLADQMINRVEYMHQKGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPVEVLCKSYPSEFISYFHYCRSLRFEDKPDYSYLKRLFRDLFIREGYQFDYVFDWTILKYPQISSNPRMRAGERTSGAAGPSMDKIEKTPGEASGRRNPSGSVNPSDNYAQRPRETVSMSLKEIMHSTDRSGERTVERPRTSSRTGSASRRAVASSSRPASSVEPSEQYNRTSRLFSSNSGSRPSSTQRVNPSPGESRATSLSRAAVARGSRDEPLHRSLELLSLGGGKRK

SEQ ID NO: 8563 - DNA, 885 bp, Sorghum bicolor
  misc_feature: Ceres ANNOT ID no. 6091186
  misc_feature: Encodes the peptide sequence at SEQ ID NO 8564
atggccggcgaagggaacggggacgaagggtggaggcggagcggcatcgaggttagcgccctgcagttcggctacgacgggcagccgccgctcttcgcgcgcttcaacctccgcgtcgcacccggctcccgctgcctcctcatcggcgccaacggatcaggcaagaccacactcttgaagattcttgcgggaaagcatatggttggaggaagagatgtggtccgtgttctcaatggttccgcttttcatgatacacaactagtgtgcagtggagatctttcgtacttgggtggttcttggagccgtactattggttcagctggtgatgttccgcttcaaggcgatttctctgctgagcacatgatttttggagttgatggggttgatcctgttaggcgagagaagctggttgatctgctagacattgatctgcaatggcgcatgcataaagtttcagatgggcagcgacgcagggtgcaaatctgcatgggtcttcttcatccatacaaggtgcttttgcttgatgaaatcactgttgatctggacgttgtgaccagaatggatctgcttgatttctttaaggaagagtgtgagcagagggaagctaccatcgtgtacgcgactcatatatttgatggactcgagacatgggctaccgactttgcgtacatccaagaaggcgagctgagaagatctggcagatactctgatatcgaagagctaaagagcgccaagaacctgctgtcagtagttgagtcgtggctgagatcagagaccaaactcccaaagaaggaacttccacgtcctgagacccaggccaggcgttcctcgccgttggacgcttctcctttccgttcatcgcgccacatggcctactaccgttga

SEQ ID NO: 8564 - protein, 294 aa, Sorghum bicolor
  misc_feature: Ceres ANNOT ID no. 6091186
  misc_feature (42)..(227): Pfam Id: ABC_tran Pfam Desc: ABC transporter
  misc_feature (16)..(294): NCBI GI: 18379174 NCBI Desc: abc transporter family protein [arabidopsis thaliana]
  misc_feature (16)..(294): NCBI GI: 21592901 NCBI Desc: nbd-like protein [arabidopsis thaliana]
  misc_feature (16)..(294): NCBI GI: 75338543 NCBI Desc: non-intrinsic abc protein 2 (gcn-related protein 1)
  misc_feature (16)..(200): NCBI GI: 79329856 NCBI Desc: pop1 [arabidopsis thaliana]
  misc_feature (16)..(294): NCBI GI: 145350567 NCBI Desc: abc(atp-binding) family transporter: iron compound [ostreococcus lucimarinus cce9901]
  misc_feature: The plant produces a reduced number of seeds.
  misc_feature: Useful for biocontainment applications
  misc_feature: GREAT-hit functional homolog of the protein sequence given in SEQ ID NO 13106
  misc_feature: Useful for biocontainment applications
  misc_feature: Functional homolog of the protein sequence given in SEQ ID NO 13106
MAGEGNGDEGWRRSGIEVSALQFGYDGQPPLFARFNLRVAPGSRCLLIGANGSGKTTLLKILAGKHMVGGRDVVRVLNGSAFHDTQLVCSGDLSYLGGSWSRTIGSAGDVPLQGDFSAEHMIFGVDGVDPVRREKLVDLLDIDLQWRMHKVSDGQRRRVQICMGLLHPYKVLLLDEITVDLDVVTRMDLLDFFKEECEQREATIVYATHIFDGLETWATDFAYIQEGELRRSGRYSDIEELKSAKNLLSVVESWLRSETKLPKKELPRPETQARRSSPLDASPFRSSRHMAYYR

SEQ ID NO: 8565 - DNA, 2742 bp, Sorghum bicolor
  misc_feature: Ceres ANNOT ID no. 6091189
  misc_feature: Encodes the peptide sequence at SEQ ID NO 8566
  misc_feature: Up-regulated in root tissues in response to methyl jasmonate treatment
  misc_feature: Up-regulated in shoot tissues in response to methyl jasmonate treatment
atggcgccgcagcccactccgcctccgcgtccggcgccggcgccgacgccgacgcctcaggccgcggccgcgacgaaccccaggacgcccgcggccaagcaccgcctccacttccccgccgccaccccgaggaacgccaacaacggcggcggcggcggcgccacggagcatccggtcgaggtgatcggccgcatccggaacctcgcctcggggaccgcgtccgcgctggagattgcgagcggcgggacggccgtgcgcgtgcgcggcgacgcgggcggttgccgcgacttcacccttgacggcgtctccgtgtccgaggaggaggacctcgaggggttctaccgccgcttcgtgcgctccaggatccagggcgtccgggtcggggccaagtgcaccgtcatggtctacgggcccacggggtccgggaagagccacaccatgttcggctgcaccaaccccaagcagcccgggatcgtgtaccgcgcgctcagggacatccttgagggaggaggcggcggcgaaggcgattccgctgaggatgacgccgggtttgacgccggcctcttcgtccaggtcgcggtgctggagatctacaacgaggagatctacgatttgctcgcgggaagcggggccactgctaaaggaaacgcccccaaggcgagactggaagtaatggggaaaaaggcaaagaacgcaacttatatatctggaaatgaagctgggaagatatcaagagaagttgctaaggtggaaaagcgaagaactgtgaagagcacactttgcaatgagagaagttcgcgaagccattgcatgattatcctggatgtcccatctgtgggaggaaggttaatgcttgtggacatggctggatcggaaaacatagaagcagcaggacaaacaggatttgaagccaaaatgcagacggcaaaaattaaccaagggaacactgctttgaagcgagtggttgaatccattgctaatggtgattcccatgttccatttagggatagcaagctcacaatgctactacaggactcattcgaggatgacaaatccaaaatcctgatgattctgtgcgccagtcctgacccaaaggaattgcacaagacagtttctactttggaatatggtgccaaggcaaagtgtattatccgtgctgctcatgccgcaacacctagggacaaaatgagctctgaggagtcatctgcaatgctcaattctagaattgttgcgatgaaccagttcatccacaagcttcaaaaggagaacaaacttagggagaaagagcgcaatgaggcccagaatgtgctaaagctgaaggaagaggagctagcacaactgagagcaaagctcaagctgatagaagggcaagaaatggaggaaatctggtcattgaggagtgaactcgcgaagatggaagaagcgatgcgtaagcagcagcaagagctcactgcactaagacatcaactgcatgaggttgagcgtgaaaaggctgatggttctcagctagtgcagcaggattcttttggaggtagattgctggcacggctatcagagatgcctgcaggccttgatcaatcaatggcaatgtccatgtctatggacttggatacaggagatcagccagccatgcaagacgtcaaggtaataaaggaggatcctcaccagcagggccacatacggaatcaaacagccacagcagcaagtgcttgcacagggtctgcggtgcaagaagatgatgtcaggctgtccgggtatcctgaaaagactgtcctcagcactgtgtttgaggagggagacgaagatgatgcagagaaggaatgtggtcttcaagaggaggtacgcaaggaggttgtagaggagaactttaagatggacacaacacaacatacactttctgagccagacgatcctgcaacaaggaagcatcggattgagaacatattcaggctatgtggcaattatcgtgaaatagctaagaaaccaaaggtccagtcaccagcaaaggaaatgttctggaatgagaacaagtctccagcgaagcaagtgtttggggatcagaacaaatcattggcaaaccaaacttttggagatgaaaacaaggagccgtcggcatggggagctatagagaaccccatgtgcgacgtcagagtgactgacagcccagtgtcttctcaactttctccaatcgtatgccaagttgtggatgcaccattatcggatcaactgaatacatgcagtgcagcggaagagagtgatccgaagaaggagaacagccttgctggacagaaggatggcggcctcttggaagtttacataaaatgggagtctggcagcctgatcaaagggctgaaggtactgcacaactcatgcctttcagatctgaggaagctcatagaggctcactttgaagaagtaggcagcaaacagcagcagcatcagttcaccttccttctcctcggggacccgtccggtgctcccgtgtccagggacaaggaagcttcggtgcagataagcaggctgcctcactggaacaaccagccggacagctacctggcgtgcctgcgcgcggccaagaagccggctgtggacaacatgcccttcagcccactggacagcaagctgaacacggttttgaaggacgcccacctcgccggtgcgatgtcacccaaggtcaaccagatgagctcgcccaaggtcaaccagatgagtcccaactacatccgggagctgagagcttga

SEQ ID NO: 8566 - protein, 913 aa, Sorghum bicolor
  misc_feature: Ceres ANNOT ID no. 6091189
  misc_feature (64)..(384): Pfam Id: Kinesin Pfam Desc: Kinesin motor domain
  misc_feature (14)..(621): NCBI GI: 16973453 NCBI Desc: phragmoplast-associated kinesin-related protein 2 [arabidopsis thaliana]
  misc_feature (14)..(621): NCBI GI: 110743789 NCBI Desc: kinesin like protein [arabidopsis thaliana]
  misc_feature (14)..(871): NCBI GI: 7268138 NCBI Desc: kinesin like protein [arabidopsis thaliana]
  misc_feature (700)..(913): NCBI GI: 115449445 NCBI Desc: os02g0810200 [oryza sativa (japonica cultivar-group)]
  misc_feature (95)..(514): NCBI GI: 9800187 NCBI Desc: krp85 [caenorhabditis elegans]
  misc_feature: Up-regulated in root tissues in response to methyl jasmonate treatment
  misc_feature: Up-regulated in shoot tissues in response to methyl jasmonate treatment
MAPQPTPPPRPAPAPTPTPQAAAATNPRTPAAKHRLHFPAATPRNANNGGGGGATEHPVEVIGRIRNLASGTASALEIASGGTAVRVRGDAGGCRDFTLDGVSVSEEEDLEGFYRRFVRSRIQGVRVGAKCTVMVYGPTGSGKSHTMFGCTNPKQPGIVYRALRDILEGGGGGEGDSAEDDAGFDAGLFVQVAVLEIYNEEIYDLLAGSGATAKGNAPKARLEVMGKKAKNATYISGNEAGKISREVAKVEKRRTVKSTLCNERSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKMSSEESSAMLNSRIVAMNQFIHKLQKENKLREKERNEAQNVLKLKEEELAQLRAKLKLIEGQEMEEIWSLRSELAKMEEAMRKQQQELTALRHQLHEVEREKADGSQLVQQDSFGGRLLARLSEMPAGLDQSMAMSMSMDLDTGDQPAMQDVKVIKEDPHQQGHIRNQTATAASACTGSAVQEDDVRLSGYPEKTVLSTVFEEGDEDDAEKECGLQEEVRKEVVEENFKMDTTQHTLSEPDDPATRKHRIENIFRLCGNYREIAKKPKVQSPAKEMFWNENKSPAKQVFGDQNKSLANQTFGDENKEPSAWGAIENPMCDVRVTDSPVSSQLSPIVCQVVDAPLSDQLNTCSAAEESDPKKENSLAGQKDGGLLEVYIKWESGSLIKGLKVLHNSCLSDLRKLIEAHFEEVGSKQQQHQFTFLLLGDPSGAPVSRDKEASVQISRLPHWNNQPDSYLACLRAAKKPAVDNMPFSPLDSKLNTVLKDAHLAGAMSPKVNQMSSPKVNQMSPNYIRELRA

SEQ ID NO: 8567 - DNA, 2418 bp, Sorghum bicolor
  misc_feature: Ceres ANNOT ID no. 6091192
  misc_feature: Encodes the peptide sequence at SEQ ID NO 8568
atggtgaagttctcgcgggagtacgaggccagcatcatccccgagtggaaggccgccttcgtcgactacaagggcctcaagaagctcgtcaagaggatcaagatcgcccgccgcgacgccgcgccgctgctcgccgccggcgccggcggtggccgtagaagtagcgacgccagcagcggcagctacggcttctccgtcctcgaccccgtccgcgccctcgccgcccacttcgccgcgacgccggcctcaccaacgacgcaggtgggcgacgacgacggcgactcggacagcggcttggaatcggattcgggggagctcgagcaggagtttctggagaaggcggacgaggagctggagaaggtgaacaagttctacgcggcgcaggaggcggacatgctggcgcgcggcgaggccctcatcgagcagctccgcatcctggccgacgtcaagcgcatcctcgccgaccacgccgcggcgtcccggcgcgggcggtcgcggctcgcccggacggcggcctcgtcgccgccgccgtccgtgaacgggtccaacagcggccgccacctcctctcctcccccttcgtggtggcctcgccgcagtccatgtcagacgggagcgtggagctgcagcaggcgcgcgtggcggagggcgcggcggtggcggaggaggtgatggcggcgctggagcggaacggcgtcagcttcgtgggcggcgggctgggcaaggccaagaaggacggcagcgggaagcagctcatgggccgcgccgcgctgctgcagctgccggcgacggtgcgcatcgacatcccgcccaccagccccggccgggcggcgctcaaggtgtgggaggagctcgtcaacgtgctccgcaaggacggcgcagaccccgccgccgccttcgtccaccgcaagaaggtccagcacgccgagaagaacatccgcgacgccttcctcgccctctaccgcggcctcgaactcctcaagaagttcagctctctcaatgtgaaggctttcaccaaaatattgaagaaattcgtcaaggtgtcggagcagcagcggaaaactgacctgttttcagagaaggtgaagaggtcgccgttcagcagctccgacaaggtgcttcagctggcagacgaggtggagtccatcttcttgaggcatttcgcgggcaacgacaggaaggtggccatgaagtacctgaagccgcagcagcccaggaacacccatatgatcaccttcctcgtaggcctgttcacaggaacatttgtgtccttattcatcatatattcagttctagcccatgtcgccggcattttctcctctaccggaaacacagcatacatggagattgtttaccatgtcttcagtatgtttgcactcatcagcctgcacgtcttcctgtacgggtgcaacctcttcatgtggaagagcaccaggatcagccacaacttcatatttgatttctcctccagcaccgccctgacacaccgggacgccttcctcatgtcggcatccatcatgtgcaccgtcgtcgcagcactggtcatcaacctgttcctcaggaatgccggggcaacctacgccaatgcattgcccggggcacttctgcttctgtcagcagtggttctgttctgcccattcaacgtcttctaccgctcgacgcgctactgtttcatgcgcgtcatgcgcaacatcatgctctcgccattctacaaggttctgatggcagatttcttcatggctgaccagctaaccagccagatcccactgttaagacacctcgagttcacggggtgttacttcatggctggaacttttagaactcacgaatatggaagctgtaccagcagctctctatacaaaaacctggcgtacgtgctttccttcctgccatactactggagagcaatgcagtgtttgagaaggtacctggaagaaggccatgatctcaaccagcttgctaatgcgggcaagtacatatcagcaatggtagcagctgctgtcaggttcaagtatgctgcgacaccaacaccattctggatgtggatggtcataatatcatctacaggcgccaccatttaccagctctactgggattttgtcatggactggggcttcttaaacccaaaatctaaaaacttctggctccgagatcaactcatcctgaagaataagtcagtctactatgcttccatgatgctcaaccttgtgctacgcctagcctgggcccaaagtgtaatgaaactccatcttggtatggtggagtctcgcttgctggatttctcactcgcttcactggaaattatccgacgtgggcattggaacttctacaggctggagaatgaacacttaaccaacgctggaaagtttagagcagtgaagactgtcccattaccattccgtgaacttgaaactgattga

SEQ ID NO: 8568 - protein, 805 aa, Sorghum bicolor
  misc_feature: Ceres ANNOT ID no. 6091192
  misc_feature (614)..(783): Pfam Id: EXS Pfam Desc: EXS family
  misc_feature (2)..(361): Pfam Id: SPX Pfam Desc: SPX domain
  misc_feature (1)..(805): NCBI GI: 11994328 NCBI Desc: receptor protein-like [arabidopsis thaliana]
  misc_feature (264)..(805): NCBI GI: 15982933 NCBI Desc: at1g68740/f24j5.8 [arabidopsis thaliana]
  misc_feature (264)..(805): NCBI GI: 41079243 NCBI Desc: pho1-like protein [arabidopsis thaliana]
  misc_feature (356)..(805): NCBI GI: 5734704 NCBI Desc: contains similarity to gbaf114753 polytropic murine leukamia virus receptor syg1 from mus musculus. est gbn96331 comes from this gene. [arabidopsis thaliana]
  misc_feature (295)..(802): NCBI GI: 41079295 NCBI Desc: pho1-like protein [arabidopsis thaliana]
MVKFSREYEASIIPEWKAAFVDYKGLKKLVKRIKIARRDAAPLLAAGAGGGRRSSDASSGSYGFSVLDPVRALAAHFAATPASPTTQVGDDDGDSDSGLESDSGELEQEFLEKADEELEKVNKFYAAQEADMLARGEALIEQLRILADVKRILADHAAASRRGRSRLARTAASSPPPSVNGSNSGRHLLSSPFVVASPQSMSDGSVELQQARVAEGAAVAEEVMAALERNGVSFVGGGLGKAKKDGSGKQLMGRAALLQLPATVRIDIPPTSPGRAALKVWEELVNVLRKDGADPAAAFVHRKKVQHAEKNIRDAFLALYRGLELLKKFSSLNVKAFTKILKKFVKVSEQQRKTDLFSEKVKRSPFSSSDKVLQLADEVESIFLRHFAGNDRKVAMKYLKPQQPRNTHMITFLVGLFTGTFVSLFIIYSVLAHVAGIFSSTGNTAYMEIVYHVFSMFALISLHVFLYGCNLFMWKSTRISHNFIFDFSSSTALTHRDAFLMSASIMCTVVAALVINLFLRNAGATYANALPGALLLLSAVVLFCPFNVFYRSTRYCFMRVMRNIMLSPFYKVLMADFFMADQLTSQIPLLRHLEFTGCYFMAGTFRTHEYGSCTSSSLYKNLAYVLSFLPYYWRAMQCLRRYLEEGHDLNQLANAGKYISAMVAAAVRFKYAATPTPFWMWMVIISSTGATIYQLYWDFVMDWGFLNPKSKNFWLRDQLILKNKSVYYASMMLNLVLRLAWAQSVMKLHLGMVESRLLDFSLASLEIIRRGHWNFYRLENEHLTNAGKFRAVKTVPLPFRELETD

SEQ ID NO: 8569 - DNA, 2214 bp, Sorghum bicolor
  misc_feature: Ceres ANNOT ID no. 6091199
  misc_feature: Encodes the peptide sequence at SEQ ID NO 8570
atgtcgaacaaaaaatcccgcggccggggcgggggaggcggtgccgccgcctccggcgacggccatgaggacctcgcgcgcccgcccccactccaggcggtcctcctcgccgacagcttcacgctcaaattccgccccatcaccctcgagcgccccaaggtgctgctgccgctggtgcacatgccgatgatcgagtacacgctcacgtggctggagtctgcgggggtggaggaggccttcgtcttctgctgcgcgcactcgcaccaggtcaaggagtacttggagaaggccggttgggctggtaagtctgggcccgggagcatggccgtcacggccgtcgagtcccacgacgcgattagcgcgggcgacgcgctccgcgtcatctacgaccgcggcgtgatacacggagatttcgttctcatcagtggtgatacggtcagtaacatgagcttgaaggatgctctccaggagcatatggacaggaagaaaaaggacccacttgctgttatgactatggttataaagcattcaaaaccttctatcctgacacaccaaactcgcctgggtaacgatgaaattgttatggcgatagatcctgagacaaaggagttactttattacgaggacagggcagatagctcacacttgtatgttacaattgataaggatatactgaccaataatcctactctccagctgcataatgacatggaggactgctatatagatatctgctctccagaagtcctaagtctttttacagataactttgattatcagcatcttcggcgtcattttgtgaagggcttactagttgacgatattatggggtacaaaatctatactcatgaattacgctctggatatgctgcaaggattgataatttcaggagttatgataccgtgagcaaagatgtaattcaaaggtggacataccctatggtgcctgatgtaatatcaagtcgtgattgctcagaaagtagacttcataggcagggaatatacaaagcatcagatgtaacattgtcaccttccgcacaaattggtgcaaattctgttgttggtagtgcgactagtattggagaccactgcaaagtattaaattcagttattggggagggctgcaagattgggaaaaatgttttgattaacggctcattcatatgggacaatgtcataatcgaagatggatgcaaagtcagtaactctttagtctgtgatggtgttcatttaagagctggtgctattgttgaacctggttgcgtactctcatttaaggttgaagttggaaagaatgttgttgtgcctgcccactcaaaagtttcattacttcctcagccttcaaatgaagatagtgatgaagaacttgagtatgctgacaccaactctggaattacagacagtccaccattttccagtatgaggagtaatggtgatcaagcaactgttcctttggaagaagatgagttgggaacatctgaggctggtacctgtggtgttgtcggttacgtatggacaagcgttgatactgggatcgtggaagaatggagacaatcaattgccccgattcctaaagaaaaacttgaagagctgcggcatgctgcgtctgatgatgatgggtcagaagatgaatccaataatcggactctaccagataaagatgattcgtcagacagtgtggttgatgatgatgatcatatttctaagtttgagaaagaggtggaagagacatttcagcgagccctgggtggcggcgttaatcgagataatttgatactagagattaatggcctaaggttagcctacagccttcaacatgcagattgtgctggagctgtgttctattctgtcatgaagagtgcattagtggctgcacaatctactaatgatactcttctaaagacaactgctgatgcacttggcaagtggaaggatcttttgcgcaattacaccaagacagttgatgaggagatggagatacttttaaagtttgaggaaatgtgtcaagagaccacaaaagagttttctccgctgtttccaacgatcttgccatacctctatgacagagaggttgtaagtgaagatgcaattttgagatgggcggaagagaaagaacatgcagatgagtctgataaagtctttgttaaacagtcagaggcctttattaagtggctcaaggaagctgaagaggaggatgacgaagaggaggaataa

SEQ ID NO: 8570 - protein, 737 aa, Sorghum bicolor
  misc_feature: Ceres ANNOT ID no. 6091199
  misc_feature (654)..(736): Pfam Id: W2 Pfam Desc: eIF4-gamma/eIF5/eIF2-epsilon
  misc_feature (15)..(735): NCBI GI: 7268623 NCBI Desc: initiation factor-2bepsilon-like protein [arabidopsis thaliana]
  misc_feature (25)..(442): NCBI GI: 19115197 NCBI Desc: translation initiation factor eif-2b [schizosaccharomyces pombe]
  misc_feature (25)..(442): NCBI GI: 2408098 NCBI Desc: tif225 [schizosaccharomyces pombe]
  misc_feature (1)..(735): NCBI GI: 44985772 NCBI Desc: agl094wp [eremothecium gossypii]
  misc_feature (1)..(735): NCBI GI: 45201002 NCBI Desc: agl094wp [eremothecium gossypii]
MSNKKSRGRGGGGGAAASGDGHEDLARPPPLQAVLLADSFTLKFRPITLERPKVLLPLVHMPMIEYTLTWLESAGVEEAFVFCCAHSHQVKEYLEKAGWAGKSGPGSMAVTAVESHDAISAGDALRVIYDRGVIHGDFVLISGDTVSNMSLKDALQEHMDRKKKDPLAVMTMVIKHSKPSILTHQTRLGNDEIVMAIDPETKELLYYEDRADSSHLYVTIDKDILTNNPTLQLHNDMEDCYIDICSPEVLSLFTDNFDYQHLRRHFVKGLLVDDIMGYKIYTHELRSGYAARIDNFRSYDTVSKDVIQRWTYPMVPDVISSRDCSESRLHRQGIYKASDVTLSPSAQIGANSVVGSATSIGDHCKVLNSVIGEGCKIGKNVLINGSFIWDNVIIEDGCKVSNSLVCDGVHLRAGAIVEPGCVLSFKVEVGKNVVVPAHSKVSLLPQPSNEDSDEELEYADTNSGITDSPPFSSMRSNGDQATVPLEEDELGTSEAGTCGVVGYVWTSVDTGIVEEWRQSIAPIPKEKLEELRHAASDDDGSEDESNNRTLPDKDDSSDSVVDDDDHISKFEKEVEETFQRALGGGVNRDNLILEINGLRLAYSLQHADCAGAVFYSVMKSALVAAQSTNDTLLKTTADALGKWKDLLRNYTKTVDEEMEILLKFEEMCQETTKEFSPLFPTILPYLYDREVVSEDAILRWAEEKEHADESDKVFVKQSEAFIKWLKEAEEEDDEEEE

SEQ ID NO: 8571 - DNA, 909 bp, Sorghum bicolor
  misc_feature: Ceres ANNOT ID no. 6091205
  misc_feature: Encodes the peptide sequence at SEQ ID NO 8572
atggactccacggcgccggcgcccgccacctgcgagatcgcgcgcctgccggacgacctcctgtcggcgtcgctggcccggacggggccgctcgacgcctgccgcgccgccgcggtctcgccggccttccgcgccgcggccgacgccgacgccgtctggtccagcctcctgccgcgcgacctgcccccgctcgccgacggggagctccccgacgacccgcactccaccaagaagcagctcttcatgcgactctccgactccgccagacccgtcctcctggccgacggcctcacgagcatgtggctggacagggccaccgccgccaagtgctacatgctgtccgccaggaagctgtgcatcatatggggcggcacgccgcagtactggcgctggatccctctcaccgactccaggttcacagaaggcgcagaacttctgaacgtttgctggttggaaatccgtggcaagacacattgcaacatgctctcccagtacaccacctacgccgcctacatggtgttcaagatgtccgatgaatcctatgggttggatgatccactccaggaggctgaagttagcattggggcaaccaaatccactcgtcgggtttgcctaggatatgacaatgaggacgaggacggggaagaggtgcctcagaattaccgatcattcagaccaattggattattcagaccaagggtagggagaagaaaccgtcgcgtgcctcctggagtgcaagtacagcgccctcaggcaagagctgacggctggatggagatggagatgggtgagttcaagaatgaagaaggtgaggatggtgaggtgtccatcagtctcttggagaccaggggcggcaactggaagaaaggtcttattttgcagggcattgagatcagggtgaagaaataa

SEQ ID NO: 8572 - protein, 302 aa, Sorghum bicolor
  misc_feature: Ceres ANNOT ID no. 6091205
  misc_feature (11)..(58): Pfam Id: F-box Pfam Desc: F-box domain
  misc_feature (1)..(203): NCBI GI: 47848533 NCBI Desc: f-box family protein-like [oryza sativa (japonica cultivar-group)]
  misc_feature (9)..(202): NCBI GI: 115449503 NCBI Desc: os02g0813100 [oryza sativa (japonica cultivar-group)]
  misc_feature (9)..(202): NCBI GI: 47848218 NCBI Desc: phloem-specific lectin-like [oryza sativa (japonica cultivar-group)]
  misc_feature (7)..(202): NCBI GI: 42570651 NCBI Desc: f-box family protein / skp1 interacting partner 3-related [arabidopsis thaliana]
  misc_feature (9)..(138): NCBI GI: 47848537 NCBI Desc: f-box family protein-like [oryza sativa (japonica cultivar-group)]
MDSTAPAPATCEIARLPDDLLSASLARTGPLDACRAAAVSPAFRAAADADAVWSSLLPRDLPPLADGELPDDPHSTKKQLFMRLSDSARPVLLADGLTSMWLDRATAAKCYMLSARKLCIIWGGTPQYWRWIPLTDSRFTEGAELLNVCWLEIRGKTHCNMLSQYTTYAAYMVFKMSDESYGLDDPLQEAEVSIGATKSTRRVCLGYDNEDEDGEEVPQNYRSFRPIGLFRPRVGRRNRRVPPGVQVQRPQARADGWMEMEMGEFKNEEGEDGEVSISLLETRGGNWKKGLILQGIEIRVKK

SEQ ID NO: 8573 - DNA, 1488 bp, Sorghum bicolor
  misc_feature: Ceres ANNOT ID no. 6091206
  misc_feature: Encodes the peptide sequence at SEQ ID NO 8574
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atggcgaggaagatgcttgtcgacggggaggtggcggccgtcgcggacgccgggcagtacgactacgatctgttcgtcatcggggcgggcagcggcggcgttcgcggctctcgcttcgccgcctccttcggagctaaggttgcgatttgtgagctcccattccaccccatcagctcagagtggctaggaggacatggtgggacgtgtgtgatacgtggttgcgtacccaaaaagatactcgtgtacggtgcatctttcggtggagagtttgaggattcaaagaatttcgggtgggagattaatggggatattaacttcaattggaaaaagctgttggaaaataagactaaagaaattgttagattaaatggagtatatcagaggatccttaccaatgctggtgtgacaatgattgaaggggcaggcagtctagttgatgctcatactgttgaagttagccagcccgatggttcaaagcaaaggtatacagcgaagcacattttgattgcgactggtagccatgctcaacgtgtcaacatacctggaaaggagctggctattacatcagatgaggccttgagcttggaggagcttccaaagcgtgctgtaatcctcggtggcggatatattgctgttgaatttgcttctatctggagagggatgggtgctgaagtagatttgttttatcgaagggagcttcctctaagaggttttgatgatgagatgagaactgttgttgcaagcaaccttgagggaaggggaatcaaattgcatccagggacaaatctgtctgagttaagtaaaacggctgatggcataaaagttgtaactgataaaggagaagagctcattgcagatgttgttctatttgcgacagggcgcacaccaaactcccagagattgaacttgcaagctgcaggcgtcgaggttgaccagattggtgccatcaaggttgacgaatattctcgtacatctgctcctagtgtatgggctgtgggtgatgtaacaaaccggatcaatctaacacctgttgcattgatggaggcaacttgctttgccaaaactgtgtttggtggccaggaagttaagcctgactatggagatgttccttgtgctgttttctccattccaccactatccgtagtgggcctcagcgaacaacaggccttggaggaagccaatggtgatattcttgttttcacttcatcattcaacccaatgaagaacagcatatccaagcgccaggagaagactgtcatgaaactggtagttgatgctgaaactgatagagtacttggtgcatccatgtgtggaccagatgcacctgaaattatccagggcattgctattgcgcttaaatgtggagccaccaaagcgaacttcgacagcactgtcggaatccacccttctgctgctgaagagttcgtgaccatgcggactgtgacaaggcgcgtgagcccgacatccaagccaaagacaaacttgtaa

SEQ ID NO: 8574 - protein, 495 aa, Sorghum bicolor
  misc_feature: Ceres ANNOT ID no. 6091206
  misc_feature (23)..(339): Pfam Id: Pyr_redox_2 Pfam Desc: Pyridine nucleotide-disulphide oxidoreductase
  misc_feature (369)..(479): Pfam Id: Pyr_redox_dim Pfam Desc: Pyridine nucleotide-disulphide oxidoreductase, dimerisationdomain
  misc_feature (201)..(293): Pfam Id: Pyr_redox Pfam Desc: Pyridine nucleotide-disulphide oxidoreductase
  misc_feature (1)..(495): NCBI GI: 19860133 NCBI Desc: glutathione reductase, cytosolic (gr) (grase)
  misc_feature (1)..(495): NCBI GI: 7431855 NCBI Desc: probable glutathione-disulfide reductase (ec 1.8.1.7) - rice
  misc_feature (1)..(495): NCBI GI: 1841894 NCBI Desc: glutathione reductase [oryza sativa (japonica cultivar-group)]
  misc_feature (1)..(495): NCBI GI: 34334010 NCBI Desc: cytosolic glutathione reductase [triticum monococcum]
  misc_feature (1)..(495): NCBI GI: 86371808 NCBI Desc: glutathione reductase [vigna unguiculata]
  misc_feature (1)..(495): SWISSPROT Homolog: EC 1.8.1.7 Glutathione reductase, cytosolic
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
MARKMLVDGEVAAVADAGQYDYDLFVIGAGSGGVRGSRFAASFGAKVAICELPFHPISSEWLGGHGGTCVIRGCVPKKILVYGASFGGEFEDSKNFGWEINGDINFNWKKLLENKTKEIVRLNGVYQRILTNAGVTMIEGAGSLVDAHTVEVSQPDGSKQRYTAKHILIATGSHAQRVNIPGKELAITSDEALSLEELPKRAVILGGGYIAVEFASIWRGMGAEVDLFYRRELPLRGFDDEMRTVVASNLEGRGIKLHPGTNLSELSKTADGIKVVTDKGEELIADVVLFATGRTPNSQRLNLQAAGVEVDQIGAIKVDEYSRTSAPSVWAVGDVTNRINLTPVALMEATCFAKTVFGGQEVKPDYGDVPCAVFSIPPLSVVGLSEQQALEEANGDILVFTSSFNPMKNSISKRQEKTVMKLVVDAETDRVLGASMCGPDAPEIIQGIAIALKCGATKANFDSTVGIHPSAAEEFVTMRTVTRRVSPTSKPKTNL

SEQ ID NO: 8575 - DNA, 1389 bp, Sorghum bicolor
  misc_feature: Ceres ANNOT ID no. 6091208
  misc_feature: Encodes the peptide sequence at SEQ ID NO 8576
atggagatgctggccctgcttaccgtcctcctgctggcacacgccgtggcgtacctggcgtggcaggccgtgtcgcgccgccgccgcgcgtgctgctacctcctggactacgcgtgccacaagccctccgacgaccgcaaggtcaccaccgagatggccggcgacgtcatcgagcgcaacaagcgcctcggcctctccgactaccgcttcctcctcaaggtcatcgtcaactccggcatcggcgagcacacctactgcccgcgcaacgtgctgcagggccgggaggagtcccccacccaccacgacgcgctggaggagatggacgacttcttcgcccacgccgtcgccggggtgctcgccaagacggccgtccgcgcgcgcgacgtcgacctagtcgtcctcaatgtcggctccttctccccggcgccgtccctggtgtccaggctcgtccggcgcttcggcatgcgggaggacgtcatggcgtacaacctctccgggatgggatgcagcgcggggctcatcgccgtcgacctcgcccggaacgtcatgctcacgcgacggccgcgcaccaccatggcgctcgtcgtcacctccgagtcgtgcgcgcccaactggtacgtcggcaccgacaagtccatgatgctcggcaactgcctcttccgctgcggcggcgccgccgcgctgctcaccaacgacccggcgttccggtcacgcgccaagatggagctgcgctgcctcgtgcgcgccaacatcggcgccaacgacgacgcgcacgccgccgccgtgcaccgcgaggacgccgacggccgcctcggcgtcagcctcagcaaggcgctgcccaaggccgccgtgcgcgccttcaccgagaacctgcagcgcctggcgccgcggatcctccccgcccgcgagctcgcgcgcttcgcgtcccgcctcctcctccgcaagctcctgatgggcccccgcaagcacgccgccgagggccccaagatcgacttcaagaccggcgtggaccacttctgcctccaccccggcgggacggcggtgatcgaggcggtgaggaagagcctgggactcaccgcccacgacgtggagccggcgaggatgacgctgcaccggtgggggaacacgtcggcgagcagcctctggtacgtgctctcctacatggaggccaagcggaggctcaagcgcggggacagggtgctcatggtcaccttcggctccggcttcaagtgcaacagctgctactgggaggtgaccagggacctcgccgacgccggcgcgtgggaggactgcatcgacgagtacccgccggagacactggtcaacccctacatggacaagttcggatgggtcaacgacctccagggactggggagcggcttattttaa

SEQ ID NO: 8576 - protein, 462 aa, Sorghum bicolor
  misc_feature: Ceres ANNOT ID no. 6091208
  misc_feature (23)..(316): Pfam Id: FAE1_CUT1_RppA Pfam Desc: FAE1/Type III polyketide synthase-like protein
  misc_feature (330)..(418): Pfam Id: ACP_syn_III_C Pfam Desc: 3-Oxoacyl-[acyl-carrier-protein (ACP)] synthase III C terminal
  misc_feature (1)..(455): NCBI GI: 92877047 NCBI Desc: chalcone and stilbene synthases, n-terminal [medicago truncatula]
  misc_feature (1)..(455): NCBI GI: 92877056 NCBI Desc: chalcone and stilbene synthases, n-terminal [medicago truncatula]
  misc_feature (1)..(455): NCBI GI: 92877054 NCBI Desc: probable fatty acid elongase [imported] - arabidopsis thaliana [medicago truncatula]
  misc_feature (1)..(453): NCBI GI: 114149943 NCBI Desc: 3-ketoacyl-coa synthase 3 (kcs-3) (very-long-chain fatty acid condensing enzyme 3) (vlcfa condensing enzyme 3)
  misc_feature (1)..(455): NCBI GI: 140054927 NCBI Desc: chalcone and stilbene synthases, c-terminal; very-long-chain 3-ketoacyl-coa synthase [medicago truncatula]
MEMLALLTVLLLAHAVAYLAWQAVSRRRRACCYLLDYACHKPSDDRKVTTEMAGDVIERNKRLGLSDYRFLLKVIVNSGIGEHTYCPRNVLQGREESPTHHDALEEMDDFFAHAVAGVLAKTAVRARDVDLVVLNVGSFSPAPSLVSRLVRRFGMREDVMAYNLSGMGCSAGLIAVDLARNVMLTRRPRTTMALVVTSESCAPNWYVGTDKSMMLGNCLFRCGGAAALLTNDPAFRSRAKMELRCLVRANIGANDDAHAAAVHREDADGRLGVSLSKALPKAAVRAFTENLQRLAPRILPARELARFASRLLLRKLLMGPRKHAAEGPKIDFKTGVDHFCLHPGGTAVIEAVRKSLGLTAHDVEPARMTLHRWGNTSASSLWYVLSYMEAKRRLKRGDRVLMVTFGSGFKCNSCYWEVTRDLADAGAWEDCIDEYPPETLVNPYMDKFGWVNDLQGLGSGLF

SEQ ID NO: 8577 - DNA, 2406 bp, Sorghum bicolor
  misc_feature: Ceres ANNOT ID no. 6091213
  misc_feature: Encodes the peptide sequence at SEQ ID NO 8578
atggcgcagagcaactgggaagcggataagatgctcgacgtgtatatctatgactatctgctgaagaggaacctgcagacgacggccaaggctttcatggctgagggaaaggttgctgctgatccagtcgcaattgatgctcctggagggtttctctttgagtggtggtctgtcttttgggatatattcatcgcaaggacaaatgaaaagcattctgaagttgcagcggcatacctagaggcacagcaaataaaagcaagagagcaccagcagcagatgcagatgcagcaattgcaactcatgcagcaaaggcatgctcaacttcagcgaactaatgcgaatcatccttcacttaatggtccaataaatgctttaaactctgatggcattttggggccatcaacagctagtgtcttagctgccaagatgtatgaagagcgcttgaagcacccacattcaatggagtcagagggatcacaactcattgaagctagtagaatggctcttctcaagtcagcaacaaaccatgcagggcaattagttccagggactcctggaaatgtgtctacaactctgcagcaaatccaggctcggaatcagcaaacgattgatattaagagtgaaggtaacatgggagtaccccagagatctttacccatggatccatcatcgttgtatggacagggaataattcagcctaaacctggattgagtggtgcaggactgaaccaaggtgtgagcggtttaccattgaaaggctggccattaactggaattgatcaattaaggccgaatttgggtgctcaaatgcagaagccatttctttcaacacagtcacagttccaacttatgtccccacagcagcagcagcaatacttagcacaggcccaagcacaagggaaccttggcaactcaactaattatggggatattgatccccgcagacttacagcgttgaccaggggtgggttgaatggtaaagatggtcaacctgcaggaactgatgggtgtattagttccccaatgcaatccagttcacccaaagtcagaccagaccaagagtatctcatgaagcagacatcttcacagcaaccccaggaacagcttcaacagcagcagcagcagcatcagaaccagcagcagcaacagagccagcaacaacaaatgcagcagaacaatagaaaaagaaagcagcctacttcttcaggaccagcaaatagtactggtacaggaaacactgtgggtcctgccaactccccaccatctacaccatccacacatacgcctggggatggacttggaatgggtggtaatatgcgccacgttccaaagaacttaatgatctatggtgctgatggaactggacttgcctcctcttcaaatcaaatggatgaccttgagcagtttggtgatgtgggctctttggatgaaaatgttgaatccttcttatccaatgatgatggagatcccagggatatttttgcagcactcaaaagaagtcctgcagagcctaacccagccacttcgaaaggttttactttcagtgaagtgaactgttggcgcacaagcaacagcaaaattgtttgctgccacttctcttcagatggcaagattttggctagtgcaggacatgaaaagaagactgtactttggaacatggaaaatttccagacacagtatacgccagaagagcatggccttattatcactgatgttcgtttcaggcctaactctagtcagctggcaacatcttcttttgatagaactattaaactgtggaatgctgccgatcctggattctctctgcatacgttcactgggcacagtggccaggtcacatcattagattttcatccaaagaaaacagaccttctgtgctcttgtgatggcagcggtgaaatccggtactggaatgcaacccagcttacatgtttgcgtgccataaagggtggtagtgcccaagttcgattccaacctcatgttggccagtttttagccgcagctgctgaaaacgtggtttccatatttgatattgagacgcatgggaaaaaatacactctacagggccataacaccgatgtgcagtcagtgtgctgggacaacaatggggaatatattgcatccgtcagtcaggacctagttaaggtttggtcaatatcttcaggggagtgcattcatgagcttagctccaatggaaacaagttccattcttgtgtgttccacccgagctattccaatctcttggttattggaggctaccagtctctcgaggtttggaacatggtgaagaaccagagcctgacagtacaagctcatgaaggtctaatcgctgcgctggcgcagtcaccagtcacagggatggtagcttctgcgagccatgacaactctgtcaaggtgtggaaataa

SEQ ID NO: 8578 - protein, 801 aa, Sorghum bicolor
  misc_feature: Ceres ANNOT ID no. 6091213
  misc_feature (556)..(594): Pfam Id: WD40 Pfam Desc: WD domain, G-beta repeat
  misc_feature (599)..(638): Pfam Id: WD40 Pfam Desc: WD domain, G-beta repeat
  misc_feature (681)..(718): Pfam Id: WD40 Pfam Desc: WD domain, G-beta repeat
  misc_feature (763)..(801): Pfam Id: WD40 Pfam Desc: WD domain, G-beta repeat
  misc_feature (10)..(36): Pfam Id: LisH Pfam Desc: LisH
  misc_feature (1)..(801): NCBI GI: 38345190 NCBI Desc: osjnbb0065l13.11 [oryza sativa (japonica cultivar-group)]
  misc_feature (1)..(801): NCBI GI: 116311067 NCBI Desc: osigba0157k09-h0214g12.8 [oryza sativa (indica cultivar-group)]
  misc_feature (1)..(801): NCBI GI: 145323105 NCBI Desc: wd-40 repeat family protein [arabidopsis thaliana]
  misc_feature (343)..(801): NCBI GI: 49523567 NCBI Desc: stylosa protein [antirrhinum majus]
  misc_feature (384)..(801): NCBI GI: 30580400 NCBI Desc: transcriptional corepressor leunig
  misc_feature: The sequence is a functional homolog of SEQ ID NO. 502 in the 11/188,298 US application
  misc_feature: The sequence is a functional homolog of SEQ ID NO. 485 in the 11/188,298 US application
MAQSNWEADKMLDVYIYDYLLKRNLQTTAKAFMAEGKVAADPVAIDAPGGFLFEWWSVFWDIFIARTNEKHSEVAAAYLEAQQIKAREHQQQMQMQQLQLMQQRHAQLQRTNANHPSLNGPINALNSDGILGPSTASVLAAKMYEERLKHPHSMESEGSQLIEASRMALLKSATNHAGQLVPGTPGNVSTTLQQIQARNQQTIDIKSEGNMGVPQRSLPMDPSSLYGQGIIQPKPGLSGAGLNQGVSGLPLKGWPLTGIDQLRPNLGAQMQKPFLSTQSQFQLMSPQQQQQYLAQAQAQGNLGNSTNYGDIDPRRLTALTRGGLNGKDGQPAGTDGCISSPMQSSSPKVRPDQEYLMKQTSSQQPQEQLQQQQQQHQNQQQQQSQQQQMQQNNRKRKQPTSSGPANSTGTGNTVGPANSPPSTPSTHTPGDGLGMGGNMRHVPKNLMIYGADGTGLASSSNQMDDLEQFGDVGSLDENVESFLSNDDGDPRDIFAALKRSPAEPNPATSKGFTFSEVNCWRTSNSKIVCCHFSSDGKILASAGHEKKTVLWNMENFQTQYTPEEHGLIITDVRFRPNSSQLATSSFDRTIKLWNAADPGFSLHTFTGHSGQVTSLDFHPKKTDLLCSCDGSGEIRYWNATQLTCLRAIKGGSAQVRFQPHVGQFLAAAAENVVSIFDIETHGKKYTLQGHNTDVQSVCWDNNGEYIASVSQDLVKVWSISSGECIHELSSNGNKFHSCVFHPSYSNLLVIGGYQSLEVWNMVKNQSLTVQAHEGLIAALAQSPVTGMVASASHDNSVKVWK

SEQ ID NO: 8579 - DNA, 1155 bp, Sorghum bicolor
  misc_feature: Ceres ANNOT ID no. 6091222
  misc_feature: Encodes the peptide sequence at SEQ ID NO 8580
atggcgccgcctctgccgccggggctcatggacgacctcatcggcgagatcctcctccgcctcccgccgtccgacccggcgtgcctcgtgcgcgcctccttggtcagcaagcgctggcgcagccttgtcttggaccgcgctttcctccgccagtaccgcgtcttccaccggacggcccccgtgctgggcttcttccacgaccagcagtgcgggtacgccgacgacatcttcgttcaccgcttcgttgccaccaccaccatgcaagcgcccccgtcgcttccccagccggcagcaagcgccggaccctccggcagcgccgccaaaggcaaacagtactcctgccgtaccctagattgccgccacggccgcgtgctcttccacaccgtgaccgtgctgtggccatcatcaacgctcaccgtctgggatcctgtcaccggcgatcacaagagcttccccccaccatcggacatcgacccgtactacgagttcacaggcgccgtgctctgcgcctccgcggccgcctctgacggcggcggcggcggccacctcgaatgcagcggcggggggcctttcctcgtggttattgcgggcgtagaccacggcgaggactacgacgaagacggcgtggcatgggctagagtctactcatcggagactgccgcgtggggcgaggcgaccacccttgacgtcgagtccttcgtcgaccctgcgcaacccagcctgctcgtcgaaggagaatcctcaagtacgactgccctgtcggtgatgaaggcgccgccgcaccatggacatggagacccagacatcatcttcgccgcggcacgggatggcgagctgggagccgccacagtggagggctacaagttgtacctgtggacgtgggacgctggcgttggcgagtgggcacgtggcagggccatcgagcttgacatcatgatcccaatctccatgggtgacccctccactgagtttgatctggctggctttgctcaaggcgctggcttgatttttattagtgcaaacgatgatcatcataacatcttcaccgttgaactcaagtctggacaaattaccaagacaggcaagacaagacattacggcaaaatgttccctttaatcaacttctacactcctgacctgcttggtactagctag

SEQ ID NO: 8580 - protein, 384 aa, Sorghum bicolor
  misc_feature: Ceres ANNOT ID no. 6091222
  misc_feature (4)..(54): Pfam Id: F-box Pfam Desc: F-box domain
  misc_feature (117)..(378): NCBI GI: 115437584 NCBI Desc: os01g0557400 [oryza sativa (japonica cultivar-group)]
  misc_feature (1)..(239): NCBI GI: 38567955 NCBI Desc: osjnbb0115i21.11 [oryza sativa (japonica cultivar-group)]
  misc_feature (115)..(378): NCBI GI: 115475786 NCBI Desc: os08g0299900 [oryza sativa (japonica cultivar-group)]
  misc_feature (73)..(384): NCBI GI: 115470391 NCBI Desc: os07g0122900 [oryza sativa (japonica cultivar-group)]
  misc_feature (11)..(197): NCBI GI: 115481344 NCBI Desc: os10g0188000 [oryza sativa (japonica cultivar-group)]
MAPPLPPGLMDDLIGEILLRLPPSDPACLVRASLVSKRWRSLVLDRAFLRQYRVFHRTAPVLGFFHDQQCGYADDIFVHRFVATTTMQAPPSLPQPAASAGPSGSAAKGKQYSCRTLDCRHGRVLFHTVTVLWPSSTLTVWDPVTGDHKSFPPPSDIDPYYEFTGAVLCASAAASDGGGGGHLECSGGGPFLVVIAGVDHGEDYDEDGVAWARVYSSETAAWGEATTLDVESFVDPAQPSLLVEGESSSTTALSVMKAPPHHGHGDPDIIFAAARDGELGAATVEGYKLYLWTWDAGVGEWARGRAIELDIMIPISMGDPSTEFDLAGFAQGAGLIFISANDDHHNIFTVELKSGQITKTGKTRHYGKMFPLINFYTPDLLGTS

SEQ ID NO: 8581 - DNA, 888 bp, Sorghum bicolor
  misc_feature: Ceres ANNOT ID no. 6091224
  misc_feature: Encodes the peptide sequence at SEQ ID NO 8582
atggtcaactcctgcctctccaccgccgcagcgcactctgcgctgcgcctcctgtccgacggcgctgccggggcgcagctccatcacgcgtcgtcatcagtgtttccgcgcccggcgcgcgcaccgcaccaccggctcgtcgccgcgcccgcggtggcagtgcccgggcactggaggcgcgcgctcgcggtcacagtgatggcgtcgcgggaggaggccgcggccacggctgtcgaggagttggaggaggtcgcggagcgagaggaacagttaccagagcaagacgaagttcaggatggggaaggtggagccgtcgagggtagttcgcaagacagcagaccgtcggtggccgcgagcaccaccaccaccaccaagctctacttcggcaacctgccgtacaactgcgacagcgcgcagcttgccggcattgtgcaggagtacgccagcccggagatggtcgaggtgttgtacgatcgcatcacgggaagaagccgagggttcgccttcgtgacaatgaccacggttcaagactgcgagctggtaatcaagaacctcgacggcagcctgtacggtggccggacgatgaaggtgaacttcgccgaccggccgaagccgaagctgccgctgtacccggagacggagcacaagcttttcgtcggcaacctgtcgtggacggtcacctcggagatgctcacggaggcgttcggacgctgcggcaacgtggtcggcgcgagggtgctctacgacggcgagaccggccgctcccggggctacggcttcgtctgctactccaccaaggaggagatggacgaggctatttcctcgctcaacggaacggaattggaaggcagggagatcagggtcaacttagccctcggaaacaagtaa

SEQ ID NO: 8582 - protein, 295 aa, Sorghum bicolor
  misc_feature: Ceres ANNOT ID no. 6091224
  misc_feature (126)..(197): Pfam Id: RRM_1 Pfam Desc: RNA recognition motif. (a.k.a. RRM, RBD, or RNP domain)
  misc_feature (217)..(288): Pfam Id: RRM_1 Pfam Desc: RNA recognition motif. (a.k.a. RRM, RBD, or RNP domain)
  misc_feature (73)..(295): NCBI GI: 558629 NCBI Desc: chloroplast rna binding protein [phaseolus vulgaris]
  misc_feature (64)..(295): NCBI GI: 144924254 NCBI Desc: rna-binding region rnp-1 (rna recognition motif) [medicago truncatula]
  misc_feature (75)..(295): NCBI GI: 2104687 NCBI Desc: rna- or ssdna-binding protein [vicia faba]
  misc_feature (201)..(291): NCBI GI: 92887758 NCBI Desc: rna-binding region rnp-1 (rna recognition motif) [medicago truncatula]
  misc_feature (212)..(291): NCBI GI: 14135 NCBI Desc: 29kd b ribonucleoprotein [nicotiana sylvestris]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: Useful for making plants with altered alkaloid content
  misc_feature: Functional homolog of the protein sequence given in SEQ ID NO 13848
  misc_feature: Useful for making plants with modulated biomass
  misc_feature: Functional homolog of the protein sequence given in SEQ ID NO 14026
  misc_feature: The sequence is a functional homolog of SEQ ID NO. 339 in the 11/188,298 US application
  misc_feature: The sequence is a functional homolog of SEQ ID NO. 458 in the 11/188,298 US application
MVNSCLSTAAAHSALRLLSDGAAGAQLHHASSSVFPRPARAPHHRLVAAPAVAVPGHWRRALAVTVMASREEAAATAVEELEEVAEREEQLPEQDEVQDGEGGAVEGSSQDSRPSVAASTTTTTKLYFGNLPYNCDSAQLAGIVQEYASPEMVEVLYDRITGRSRGFAFVTMTTVQDCELVIKNLDGSLYGGRTMKVNFADRPKPKLPLYPETEHKLFVGNLSWTVTSEMLTEAFGRCGNVVGARVLYDGETGRSRGYGFVCYSTKEEMDEAISSLNGTELEGREIRVNLALGNK

SEQ ID NO: 8583 - DNA, 3045 bp, Sorghum bicolor
  misc_feature: Ceres ANNOT ID no. 6091233
  misc_feature: Encodes the peptide sequence at SEQ ID NO 8584
atgaccaaggcggagaagctggtggtggaggtggtggcggcgcacaacctcatgcccaaggacggccagggctcctcgtcgccgtacgtggaggttgagttcgagcaccagaagcgccgcacgcgggccaggcccaaggagctcaaccccgtctggaacgagcgcctcgtcttccccgtctccgacccagacgacctgccctaccgcgccatcgacgtcggggtctacaacgaccgcggcgccgccgcgtccggagccgccgccggcggggctgctccgcacggccggaacttcctcggcaaggtgcgcgtcccggccgccggcgtgccggcgcccggcgaggaggccgtgccgcagctcttcactctcgagaagcgcagcctcttctcccacatccgcggcgaaatcaccctcaagatttaccgcgtcaactccggcgacgtcgtcgtcaagtccaagcaggagaagccggccaaggcggtggtggttgggccggaggtggtggcggcgccgacggtgactgggcccaagaagcacccgcacccgcatccgcacccaccgccgcagccgcagcagcagcaccagcaccatccggtggtggccgtgcagccgctgcctccgcagcctgagccacccatggatatcatgccgcaaccgccggtcccgatggccatgaagccggtggtgatgcacgcggacccgtaccccgtcccgcccatgttctccggccccggggacttctcgctgaaggagacgcggccccgcctcggcagcggcgtcgtcgccgacaaggccagcgcgacctacgacctggtggagcaggtggagtacctctacgtgcgcgtggtgcgcgcgcgcggcgtgcccatggtgaccgaggccgtcgcggaggtcaagctcggcaactaccgcggcgtgacgccggccgtcccttcgcacaactgggaccaggtgttcgccttctccagggagaccatccagtcgtcgttcgtcgaggtgttcgtgcgcgcacgcggcagcgacgaccacgtcggccgcgtgtggttcgacctctccgaggtgccgcgccgcgcgccacccgacagcacgctcgccccgcagtggtacagcatggaggaccgcaagggacagcgcggcggcgcggaggtgatgctcgccgtctggttcggcactcaggccgacgagtccttcgccgaggcctggcactccaaggccgccggcgtccatggcaacggggcgcttggctccatcaggtcccaggtgtacgtcgcgcccaagctctggtatcttcgtgtctccgtcattgaagggcaggatttgttcccgatggacaagggcgcattgccaatcggccgattcccggagctcttcgtgcgtgcgcaggtggggagccagattatgcgcacacggccggcgccggtggtgtctacacggggacctgcaagtccgttctggaatgaagacctgatgtttgtggtggcagagccatttgaagagttcttggtgctgtctgtggaagaccgtgtgtccccagggcgggatgagttgcttggccgccttgttgtgccagtgtctgccattgagaggcggtgggattggaagccagtggtttcgagatggtttgggttggaccgtggtactgccggtggcaatgttgctgccaacaatgtgcacaggtttgggagccgccgtgtgcatctccggctaagtcttgatggaggttaccatgtcctggatgaggctacagcttacagcagcgaccttcagcccacagcaaaacagctatggaaaccacatgttggggtgcttgaggttggtgttcttggtgccactggactaatgccaatgaagtcccgagatggtaggggtgcgacaacggatgcttattgtgttgcaaagtatggccagaagtggatccgcacacgcactcttgttgattcattgtgcccccggtggaacgagcagtacacatgggaggtgtttgacccctgcactgtcatcactgttggtgtgtttgacaattgccatgttggcaacacatctgggagtactactatggctgcccgtgataattgcattggcaaagttcgtattcggctttcgacattggagactgatagggtgtatacccatgcctaccctttgctgatgctgcatccgtcaggggtcaagaagatgggggaacttcacctagctgtgcgcttcgcctgtggcaatgctggcaacatgttccatgcctatgcacgccctttgcttccgaagatgcactatgcggagccactcctcgtgcgccaggttgagactcttcggtcccaggccaccaatgtggttgcagctcgacttggacgtgctgagccgccccttggcaaggaggttgttgagtacatgcttgatcatcgttcaaacctgtggagcatgaggcgcagcaaagcgaacttctttcgcctgatcaatgtgctctctggtcctatcgctattggcaggtggtttgagcttgtccgctcttggcagcgcccggtgcattcatgccttgctgtattcacattcctggtgttcctcacaatgccagagctgattcttccaacagcctttctggccatggcgtttgccgggctttggaggtatagagtccgcccaaggcacccgcctcacatggagatgaggctgtctcatgcagatggagccactgcagatgagctggatgaggagtttgacacattcccctcaacccgtggggatgtcgtgcgcttccgatatgaccgcctccgcagtgtggctgggagagttcagacagtggtaggcgacattgcaacacagggtgagaggatgcaggccgtccttagctggcgtgaccctagggcgacactgctcttcgccatcgcctgtgtatctgctgcagtgattgcatattgtgttcctatgaaggtgatgattgggatgtggggcctttacgccatgcgtccaccgaggttcaggagcaggatgccttccccactgatgaacttcttccgaaggcttccttctagggctgacatcctgctctga

SEQ ID NO: 8584 - protein, 1014 aa, Sorghum bicolor
  misc_feature: Ceres ANNOT ID no. 6091233
  misc_feature (860)..(1014): Pfam Id: PRT_C Pfam Desc: Plant phosphoribosyltransferase C-terminal
  misc_feature (7)..(103): Pfam Id: C2 Pfam Desc: C2 domain
  misc_feature (430)..(521): Pfam Id: C2 Pfam Desc: C2 domain
  misc_feature (603)..(697): Pfam Id: C2 Pfam Desc: C2 domain
  misc_feature (2)..(1014): NCBI GI: 3142295 NCBI Desc: strong similarity to phosphoribosylanthranilate transferase gbd86180 from pisum sativum. [arabidopsis thaliana]
  misc_feature (4)..(1014): NCBI GI: 32488702 NCBI Desc: osjnba0088h09.3 [oryza sativa (japonica cultivar-group)]
  misc_feature (263)..(1014): NCBI GI: 92878462 NCBI Desc: c2 [medicago truncatula]
  misc_feature (263)..(1014): NCBI GI: 140066772 NCBI Desc: c2 [medicago truncatula]
  misc_feature (244)..(1014): NCBI GI: 6729531 NCBI Desc: anthranilate phosphoribosyltransferase-like protein [arabidopsis thaliana]
MTKAEKLVVEVVAAHNLMPKDGQGSSSPYVEVEFEHQKRRTRARPKELNPVWNERLVFPVSDPDDLPYRAIDVGVYNDRGAAASGAAAGGAAPHGRNFLGKVRVPAAGVPAPGEEAVPQLFTLEKRSLFSHIRGEITLKIYRVNSGDVVVKSKQEKPAKAVVVGPEVVAAPTVTGPKKHPHPHPHPPPQPQQQHQHHPVVAVQPLPPQPEPPMDIMPQPPVPMAMKPVVMHADPYPVPPMFSGPGDFSLKETRPRLGSGVVADKASATYDLVEQVEYLYVRVVRARGVPMVTEAVAEVKLGNYRGVTPAVPSHNWDQVFAFSRETIQSSFVEVFVRARGSDDHVGRVWFDLSEVPRRAPPDSTLAPQWYSMEDRKGQRGGAEVMLAVWFGTQADESFAEAWHSKAAGVHGNGALGSIRSQVYVAPKLWYLRVSVIEGQDLFPMDKGALPIGRFPELFVRAQVGSQIMRTRPAPVVSTRGPASPFWNEDLMFVVAEPFEEFLVLSVEDRVSPGRDELLGRLVVPVSAIERRWDWKPVVSRWFGLDRGTAGGNVAANNVHRFGSRRVHLRLSLDGGYHVLDEATAYSSDLQPTAKQLWKPHVGVLEVGVLGATGLMPMKSRDGRGATTDAYCVAKYGQKWIRTRTLVDSLCPRWNEQYTWEVFDPCTVITVGVFDNCHVGNTSGSTTMAARDNCIGKVRIRLSTLETDRVYTHAYPLLMLHPSGVKKMGELHLAVRFACGNAGNMFHAYARPLLPKMHYAEPLLVRQVETLRSQATNVVAARLGRAEPPLGKEVVEYMLDHRSNLWSMRRSKANFFRLINVLSGPIAIGRWFELVRSWQRPVHSCLAVFTFLVFLTMPELILPTAFLAMAFAGLWRYRVRPRHPPHMEMRLSHADGATADELDEEFDTFPSTRGDVVRFRYDRLRSVAGRVQTVVGDIATQGERMQAVLSWRDPRATLLFAIACVSAAVIAYCVPMKVMIGMWGLYAMRPPRFRSRMPSPLMNFFRRLPSRADILL

SEQ ID NO: 8585 - DNA, 825 bp, Sorghum bicolor
  misc_feature: Ceres ANNOT ID no. 6091236
  misc_feature: Encodes the peptide sequence at SEQ ID NO 8586
atgctcccccgcctgctcctcgggccccaccgcctgctcctcggcggccccctcgccgcgaccgcgagcgcggcgcccctcccccgccgccgcgccgtcgccggccgccgggtcatgtccgcctccgccgcgcccgccccggggccgaggcggcggccgctgcgcggggtggtgttcgacatggacggcaccctcacggtgcccgtcatcgacttccaggccatgtaccgcgaggtgctcggcggggacgcggcctacgccgcggcgcgcgcggccgggggaggcgccgtcgacatcctccactgcatcgaggactgggcgccagacaagcagcgccacgcgtacgaggttatcgcgcgcttcgaacaggaggggctcgaccgcctccagatcatgcccggggcctcggagctatgcggcttcctggacgcaaagcagatcagaagaggtttgatcacccgtaatgtgaaggacgcagttgatttgtttcaccaaagatttggtatgatgttcactcctgcacttagtagagaatttcgcccctataagccagatccagctccactgcttcacatatgctccacttggaacattccgccacacgaagtgatcatggtcggcgacagtctcaaggatgatgttgtttgtggaaagagggcaggagcttttacttgcttgctagatgaaacagggcgatatggtcctcatgattctttgcctgaggaagttaaacctgacttcaaggtggcctcgcttacagaagtgttcactgtgctggaggagtacttcgatttggcaccagtacctgctgagagtagaatatga

SEQ ID NO: 8586 - protein, 274 aa, Sorghum bicolor
  misc_feature: Ceres ANNOT ID no. 6091236
  misc_feature (54)..(230): Pfam Id: Hydrolase Pfam Desc: haloacid dehalogenase-like hydrolase
  misc_feature (1)..(274): NCBI GI: 115449613 NCBI Desc: os02g0816100 [oryza sativa (japonica cultivar-group)]
  misc_feature (37)..(267): NCBI GI: 140056574 NCBI Desc: had-superfamily hydrolase subfamily ia, variant 3 [medicago truncatula]
  misc_feature (54)..(262): NCBI GI: 91202548 NCBI Desc: similar to phosphoglycolate phosphatase [candidatus kuenenia stuttgartiensis]
  misc_feature (54)..(234): NCBI GI: 119773639 NCBI Desc: hydrolase, haloacid dehalogenase-like family [shewanella amazonensis sb2b]
  misc_feature (55)..(242): NCBI GI: 127513185 NCBI Desc: had-superfamily hydrolase, subfamily ia, variant 1 [shewanella loihica pv-4]
MLPRLLLGPHRLLLGGPLAATASAAPLPRRRAVAGRRVMSASAAPAPGPRRRPLRGVVFDMDGTLTVPVIDFQAMYREVLGGDAAYAAARAAGGGAVDILHCIEDWAPDKQRHAYEVIARFEQEGLDRLQIMPGASELCGFLDAKQIRRGLITRNVKDAVDLFHQRFGMMFTPALSREFRPYKPDPAPLLHICSTWNIPPHEVIMVGDSLKDDVVCGKRAGAFTCLLDETGRYGPHDSLPEEVKPDFKVASLTEVFTVLEEYFDLAPVPAESRI

SEQ ID NO: 8587 - DNA, 1134 bp, Sorghum bicolor
  misc_feature: Ceres ANNOT ID no. 6091237
  misc_feature: Encodes the peptide sequence at SEQ ID NO 8588
  misc_feature: Down-regulated in shoot tissues in response to salicylic acid treatment
atggcgtccccgacctgccgcctcgtgtccctcgtgctctgcctgggggcgctcgccgtgctcctggcggcgcggggcgccgacgcggcccgcgccttcttcgtcttcggcgactccctcgtcgacaacggcaacaacaactacctcatcacggcggcgcgcgccgactcgccgccctacggcatcgacacgccggaccaccgcgccacggggcggttcagcaacggcaagaacgtgccggacattatcagtgagcacctcggcgcggagcccgtgctgccgtacctgagccccgagctcgacggcgagaagatgctcgtcggcgccaacttcgcgtccgccggcgtgggcatcctcaacgacaccggaatccaattcgccaacatcatccacatcgccaagcagctgcgctacttcgagcagtaccagaagcgtctgacggcgctgatcggcgcggacgcggcgacccggctggtgcgcggcgcgctggtgctcatcacgctgggcggcaacgacttcgtgaacaactactacctggtgccctactcggcgcggtcgcgtgagttctcgctgccggactacgtctcctacatcctgtcagagtacgcccaggtcctggagcacatgtacgatctcggcgcccggcgggtgctggtgcagggcgtcggccccatcgggtgcgtcccggccgagctggcgctgcacagcctagacggcacctgcgacccggagctgcagcgcgccgccgagatgtacaacccgcggctcatgtccctgctgcaggacctcaacgcacgccacggcggcgaggtgttcgtcggcgtgaacatgaagcggatccacgacgacttcatcgacgaccccaaggcgtacggcttcgagaccgccaccgaggcgtgctgcggacagggaaggttcaacggcatggggctgtgcaccatggtgtccagcctctgcgccgaccgcgacagctacgtgttctgggacgccttccaccccacggagcgcgccaaccgcctcatcgtgcagcagttcatgtcgggctctgtggaatacatcgcgccaatgaacctcagcaccgtcctcgccatcgacgaagaactcgagaggcagcagcaaagcacattgccgtga

SEQ ID NO: 8588 - protein, 377 aa, Sorghum bicolor
  misc_feature: Ceres ANNOT ID no. 6091237
  misc_feature (33)..(345): Pfam Id: Lipase_GDSL Pfam Desc: GDSL-like Lipase/Acylhydrolase
  misc_feature (9)..(366): NCBI GI: 45649132 NCBI Desc: gsdl-motif lipase [agave americana]
  misc_feature (9)..(364): NCBI GI: 58531342 NCBI Desc: at5g18430 [arabidopsis thaliana]
  misc_feature (1)..(292): NCBI GI: 145334571 NCBI Desc: gdsl-motif lipase/hydrolase family protein [arabidopsis thaliana]
  misc_feature (128)..(366): NCBI GI: 144924029 NCBI Desc: lipolytic enzyme, g-d-s-l [medicago truncatula]
  misc_feature (9)..(361): NCBI GI: 115439921 NCBI Desc: os01g0748500 [oryza sativa (japonica cultivar-group)]
  misc_feature: Down-regulated in shoot tissues in response to salicylic acid treatment
MASPTCRLVSLVLCLGALAVLLAARGADAARAFFVFGDSLVDNGNNNYLITAARADSPPYGIDTPDHRATGRFSNGKNVPDIISEHLGAEPVLPYLSPELDGEKMLVGANFASAGVGILNDTGIQFANIIHIAKQLRYFEQYQKRLTALIGADAATRLVRGALVLITLGGNDFVNNYYLVPYSARSREFSLPDYVSYILSEYAQVLEHMYDLGARRVLVQGVGPIGCVPAELALHSLDGTCDPELQRAAEMYNPRLMSLLQDLNARHGGEVFVGVNMKRIHDDFIDDPKAYGFETATEACCGQGRFNGMGLCTMVSSLCADRDSYVFWDAFHPTERANRLIVQQFMSGSVEYIAPMNLSTVLAIDEELERQQQSTLP

SEQ ID NO: 8589 - DNA, 1227 bp, Sorghum bicolor
  misc_feature: Ceres ANNOT ID no. 6091246
  misc_feature: Encodes the peptide sequence at SEQ ID NO 8590
atgcaggcggcggcgtggaggcgtcacctcctcgaccatcacctgtccccttccacctcggctgccatcgccgccttcagatccgcctcccagccggggctcgctccccaagggttgtgcggagcggatggcgcgaggtacatgtcgtccgcgagggcgccggcggtcaaggggtccgggcatctcgtccgcaagggcaccggagggaggtcttctgtgagtggaattgtagccacggtgtttggagctactggttttcttggacgctatcttgtgcaacaacttgccaagatgggatctcaagtgcttgtcccattcagaggttgtgaggattctcatcgccacctgaagattatgggtgacttgggtcagattgtgccgatgaaataccatccaagagatgttgattcaattaaggctgttatggccaagtcaaatgtggttattaacctcataggacgagagtatgaaacaaggaactacagctttgaagaagtgaaccaccatatggctgaacaacttgcaacgattgctaaggagcatggtggtatcatgagatttatccaggtttcttgcctaggggcatcaccgtcttctgaatctagattgttgaggacaaaagctgcaggagagcaatcaatcttgaaagaattccctgaggctacaatcatgaggcctgctaccatgattggcacagaagatcgaattttgaacagatgggcacaatttgcaaagaattggggtttcctcccgcttgttggtggtggatccacaaagattcagcctgtttatgtaatcgatgttgctgctgctattgtcaactccctcaaggatgatggcactagcatgggaaagatatatgaacttgggggccctgaaatttacactgtccatgagctggctgagctgatgtatgagacaatccgtgaatggccaagatatgtcaatgttcctcttcctgttgcaagggctattgcttccccaagggaaatgttgctgaacaaagtgccgttccccctgccaaccccttccattttcaacctagaccagatcaatgcattcgctgtggacaaccttgtctcagaagatgctctcactttcgaagacctcggcatcatgcctcagaagttgaaggggtacccggtggagttcctcgtgtcgtacaggaagggtgggccatcgttcggctcaactgtgagcgagaagatgaggagctccgagatgtag

SEQ ID NO: 8590 - protein, 408 aa, Sorghum bicolor
  misc_feature: Ceres ANNOT ID no. 6091246
  misc_feature (78)..(290): Pfam Id: Epimerase Pfam Desc: NAD dependent epimerase/dehydratase family
  misc_feature (78)..(316): Pfam Id: NmrA Pfam Desc: NmrA-like family
  misc_feature (80)..(273): Pfam Id: NAD_binding_4 Pfam Desc: Male sterility protein
  misc_feature (79)..(321): Pfam Id: 3Beta_HSD Pfam Desc: 3-beta hydroxysteroid dehydrogenase/isomerase family
  misc_feature (34)..(390): NCBI GI: 32484269 NCBI Desc: mgc64316 protein [xenopus laevis]
  misc_feature (62)..(390): NCBI GI: 28278769 NCBI Desc: mgc64316 protein [xenopus laevis]
  misc_feature (62)..(389): NCBI GI: 13543186 NCBI Desc: ndufa9 protein [mus musculus]
  misc_feature (62)..(389): NCBI GI: 37231685 NCBI Desc: nadh dehydrogenase (ubiquinone) 1 alpha subcomplex, 9 [mus musculus]
  misc_feature (59)..(407): NCBI GI: 85093948 NCBI Desc: nadh-ubiquinone oxidoreductase 40 kd subunit precursor (complex i-40kd) (ci-40kd) [neurospora crassa n150]
MQAAAWRRHLLDHHLSPSTSAAIAAFRSASQPGLAPQGLCGADGARYMSSARAPAVKGSGHLVRKGTGGRSSVSGIVATVFGATGFLGRYLVQQLAKMGSQVLVPFRGCEDSHRHLKIMGDLGQIVPMKYHPRDVDSIKAVMAKSNVVINLIGREYETRNYSFEEVNHHMAEQLATIAKEHGGIMRFIQVSCLGASPSSESRLLRTKAAGEQSILKEFPEATIMRPATMIGTEDRILNRWAQFAKNWGFLPLVGGGSTKIQPVYVIDVAAAIVNSLKDDGTSMGKIYELGGPEIYTVHELAELMYETIREWPRYVNVPLPVARAIASPREMLLNKVPFPLPTPSIFNLDQINAFAVDNLVSEDALTFEDLGIMPQKLKGYPVEFLVSYRKGGPSFGSTVSEKMRSSEM

SEQ ID NO: 8591 - DNA, 987 bp, Sorghum bicolor
  misc_feature: Ceres ANNOT ID no. 6091252
  misc_feature: Encodes the peptide sequence at SEQ ID NO 8592
atgcagtacaagaacctgggccggtcggggctccgcgtgagccagctctcgtacggctcgtgggtgaccttcggcaaccagctggacgtgaaggaggccaaggcgctgctgcaggcgtgccgggatgcgggcgtcaacttcttcgacaacgccgaggtctacgccaacgggcgcgccgaggagatcatggggcaggccatccgggacctgggctggcgccgctccgacgtcgtcatctccaccaagctcttctggggcggcccgggccccaacgacaagggtctctcccggaagcacatcgtcgagggcctccgcggctcgctccgccgcctcgacatggactacgtcgacgtcgtctactgccatcgccccgacgcctccacgcccgtcgaggagacggtgcgcgccatgaactgggtcatcgaccagggatgggccttctactggggcacctccgagtggtccgcgcagcagatcaccgaggcctgggctgtcgccaaccgcctcgacctcgtcggacccatcgtcgagcagccggagtacaacctcttctccaggcacaaggtcgagtctgagttcttgccactttacagcacctatggcattggtttgactacatggagtcctctagcttcaggagtactaaccggcaaatatggcaaagggaacgtaccagctgatagcaggtttgccctagacaattacaagaacctggcaaataggtccctggttgacgacacgcttcgaaaagtgaatgggctaaaacctatcgctgatgaacttggtgttacattagcccaactctcaattgcttggtgtgcatcgaaccccaacgtctcatctgtgatcactggagccaccaaagaaagccagatcgtggagaacatgaaggctctagatgtcattccactgctgacgccggaggttctcgacaggattgaggcggtggtccaaagcaagcccaaacgtgccgactcatacaggtga

SEQ ID NO: 8592 - protein, 328 aa, Sorghum bicolor
  misc_feature: Ceres ANNOT ID no. 6091252
  misc_feature (7)..(318): Pfam Id: Aldo_ket_red Pfam Desc: Aldo/keto reductase family
  misc_feature (1)..(328): NCBI GI: 84029321 NCBI Desc: probable voltage-gated potassium channel beta subunit (k(+) channel beta subunit)
  misc_feature (1)..(328): NCBI GI: 2832783 NCBI Desc: potassium channel beta subunit [egeria densa]
  misc_feature (1)..(328): NCBI GI: 1063415 NCBI Desc: k+ channel protein
  misc_feature (1)..(328): NCBI GI: 1197587 NCBI Desc: potassium channel beta subunit protein [oryza sativa]
  misc_feature (1)..(322): NCBI GI: 145621880 NCBI Desc: aldo/keto reductase [petrotoga mobilis sj95]
MQYKNLGRSGLRVSQLSYGSWVTFGNQLDVKEAKALLQACRDAGVNFFDNAEVYANGRAEEIMGQAIRDLGWRRSDVVISTKLFWGGPGPNDKGLSRKHIVEGLRGSLRRLDMDYVDVVYCHRPDASTPVEETVRAMNWVIDQGWAFYWGTSEWSAQQITEAWAVANRLDLVGPIVEQPEYNLFSRHKVESEFLPLYSTYGIGLTTWSPLASGVLTGKYGKGNVPADSRFALDNYKNLANRSLVDDTLRKVNGLKPIADELGVTLAQLSIAWCASNPNVSSVITGATKESQIVENMKALDVIPLLTPEVLDRIEAVVQSKPKRADSYR

SEQ ID NO: 8593 - DNA, 1392 bp, Sorghum bicolor
  misc_feature: Ceres ANNOT ID no. 6091254
  misc_feature: Encodes the peptide sequence at SEQ ID NO 8594
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atggagaaggcgatcgatcggcagcgggtcctcctggcgcacctcctcccctccgcctccgcctccgcctcctccgcgcagcctcagcttgcggcgtcggcgtgcgcggccggggacagcgccgcctaccagaggacctcctccttcggggacgatgtcgtcgtcgtcgctgcgtaccggacgcccatatgcaaggccaagcgaggaggcttcaaggacacctacccagaggacctcctcactgttgttctcaaggctgttctggacaacactagaatcaatccagctgacattggtgacattgtggttggtacggtgcttggtcctggttcccagcgtgcaatcgagtgcaggacggctgcgttgtttgctggattccctgaaaccgttcctgttagaactgtcaaccgacaatgttcatctgggcttcaggcagtagccgacgtcgcggctgctataaaggctggttactatgacatagggattggtgctggtttggaatccatgtccataaattccatgggttgggaagggcaagttaacccaagaataactgaactccagaaagcacaggattgtcttctgcccatgggaattacttctgaaaatgtcgcccatcgatatggtgtaaccaggcaagagcaagaccaggctgctgctgagtctcataggagagctgctgcagccacggcctctggaaaattcaaggatgagatcgtccccgtgccaacaaagattgttgatcctaaaactggagaggagaagaaagttgtgatatcagttgatgatggggttaggccagggaccacagcatctggattggcaaaacttaaaccagtttttaaaaaggatgggactacaactgcaggcaattctagtcaagtgagtgatggtgctggagctgttcttctcatgaaaagatctgtggctctgaagaaaggacttcctattcttggtgttttcaggagctttgccgctgttggagtggatccagctgttatgggtgtaggtcctgctgtggccattcctgctgcagtgaaatctgctggccttgagattggagacattgatctgtttgaactgaatgaggcctttgcctctcaatttgtttattgctgcaacaagttgggcctggaccgttccaaagtaaatgtaaacggaggcgcgattgcccttggacacccactgggtgcaacaggtgcccggtgtgtggctactcttctaaatgaaatgaagcgccggggcagagactgcagatttggcgttgtcaccatgtgtatcggatctggaatgggggcagcagctgtgttcgagcggggagatgctgtggatggactctccaacgtgagggacacccagacacaaaattttctgtcaagggatgcaaagtag

SEQ ID NO: 8594 - protein, 463 aa, Sorghum bicolor
  misc_feature: Ceres ANNOT ID no. 6091254
  misc_feature (50)..(308): Pfam Id: Thiolase_N Pfam Desc: Thiolase, N-terminal domain
  misc_feature (315)..(439): Pfam Id: Thiolase_C Pfam Desc: Thiolase, C-terminal domain
  misc_feature (1)..(463): NCBI GI: 7433647 NCBI Desc: acetyl-coa c-acyltransferase (ec 2.3.1.16) precursor - cucurbit
  misc_feature (1)..(463): NCBI GI: 1694621 NCBI Desc: 3-ketoacyl-coa thiolase [cucurbita cv. kurokawa amakuri]
  misc_feature (1)..(463): NCBI GI: 393707 NCBI Desc: 3-ketoacyl-coa thiolase; acetyl-coa acyltransferase [cucumis sativus]
  misc_feature (1)..(463): NCBI GI: 1066163 NCBI Desc: glyoxysomal beta-ketoacyl-thiolase [brassica napus]
  misc_feature (1)..(450): NCBI GI: 34597334 NCBI Desc: acetoacetyl coa thiolase [helianthus annuus]
  misc_feature (1)..(463): SWISSPROT Homolog: EC 2.3.1.16 3-ketoacyl-CoA thiolase 2, peroxisomal precursor
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
MEKAIDRQRVLLAHLLPSASASASSAQPQLAASACAAGDSAAYQRTSSFGDDVVVVAAYRTPICKAKRGGFKDTYPEDLLTVVLKAVLDNTRINPADIGDIVVGTVLGPGSQRAIECRTAALFAGFPETVPVRTVNRQCSSGLQAVADVAAAIKAGYYDIGIGAGLESMSINSMGWEGQVNPRITELQKAQDCLLPMGITSENVAHRYGVTRQEQDQAAAESHRRAAAATASGKFKDEIVPVPTKIVDPKTGEEKKVVISVDDGVRPGTTASGLAKLKPVFKKDGTTTAGNSSQVSDGAGAVLLMKRSVALKKGLPILGVFRSFAAVGVDPAVMGVGPAVAIPAAVKSAGLEIGDIDLFELNEAFASQFVYCCNKLGLDRSKVNVNGGAIALGHPLGATGARCVATLLNEMKRRGRDCRFGVVTMCIGSGMGAAAVFERGDAVDGLSNVRDTQTQNFLSRDAK

SEQ ID NO: 8595 - DNA, 567 bp, Sorghum bicolor
  misc_feature: Ceres ANNOT ID no. 6091267
  misc_feature: Encodes the peptide sequence at SEQ ID NO 8596
atggccgccaccccagcccacgcagccgccgccgccaccgccggctgcgaagcggcgccgtcccacggccgaatcggagtccgtccgggtccgggtccggccccatcgcgtctcggtttcctcgccaaaccgtcctcccggtgggctgcgatctcgctgccgccggggcctcgccgcgcagcgccggcggcggccgcggccagggagagggttgcgggggaggagggtcccgtgtgggtggagctggagcccatcaccagcgagcagcagctggaccgggtccttgcggacgcgcagcagctcgacatccccatcgtcctgctctggatggcaagttggtgcagaaaatgtatatatctgaagcctaagcttgagaagttggcagcagaataccatccaagagtccggttctactgtatcgatgtgaattgtgttccacaaaagcttgtgaaccgtgctggagtaacactgtggagcaactcccggaaacaggcggaggtgattggtgggcacaaatcttggctggtgatcgatgatgtccggaggatgatcgagcaggaggaatga

SEQ ID NO: 8596 - protein, 188 aa, Sorghum bicolor
  misc_feature: Ceres ANNOT ID no. 6091267
  misc_feature (74)..(187): NCBI GI: 9955581 NCBI Desc: thioredoxin-like protein [arabidopsis thaliana]
  misc_feature (77)..(186): NCBI GI: 9759297 NCBI Desc: thioredoxin-like [arabidopsis thaliana]
  misc_feature (77)..(186): NCBI GI: 18415285 NCBI Desc: thioredoxin family protein [arabidopsis thaliana]
  misc_feature (77)..(186): NCBI GI: 51702145 NCBI Desc: thioredoxin-like 5, chloroplast precursor
  misc_feature (77)..(186): NCBI GI: 4973264 NCBI Desc: thioredoxin-like 5 [arabidopsis thaliana]
MAATPAHAAAAATAGCEAAPSHGRIGVRPGPGPAPSRLGFLAKPSSRWAAISLPPGPRRAAPAAAAARERVAGEEGPVWVELEPITSEQQLDRVLADAQQLDIPIVLLWMASWCRKCIYLKPKLEKLAAEYHPRVRFYCIDVNCVPQKLVNRAGVTLWSNSRKQAEVIGGHKSWLVIDDVRRMIEQEE

SEQ ID NO: 8597 - DNA, 2997 bp, Sorghum bicolor
  misc_feature: Ceres ANNOT ID no. 6091269
  misc_feature: Encodes the peptide sequence at SEQ ID NO 8598
atggctccatctcaagcggcggcggctggccccacctttgaggacctggagcgcgacctgcaggcagttctcatggaccaaaaccacacggcccctgcagacgagctcagcatgttccgcagcggcagtgctccccccaccgtcgagggctcacgcacggccattggcgcgctcttctctggtccgccgcttcctgccaacaaccttggtggcagtggcggcggcgggactggtgctggcattgacatgctcactgaggaggagatacggtcgcacccagcgtatctgtcgtactactattctaacgagcacctcaacccaaggcttccgccaccaatggtctccaaagaggactggcgtgcggcgcagcggttccaggcagtgtctggaggtattggggataggcggaggaggccttcagaggtcgggagtggaaactcgctgttctcggtgcagccaggggcgcgcgaagttggtggagagaaggcgctgctgagtgatagaatggggaggggtgaaaggaatgggctcgcacggcagcagtcatctgagtggcttgggagaggtgccgatgggctcattggcttgtcagatatcagtggccttgggtctcggcgcaagagctttgctgatgcattgcaggaaaatattagccgtcctgctgctactgccggtcatctttcacgatctaatagccgcaatgctcttgagggcccaactccaatcaggtcatctgattcacccaagccacaactgcagaatagatcagaatccatgaatggcctgcgatctggatccacttcacccagtctggtcagggtccaaagtcttggttcttcaatgtctcatacctttgcttctgcagtaggttcatctatctcaagaagcaccacccctgacccccagctcatacggagaactccaagtccctgccttcctcctgttggagttcggatggggagttctgataaaaaagttgaagctgcagctgttgcttcacttaatcatgatggtgctgacattgcggcaactctgtctagcttaagcctatctggaaataagatgtcgaatgtggaaaatgaagttcagaatcatgtttaccagaactttggtgaccaggcagatgtgctgtttaatgtaccaaaggatcataggcaattttcacaacaaaatttaactcaaaataccaatgaagactcgcttaatgcccctgaatatgcagttttcccaaatggggggagtaacttcagtaatttgcatgctagtaagctggcatctcatagaaatagcaagttccctatgcagtcaccacatggtaatgcgaacaagaaaggatctttgatgagctcagctggttcagtttctcactaccagaacttgaatggtgatagccatggcattgatgtatctggacggcatatgaagactcatgcaggcggttttacttcatccatgctgaatcctgatggtgactatggcaatgttctttcgaaccatgggggatcgagttatcagggccaaccaacagagacaatgtacgcacaatacttgcaggcaaaccctgattccccccttggttcagctgcaagcatgagtcctttccaagggaggggttttactggttcaggacacttggatagtcctggatatcaaaaagcttaccttgggtcattatttgcccagcaaaagctacagtatgggataccatacctgggcaagtctggtgctcttaatcaaaatatatatggcaacgatcctgcatttggcattggaatgacttatctaacaagcccaccatctagtccgtatatctcatctcctcaaggccatgtcaggcaaggagatcgactgactcgacttccagccgtggtgaggaacactgctggaggatccatgggatcatggagttcagagaatggtctgatggataatggggggtcctccctgctggaggaattcaaaactaacaaaaccagatcttttgagctgttagatattgtaggccatgtggtagagttcagttcggatcagtatgggagtcgctttatacagcagaaactagaaactgcttctattgaagagaagaatatgatttttcctgagatccttccccaggcacgtaccttgatgactgatgttttcggaaactatgttatacagaagttctttgaatatggaactgaaacacaaacgaagcaactggcaaccctgctcaagggttatgtgttacagctgagtcttcaaatgtatggctgcagggtgattcagaaggctttggaagttgttgaagtggaacaacaaacacaaatggctttggagcttgatggatctatcatgagatgtgttcgtgatcagaatggcaaccatgtcatccaaaaatgtattgaatgcatccctcaggagaggatacgatttatcatttctgccttttacggacatgtggtggagctttccatgcatccctatggttgccgtgttattcagagggtattggaacattgtgatgatgaaagcacacaaaatgccatgatggaagagatcatgcagtctgtggttactttaacagaggaccagtatggtaattatgtaatccagcatgtcctgcagcatgggaaaccagaagagcgttctactataatcacacaactagctggacagatagtgaagatgagccaacagaaatttgcttctaatgttgttgagaagtgtcttacttttggtaatcctgagcaacgccagattctgatcaatgaaatgcttggcacaactgatgagaatgagccgttgcaggcaatgatgaaagaccagtttgcaaactatgtggtgcagaaggttctagagatatgtgatgaccagaaccgtgaattgattctttcccgtatcaaggtccacttgaatgcactgaaaagatacacctacgggaagcatattgtggcacgtgttgagaagcttattgccgcaggagaacggcgcattggcgccccatcctcctgctga

SEQ ID NO: 8598 - protein, 998 aa, Sorghum bicolor
  misc_feature: Ceres ANNOT ID no. 6091269
  misc_feature (306)..(664): Pfam Id: NABP Pfam Desc: Nucleic acid binding protein NABP
  misc_feature (665)..(699): Pfam Id: PUF Pfam Desc: Pumilio-family RNA binding repeat
  misc_feature (701)..(735): Pfam Id: PUF Pfam Desc: Pumilio-family RNA binding repeat
  misc_feature (737)..(772): Pfam Id: PUF Pfam Desc: Pumilio-family RNA binding repeat
  misc_feature (773)..(807): Pfam Id: PUF Pfam Desc: Pumilio-family RNA binding repeat
  misc_feature (809)..(843): Pfam Id: PUF Pfam Desc: Pumilio-family RNA binding repeat
  misc_feature (846)..(880): Pfam Id: PUF Pfam Desc: Pumilio-family RNA binding repeat
  misc_feature (882)..(916): Pfam Id: PUF Pfam Desc: Pumilio-family RNA binding repeat
  misc_feature (924)..(958): Pfam Id: PUF Pfam Desc: Pumilio-family RNA binding repeat
  misc_feature (567)..(994): NCBI GI: 62002537 NCBI Desc: puf-domain rna-binding protein [physcomitrella patens]
  misc_feature (398)..(998): NCBI GI: 20513851 NCBI Desc: bpm [hordeum vulgare]
  misc_feature (216)..(993): NCBI GI: 115441005 NCBI Desc: os01g0844800 [oryza sativa (japonica cultivar-group)]
  misc_feature (172)..(993): NCBI GI: 92885524 NCBI Desc: nucleic acid binding nabp [medicago truncatula]
  misc_feature (279)..(997): NCBI GI: 22330960 NCBI Desc: pumilio/puf rna-binding domain-containing protein [arabidopsis thaliana]
  misc_feature: The sequence is a functional homolog of SEQ ID NO 1232 in the 10/666,642US patent application
  misc_feature: Useful for making plants with modulated growth and phenotype characteristics
  misc_feature: The sequence is a functional homolog of SEQ ID NO 1232 in the 20070033671 US patent application
  misc_feature: The sequence is a functional homolog of SEQ ID NO 1232 in the 10/666,642 US patent application
MAPSQAAAAGPTFEDLERDLQAVLMDQNHTAPADELSMFRSGSAPPTVEGSRTAIGALFSGPPLPANNLGGSGGGGTGAGIDMLTEEEIRSHPAYLSYYYSNEHLNPRLPPPMVSKEDWRAAQRFQAVSGGIGDRRRRPSEVGSGNSLFSVQPGAREVGGEKALLSDRMGRGERNGLARQQSSEWLGRGADGLIGLSDISGLGSRRKSFADALQENISRPAATAGHLSRSNSRNALEGPTPIRSSDSPKPQLQNRSESMNGLRSGSTSPSLVRVQSLGSSMSHTFASAVGSSISRSTTPDPQLIRRTPSPCLPPVGVRMGSSDKKVEAAAVASLNHDGADIAATLSSLSLSGNKMSNVENEVQNHVYQNFGDQADVLFNVPKDHRQFSQQNLTQNTNEDSLNAPEYAVFPNGGSNFSNLHASKLASHRNSKFPMQSPHGNANKKGSLMSSAGSVSHYQNLNGDSHGIDVSGRHMKTHAGGFTSSMLNPDGDYGNVLSNHGGSSYQGQPTETMYAQYLQANPDSPLGSAASMSPFQGRGFTGSGHLDSPGYQKAYLGSLFAQQKLQYGIPYLGKSGALNQNIYGNDPAFGIGMTYLTSPPSSPYISSPQGHVRQGDRLTRLPAVVRNTAGGSMGSWSSENGLMDNGGSSLLEEFKTNKTRSFELLDIVGHVVEFSSDQYGSRFIQQKLETASIEEKNMIFPEILPQARTLMTDVFGNYVIQKFFEYGTETQTKQLATLLKGYVLQLSLQMYGCRVIQKALEVVEVEQQTQMALELDGSIMRCVRDQNGNHVIQKCIECIPQERIRFIISAFYGHVVELSMHPYGCRVIQRVLEHCDDESTQNAMMEEIMQSVVTLTEDQYGNYVIQHVLQHGKPEERSTIITQLAGQIVKMSQQKFASNVVEKCLTFGNPEQRQILINEMLGTTDENEPLQAMMKDQFANYVVQKVLEICDDQNRELILSRIKVHLNALKRYTYGKHIVARVEKLIAAGERRIGAPSSC

SEQ ID NO: 8599 - DNA, 1398 bp, Sorghum bicolor
  misc_feature: Ceres ANNOT ID no. 6091272
  misc_feature: Encodes the peptide sequence at SEQ ID NO 8600
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
atgagcgccgaccagggccgactcgcggagggtgcttggactgcacctgtcatggatcgcgccgagctcaccactgagcaggttctcaagcgagatattccatgggagcattacatgtcaactaagcttatctctggaacatgccttcagcttttacggcgatatgaccacaaaccagagagtcagcgagctcctttgcttgaggaggacgggccagcgtatgtccgagttttcctgaatatcctgcggagcatctccaaggaagagactgtggaatacgtgcttgctctcattgatgaaatgcttgcagcaaatcctaagcgtgcagcactgttttatgaccaatctctgtctggtgaagatatttatgagttgttgtggaaaggcaactggtttgtacaagaaaaaagttgtaagatattgactgatataattagtgcacgaccaaagcttcagaatggcatgcttccaaatggagatgcttcaaattcaaagagcaaacttacttcaacacatgatgtattgagagatttggttgattggctctgttcacagctgaggaatcctacacacccgagctgctctattcctacttctatccattgcctctccactttgctcagagaaccatatgttaggacattatttgttcaagctgatggcatcaagctgctcattcctttgatatccccagcttccacacaacagtcaattcagctcctttatgaaacttgcctctgcatctggcttttatcattctatgatgctgcagttgattatttgtccaccacaagggttatgccaagacttgtagaggttgtcaagggctctactaaagagaaggtggtcagagttgttgtgttgtccttccgtaatttgctggcaaagggtgcatttgctgcacagatgatcgatcttggattgccacaaatagtacaaaacttgaaagctcaagcatggactgatgaggatctgttagatgctctgaatcaattagaggtgggactcaaagaaaacctcaagaagttgagttcctttgataagtacaaacagcaagttcttcttggtcaccttgactggtctccaatgcacaaagatccaagtttctggcgtgagaacattaacagttttgaagaaaatgatttccagattctacgagttctcatgacaatcattgacacatcaagtgacaccaccgcccttgccgtggcctgctatgacctctcacagttcctccagtaccatccatctggtcgaatcgtggtggcagacctcaaggccaaggaccaagtcatgaagctcatgaatcatgggaacactgaagtgaggaaaaatgcactgctctgtgtgcagaggctcttccttggcgcaaagtatgctagtttcctgcaggcttga

SEQ ID NO: 8600 - protein, 465 aa, Sorghum bicolor
  misc_feature: Ceres ANNOT ID no. 6091272
  misc_feature (16)..(420): Pfam Id: V-ATPase_H Pfam Desc: V-ATPase subunit H
  misc_feature (18)..(464): NCBI GI: 75243541 NCBI Desc: probable vacuolar atp synthase subunit h (v-atpase h subunit) (vacuolar proton pump subunit h)
  misc_feature (18)..(464): NCBI GI: 140063809 NCBI Desc: cytochrome b5; armadillo-like helical [medicago truncatula]
  misc_feature (18)..(465): NCBI GI: 20147135 NCBI Desc: at3g42050/f4m19_10 [arabidopsis thaliana]
  misc_feature (18)..(465): NCBI GI: 14334994 NCBI Desc: at3g42050/f4m19_10 [arabidopsis thaliana]
  misc_feature (124)..(464): NCBI GI: 115472671 NCBI Desc: os07g0549700 [oryza sativa (japonica cultivar-group)]
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
MSADQGRLAEGAWTAPVMDRAELTTEQVLKRDIPWEHYMSTKLISGTCLQLLRRYDHKPESQRAPLLEEDGPAYVRVFLNILRSISKEETVEYVLALIDEMLAANPKRAALFYDQSLSGEDIYELLWKGNWFVQEKSCKILTDIISARPKLQNGMLPNGDASNSKSKLTSTHDVLRDLVDWLCSQLRNPTHPSCSIPTSIHCLSTLLREPYVRTLFVQADGIKLLIPLISPASTQQSIQLLYETCLCIWLLSFYDAAVDYLSTTRVMPRLVEVVKGSTKEKVVRVVVLSFRNLLAKGAFAAQMIDLGLPQIVQNLKAQAWTDEDLLDALNQLEVGLKENLKKLSSFDKYKQQVLLGHLDWSPMHKDPSFWRENINSFEENDFQILRVLMTIIDTSSDTTALAVACYDLSQFLQYHPSGRIVVADLKAKDQVMKLMNHGNTEVRKNALLCVQRLFLGAKYASFLQA

SEQ ID NO: 8601 - DNA, 894 bp, Sorghum bicolor
  misc_feature: Ceres ANNOT ID no. 6091274
  misc_feature: Encodes the peptide sequence at SEQ ID NO 8602
atgagcatgtgtgagaaagatcagaatttgccatggggatacgacctgttccgcgacccttttgctcctcccaacgggtactacgggcctcctcccggctactgtgatggtcactgttgtgacctccattacggtagagcacatccagatgagactcagttgcattcttctcaactcacatatgatttgtacaacccatcagtaggcatctaccatcctggaagcacccatgagcatgagcacgagacagtatatgtagagccgtctagttcctctccagacgcagctggtgacggttattttgagatggaggaggaagtagggaagaggttttaccccatggtcccagttccccatgtccccaaaattaatggagaaattccatcaattgatgaagccactatggaccatgaaaggctgacagaaaggttgaagctgtatgagttggttgaacacaaggtgcaaggagatggcaactgtcagttccgagcactatcagaccagctttaccaaagtccagatcaccatgagtttgtgagggagcagataattaaccagcttaaaactaaccgtgacgcctatgatggatacgttcccatggcatatgatgattacttggagaaagttgcacgaaacggtgaatggggtgaccatgtgactctacaggctgctgctgacaagtatggagtaaaaatctttgtgatgacatcgttcaaggatacttgctacatcgagatccagcctaaggttcagaagtccaacaaagtggtactgttgagcttctgggcggaggtgcactacaactccatatatccgcagaatgatgcaccgaggtcacagacgacgaccaagaggaggagatggtggccgttctcgcagcaccaccaccattga

SEQ ID NO: 8602 - protein, 297 aa, Sorghum bicolor
  misc_feature: Ceres ANNOT ID no. 6091274
  misc_feature (155)..(267): Pfam Id: OTU Pfam Desc: OTU-like cysteine protease
  misc_feature (1)..(297): NCBI GI: 48716492 NCBI Desc: otu-like cysteine protease-like [oryza sativa (japonica cultivar-group)]
  misc_feature (1)..(210): NCBI GI: 48716493 NCBI Desc: otu-like cysteine protease-like [oryza sativa (japonica cultivar-group)]
  misc_feature (43)..(295): NCBI GI: 140068577 NCBI Desc: calcium-binding ef-hand; ovarian tumour, otubain [medicago truncatula]
  misc_feature (144)..(273): NCBI GI: 92885521 NCBI Desc: ovarian tumour, otubain [medicago truncatula]
  misc_feature (100)..(275): NCBI GI: 115458186 NCBI Desc: os04g0402300 [oryza sativa (japonica cultivar-group)]
MSMCEKDQNLPWGYDLFRDPFAPPNGYYGPPPGYCDGHCCDLHYGRAHPDETQLHSSQLTYDLYNPSVGIYHPGSTHEHEHETVYVEPSSSSPDAAGDGYFEMEEEVGKRFYPMVPVPHVPKINGEIPSIDEATMDHERLTERLKLYELVEHKVQGDGNCQFRALSDQLYQSPDHHEFVREQIINQLKTNRDAYDGYVPMAYDDYLEKVARNGEWGDHVTLQAAADKYGVKIFVMTSFKDTCYIEIQPKVQKSNKVVLLSFWAEVHYNSIYPQNDAPRSQTTTKRRRWWPFSQHHHH

SEQ ID NO: 8603 - DNA, 618 bp, Sorghum bicolor
  misc_feature: Ceres ANNOT ID no. 6091289
  misc_feature: Encodes the peptide sequence at SEQ ID NO 8604
atggccggagccgccgccgccgctgctgccaacggagggacgaccgcggctgctgccgccgcgacgggcgcggggtccccgtgcggcgcgtgcaagttcctgcgccggcggtgcgtgccggagtgcgtattcgcgccctacttcagcagcgaccagggcgccgcgcgcttcgccgccatccacaaggtgttcggcgccagcaacgcatccaagctgctgtcgcacctccccgtcgccgaccgctgcgaggccgtcgtcaccatcacctacgaggcgcaggccaggctacgcgaccctgtctacggctgcgtcgcccagatcttcgccctccagcagcaggccaaggcgcagctcgcgtgcggcgtccaaggcgccgcgcactcgccggcgagccaccagtggcccgacagcgccagcatcagcgccctgctccgccaggacacggcgtgcagcgccaggagacccggtcccctcgacgactgcttcatgccggagctcatggccgggttcagggacgacgtcgccgcggccgcgcagcattgtgccggcaaggtggatgccggcgagctccagtacctggcccaggccatgatgaggagccccaactactccctgtag

SEQ ID NO: 8604 - protein, 205 aa, Sorghum bicolor
  misc_feature: Ceres ANNOT ID no. 6091289
  misc_feature (1)..(200): NCBI GI: 48716501 NCBI Desc: lob domain protein-like [oryza sativa (japonica cultivar-group)]
  misc_feature (22)..(130): NCBI GI: 126567727 NCBI Desc: rootless concerning crown and seminal lateral roots [zea mays]
  misc_feature (22)..(133): NCBI GI: 126567721 NCBI Desc: rootless concerning crown and seminal lateral roots [zea mays]
  misc_feature (22)..(116): NCBI GI: 126567723 NCBI Desc: rtcs-like protein [zea mays]
  misc_feature (16)..(150): NCBI GI: 126567725 NCBI Desc: rtcn [zea mays]
  misc_feature: The plants are small.
  misc_feature: Useful for making plants with modulated biomass
  misc_feature: Functional homolog of the protein sequence given in SEQ ID NO 13546
MAGAAAAAAANGGTTAAAAAATGAGSPCGACKFLRRRCVPECVFAPYFSSDQGAARFAAIHKVFGASNASKLLSHLPVADRCEAVVTITYEAQARLRDPVYGCVAQIFALQQQAKAQLACGVQGAAHSPASHQWPDSASISALLRQDTACSARRPGPLDDCFMPELMAGFRDDVAAAAQHCAGKVDAGELQYLAQAMMRSPNYSL

SEQ ID NO: 8605 - DNA, 939 bp, Sorghum bicolor
  misc_feature: Ceres ANNOT ID no. 6091291
  misc_feature: Encodes the peptide sequence at SEQ ID NO 8606
atggcggccacctccgcgttcgagtcatccccggagatggagcggttcctctgcgagcggctgttggacgcggagcagcccatcgcagagcgcttccgggcgctcttctccctccgcaacctccgcggggatgcgccgcgccgcgccctcctccaagctgcaagggatccttctaacttgcttgcccatgaggctgcatttgcacttggacaaatgcaggatgctgaggctattcctgcactggtggcagtgctcaaagatctttctctacatccaattgtccgccatgaggcagcagaagctcttggagctattggcctggaaaagagcatccccctgttggaggaaagtttaacaactgatcctgctgtggaggtacaagaaacttgcgagctggcgctaagacgaatagaagagcagaagaaagctaatggtgctgagagtacagtcgcttcaccctttctctcagttgatccagcgctgcctgcaaagcatggactttcagtagatcaattaagggatctactcctcaatgaacaagagagcatgtacgaacgttatgcagctctttttgcacttaggaatgatggtggagatgctgctgtttctgctattgttgcagctctgagcgtcaaaagtgctcttctacgtcacgaggttgcttatgtgttaggtcagctgcaaaacaaagccgcttcagatgcactttctacagtcctgaaggatgtctgtgagcatccaatggtcaggcatgaagctgctgaagcccttggctcaattgcagaccaagaaagcattgcgcttttggaggagtttgcaaaggatcctgagcccattgtctcgcagagctgtgaagtagctctcagtatgcttgagtatgagagatcggggaagtcctttgagtttctcttccttcagactcctcatgtgcagtcctag

SEQ ID NO: 8606 - protein, 312 aa, Sorghum bicolor
  misc_feature: Ceres ANNOT ID no. 6091291
  misc_feature (61)..(87): Pfam Id: HEAT_PBS Pfam Desc: PBS lyase HEAT-like repeat
  misc_feature (94)..(120): Pfam Id: HEAT_PBS Pfam Desc: PBS lyase HEAT-like repeat
  misc_feature (249)..(275): Pfam Id: HEAT_PBS Pfam Desc: PBS lyase HEAT-like repeat
  misc_feature (3)..(311): NCBI GI: 115489670 NCBI Desc: os12g0626100 [oryza sativa (japonica cultivar-group)]
  misc_feature (1)..(311): NCBI GI: 114149288 NCBI Desc: deoxyhypusine hydroxylase-a (deoxyhypusine monooxygenase-a)
  misc_feature (13)..(311): NCBI GI: 114149289 NCBI Desc: deoxyhypusine hydroxylase-b (deoxyhypusine monooxygenase-b)
  misc_feature (1)..(310): NCBI GI: 22655416 NCBI Desc: at3g58180/f9d24_90 [arabidopsis thaliana]
  misc_feature (21)..(302): NCBI GI: 19527182 NCBI Desc: riken cdna 1110033c18 [mus musculus]
  misc_feature (1)..(311): SWISSPROT Homolog: EC 1.14.99.29 Deoxyhypusine hydroxylase-A
MAATSAFESSPEMERFLCERLLDAEQPIAERFRALFSLRNLRGDAPRRALLQAARDPSNLLAHEAAFALGQMQDAEAIPALVAVLKDLSLHPIVRHEAAEALGAIGLEKSIPLLEESLTTDPAVEVQETCELALRRIEEQKKANGAESTVASPFLSVDPALPAKHGLSVDQLRDLLLNEQESMYERYAALFALRNDGGDAAVSAIVAALSVKSALLRHEVAYVLGQLQNKAASDALSTVLKDVCEHPMVRHEAAEALGSIADQESIALLEEFAKDPEPIVSQSCEVALSMLEYERSGKSFEFLFLQTPHVQS

SEQ ID NO: 8607 - DNA, 582 bp, Sorghum bicolor
  misc_feature: Ceres ANNOT ID no. 6091297
  misc_feature: Encodes the peptide sequence at SEQ ID NO 8608
atggagttggggccagagaggaaggacgacgagggtgcaggtgcacgggcgtcgccatcggcgtcgtccccgagctgcgaggccgacgacaacaaggatctgccgaagcagcagcagcgcgccatcggcggcggtggcggcgatgacgacgagggaacaaggcagccgtacaagtgcaccttctgcaggagggggttcccgacggcgcaggcgctcggcggccacatgaacgtccaccgtcggcacaggggcagaccagcagcagtgtccgccggcgccgccagtgtctacgactacgaccagcagccatgctcgacgatgacgacgtcgacgacgcccgttctggcgttcgcccaacaggctacgacgacgactcggccggcggccggcgcgttgcacgcccaacggaagccgcacgagctgctgcctctgttcggccgcggtgactgctgttctgccggccgtggcagtggcgcggccgccggagatgtacgagaagatggctacttcgccatcgccgaggaaggggatggaggggaggagctggacttggagctcaggcttggaagtgcaggatcatga

SEQ ID NO: 8608 - protein, 193 aa, Sorghum bicolor
  misc_feature: Ceres ANNOT ID no. 6091297
  misc_feature (52)..(189): NCBI GI: 38346721 NCBI Desc: osjnba0086o06.19 [oryza sativa (japonica cultivar-group)]
  misc_feature (34)..(97): NCBI GI: 51091156 NCBI Desc: zinc finger protein-like [oryza sativa (japonica cultivar-group)]
  misc_feature (52)..(189): NCBI GI: 7268534 NCBI Desc: superman like protein [arabidopsis thaliana]
  misc_feature (57)..(85): NCBI GI: 28948901 NCBI Desc: chain a, nmr structure of the single qalggh zinc finger domain from arabidopsis thaliana superman protein
  misc_feature (19)..(85): NCBI GI: 37514920 NCBI Desc: one finger-type zinc finger protein for rabbit ears [arabidopsis thaliana]
  misc_feature: The sequence is a functional homolog of SEQ ID NO 10 in the 10/412,699US patent application
  misc_feature: The sequence is a functional homolog of SEQ ID NO 1013 in the 10/666,642US patent application
  misc_feature: The sequence is a functional homolog of SEQ ID NO 1091 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 232 in the 10/666,642US patent application
  misc_feature: The sequence is a functional homolog of SEQ ID NO 636 in the 10/374,780US patent application
  misc_feature: The sequence is a functional homolog of SEQ ID NO 904 in the 10/412,699US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1091 in the 20040045049 US patent application
  misc_feature: The sequence is a functional homolog of SEQ ID NO 904 in the 20040045049 US patent application
  misc_feature: The sequence is a functional homolog of SEQ ID NO 1013 in the 20070033671 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MELGPERKDDEGAGARASPSASSPSCEADDNKDLPKQQQRAIGGGGGDDDEGTRQPYKCTFCRRGFPTAQALGGHMNVHRRHRGRPAAVSAGAASVYDYDQQPCSTMTTSTTPVLAFAQQATTTTRPAAGALHAQRKPHELLPLFGRGDCCSAGRGSGAAAGDVREDGYFAIAEEGDGGEELDLELRLGSAGS

SEQ ID NO: 8609 - DNA, 504 bp, Sorghum bicolor
  misc_feature: Ceres ANNOT ID no. 6091300
  misc_feature: Encodes the peptide sequence at SEQ ID NO 8610
atgggtgcatgctgctgctgttcatcaagggcgtctgagtcagatagagcaccagtgcatatctatcatcgacaaaatcctgaggaatatgaacccttgtcttcagctgttagtggaccatctccaactcctgctgtagttgcagttgacacaaatcttgatacatcctctcttgacacttaccgagcaccacctgcacctttgccttatgatgtttgcttcgcagttgcacaaaatcctgatttggagaagtcagacattaaaatgaaaactgacgggcagcagcccccaaaagtggatgaatttgagtcatgcgaaaaagttgcccctgaggataaggctgatgaggaggatgtttgtccaatctgtcttgaagaatatgatgaagaaaatccccgttcggtgaccagatgcgagcatcatttccatctctgctgcatacttgaatggatggagaggagcgagacatgcccagtttgtgaccaggttagcacaacaatttaa

SEQ ID NO: 8610 - protein, 167 aa, Sorghum bicolor
  misc_feature: Ceres ANNOT ID no. 6091300
  misc_feature (120)..(160): Pfam Id: zf-C3HC4 Pfam Desc: Zinc finger, C3HC4 type (RING finger)
  misc_feature (90)..(162): NCBI GI: 23505815 NCBI Desc: at5g41350/myc6_6 [arabidopsis thaliana]
  misc_feature (114)..(160): NCBI GI: 57900128 NCBI Desc: zinc finger (c3hc4-type ring finger) protein-like [oryza sativa (japonica cultivar-group)]
  misc_feature (1)..(162): NCBI GI: 20334768 NCBI Desc: at4g23450/f16g20_150 [arabidopsis thaliana]
  misc_feature (81)..(163): NCBI GI: 79324959 NCBI Desc: rhb1a; protein binding / ubiquitin-protein ligase/ zinc ion binding [arabidopsis thaliana]
  misc_feature (114)..(163): NCBI GI: 92885424 NCBI Desc: zinc finger, ring-type; ringv [medicago truncatula]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
  misc_feature: The sequence is a functional homolog of SEQ ID NO. 350 in the 11/188,298 US application
MGACCCCSSRASESDRAPVHIYHRQNPEEYEPLSSAVSGPSPTPAVVAVDTNLDTSSLDTYRAPPAPLPYDVCFAVAQNPDLEKSDIKMKTDGQQPPKVDEFESCEKVAPEDKADEEDVCPICLEEYDEENPRSVTRCEHHFHLCCILEWMERSETCPVCDQVSTTI

SEQ ID NO: 8611 - DNA, 987 bp, Sorghum bicolor
  misc_feature: Ceres ANNOT ID no. 6091310
  misc_feature: Encodes the peptide sequence at SEQ ID NO 8612
atgtcctggtgcactattgagtctgatcctggtgtgttcaccgagctgattcagcaaatgcaagtgaaaggtgtacaggtggaagagctttattctcttgatgtggattctcttagtcaactgcggccagtatatgggctaatttttctcttcaagtggatacctggggagaaggatgaacggcttgttgtcagagatcctaatccaaaccttttctttgcacaccaagtcatcactaacgcatgtgctactcaagctattctctcagttctcatgaatcgccctgaaattgacatcggtccagaattatctcaattgaaggaattcacaggagctttcacacctgatctgaagggcttagctatcagcaacagcgaatccatccggacagctcataacagctttgcaaggccagagccatttatttctgatgagcagagagccgcgactaaggatgatgatgtttaccatttcataagctatttaccttttgaaggtgtcctgtatgagctggatgggctgaaggaagggcctgtaaatcttgggcagtgcggtggtgctgatgaccttgattggctacggatggtgcagccagttattcaagaaaggattgagcgctactcacagagtgagatcaggttcaatcttatggccatcataaagaacaggaaagaggtgtacagtgctgagctggaggagctggagaagagaagggagcagattttgcaggagatgaacaagactgccgccacagaatccttgaacaactcgcttacagaggtgatatcggcaatcgaaaccgtcagagagaagatggtcatggaagaagagaagttcaagaagtggaagacggagaacattcggaggaagcataactacatccctttcctcttcaacttgctgaagatgcttgcagagaagcagcaactaaaacctctggtcgagaaagccaaacagcaaaagtcatcaagccctagcacaagatga

SEQ ID NO: 8612 - protein, 328 aa, Sorghum bicolor
  misc_feature: Ceres ANNOT ID no. 6091310
  misc_feature (2)..(207): Pfam Id: Peptidase_C12 Pfam Desc: Ubiquitin carboxyl-terminal hydrolase, family 1
  misc_feature (1)..(324): NCBI GI: 15724238 NCBI Desc: f5i14.29/f5i14.29 [arabidopsis thaliana]
  misc_feature (3)..(324): NCBI GI: 6686411 NCBI Desc: f1e22.3 [arabidopsis thaliana]
  misc_feature (3)..(323): NCBI GI: 4878009 NCBI Desc: ubiquitin c-terminal hydrolase uch37 [bos taurus]
  misc_feature (3)..(323): NCBI GI: 7706753 NCBI Desc: ubiquitin c-terminal hydrolase uch37 [homo sapiens]
  misc_feature (3)..(323): NCBI GI: 115394786 NCBI Desc: uchl5 [sus scrofa]
  misc_feature (3)..(323): SWISSPROT Homolog: EC 3.4.19.12 Ubiquitin carboxyl-terminal hydrolase isozyme L5
  misc_feature (1)..(224): SWISSPROT Homolog: EC 3.1.2.15 Ubiquitin carboxyl-terminal hydrolase 2
MSWCTIESDPGVFTELIQQMQVKGVQVEELYSLDVDSLSQLRPVYGLIFLFKWIPGEKDERLVVRDPNPNLFFAHQVITNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCGGADDLDWLRMVQPVIQERIERYSQSEIRFNLMAIIKNRKEVYSAELEELEKRREQILQEMNKTAATESLNNSLTEVISAIETVREKMVMEEEKFKKWKTENIRRKHNYIPFLFNLLKMLAEKQQLKPLVEKAKQQKSSSPSTR

SEQ ID NO: 8613 - DNA, 1032 bp, Sorghum bicolor
  misc_feature: Ceres ANNOT ID no. 6091311
  misc_feature: Encodes the peptide sequence at SEQ ID NO 8614
atggaagccccgggctccccatacgcctcctcgccggaatccgcccccaagcgtgccccccgctcccctccgcagcagcagcctccctccgaggaaggagatgacaaggagaaaccaacacatttgaggtttctggtgtctaatacagcagcaggatgtatcattggcaagggtggatcaactattaatgactttcagtcccagtctggggctcgtattcagttatcacgcagccatgagtttttccctggtacaaatgacagaatcatcatggtttctggactgtttgatgaagtaatgaaggccatggagttgattcttgagaaacttttggctgagggtgaagaattcaatgaagctgaagctagacctaaagttagacttgtagttcctaacagctcgtgtggtgggataattggtaaaggtggagcaacaataaagtcatttattgaagaatcacatgctggaatcaaaatttctccacaggataacaactatgttggtttgcatgataggcttgttacagtcacaggaacctttgataatcagatgaatgcgatagatttgatactgaagaagttatctgaggatgttcactacccacctaatttgagttccccatttccatatgcaggtcttactttcccaaactaccctggtgttcctgttggttatatgattccacaggtgccatataataatgctgtgaactatggacctaataatgggtacggaggaaggtaccaaaacaacaagcccagtacacctatgaggtcgcctgctagtaatgaagcccaagaatctttgaccattggtatagctgatgaacacattggtgctgttgtaggtcgtgctggaaggaacataacagagatcattcaggctagtggtgctcggatcaagatatcagataggggtgacttcatatctgggacatctgacaggaaggtgacgattactggaacatcagaagctatccggaccgcggagtccatgatcatgcagagggtgtcagccagttcagagaggtga

SEQ ID NO: 8614 - protein, 343 aa, Sorghum bicolor
  misc_feature: Ceres ANNOT ID no. 6091311
  misc_feature (41)..(106): Pfam Id: KH_1 Pfam Desc: KH domain
  misc_feature (125)..(190): Pfam Id: KH_1 Pfam Desc: KH domain
  misc_feature (268)..(333): Pfam Id: KH_1 Pfam Desc: KH domain
  misc_feature (1)..(343): NCBI GI: 48716278 NCBI Desc: kh domain-containing protein nova-like [oryza sativa (japonica cultivar-group)]
  misc_feature (116)..(343): NCBI GI: 459269 NCBI Desc: transcribed sequence 1087 [zea mays]
  misc_feature (5)..(240): NCBI GI: 30230625 NCBI Desc: neuro-oncological ventral antigen 1-like protein [rattus norvegicus]
  misc_feature (5)..(240): NCBI GI: 56549651 NCBI Desc: neuro-oncological ventral antigen 1 isoform 2 [homo sapiens]
  misc_feature (5)..(240): NCBI GI: 49258011 NCBI Desc: mgc84002 protein [xenopus laevis]
MEAPGSPYASSPESAPKRAPRSPPQQQPPSEEGDDKEKPTHLRFLVSNTAAGCIIGKGGSTINDFQSQSGARIQLSRSHEFFPGTNDRIIMVSGLFDEVMKAMELILEKLLAEGEEFNEAEARPKVRLVVPNSSCGGIIGKGGATIKSFIEESHAGIKISPQDNNYVGLHDRLVTVTGTFDNQMNAIDLILKKLSEDVHYPPNLSSPFPYAGLTFPNYPGVPVGYMIPQVPYNNAVNYGPNNGYGGRYQNNKPSTPMRSPASNEAQESLTIGIADEHIGAVVGRAGRNITEIIQASGARIKISDRGDFISGTSDRKVTITGTSEAIRTAESMIMQRVSASSER

SEQ ID NO: 8615 - DNA, 1959 bp, Sorghum bicolor
  misc_feature: Ceres ANNOT ID no. 6091313
  misc_feature: Encodes the peptide sequence at SEQ ID NO 8616
  misc_feature: Up-regulated in shoot tissues in response to salicylic acid treatment
atgagcctatcaccgctcgactcctcctccccgccggcggcggccgaggtgcccctcgccccgggcttccgcttccaccccaccgacgaggagctcgtctcctactacctccgccgccgcgtcctcggccgccgcctccgcgtcgacgccatcgccgaggtcgatctctaccgcctcgagccctgggacctgccctccctctcccgcatccgcagccgcgacgcccagtggtacttcttcgcccgcctcgaccgcaaggtcgccggcgccggcgccgggggccggggcggccccggcaacaggaccaaccgcgccacgccgagggggtactggaagaccacgggcaaggaccgcgaggtgcaccaccgcggcaagcccgttgggatgaagaagacgctcgtcttccacgccgggagggcgcctaagggcgagaggaccaactgggtcatgcacgagtaccgcctcctcgacgcagacgggcctcaggatctgcatgtggtgtgtagaatcttccagaagcatggatctggaccacagaacggtgcgcagtatggtgcaccatacatggaagaggaatgggaagaggatgatgatgctattgagaatggtcctaccagtggcgcatctgctcaaatggctgcaatcacatgtgctgtagatgaggagtcaaatgaggacgatgagaatgcgtattgtgaaacaaacagacctgctcgagtagaaccatctcatctgcctttggtccatgaaatgctcaatccaccagagatggctcctcaacaaggtcaggattctaaagagacaagtgatggaagctgtgctgatggtgctatttctctggaagaggttttgcaggaacctttgtcgaatattagtgtggagaatataggtagacttgaagggcagaatgcaactgatgatagcatcaatgttgatgacttgttatcagcataccccaggaaagataatggctatgtaggccaggataacactatgaatgggagtggtccagcagatggtgatcacacaagctggcctttgagagcatatagtaatcagaactatgtcaatggccctcttgctgatgagttctttgacacagggaatgataccaatggggttgcatattctgggcagcagcaagctgatggctttccagcacctcgccaagtggatgacagtatggtattttatgatgctccatctgattataacttggtggatggaaatgatgacttcgtatatctgaatgacctcctcaatgagccacttggaaatgaatcactctttgatggagatgatgtgatggcttactttgacgccacagagaatgatttcaagtatgacattttgggctctgctcagggttcgaattatcaacttgcagacatgccgttgaactttgcccaaaagagtgataacaaagacaagtttacattcgatgggatctcagaggttccggaagcaaatgctcagtacggtgcatcctcatctggttcccatgaggatctgtatgcagatactgaatttccaggtgtgccaacagatgacactgctgataaaacttatggaaagcgccttgccagcatgttgggctctatcccagctccacctgcaatggcctcagaattcccgccatcgacagggaaatctgttgggatgctctcggctgtcagctcaagctcaattcgtgttactgctggcatcatccaacttgatggcctcactttcagcagtggctccgatcggtggcccttgcagaagaatggagacttgagtttgcttgtgtctttcgccgtggagagcgacgtgtcatccaagcttcctgttggtcttgaggatgctactcggattagcactgttcccatggtgatgcgaagtggcttttaccttttctttatgtcggccatgattctcctgttgagctacaaagtagggtcgtgtatctacagcaggtga

SEQ ID NO: 8616 - protein, 652 aa, Sorghum bicolor
  misc_feature: Ceres ANNOT ID no. 6091313
  misc_feature (19)..(156): Pfam Id: NAM Pfam Desc: No apical meristem (NAM) protein
  misc_feature (129)..(640): NCBI GI: 29367359 NCBI Desc: nac-like protein [oryza sativa (japonica cultivar-group)]
  misc_feature (19)..(245): NCBI GI: 21105746 NCBI Desc: nam-like protein 9 [petunia x hybrida]
  misc_feature (19)..(414): NCBI GI: 6456751 NCBI Desc: nac2 [arabidopsis thaliana]
  misc_feature (12)..(282): NCBI GI: 21105744 NCBI Desc: nam-like protein 8 [petunia x hybrida]
  misc_feature (19)..(198): NCBI GI: 18398627 NCBI Desc: no apical meristem (nam) family protein [arabidopsis thaliana]
  misc_feature: The sequence is a functional homolog of SEQ ID NO 162 in the 10/225,068US patent application
  misc_feature: The sequence is a functional homolog of SEQ ID NO 2414 in the 10/374,780US patent application
  misc_feature: The sequence is a functional homolog of SEQ ID NO 428 in the 11/435,388US patent application
  misc_feature: The sequence is a functional homolog of SEQ ID NO 508 in the 10/412,699US patent application
  misc_feature: The sequence is a functional homolog of SEQ ID NO 728 in the 10/225,066US patent application
  misc_feature: Useful for making plants with modulated growth and phenotype characteristics
  misc_feature: The sequence is a functional homolog of SEQ ID NO 508 in the 20040045049 US patent application
  misc_feature: Up-regulated in shoot tissues in response to salicylic acid treatment
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MSLSPLDSSSPPAAAEVPLAPGFRFHPTDEELVSYYLRRRVLGRRLRVDAIAEVDLYRLEPWDLPSLSRIRSRDAQWYFFARLDRKVAGAGAGGRGGPGNRTNRATPRGYWKTTGKDREVHHRGKPVGMKKTLVFHAGRAPKGERTNWVMHEYRLLDADGPQDLHVVCRIFQKHGSGPQNGAQYGAPYMEEEWEEDDDAIENGPTSGASAQMAAITCAVDEESNEDDENAYCETNRPARVEPSHLPLVHEMLNPPEMAPQQGQDSKETSDGSCADGAISLEEVLQEPLSNISVENIGRLEGQNATDDSINVDDLLSAYPRKDNGYVGQDNTMNGSGPADGDHTSWPLRAYSNQNYVNGPLADEFFDTGNDTNGVAYSGQQQADGFPAPRQVDDSMVFYDAPSDYNLVDGNDDFVYLNDLLNEPLGNESLFDGDDVMAYFDATENDFKYDILGSAQGSNYQLADMPLNFAQKSDNKDKFTFDGISEVPEANAQYGASSSGSHEDLYADTEFPGVPTDDTADKTYGKRLASMLGSIPAPPAMASEFPPSTGKSVGMLSAVSSSSIRVTAGIIQLDGLTFSSGSDRWPLQKNGDLSLLVSFAVESDVSSKLPVGLEDATRISTVPMVMRSGFYLFFMSAMILLLSYKVGSCIYSR

SEQ ID NO: 8617 - DNA, 2292 bp, Sorghum bicolor
  misc_feature: Ceres ANNOT ID no. 6091324
  misc_feature: Encodes the peptide sequence at SEQ ID NO 8618
atggacgagtaccatcaccaccaccaccgcatgggcgccgccgccgacttccgccgcgacctcgaggacctcgtctgcgaccacctcggcggctgcttctccccgcccccgtcctcctcctcctcctgctccgccgcggcggggggaggcgccgcggaccatgagcccgacggcgaggccgagtcgtcggcggcgcgcaggcggaggcgggagtcgcgcctcctcagccgctgggtcgcgcgccaggccgaggaggtgctctcctccatggagcgcgaggtcgagcgccgcaaccgcgaggccgagctcctcgcgcttgcgcgcctccacccggtctccaccctcgacccatcctccttcctcctctcctcgcccgccacgccgccgccgccgcgcccgcaggcgccctcccccgccgcgccctcctcgctcctgcagatgtggcgcgagctcgagcaccgccgcgccgacgcccaccccttcgaccgcgagcccaccccggacaacgccgaccgtgaccgcgagcgcgtgcgccagatcgcgcgacgcctcaccgacaccgccgacagtccaacggccgccgccgccgcagccacagctaacggggagtggctcggcgagacggagaggcagagggtcaggctcgtaagggagtgggtgcagatggccagccagccacgtgactctcgtgcgggtgtgcgcagggacgagcctgctgccggcgccgacagggacaggcgaggggagcctcctcggctacgaggccggcaggcgagattggatgtcatcagccggatggccagggagcgtcagcgcgagctgcagggaatatcagggtaccatgtcgtgtccgagttccctcgccgcagccgcaaccgcatccagggattgcttagggggaggttcttgaggaatggggcgcttccggttgaagaggagcgaccaccatctgtggcagcgagggagctcgggcagttgaggcagagccatcgtatgcccgccttgagatcagagagtgttgcaagtagtcaagatgttagccaatctgatgcttctgtgcctgagagtgttagattactagttaatgatgaatctcagcaagtggctgatgtggcttttactgatactgaggatactgcccaaacgttgctggagaatgtggatttacaagaaatggatgcagatcgtgctgaggcacactcaccaagtatacctttggatgacatggttgtaatgcaagagtctctaactcaaggtgataacatgcggcaagatgagacagaagatgacacgggattctggcagtcatctttggatggcaggcttgataggtggcccagtgatattgatgaaggtgctgacagaacttgggaagataatgcagaagacttgcacagtgaaactgtggaggaggatgacagggagcatggtcatctacaagaagagcatgatggatggcatgatgacgagtctcatggtaccatggagaactggcaagatgattaccaagattccacacttgatacaggccccattcctaggaccgaaaataggtttattccacctgatgatgacaatgtgtacagcatggaacttagagaattacttagcaggcgaagtgtgtccaatcttcttagtaatggctttggtgaaagtttggagcgattaataaggtcatatgttcaacggcgtggtcatggtcccctcaactggaatcttgatgcagccatgccccctacgaatgcaccaaatgcaaatcaggaacaagaaaggaaccctgaaacacggcaattccagggtccggtcaatagacctgcccttgttatccctcctccacctttgccaccgcgacaaccattatggcacagagaactgcgtcataacaactggagcagcagacacagggaatgggatgctattaatgatttaagagctgacatgggtagactccagcaagggatgagcagcatgcagaggatgctggaagcgtgcatggatatgcagctggaattgcagcgttctgtgagacaagaagtgtcagctgccttgaatcgatttgcaggacctgaaggattctcgatggatctgtctgacgatggatcaaaatgcaatcaagtgaggaaaggaacctgctgcatatgctgcgatacgcaaatcgattctctactgtacaggtgtggacacatgtgtacttgctcgaaatgtgcaaatgagctggtgcgcagcggtggcaagtgcccgctctgccgggctcccatcgtggaggtggtccgcgcatactcagtattgtaa

SEQ ID NO: 8618 - protein, 763 aa, Sorghum bicolor
  misc_feature: Ceres ANNOT ID no. 6091324
  misc_feature (1)..(763): NCBI GI: 48716309 NCBI Desc: ubiquitin-protein ligase-like [oryza sativa (japonica cultivar-group)]
  misc_feature (447)..(763): NCBI GI: 115480787 NCBI Desc: os09g0570500 [oryza sativa (japonica cultivar-group)]
  misc_feature (484)..(760): NCBI GI: 115472235 NCBI Desc: os07g0499800 [oryza sativa (japonica cultivar-group)]
  misc_feature (251)..(758): NCBI GI: 4926833 NCBI Desc: t17h7.18 [arabidopsis thaliana]
  misc_feature (675)..(761): NCBI GI: 17136356 NCBI Desc: cg11988-pa, isoform a [drosophila melanogaster]
MDEYHHHHHRMGAAADFRRDLEDLVCDHLGGCFSPPPSSSSSCSAAAGGGAADHEPDGEAESSAARRRRRESRLLSRWVARQAEEVLSSMEREVERRNREAELLALARLHPVSTLDPSSFLLSSPATPPPPRPQAPSPAAPSSLLQMWRELEHRRADAHPFDREPTPDNADRDRERVRQIARRLTDTADSPTAAAAAATANGEWLGETERQRVRLVREWVQMASQPRDSRAGVRRDEPAAGADRDRRGEPPRLRGRQARLDVISRMARERQRELQGISGYHVVSEFPRRSRNRIQGLLRGRFLRNGALPVEEERPPSVAARELGQLRQSHRMPALRSESVASSQDVSQSDASVPESVRLLVNDESQQVADVAFTDTEDTAQTLLENVDLQEMDADRAEAHSPSIPLDDMVVMQESLTQGDNMRQDETEDDTGFWQSSLDGRLDRWPSDIDEGADRTWEDNAEDLHSETVEEDDREHGHLQEEHDGWHDDESHGTMENWQDDYQDSTLDTGPIPRTENRFIPPDDDNVYSMELRELLSRRSVSNLLSNGFGESLERLIRSYVQRRGHGPLNWNLDAAMPPTNAPNANQEQERNPETRQFQGPVNRPALVIPPPPLPPRQPLWHRELRHNNWSSRHREWDAINDLRADMGRLQQGMSSMQRMLEACMDMQLELQRSVRQEVSAALNRFAGPEGFSMDLSDDGSKCNQVRKGTCCICCDTQIDSLLYRCGHMCTCSKCANELVRSGGKCPLCRAPIVEVVRAYSVL

SEQ ID NO: 8619 - DNA, 1071 bp, Sorghum bicolor
  misc_feature: Ceres ANNOT ID no. 6091325
  misc_feature: Encodes the peptide sequence at SEQ ID NO 8620
atgtccccggcggaggcccggctggcgatgatggagctggcgaacatggtgtcggtcccgatggcgctgacggccgtaatccggctgggcgtccccgccgcaatatgggctggcggcgccaacgcgccgcggtcggcggccgagctcctcccggcgggccacccggacccgtcggtcctggagcggctgctccgcctgctggcgtcccgcggcgtcttctccgagtccacgtccacgtcggaggaccggacgacgacgacgcggcggttcgcgctcaccgcggtgggccgcacgctggtgccggagggcgcctcgggcgcgtcgtacgccgactacgtgctgcagcaccaccaggacgcgctggtggcggcgtggccgcggctgcacgaggccgtgctggacccgcgcgggcccgagccgttcgcgcgcgccaacgccggcgtccccgcctacgcctactacggcaaggacagggaagctaaccaggtgatgctccgcgccatgacgggggtctccgagcccttcatgcacgccctcctcgacggctacggcttcgacggcgggttccacggcgtcgccacgctcgtcgacgtcgggggaagctccggcgcctgcctcgagatgatcatgcgcagggtccccactatcaaggagggtatcaacttcgacctgcccgacgtcgtcgccgacgcgccggccatcgccggagtgaggcatgttggcggagacatgttcaagtccatcccctctggtgatgccatcttcatgaagtgggttctgacgacgtggaccaacgacgagtgcacggccatcctcaggaactgccacgccgcgctgccggacggcggcaagctggtcgcctgcgagccggtggtgccggaggagacggacagcagcaccaggacgagggcacttctggagaacgacatcttcgtcatgaccacctaccggacgcaggggagggagcgctccgaggaggagttccaccacctcggcatcgccgccggcttcaccggcttccgcgccatctacctcgaccccttctatgccgtcctcgagtacaccaagtga

SEQ ID NO: 8620 - protein, 356 aa, Sorghum bicolor
  misc_feature: Ceres ANNOT ID no. 6091325
  misc_feature (82)..(333): Pfam Id: Methyltransf_2 Pfam Desc: O-methyltransferase
  misc_feature (6)..(356): NCBI GI: 30313849 NCBI Desc: s-adenosyl-l-methionine: beta-alanine n-methyltransferase [limonium latifolium]
  misc_feature (4)..(356): NCBI GI: 6688808 NCBI Desc: o-diphenol-o-methyl transferase [medicago sativa subsp. x varia]
  misc_feature (119)..(356): NCBI GI: 30313843 NCBI Desc: s-adenosyl-l-methionine: beta-alanine n-methyltransferase [limonium latifolium]
  misc_feature (150)..(356): NCBI GI: 30313845 NCBI Desc: s-adenosyl-l-methionine: beta-alanine n-methyltransferase [limonium latifolium]
  misc_feature (1)..(356): NCBI GI: 114199048 NCBI Desc: caffeic acid o-methyltransferase [malus x domestica]
  misc_feature: The sequence is a functional homolog of SEQ ID NO. 413 in the 11/188,298 US application
MSPAEARLAMMELANMVSVPMALTAVIRLGVPAAIWAGGANAPRSAAELLPAGHPDPSVLERLLRLLASRGVFSESTSTSEDRTTTTRRFALTAVGRTLVPEGASGASYADYVLQHHQDALVAAWPRLHEAVLDPRGPEPFARANAGVPAYAYYGKDREANQVMLRAMTGVSEPFMHALLDGYGFDGGFHGVATLVDVGGSSGACLEMIMRRVPTIKEGINFDLPDVVADAPAIAGVRHVGGDMFKSIPSGDAIFMKWVLTTWTNDECTAILRNCHAALPDGGKLVACEPVVPEETDSSTRTRALLENDIFVMTTYRTQGRERSEEEFHHLGIAAGFTGFRAIYLDPFYAVLEYTK

SEQ ID NO: 8621 - DNA, 978 bp, Sorghum bicolor
  misc_feature: Ceres ANNOT ID no. 6091341
  misc_feature: Encodes the peptide sequence at SEQ ID NO 8622
atgagatctctcgagatggcgggggaggagaggaagcgggtgctagtggtgggcggcagtggctacctgggccagcacctccttgcggcgtcctccgccgccgaccgcctcgacgtcgctttcacccaccacagccccgccccgccgcagccgctcctcgacgcgctcccctccgtccgcgccttccgcgccgacctccgctccggcgacggcttggaggcgatctccgcgtccttcggccagccacacgtagttgtcaactgtgctgccatgtcagttcctcgggcatgtgaaatggatccacctgctgccatggctaccaatgtgccttcttcacttgtgaactggttgctaagttttgggaatgaagactcacttctgattcatctctcaactgatcaagtttatgagggggtgaaatccttctacaaagaagaggacgagacaaagccggtgaacatgtatggaaaatctaaagtcgccgcggagaaactcattgttgagagatgctcaaactatgcgatcttgagaagcagcattatctatggaccacaaacaatctctcctgtggcaaaatcccttcccattcagtggatagatggtgttctttcacaaggccaacaggttgagttcttcaatgatgaattccggtgccctgtctatgtcaaagatatggtggacgtgattttgtcattgacaaaaacttggttatcaaatggagaaaaagtccaggtcctcctaaatgttggtggtccagatagggtatcaagactgcagatggctgagtctgttgctgttgttcgtggatatgaccccagaataatcaaatctgtgtctgcatcatcggttaatcgaggggtagcttctccaccagacatatccatggacatcaccaaactaacccagattcttggtatcaagccaatctcatttcgagatggagtcagaagtacacttgatgcagaagccagtacatga

SEQ ID NO: 8622 - protein, 325 aa, Sorghum bicolor
  misc_feature: Ceres ANNOT ID no. 6091341
  misc_feature (14)..(250): Pfam Id: Epimerase Pfam Desc: NAD dependent epimerase/dehydratase family
  misc_feature (16)..(226): Pfam Id: NAD_binding_4 Pfam Desc: Male sterility protein
  misc_feature (9)..(323): NCBI GI: 30678677 NCBI Desc: methionine adenosyltransferase regulatory beta subunit-related [arabidopsis thaliana]
  misc_feature (9)..(238): NCBI GI: 42572791 NCBI Desc: methionine adenosyltransferase regulatory beta subunit-related [arabidopsis thaliana]
  misc_feature (9)..(200): NCBI GI: 42572789 NCBI Desc: methionine adenosyltransferase regulatory beta subunit-related [arabidopsis thaliana]
  misc_feature (81)..(316): NCBI GI: 86134015 NCBI Desc: dtdp-4-dehydrorhamnose reductase [tenacibaculum sp. med152]
  misc_feature (12)..(313): NCBI GI: 119486569 NCBI Desc: 3-beta hydroxysteroid dehydrogenase/isomerase [lyngbya sp. pcc 8106]
MRSLEMAGEERKRVLVVGGSGYLGQHLLAASSAADRLDVAFTHHSPAPPQPLLDALPSVRAFRADLRSGDGLEAISASFGQPHVVVNCAAMSVPRACEMDPPAAMATNVPSSLVNWLLSFGNEDSLLIHLSTDQVYEGVKSFYKEEDETKPVNMYGKSKVAAEKLIVERCSNYAILRSSIIYGPQTISPVAKSLPIQWIDGVLSQGQQVEFFNDEFRCPVYVKDMVDVILSLTKTWLSNGEKVQVLLNVGGPDRVSRLQMAESVAVVRGYDPRIIKSVSASSVNRGVASPPDISMDITKLTQILGIKPISFRDGVRSTLDAEAST

SEQ ID NO: 8623 - DNA, 2163 bp, Sorghum bicolor
  misc_feature: Ceres ANNOT ID no. 6091345
  misc_feature: Encodes the peptide sequence at SEQ ID NO 8624
atggcggctgcggcggccgcgagcatgggggtggtgcgggaggtcctgggcgccgacgtcgtcgaggaggtggaccagcccatcatcgactacatcgccaacgtcctcgccgacgaggatttcgacttcggggccccggaagggcacggcatcttcgaggcgctcggggagctcctcatcgactccggatgcgtctccgaccaggaacactgcctccaggtctgcagtaagctttgtgaaaagtttggaaagcatggtctggtgaaacccaaacaagttatgcgcagccttgttacaccgttacgaatgaatgcggggatggacgatgacatcgctccaaaaaagcctcaaccagaagtattcgacggaccgctgctgtcttctcgtgataaagccaagattgaacggaggaaaagaaaagaggagaggcaaagagaggttcaatatcaaacacatgtcgcggagatggaggcacttagggctggaatgcctcctgtttatgtaaaccacagtaatgatggtgggccagctgttagggatatacatatggagaacttcagtgtcactgttggtggtcgtgatctaattcaagaagccactataacacttgcttttggaaggcactatggtcttgttggaaggaatgggaccgggaagacatcttttctcagagcgatggcattgcatgcgattgatggtattcccaagaactgccagatattgcatgttgagcaagaggtcgtgggtgatgatacaacagctttgcagtgtgttctgaatgccgatgtcgaacgagttcaacttttgcaggaagaagctcgtctggttcaacaacagaaagatttagagattgaggctgagtttgggcagagctctggcaagagcaaggatggccttgacaaagattctatcagcaagaggcttgaggagatatataaacggcttgagctcattgatgcagatgcagcagaggctcgtgcggcatcaattttggcgggtcttagttttactccagaaatgcaacgcaagcgaacaaaacaattttctggtggatggcgcatgagaatagctctagcacgcgctctgttcattgagcctgatttgctactacttgatgagccgacaaaccaccttgatcttcatgctgtgttatggctagaaacgtatctcctgaagtggccaaagacattcattgttgtatcacacgcaagggagtttttaaatacggttgtcaccgatatccttcatctacatggtagaaaactacatgcttacaaaggtgactatgacacatttgagaggacaagggaagagcaccttaagaatcagcagaaagcctttgaaacaaatgagaaggccagacagcacatgcagacattcattgacaagtttcggtataatgcaaagagagcgtcacttgttcaatcgagaatcaaggcattggagcgaatggaacatgttgatgcagttgtcagtgatccagactataaatttgaatttccaaccccagatgatcgccctgggccaccaattattagcttcagtgatgcctcgtttggttaccctggagggcctaccttgtttaaaaatttgaattttggtattgacctcgacagccgcatagcaatggttggtcctaatggcattggcaagtccactatactgaaactaatatctggggatctgcaaccaacttctggaaccgtattccggtctcctaaggttcgcatggctgtattcaatcaacatcatgttgatggccttgatttgacagtgaatccccttttgtacatgatgaagtgctacccgggtgtacctgagcagaagttgagggcacatctaggttcgtttggtgtttcaggaagccttgccctccaacctatgtatactttatcaggtggtcagaagagtagagttgcgtttgcaaaaataaccttcaagaagccacacatcattctcctcgatgagccttctaaccatcttgatctggacgcggttgaggcgctcatccaaggtttactcgtcttccagggaggagtgctgatggtgagtcacgacgagcatctcatcactggaagcgtggacgagctttgggtggtgtcagaaggcagggtgaccccgttctctggcactttcaaggactacaagaagatgctcaagtaa

SEQ ID NO: 8624 - protein, 720 aa, Sorghum bicolor
  misc_feature: Ceres ANNOT ID no. 6091345
  misc_feature (206)..(420): Pfam Id: ABC_tran Pfam Desc: ABC transporter
  misc_feature (538)..(703): Pfam Id: ABC_tran Pfam Desc: ABC transporter
  misc_feature (147)..(458): NCBI GI: 6633814 NCBI Desc: f1n19.11 [arabidopsis thaliana]
  misc_feature (11)..(636): NCBI GI: 18253965 NCBI Desc: abc transporter-like protein [glycine max]
  misc_feature (131)..(719): NCBI GI: 115400811 NCBI Desc: protein gcn20 [aspergillus terreus nih2624]
  misc_feature (85)..(717): NCBI GI: 3006145 NCBI Desc: spbc29a3.09c [schizosaccharomyces pombe]
  misc_feature (11)..(719): NCBI GI: 60466383 NCBI Desc: non-transporter abc protein [dictyostelium discoideum]
MAAAAAASMGVVREVLGADVVEEVDQPIIDYIANVLADEDFDFGAPEGHGIFEALGELLIDSGCVSDQEHCLQVCSKLCEKFGKHGLVKPKQVMRSLVTPLRMNAGMDDDIAPKKPQPEVFDGPLLSSRDKAKIERRKRKEERQREVQYQTHVAEMEALRAGMPPVYVNHSNDGGPAVRDIHMENFSVTVGGRDLIQEATITLAFGRHYGLVGRNGTGKTSFLRAMALHAIDGIPKNCQILHVEQEVVGDDTTALQCVLNADVERVQLLQEEARLVQQQKDLEIEAEFGQSSGKSKDGLDKDSISKRLEEIYKRLELIDADAAEARAASILAGLSFTPEMQRKRTKQFSGGWRMRIALARALFIEPDLLLLDEPTNHLDLHAVLWLETYLLKWPKTFIVVSHAREFLNTVVTDILHLHGRKLHAYKGDYDTFERTREEHLKNQQKAFETNEKARQHMQTFIDKFRYNAKRASLVQSRIKALERMEHVDAVVSDPDYKFEFPTPDDRPGPPIISFSDASFGYPGGPTLFKNLNFGIDLDSRIAMVGPNGIGKSTILKLISGDLQPTSGTVFRSPKVRMAVFNQHHVDGLDLTVNPLLYMMKCYPGVPEQKLRAHLGSFGVSGSLALQPMYTLSGGQKSRVAFAKITFKKPHIILLDEPSNHLDLDAVEALIQGLLVFQGGVLMVSHDEHLITGSVDELWVVSEGRVTPFSGTFKDYKKMLK

SEQ ID NO: 8625 - DNA, 1194 bp, Sorghum bicolor
  misc_feature: Ceres ANNOT ID no. 6091348
  misc_feature: Encodes the peptide sequence at SEQ ID NO 8626
atgcagagcgccgcggctttccggccgtgccccgccggcgccggcgccggcgccgggcagctggtgagccgtaatcctagccggggccccctcctcccggtcccggcccgcccgctccgcgtcgtcgtctccgccgctaccactcgcgctctgggtctcgggcggctgcgcctgtcagcctcgccggatgatcggtccggccagcgacaggtgtcgtgtggcgcggccggggacgctgtggcggccccgagtgcggaggaaggcggcggcttcatgaagacgctgtggctcggctcgctcttcggcctctggtacctcttcaacatctacttcaacatctataacaagcaggttctcaaggttttcccataccccataaacatcacagaagctcaatttgctgtcggatctgtagtatctttgttcttttggaccactggtattattaagaggccaaagatttctggagcgcagcttgcagccatcctacctctggctattgttcacactatgggcaatctcttcaccaacatgagccttgggaaagttgcagtatcatttacgcacaccatcaaggctatggaacctttcttttctgttcttctttctgcaattttcctcggcgagtttcctactgtttgggtagtagcatctcttcttccaattgttggtggtgttgcattggcatctcttactgaggcatcctttaactggattggcttttggagtgcaatggcttcaaatgttacctttcaatcccggaatgtactgagcaagaagctcatggttaagaaagaggaatccttggacaaccttaatctcttctctatcattacagtgatgtcatttttcgttttggcccctgttaccttctttactgaaggtgtcaaaattactcctacatttttgcaatctgctggtctgaatgtaaaccaggtccttacaaggtctcttcttgctggactgtgtttccatgcataccaacaggtgtcttacatgattttggcgatggtgtctcctgtcactcattctgtgggcaactgtgttaagcgtgttgtggtcattgtaacatcagtgttgttcttcaggacacctgtttctcctatcaactctctcggtactgcgattgcacttgccggagttttcctgtactcacagctcaaaagactcaagcccaagccgaagactccttaa

SEQ ID NO: 8626 - protein, 397 aa, Sorghum bicolor
  misc_feature: Ceres ANNOT ID no. 6091348
  misc_feature (240)..(386): Pfam Id: TPT Pfam Desc: Triose-phosphate Transporter family
  misc_feature (1)..(396): NCBI GI: 13991929 NCBI Desc: phosphoenolpyruvate/phosphate translocator [oryza sativa]
  misc_feature (1)..(396): NCBI GI: 1778147 NCBI Desc: phosphate/phosphoenolpyruvate translocator precursor
  misc_feature (1)..(395): NCBI GI: 1778149 NCBI Desc: phosphate/phosphoenolpyruvate translocator precursor
  misc_feature (1)..(396): NCBI GI: 1778143 NCBI Desc: phosphate/phosphoenolpyruvate translocator precursor
  misc_feature (30)..(396): NCBI GI: 1778145 NCBI Desc: phosphate/phosphoenolpyruvate translocator precursor
  misc_feature: The sequence is a functional homolog of SEQ ID NO. 360 in the 11/188,298 US application
  misc_feature: The sequence is a functional homolog of SEQ ID NO. 484 in the 11/188,298 US application
MQSAAAFRPCPAGAGAGAGQLVSRNPSRGPLLPVPARPLRVVVSAATTRALGLGRLRLSASPDDRSGQRQVSCGAAGDAVAAPSAEEGGGFMKTLWLGSLFGLWYLFNIYFNIYNKQVLKVFPYPINITEAQFAVGSVVSLFFWTTGIIKRPKISGAQLAAILPLAIVHTMGNLFTNMSLGKVAVSFTHTIKAMEPFFSVLLSAIFLGEFPTVWVVASLLPIVGGVALASLTEASFNWIGFWSAMASNVTFQSRNVLSKKLMVKKEESLDNLNLFSIITVMSFFVLAPVTFFTEGVKITPTFLQSAGLNVNQVLTRSLLAGLCFHAYQQVSYMILAMVSPVTHSVGNCVKRVVVIVTSVLFFRTPVSPINSLGTAIALAGVFLYSQLKRLKPKPKTP

SEQ ID NO: 8627 - DNA, 924 bp, Sorghum bicolor
  misc_feature: Ceres ANNOT ID no. 6091354
  misc_feature: Encodes the peptide sequence at SEQ ID NO 8628
atggcgccgtcgcggccgctcatgcgggggatccgcccgccgcgcgtcttcccgacccgcggcggccgcgcctcgccttacgccgtcgcgctcaccgccctgctcctcgtctccgccgccctcctcgcgctcatcgccttcggcgtcttctcgctccccgtgtccgcgcccaacgccgccactaccggcgccggtggggagaccgagtccgccgacgctcgacccgcgcgcccccgcgcccgccgcgacctgggggaggggctgggagagcgcggtgcgcagtggaccgaggtcatctcgtgggagcccagggctttcgtctaccacaacttcctgtctaaggaagagtgtgaatacctaattggattggccaagcctcacatggtcaaatcaacagttgtcgacagcactactggtaaaagcaaggacagcagggtccggacaagttcaggcatgtttcttcaaagaggaagagacaaggttattcgagcaattgaaaagaggatagcagactataccttcatacctgcagatcatggtgagggactccaagtgctgcattatgaagttgggcagaagtatgagcctcactttgattattttcttgatgagttcaacaccaagaatggtggtcagaggatggctactcttctgatgtatctatcagatgttgaagaaggaggtgagactattttccctgatgcaaatgtgaacgccagttctttaccatggtacaatgagctttcagagtgtgccaaaagaggcctttctgtcaaaccaaagatgggagatgcacttcttttctggagcatgaaaccagatgccactctggacccactaagtttgcatggggggtgtcctgtgattagaggaaataaatggtcctcaaccaagtggatgcatatccatgagtacaaagcttga

SEQ ID NO: 8628 - protein, 307 aa, Sorghum bicolor
  misc_feature: Ceres ANNOT ID no. 6091354
  misc_feature (179)..(302): Pfam Id: 2OG-FeII_Oxy Pfam Desc: 2OG-Fe(II) oxygenase superfamily
  misc_feature (25)..(306): NCBI GI: 18394842 NCBI Desc: oxidoreductase, 2og-fe(ii) oxygenase family protein [arabidopsis thaliana]
  misc_feature (81)..(306): NCBI GI: 144923396 NCBI Desc: 2og-fe(ii) oxygenase [medicago truncatula]
  misc_feature (30)..(306): NCBI GI: 25411813 NCBI Desc: similar to prolyl 4-hydroxylase alpha subunit [imported] - arabidopsis thaliana
  misc_feature (32)..(305): NCBI GI: 42567428 NCBI Desc: oxidoreductase, 2og-fe(ii) oxygenase family protein [arabidopsis thaliana]
  misc_feature (12)..(284): NCBI GI: 10177121 NCBI Desc: prolyl 4-hydroxylase, alpha subunit-like protein [arabidopsis thaliana]
  misc_feature: The sequence is a functional homolog of SEQ ID NO. 333 in the 11/188,298 US application
MAPSRPLMRGIRPPRVFPTRGGRASPYAVALTALLLVSAALLALIAFGVFSLPVSAPNAATTGAGGETESADARPARPRARRDLGEGLGERGAQWTEVISWEPRAFVYHNFLSKEECEYLIGLAKPHMVKSTVVDSTTGKSKDSRVRTSSGMFLQRGRDKVIRAIEKRIADYTFIPADHGEGLQVLHYEVGQKYEPHFDYFLDEFNTKNGGQRMATLLMYLSDVEEGGETIFPDANVNASSLPWYNELSECAKRGLSVKPKMGDALLFWSMKPDATLDPLSLHGGCPVIRGNKWSSTKWMHIHEYKA

SEQ ID NO: 8629 - DNA, 1785 bp, Sorghum bicolor
  misc_feature: Ceres ANNOT ID no. 6091355
  misc_feature: Encodes the peptide sequence at SEQ ID NO 8630
atggacgccggcaccgggggcggcgggccaacggccatccgcgtgccctaccgccacctccgcgacgccgagatggagctcgtcagcctcaacggagcggacgcgggcccgacgccgcacaaggacgcggaccagccgcggagccgcggcgccaacgccgacaggaccaagctcgtgcttgcctgcatggtcgccgcgggcgtccagttcgggtgggcactgcagctctccctcctcacgccatacatccagaccctaggaatagaccatgccatggcatcatttatttggctctgtgggccaataactggttttgtggttcaaccttgtgttggtgtttggagtgataagtgccgatcaaagtatgggaggagaaggccatttattttggctggatgcataatgatatgtgctgctgtaactttaatcgggttttctgcagacctcggttacatcttaggggataccaccgagcactgcagaacatataaaggttcaagatttcgagctgctatggttttcattctaggattctggatgttggacctggcaaacaatacagtgcaaggtcctgctcgtgctcttctagctgatctttcaggtcctgatcagtgtaattctgcaaatgcaatattctgctcatggatggctgttggaaatattcttggtttttcagctggtgcaagcggggattggcacaagtggtttccttttctaatgactagagcctgctgtgaagcttgtggtaatttgaaagcagctttcttagttgcagtcgtatttcttttgttctgtatgtctgttacgctgtacttcgctgaagagatcccactagagccaaaagatgcacaaggactgtcagattctgctcctctactgaacggttctagagaggatgcacatgcattgaatgaaccaaataatgaaagatttcctaatggccatgtagatggaaacaacgtgtcggctaacaacaacactgaggaatttccaaatgcgaattccaacacagacaatggaggagtcttcaatgatggacctggagcagttttggttaacattttgaccagcatgaggcatctacctcctgggatgcattcagtgcttgtagttatggccctaacatggttgtcatggtttcccttttttctttttgacactgactggatggggcgtgaagtttaccatggggatccaaatggagatctgagtgagaggaaagcttatgacaatggtgtccgagaaggtgcatttggtttgctattgaattcagttgtccttggcgttggttccttccttgttgatccactatgccggatgattggtgcaagattggtttgggccattagcaacttcactgtgtttatttgcatgatggctacaacaatactaagttggatctcttctgatctgtactcaagcaaactccatcacatcattggggcaaataaaacagtcaagactacagcattggttgttttctctcttctcggactgccactctcgatcacttatagcgttccattttctgtgactgctgagctgactgctggtacaggaggtggacaaggtctggccacaggagtcctaaatctcgctattgttgttccccagatagtagtgtcactcggagcaggtccatgggatgctctatatgggggaggaaacatcccagcgttcgccttggcttcggtcttctccctggcggcaggtgtgctcgcagttctcaagctaccaaagctgtcgaactcgtaccaatctgccggtttccatggatttggctga

SEQ ID NO: 8630 - protein, 594 aa, Sorghum bicolor
  misc_feature: Ceres ANNOT ID no. 6091355
  misc_feature (61)..(542): Pfam Id: MFS_1 Pfam Desc: Major Facilitator Superfamily
  misc_feature (59)..(552): Pfam Id: Sugar_tr Pfam Desc: Sugar (and other) transporter
  misc_feature (1)..(594): NCBI GI: 46393740 NCBI Desc: sucrose transporter 2 [zea mays]
  misc_feature (1)..(594): NCBI GI: 37548736 NCBI Desc: sucrose transporter sut2 [oryza sativa (japonica cultivar-group)]
  misc_feature (1)..(594): NCBI GI: 29467454 NCBI Desc: sucrose transporter [oryza sativa (japonica cultivar-group)]
  misc_feature (35)..(594): NCBI GI: 116008244 NCBI Desc: sucrose transporter 2b [hevea brasiliensis]
  misc_feature (12)..(594): NCBI GI: 10119908 NCBI Desc: sucrose transporter-like protein [lycopersicon esculentum]
MDAGTGGGGPTAIRVPYRHLRDAEMELVSLNGADAGPTPHKDADQPRSRGANADRTKLVLACMVAAGVQFGWALQLSLLTPYIQTLGIDHAMASFIWLCGPITGFVVQPCVGVWSDKCRSKYGRRRPFILAGCIMICAAVTLIGFSADLGYILGDTTEHCRTYKGSRFRAAMVFILGFWMLDLANNTVQGPARALLADLSGPDQCNSANAIFCSWMAVGNILGFSAGASGDWHKWFPFLMTRACCEACGNLKAAFLVAVVFLLFCMSVTLYFAEEIPLEPKDAQGLSDSAPLLNGSREDAHALNEPNNERFPNGHVDGNNVSANNNTEEFPNANSNTDNGGVFNDGPGAVLVNILTSMRHLPPGMHSVLVVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKTTALVVFSLLGLPLSITYSVPFSVTAELTAGTGGGQGLATGVLNLAIVVPQIVVSLGAGPWDALYGGGNIPAFALASVFSLAAGVLAVLKLPKLSNSYQSAGFHGFG

SEQ ID NO: 8631 - DNA, 549 bp, Sorghum bicolor
  misc_feature: Ceres ANNOT ID no. 6091361
  misc_feature: Encodes the peptide sequence at SEQ ID NO 8632
atggattccctgcgcaacatggtggagccgattcggacgatgcagatccgccccgtgctcgcccaaatcatcaccctagggatgatcctgacttcggcattgatcatatggaaaggattgattatcgtaacagggagtgagtcaccagttgtggtggttctatctgaaagcatggagcctggatttcgaaggggtgatatcctgtttttacacatgaataaggaccctgtccgcacgggagacatagttgttttcaatattgagggccgtgatattccaattgtccatcgtgtgatcaaggttcacgaacgccatggtatggcagaatttgatgtcctcacaaaaggtgacaataaccgtgacgatgaccgaatgggaatgctgtatgcaaatgggcagctttggcttcagcgacagcacattattggacgggctgttggctatctgccttatgctgggtggcttacaatcgccatgacggagaaaccagtcctcaagtatctgctaattggtgcactggggctgctggttgtagcatccaaggagtga

SEQ ID NO: 8632 - protein, 182 aa, Sorghum bicolor
  misc_feature: Ceres ANNOT ID no. 6091361
  misc_feature (52)..(133): Pfam Id: Peptidase_S24 Pfam Desc: Peptidase S24-like
  misc_feature (1)..(182): NCBI GI: 115463043 NCBI Desc: os05g0297900 [oryza sativa (japonica cultivar-group)]
  misc_feature (1)..(182): NCBI GI: 87162920 NCBI Desc: peptidase s24, s26a and s26b [medicago truncatula]
  misc_feature (14)..(166): NCBI GI: 115449971 NCBI Desc: os02g0827900 [oryza sativa (japonica cultivar-group)]
  misc_feature (1)..(182): NCBI GI: 55241434 NCBI Desc: ensangp00000020448 [anopheles gambiae str. pest]
  misc_feature (1)..(182): NCBI GI: 114864578 NCBI Desc: signal peptidase i [anopheles funestus]
MDSLRNMVEPIRTMQIRPVLAQIITLGMILTSALIIWKGLIIVTGSESPVVVVLSESMEPGFRRGDILFLHMNKDPVRTGDIVVFNIEGRDIPIVHRVIKVHERHGMAEFDVLTKGDNNRDDDRMGMLYANGQLWLQRQHIIGRAVGYLPYAGWLTIAMTEKPVLKYLLIGALGLLVVASKE

SEQ ID NO: 8633 - DNA, 1176 bp, Sorghum bicolor
  misc_feature: Ceres ANNOT ID no. 6091376
  misc_feature: Encodes the peptide sequence at SEQ ID NO 8634
atggcgccgcacacgctgctccgcgccgccgcatccgagctccgccgccgggggcgccgtgcccctctccccctaccggcgctgtcctcgctcctctcctcgccgtctccacagagcccaccctccagccgccccgatcctagcccccacgccgaccggcgccacctcatcgcgctccgccggtgcccgccgcacccggccctcgcccccgagctgctccacggcagggttctcctcccgagccacttctcgcacgcctcgccgctctccacctcctcgtcctcttccgaacccgcgggcaaggcttcgccggcgccgccgctcacgtgggtggacaagtgggtacctgaggcggcgcggccgtacgccatgctcgcccgcctcgacaagcccatcgggacctggctcctcgcctggccctgcatgtggtcaatcacaatagcagcaacgccaggggagttgccagacttgaaaatgctggcactctttggatgtggagctgtcctcctcaggggggctggttgcacagtgaatgatcttctcgatcgcgacattgataataaggttgagcgcaccaaaactaggccttttgcctcaggagtgcttactcctttacagggagtgggcttccttggaattcagctcctattgggacttggcattcttctccaattgaacaactatagtcgtattctgggggcgtcttcactttttctggtcttctcgtatcccctgatgaagaggttcacattttggcctcaggcttatcttggcctgacattcaactggggagctttattaggatgggctgctattaaggaaagcttagaccctgcaatcatccttccattgtatacagctggtatatgttggacgctggtgtatgatactatatatgcgcatcaggacaaagaagatgacctcaaagtaggagttaagtccacagcattaagatttggagatttgaccaaatactggattggtggctttggtgcggcatgcattggcagcttagcactcagtggttacaatgctgaccttgctgcacagttagggtggcaggtttcaactgtggatctgtctagccgctcagattgcaacatgaagtttgtgtccaacaagtggtttggagctttggtatttagtgggattctatttgggcgtcttgtatcatga

SEQ ID NO: 8634 - protein, 391 aa, Sorghum bicolor
  misc_feature: Ceres ANNOT ID no. 6091376
  misc_feature (134)..(388): Pfam Id: UbiA Pfam Desc: UbiA prenyltransferase family
  misc_feature (109)..(388): NCBI GI: 30725666 NCBI Desc: at4g23660 [arabidopsis thaliana]
  misc_feature (109)..(350): NCBI GI: 7269214 NCBI Desc: polyprenyltransferase like protein [arabidopsis thaliana]
  misc_feature (94)..(389): NCBI GI: 18389308 NCBI Desc: pgt-2 [lithospermum erythrorhizon]
  misc_feature (189)..(391): NCBI GI: 115476242 NCBI Desc: os08g0388900 [oryza sativa (japonica cultivar-group)]
  misc_feature (91)..(389): NCBI GI: 92111537 NCBI Desc: geranyl diphosphate:4-hydroxybenzoate geranyltransferase [arnebia euchroma]
MAPHTLLRAAASELRRRGRRAPLPLPALSSLLSSPSPQSPPSSRPDPSPHADRRHLIALRRCPPHPALAPELLHGRVLLPSHFSHASPLSTSSSSSEPAGKASPAPPLTWVDKWVPEAARPYAMLARLDKPIGTWLLAWPCMWSITIAATPGELPDLKMLALFGCGAVLLRGAGCTVNDLLDRDIDNKVERTKTRPFASGVLTPLQGVGFLGIQLLLGLGILLQLNNYSRILGASSLFLVFSYPLMKRFTFWPQAYLGLTFNWGALLGWAAIKESLDPAIILPLYTAGICWTLVYDTIYAHQDKEDDLKVGVKSTALRFGDLTKYWIGGFGAACIGSLALSGYNADLAAQLGWQVSTVDLSSRSDCNMKFVSNKWFGALVFSGILFGRLVS

SEQ ID NO: 8635 - DNA, 837 bp, Sorghum bicolor
  misc_feature: Ceres ANNOT ID no. 6091379
  misc_feature: Encodes the peptide sequence at SEQ ID NO 8636
atgatgccattgagccaacccgacttctcgccgtcgcagttcaccgcctcccagaatgccgccgccgactccaccacgccttccaagatgcgcggggcgtccagcaccatgccgctcaccgtcaagcaggtcgtcgacgctcagcagtctggcaccggcgagaagggcgctccgttcgtcgtggatggcgtcgagatggctaacattcgacttgtggggatggtcaacggcaaggtggagcggacgaccgatgtcacattcacgctcgatgacggcaccggccgcctcgatttcatcagatgggtgaatgatgcttcagattcttctgaaactgctgctgttcaaaatggtatgtacgtcgcggtcattggaagcctcaagggacttcaagagaggaagcgtgctactgctttctcaatcaggcctataactgatttcaatgaggttacgctgcatttcattcagtgtgttcggatgcatatagagaacacgaaattaaaggctggcagtcctgcacgaaccagttcttctatgggagtgtcagtctcaaatggattcagtgaatcaagcacaccaacatctttgaaatcaaatccagcaccattgaccggtggaggaagtggatctgatactgatttgaacaagcaggtgctgcatttttttagtgaaccagcgaaccttgagagtgagcacggggtgcatgttgatgaagtatacaagcagttcaaacaactgccaaaggataagatcaaggaggctattgctttccatgtggacgccgggcatctttactcaacaattgatgacttccacttcaagtcagctttaaccgattga

SEQ ID NO: 8636 - protein, 278 aa, Sorghum bicolor
  misc_feature: Ceres ANNOT ID no. 6091379
  misc_feature (160)..(270): Pfam Id: RPA_C Pfam Desc: Replication protein A C terminal
  misc_feature (69)..(143): Pfam Id: tRNA_anti Pfam Desc: OB-fold nucleic acid binding domain
  misc_feature (1)..(278): NCBI GI: 48716324 NCBI Desc: replication protein a2 [oryza sativa (japonica cultivar-group)]
  misc_feature (1)..(278): NCBI GI: 9801268 NCBI Desc: replication protein a2 [oryza sativa]
  misc_feature (1)..(278): NCBI GI: 13516746 NCBI Desc: replication protein a 30kda [oryza sativa (japonica cultivar-group)]
  misc_feature (9)..(275): NCBI GI: 31790111 NCBI Desc: rpa 32kda [pisum sativum]
  misc_feature (1)..(167): NCBI GI: 115469668 NCBI Desc: os06g0693300 [oryza sativa (japonica cultivar-group)]
MMPLSQPDFSPSQFTASQNAAADSTTPSKMRGASSTMPLTVKQVVDAQQSGTGEKGAPFVVDGVEMANIRLVGMVNGKVERTTDVTFTLDDGTGRLDFIRWVNDASDSSETAAVQNGMYVAVIGSLKGLQERKRATAFSIRPITDFNEVTLHFIQCVRMHIENTKLKAGSPARTSSSMGVSVSNGFSESSTPTSLKSNPAPLTGGGSGSDTDLNKQVLHFFSEPANLESEHGVHVDEVYKQFKQLPKDKIKEAIAFHVDAGHLYSTIDDFHFKSALTD

SEQ ID NO: 8637 - DNA, 978 bp, Sorghum bicolor
  misc_feature: Ceres ANNOT ID no. 6091390
  misc_feature: Encodes the peptide sequence at SEQ ID NO 8638
atggcgctgctgatgagccttggcgccgccgtgtactcctacttctccacggcaaccgcgccgccgcgtccccgaagatgcatcctgtcgtttcgcgccgccgcctcccctgcggcgctggaccgccggcgacggccgcagaacgtggcgggcgatttcttcgtcgaccagcgctgcatcgactgccagacctgccgatggatggcgccgcaagtgttcaagagggtggatggcaaggccgccgtagcggcgcagcccagctccgaggaggagaggaccaaggccctgcaggcgctgctctcctgtccaacatcctcaattcacactgagaaacctccaaaggacatccttcaagtgcaaaacatgtttcctcttccaatcgacgacaaactactcccaggcgtttatctctgtgggtacaattctgaagactcatatggggcaacatcctacctggtaattcatccacaaggaaacatactgattgacagcccaaggtatacttcaaagctggccaacaatattgaaaagcttggtggagcgcgctacatgtttttgacccacatgaagtgggctgagcagctaaaatgtgaaagaataattcatatgggagatgtggaggaggctactgcagatgttgagtggaaacttgaaggaaatgggccatggaacataggaacagattttgaatttatccatacgccaggccataccccaggctcggtgtgcttgtattacaaaccgccaaaggtgctgttcactggagatcatgttgcaaagtcagaagaatcagacgacctgaatctctttctgatgtacagcaaacagtcagtgagccttcagctggaaagcataaggaaactattggaggtagagttcgaatggcttttacctgggcatggctatcgaattaggtacaaagatgtgcaggccaagaatgcagccatggagtccctcctagctaactacttaagctag

SEQ ID NO: 8638 - protein, 325 aa, Sorghum bicolor
  misc_feature: Ceres ANNOT ID no. 6091390
  misc_feature (147)..(300): Pfam Id: Lactamase_B Pfam Desc: Metallo-beta-lactamase superfamily
  misc_feature (1)..(325): NCBI GI: 48716327 NCBI Desc: metallo-beta-lactamase-like [oryza sativa (japonica cultivar-group)]
  misc_feature (122)..(325): NCBI GI: 48716328 NCBI Desc: metallo-beta-lactamase-like [oryza sativa (japonica cultivar-group)]
  misc_feature (44)..(320): NCBI GI: 75906869 NCBI Desc: beta-lactamase-like [anabaena variabilis atcc 29413]
  misc_feature (43)..(320): NCBI GI: 23128775 NCBI Desc: cog0491: zn-dependent hydrolases, including glyoxylases [nostoc punctiforme pcc 73102]
  misc_feature (43)..(304): NCBI GI: 45658940 NCBI Desc: metallo-beta-lactamase superfamily hydrolase [leptospira interrogans serovar copenhageni str. fiocruz l1-130]
MALLMSLGAAVYSYFSTATAPPRPRRCILSFRAAASPAALDRRRRPQNVAGDFFVDQRCIDCQTCRWMAPQVFKRVDGKAAVAAQPSSEEERTKALQALLSCPTSSIHTEKPPKDILQVQNMFPLPIDDKLLPGVYLCGYNSEDSYGATSYLVIHPQGNILIDSPRYTSKLANNIEKLGGARYMFLTHMKWAEQLKCERIIHMGDVEEATADVEWKLEGNGPWNIGTDFEFIHTPGHTPGSVCLYYKPPKVLFTGDHVAKSEESDDLNLFLMYSKQSVSLQLESIRKLLEVEFEWLLPGHGYRIRYKDVQAKNAAMESLLANYLS

SEQ ID NO: 8639 - DNA, 1260 bp, Sorghum bicolor
  misc_feature: Ceres ANNOT ID no. 6091393
  misc_feature: Encodes the peptide sequence at SEQ ID NO 8640
atggcctccgccgccgccgccctctgccggagcccctcactgctgagccgccgccacctcctcgtacgcctcctctccacgcagacccagctcgctaccccaccgacgcccaccacccctgccgacctctcccgcctcaagtcctccatccgcgacgcggccaccagcccggacgcgctcgccaccctcttcctctcgggcctcccgcacccggctttcctcgccgaccgcccgctcttcgcgctctccgtccaccgcctcgcctccgcgggccgccgcgacctcgtcgcctccgtcctctcctcctccctcaccgccctccccagcccgcacccctccgagggcttcctcctccgcctcatctccctatactccgccgcgggcatgcccgaccactccctcaccgtcttccgcctcgtcaacccgccctccgaccgcgccctctccgcgctcctctccacctaccacgacaatcgcctctacgaccgcgccgtccgggccttcaacactctccccgccgagctcggtatcaaaccgggactcgtctcccacaacgtcctcctcaaggccctcgtcgccagcggggacatcgccgccgcacgctcggcgttcgacaaaatgcctgacacggctggcgtccagccggacatcgtctcttgcaacgagatcctcaagggctacctcagcactggcgacgatgcggccttcgatcagctagttaaggagatcgctggacccaataggaggctcaagcccaatgtcgggacatacaatctccggatggccatgctgtgctccaaagagaggagctttgaagctgaagagctgctggatgccatgggggcaaatggcgtcccgcccaaccgtgcaagcttcaacacggtcatcaaggggctctgcaacgagggggaggtgggtgctgccatggctctcttcaagaggatgcccgaggtgcccaggcagaaaggcaaaggggtctcccccaactttgagacctacatcatgctgctcgaggcccttgtcaacaagaatttgtttgatcctgccctggaggtctgcaaggagtgcctgcacaacaagtgggcaccgccgttccaagctgtcaaaggtttggttgagagtttgctcaagagcaggaaggccaagcacgcgagggaggttctcatggccatgagaaaggctgtcaagggtgacgccaaacaggagtggacaaaggtcgaggctcagttcccgatgttgcttgctgacaagaaagcctaa

SEQ ID NO: 8640 - protein, 419 aa, Sorghum bicolor
  misc_feature: Ceres ANNOT ID no. 6091393
  misc_feature (255)..(289): Pfam Id: PPR Pfam Desc: PPR repeat
  misc_feature (22)..(388): NCBI GI: 53828645 NCBI Desc: at1g55890 [arabidopsis thaliana]
  misc_feature (46)..(388): NCBI GI: 37179506 NCBI Desc: drought-inducible protein 1os [oryza sativa (indica cultivar-group)]
  misc_feature (46)..(388): NCBI GI: 20804913 NCBI Desc: drought-inducible protein 1os [oryza sativa (japonica cultivar-group)]
  misc_feature (9)..(395): NCBI GI: 15220068 NCBI Desc: pentatricopeptide (ppr) repeat-containing protein [arabidopsis thaliana]
  misc_feature (10)..(393): NCBI GI: 9759124 NCBI Desc: salt-inducible protein-like [arabidopsis thaliana]
MASAAAALCRSPSLLSRRHLLVRLLSTQTQLATPPTPTTPADLSRLKSSIRDAATSPDALATLFLSGLPHPAFLADRPLFALSVHRLASAGRRDLVASVLSSSLTALPSPHPSEGFLLRLISLYSAAGMPDHSLTVFRLVNPPSDRALSALLSTYHDNRLYDRAVRAFNTLPAELGIKPGLVSHNVLLKALVASGDIAAARSAFDKMPDTAGVQPDIVSCNEILKGYLSTGDDAAFDQLVKEIAGPNRRLKPNVGTYNLRMAMLCSKERSFEAEELLDAMGANGVPPNRASFNTVIKGLCNEGEVGAAMALFKRMPEVPRQKGKGVSPNFETYIMLLEALVNKNLFDPALEVCKECLHNKWAPPFQAVKGLVESLLKSRKAKHAREVLMAMRKAVKGDAKQEWTKVEAQFPMLLADKKA

SEQ ID NO: 8641 - DNA, 2301 bp, Sorghum bicolor
  misc_feature: Ceres ANNOT ID no. 6091396
  misc_feature: Encodes the peptide sequence at SEQ ID NO 8642
atgcttctcctttcctccgccctcttcaccaccgctcgcttcccactcgccgtctccgcccgcctcccaaaccctaccactaccacccgcctcctcctcttcgccggcctccctgcctcctccccactccgtgccttctgccccagggcgccgccttctccgtccctcgccacctgcgccgccttctcctcctcctcctctaccatggccgccgccgacaaccccctcctcgtcgccgacttcgacttcccgcccttcgaccgcgtcgagcccacccacgtccgacccggcatccgcgaactgctcacgcgactcgagggcgagctcgaggagctcgagaagggcgtccagcccacgtgggggaagcttgtcgagccgctcgagcgcatcaccgacaggctcgaggtcatctggggcatggtcgatcacctcaaggctgttaaggactccgccgatctccgcgccgccgtagaggaagtgcagcccgacaaagtcaagttccaactaaggctggggcagagcaagcctatctatgaagctttcaaggccatcaggaactcttccgactgggacagtctcagtgatgctcgcaagcgtatagttgaagctcaaataaaggaagctgttctcagtggagttgcgcttgaggatgagcaaagggagaagtttaaccaaatcgaacaagagcttgaaaaactgacgcaaaagtttagcgaaaatgttctggacgccacaaagaaatttgagaagttaattaccgataagaaagaaattgagggtttacctgctacagcccttggtttagcagcacagactgccgtgtcaaagggccatgaaaatgctacagctgaaaatggaccttgggttatcacgttggatgcaccaagctatatccctgttatgcaacatgctcagaacagagagctccgggaagaagtttatcgtgcttatcttacccgcgcctctagcggtgaacttgacaacaccaatatcatctcccaaattctaaagctaaggcttgagaaggctaaacttcttggctacaagaactatgctgaggtaagcatggctcagaaaatggcaactgttgagcgagtagaagagcttctcgagaagctgcgtgctgcttcctgggatcatgctgtcaaagatatggaagatctaaaaatctttgcgaaagattctggttctcctgaagctaatgatttgactcactgggaccttaccttctggagtgaacgactgagagagactaaatatgatatcaatgaggaagagctgcgcccttattttgcactacccaaggttatggatggcctcttcactctggcacataagctttttggagttactgttgaacctgcagatgggctggctcctgtctggcacagtgatgtcaaattttattgtgtcaaagactcttccaatagccctgttgcttatttttactttgatccttattcaagaccatctgaaaagcgcggaggggcttggatgaatgtggtcttctctcgaagtcgcgtgctagctcgcaatggtttgtctgctaggcttcctgttgcccatatggtgtgcaatcagactccaccagttggtgagaagcccagtcttatgaccttccgtgaggttgaaactgtgttccatgaatttggtcatgcccttcagcatatgcttactaaacaagatgaaggctttgttgctggtattcgtggagttgaatgggatgctgtagagttaccctcccaattcatggagaactggtgttaccacaagaatactcttttgagcattgcaaagcattatgaaaccggtgaaactcttccagaggaaatttatgcgaagcttgtagctgcaaagaatttccgtgctggtaccttcagcctgcgccagatacgatttgccagtgtggatatggaacttcatacaacttatgatcccaatggctcactgtccatatatgatgttgaccgaagagttgcagaacggacacaagttcttgctcctctgccggaagacagattcctgtgcagctttagccatatttttgcagggggctatgctgctggatactacagttacaagtgggctgaagtactgtcagctgatgcattctcagcttttgaagacgctggtttggataatgagaaggcaattgaggaaactggcagacggttcagagacactgttcttgcgcttggaggtggaaagtccccgcttgaggtgtttgtttcattccgaggacgggagccttcacccgaaccacttcttaggcacaacggcttgcttcctgttgctgcgtag

SEQ ID NO: 8642 - protein, 766 aa, Sorghum bicolor
  misc_feature: Ceres ANNOT ID no. 6091396
  misc_feature (300)..(761): Pfam Id: Peptidase_M3 Pfam Desc: Peptidase family M3
  misc_feature (2)..(766): NCBI GI: 48716335 NCBI Desc: oligopeptidase a-like [oryza sativa (japonica cultivar-group)]
  misc_feature (55)..(766): NCBI GI: 8978290 NCBI Desc: oligopeptidase a [arabidopsis thaliana]
  misc_feature (53)..(762): NCBI GI: 140041250 NCBI Desc: peptidase m, neutral zinc metallopeptidases, zinc-binding site [medicago truncatula]
  misc_feature (64)..(766): NCBI GI: 7671449 NCBI Desc: oligopeptidase a-like protein [arabidopsis thaliana]
  misc_feature (66)..(766): NCBI GI: 17228375 NCBI Desc: oligopeptidase a [nostoc sp. pcc 7120]
MLLLSSALFTTARFPLAVSARLPNPTTTTRLLLFAGLPASSPLRAFCPRAPPSPSLATCAAFSSSSSTMAAADNPLLVADFDFPPFDRVEPTHVRPGIRELLTRLEGELEELEKGVQPTWGKLVEPLERITDRLEVIWGMVDHLKAVKDSADLRAAVEEVQPDKVKFQLRLGQSKPIYEAFKAIRNSSDWDSLSDARKRIVEAQIKEAVLSGVALEDEQREKFNQIEQELEKLTQKFSENVLDATKKFEKLITDKKEIEGLPATALGLAAQTAVSKGHENATAENGPWVITLDAPSYIPVMQHAQNRELREEVYRAYLTRASSGELDNTNIISQILKLRLEKAKLLGYKNYAEVSMAQKMATVERVEELLEKLRAASWDHAVKDMEDLKIFAKDSGSPEANDLTHWDLTFWSERLRETKYDINEEELRPYFALPKVMDGLFTLAHKLFGVTVEPADGLAPVWHSDVKFYCVKDSSNSPVAYFYFDPYSRPSEKRGGAWMNVVFSRSRVLARNGLSARLPVAHMVCNQTPPVGEKPSLMTFREVETVFHEFGHALQHMLTKQDEGFVAGIRGVEWDAVELPSQFMENWCYHKNTLLSIAKHYETGETLPEEIYAKLVAAKNFRAGTFSLRQIRFASVDMELHTTYDPNGSLSIYDVDRRVAERTQVLAPLPEDRFLCSFSHIFAGGYAAGYYSYKWAEVLSADAFSAFEDAGLDNEKAIEETGRRFRDTVLALGGGKSPLEVFVSFRGREPSPEPLLRHNGLLPVAA

SEQ ID NO: 8643 - DNA, 1167 bp, Sorghum bicolor
  misc_feature: Ceres ANNOT ID no. 6091407
  misc_feature: Encodes the peptide sequence at SEQ ID NO 8644
atggcggcggcggcggcggcgacttccacagcctccgcgccctcctcctccttcccctccacctgcagggctagggccagggtcggggcccggccatccctcgtctctctccgcgtcagagcagcgaatcccgccacggtcaacgttaccaccgcctccgatcccgccccggtcttccagtccgtcacggccttcgcgccagccaccgtcgccaacctcggcccgggcttcgacttcctcggatgcgccgtcgctgacgcctccctctccctgggcgacaccgtcaccgcaaccctcgaccccacactcccgcccgccaccgtctccatcgcctccgtcacatccccgtcccgcccccacctcgccgaccgcctctccaaggacccgctccgcaactgcgcgggcgtcgccgccatcgccgcgctccgcgccctcggcgtccgctcccacgccgtctccatccaccttaccaagggcctgccgctcggctcggggctcggctcttccgcggcctccgccgccgccgccgccaaggccgtcgacgccctcttcggctcgcgcctcgcccgcgacgacctcgtcctcgcggggctcgagtccgagaaggccgtcagcggcttccacgccgacaacatcgcccccgccatcctcggcggcttcgtcctcgtccgcagctacgaccccttccacctcgtcccgctctgctccccgcccgcgctccgcctccacttcgtcctcgtcacccccgacttcgaggctcccacgagcaagatgcgcgccgcgctgcccaaacaggtcgacgtccaccagcacgtgcgcaactccagccaggcagcggcgctcgtggcggcggtgctgcaaggggatgcgggcctcatcggctccgcgatgtcgtccgacagcatcgtcgagcccaccagggcacccctcatacctggcatggcggccgtcaaggcggcggccctgcaagctggagcgctgggctgcacaattagcggcgcgggccccacagcggtggccgtcatcgaaggggaggaaaagggggaggaggttgcccgcaggatggtggacgccttctggagcgcaggcaaactcaaggcgactgcaaccgtcgctcagctcgatacccttggtgccagggtcatcgccacatcatccttggactag

SEQ ID NO: 8644 - protein, 388 aa, Sorghum bicolor
  misc_feature: Ceres ANNOT ID no. 6091407
  misc_feature (153)..(219): Pfam Id: GHMP_kinases_N Pfam Desc: GHMP kinases N terminal domain
  misc_feature (281)..(362): Pfam Id: GHMP_kinases_C Pfam Desc: GHMP kinases C terminal
  misc_feature (45)..(386): NCBI GI: 22135868 NCBI Desc: 3-hydroxy-3-methylglutaryl-coenzyme a reductase 2 [arabidopsis thaliana]
  misc_feature (45)..(386): NCBI GI: 4927412 NCBI Desc: homoserine kinase [arabidopsis thaliana]
  misc_feature (61)..(382): NCBI GI: 110636501 NCBI Desc: homoserine kinase [cytophaga hutchinsonii atcc 33406]
  misc_feature (60)..(386): NCBI GI: 59798420 NCBI Desc: homoserine kinase (hsk) (hk)
  misc_feature (60)..(386): NCBI GI: 21674844 NCBI Desc: homoserine kinase [chlorobium tepidum tls]
MAAAAAATSTASAPSSSFPSTCRARARVGARPSLVSLRVRAANPATVNVTTASDPAPVFQSVTAFAPATVANLGPGFDFLGCAVADASLSLGDTVTATLDPTLPPATVSIASVTSPSRPHLADRLSKDPLRNCAGVAAIAALRALGVRSHAVSIHLTKGLPLGSGLGSSAASAAAAAKAVDALFGSRLARDDLVLAGLESEKAVSGFHADNIAPAILGGFVLVRSYDPFHLVPLCSPPALRLHFVLVTPDFEAPTSKMRAALPKQVDVHQHVRNSSQAAALVAAVLQGDAGLIGSAMSSDSIVEPTRAPLIPGMAAVKAAALQAGALGCTISGAGPTAVAVIEGEEKGEEVARRMVDAFWSAGKLKATATVAQLDTLGARVIATSSLD

SEQ ID NO: 8645 - DNA, 1527 bp, Sorghum bicolor
  misc_feature: Ceres ANNOT ID no. 6091459
  misc_feature: Encodes the peptide sequence at SEQ ID NO 8646
atgtcgaccagcaagggcggagcagccaagggcggcggagggaagaagaaggaggtgaagaaggagacgaagctcgggatggcgtataagaaggacgacaacttcggggagtggtactccgaggttgttgttaacagtgaaatgatcgagtactatgacatctctggttgttatatattgaggccatgggcgatggagatctgggagctactgaaagaattctttgatgcagaaattaaaaagctcaagctcaagccatattatttccctttgtttgttactgagaatgttctacagaaggaaaaggaccacattgagggctttgcaccagaggtagcttgggttactaagtcagggaaatctgaactggaagcacctattgcaatccgccccacaagtgagactgtcatgtatccatacttctccaaatggatcagaagccaccgagacttacccttgaggtgtaatcaatggtgtaatgttgttagatgggagtttagtaatcctactcctttcataaggagccgtgaatttctgtggcaagaagggcatactgcttttgcgactaaagaagaggcagatgaagaggttctccaaatattggaactgtacagaagaatatatgaagaatttttagcagttccagtgtccaaagggaggaaaagtgagatggaaaaatttgcaggtggactttataccaccagtgttgaggccttcattccaaacactggtcgtggcatacaaggcgcaacctcacattgtcttggtcaaaacttcgccaagatgtttgatatcacttttgagaatgagaagggtgttagggaaatggtttggcaaaactcttgggcctacactacccgttcgattggagtgatggtgatgacacatggtgatgacaaaggcttagtattaccaccaaaggtggcaccaatccaggtaattgtgattgcagtgccttataaggatgctgacacaactgccataaagggagcctgtgaatcaactgtttacacactcaatgaatctgggattcgagcggatcaggacacccgtgaaaattactctccaggttggaagtattctcattgggaaatgaaaggtgttccattgagaattgagattggtccaaaagatctggcaaacaaacaggtgcgcattgtccgccgggacaacggtgcaaaggttgacattcctgtgaccaatttggttgaagaggttaaagtattactggatgagattcaaaaaaatctgttcaaaacagcccaagaaaagagagatgcctgtgttcaagtcatcaaaacttgggatgaattcacaactgctctaaataacaaaaggttgatcttggctccatggtgtgatgaggaggaagttgagaaagatgtgaaagctcggacaaaaggggaactcggagctgcaaaaacattgtgtactccatttgagcagccagaacttccagaaggtaccctgtgctttgcatctggaaagcaagcgaagaagtggtcgttctggggccgcagctactga

SEQ ID NO: 8646 - protein, 508 aa, Sorghum bicolor
  misc_feature: Ceres ANNOT ID no. 6091459
  misc_feature (435)..(508): Pfam Id: ProRS-C_1 Pfam Desc: Prolyl-tRNA synthetase, C-terminal
  misc_feature (312)..(409): Pfam Id: HGTP_anticodon Pfam Desc: Anticodon binding domain
  misc_feature (67)..(243): Pfam Id: tRNA-synt_2b Pfam Desc: tRNA synthetase class II core domain (G, H, P, S and T)
  misc_feature (1)..(508): NCBI GI: 77554943 NCBI Desc: prolyl-trna synthetase [oryza sativa (japonica cultivar-group)]
  misc_feature (1)..(508): NCBI GI: 115488440 NCBI Desc: os12g0443700 [oryza sativa (japonica cultivar-group)]
  misc_feature (1)..(300): NCBI GI: 77554944 NCBI Desc: prolyl-trna synthetase [oryza sativa (japonica cultivar-group)]
  misc_feature (5)..(508): NCBI GI: 22136084 NCBI Desc: multifunctional aminoacyl-trna ligase-like protein [arabidopsis thaliana]
  misc_feature (23)..(508): NCBI GI: 92873428 NCBI Desc: trna synthetase, class ii (g, h, p and s) [medicago truncatula]
MSTSKGGAAKGGGGKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSELEAPIAIRPTSETVMYPYFSKWIRSHRDLPLRCNQWCNVVRWEFSNPTPFIRSREFLWQEGHTAFATKEEADEEVLQILELYRRIYEEFLAVPVSKGRKSEMEKFAGGLYTTSVEAFIPNTGRGIQGATSHCLGQNFAKMFDITFENEKGVREMVWQNSWAYTTRSIGVMVMTHGDDKGLVLPPKVAPIQVIVIAVPYKDADTTAIKGACESTVYTLNESGIRADQDTRENYSPGWKYSHWEMKGVPLRIEIGPKDLANKQVRIVRRDNGAKVDIPVTNLVEEVKVLLDEIQKNLFKTAQEKRDACVQVIKTWDEFTTALNNKRLILAPWCDEEEVEKDVKARTKGELGAAKTLCTPFEQPELPEGTLCFASGKQAKKWSFWGRSY

SEQ ID NO: 8647 - DNA, 1017 bp, Sorghum bicolor
  misc_feature: Ceres ANNOT ID no. 6091464
  misc_feature: Encodes the peptide sequence at SEQ ID NO 8648
atggcgacggggggcggccagcaggggaaggccgcggggtactaccagtacccggcctcgtactcgtacgccggcgccgcggccgcggccgcggaggaggagcgccggtggtggccgtggctcgtgcccaccgtgctcgtcgcctgcatcgcggtcttcgcggccgagatgttcgtcaacgactgcccgcgccacgggagcgcgctcggcggcggcgccgggtccgggtgcgtcgcggccgggctcctccgccggttctccttccagccgctccgcgagaacccgctcttcgggccttcctccgccaccttggagaagatgggagctctcaactgggccaaagtagttcatgagcaccaagggtggcgcctcataagctgtatctggctccatgctggtctagttcacttggttgtcaacatgctaagcttgctcttcattggaatccgccttgagcaacaatttgggtttgtattttctgacttgcaagtgcgcattggggttatctacttgatatctggctttggcggcagtgtcctgtctgctcttttcctacacagtaactacatctctgttggtgcctctggggctttgtttggcctccttggatcaatgctttcagagcttattatgaactggactatctattccaacaaggcagcggcaatcataactctactttttataattgcaattaacctggccattgggatattacctcatgctgataattttgcccacattggtggctttgcttctggatttcttcttggattcgtgctgctggcaagacctcaatttggctggatggaacgcagcgagctacctcagactaatcaacctccaaagtacaaattgtaccagtatgtcttgtgggttgctgcactcctcttgctggtagttggatttgtgattatcttggtcatgctcttcaagggtaagaacgggaacgatagctgccactggtgccattacctgaactgcgtaccaacatccagatggaagtgcgatacatag

SEQ ID NO: 8648 - protein, 338 aa, Sorghum bicolor
  misc_feature: Ceres ANNOT ID no. 6091464
  misc_feature (115)..(266): Pfam Id: Rhomboid Pfam Desc: Rhomboid family
  misc_feature (1)..(338): NCBI GI: 294845 NCBI Desc: membrane protein [saccharum hybrid cultivar h65-7052]
  misc_feature (36)..(337): NCBI GI: 20466143 NCBI Desc: at5g07250/t28j14_190 [arabidopsis thaliana]
  misc_feature (79)..(336): NCBI GI: 115483002 NCBI Desc: os10g0521900 [oryza sativa (japonica cultivar-group)]
  misc_feature (32)..(337): NCBI GI: 30693911 NCBI Desc: rhomboid family protein [arabidopsis thaliana]
  misc_feature (18)..(337): NCBI GI: 38344377 NCBI Desc: osjnbb0032e06.11 [oryza sativa (japonica cultivar-group)]
MATGGGQQGKAAGYYQYPASYSYAGAAAAAAEEERRWWPWLVPTVLVACIAVFAAEMFVNDCPRHGSALGGGAGSGCVAAGLLRRFSFQPLRENPLFGPSSATLEKMGALNWAKVVHEHQGWRLISCIWLHAGLVHLVVNMLSLLFIGIRLEQQFGFVFSDLQVRIGVIYLISGFGGSVLSALFLHSNYISVGASGALFGLLGSMLSELIMNWTIYSNKAAAIITLLFIIAINLAIGILPHADNFAHIGGFASGFLLGFVLLARPQFGWMERSELPQTNQPPKYKLYQYVLWVAALLLLVVGFVIILVMLFKGKNGNDSCHWCHYLNCVPTSRWKCDT

SEQ ID NO: 8649 - DNA, 312 bp, Sorghum bicolor
  misc_feature: Ceres ANNOT ID no. 6091466
  misc_feature: Encodes the peptide sequence at SEQ ID NO 8650
atggcggcgctagaggcggccaccaccagcaccgtcccgcgcgcgctcctcgccgcgtgcctcgtcctgctggtcctcggcggcggcccgtcgtcgtcggtgcaggcgcagggcggcggcgggctgtgcctgccgcagctgaacggcctcctggcgtgccgcgcgtacctggtgcccggcgcgccggacccaagcgccgactgctgcagcgcgctgagcgccgtgtcgcacgagtgcgcctgcagcaccatgggcatcatcaacagcctccccggccgctgcaacctcgcccaagtcaactgctccgcttga

SEQ ID NO: 8650 - protein, 103 aa, Sorghum bicolor
  misc_feature: Ceres ANNOT ID no. 6091466
  misc_feature (43)..(101): Pfam Id: Tryp_alpha_amyl Pfam Desc: Protease inhibitor/seed storage/LTP family
  misc_feature (3)..(103): NCBI GI: 6689676 NCBI Desc: ltp-like protein; anther specific protein [zea mays]
  misc_feature (4)..(101): NCBI GI: 1628471 NCBI Desc: men-8 [silene latifolia]
  misc_feature (13)..(101): NCBI GI: 3378527 NCBI Desc: anther specific protein [zea mays]
  misc_feature (1)..(103): NCBI GI: 19152 NCBI Desc: 108 protein [lycopersicon esculentum]
  misc_feature (8)..(101): NCBI GI: 431148 NCBI Desc: orf [lilium longiflorum]
  misc_feature: The sequence is a functional homolog of SEQ ID NO. 364 in the 11/188,298 US application
MAALEAATTSTVPRALLAACLVLLVLGGGPSSSVQAQGGGGLCLPQLNGLLACRAYLVPGAPDPSADCCSALSAVSHECACSTMGIINSLPGRCNLAQVNCSA

SEQ ID NO: 8651 - DNA, 723 bp, Sorghum bicolor
  misc_feature: Ceres ANNOT ID no. 6091476
  misc_feature: Encodes the peptide sequence at SEQ ID NO 8652
atggatttcaagcgcaccaccacggagcctccggcggcggcaacttcgccttcggcttcgccgtcgctcgggtcgtcggggcagcatccgtccccgccgaagcggccggcggggcggaccaagttccaggagacgcggcacccggtgttccgcggggtgcgtcggcgcggccgggccgggcggtgggtgtgcgaggtgcgcgtcccgggcagccgcggggaccgcctgtgggtgggcacgttcgacaccgccgaggccgccgcgcgcgcgcacgacgccgccatgctcgcgctctgcggcgacgccgcgtgcctcaacttcgccgactccgcttcgctgctccacgtcccgcgtcccgccgccgacccctccgccgctgtgggcctccccgacgtccagcgcgccgccaccgaggccgtcgccgggttcatgctgcagcgccagcgcggcgggcacgacgcgcccgccgctgcctcgcaggacaatgccgcttcggcttcggcggcggcggcgggcgtggaccacgcccacgcgccacgtgccgtggggccgccggcggtggacagcttgctcgagctggatgtgttcggcggcatggacgacgccggctcctactatgcgagcttggcgcaggggctgctcatcgacccgccgccgcccgccgtggactgccccgacgaggatgaagattgcggcgccggtgagatggagctgtggggctag

SEQ ID NO: 8652 - protein, 240 aa, Sorghum bicolor
  misc_feature: Ceres ANNOT ID no. 6091476
  misc_feature (48)..(101): Pfam Id: AP2 Pfam Desc: AP2 domain
  misc_feature (2)..(239): NCBI GI: 115477637 NCBI Desc: os08g0545400 [oryza sativa (japonica cultivar-group)]
  misc_feature (9)..(239): NCBI GI: 115480235 NCBI Desc: os09g0522100 [oryza sativa (japonica cultivar-group)]
  misc_feature (19)..(239): NCBI GI: 118026854 NCBI Desc: crt-binding factor [lolium perenne]
  misc_feature (19)..(239): NCBI GI: 118026852 NCBI Desc: crt-binding factor [lolium perenne]
  misc_feature (13)..(239): NCBI GI: 126566983 NCBI Desc: c-repeat binding factor 3-like protein [hordeum vulgare subsp. vulgare]
  misc_feature: The sequence is a functional homolog of SEQ ID NO 1221 in the 10/374,780US patent application
  misc_feature: The sequence is a functional homolog of SEQ ID NO 1225 in the 10/374,780US patent application
  misc_feature: The sequence is a functional homolog of SEQ ID NO 1228 in the 10/374,780US patent application
  misc_feature: The sequence is a functional homolog of SEQ ID NO 1230 in the 10/374,780US patent application
  misc_feature: The sequence is a functional homolog of SEQ ID NO 1231 in the 10/374,780US patent application
  misc_feature: The sequence is a functional homolog of SEQ ID NO 1236 in the 10/374,780US patent application
  misc_feature: The sequence is a functional homolog of SEQ ID NO 1314 in the 11/479,226US patent application
  misc_feature: The sequence is a functional homolog of SEQ ID NO 1410 in the 10/412,699US patent application
  misc_feature: The sequence is a functional homolog of SEQ ID NO 16 in the 10/225,068US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 516 in the 11/435,388US patent application
  misc_feature: The sequence is a functional homolog of SEQ ID NO 566 in the 10/225,066US patent application
  misc_feature: The sequence is a functional homolog of SEQ ID NO 616 in the 10/412,699US patent application
  misc_feature: The sequence is a functional homolog of SEQ ID NO 698 in the 11/435,388US patent application
  misc_feature: The sequence is a functional homolog of SEQ ID NO 708 in the 11/435,388US patent application
  misc_feature: The sequence is a functional homolog of SEQ ID NO 720 in the 11/435,388US patent application
  misc_feature: The sequence is a functional homolog of SEQ ID NO 722 in the 11/435,388US patent application
  misc_feature: The sequence is a functional homolog of SEQ ID NO 724 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: Useful for making plants with modulated growth and phenotype characteristics
  misc_feature: The sequence is a functional homolog of SEQ ID NO 1410 in the 20040045049 US patent application
  misc_feature: The sequence is a functional homolog of SEQ ID NO 616 in the 20040045049 US patent application
  misc_feature: The sequence is a functional homolog of SEQ ID NO 1225 in the 20060162006 US patent application
  misc_feature: The sequence is a functional homolog of SEQ ID NO 1228 in the 20060162006 US patent application
  misc_feature: The sequence is a functional homolog of SEQ ID NO 1230 in the 20060162006 US patent application
  misc_feature: The sequence is a functional homolog of SEQ ID NO 1231 in the 20060162006 US patent application
  misc_feature: The sequence is a functional homolog of SEQ ID NO 1236 in the 20060162006 US patent application
  misc_feature: The sequence is a functional homolog of SEQ ID NO 698 in the 20060272060 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1248 in the 10/374,780 US patent application
  misc_feature: The sequence is a functional homolog of SEQ ID NO 1236 in the 10/374,780 US patent application
MDFKRTTTEPPAAATSPSASPSLGSSGQHPSPPKRPAGRTKFQETRHPVFRGVRRRGRAGRWVCEVRVPGSRGDRLWVGTFDTAEAAARAHDAAMLALCGDAACLNFADSASLLHVPRPAADPSAAVGLPDVQRAATEAVAGFMLQRQRGGHDAPAAASQDNAASASAAAAGVDHAHAPRAVGPPAVDSLLELDVFGGMDDAGSYYASLAQGLLIDPPPPAVDCPDEDEDCGAGEMELWG

SEQ ID NO: 8653 - DNA, 1416 bp, Sorghum bicolor
  misc_feature: Ceres ANNOT ID no. 6091482
  misc_feature: Encodes the peptide sequence at SEQ ID NO 8654
atggaggagggcaaggacgtcgggatcctcgccatggacatctacttccctcccacctgtgtccagcaggaagcactggaggctcatgacggtgccagcaaggggaagtacacaattgggcttgggcaggattgcatggcattctgcagcgaggtggaagacgttgtatctatgagcttgacagttgttgcatccctgctgcaaaagtacaacattgatcctaagctaattggacgcttggaggttggtagtgaaacggtgatagataaaagcaagtccatcaaaacatggctgatgcaaattttcgaggaaagtggtaatactgacattgaaggagtcgactcgagcaatgcatgctatggtggaacagctgccctgttgaactgtgtgaattgggttgagagtaaatcatgggatggacgctatggccttgtcgtttgcacagacagcgcggtttatgcagaaggacctgctcgtcctacagggggtgctgctgctattgcaatgcttattggtccaaatgctcctatatcttttgaaagaaaatataaagcttcccacatggcccatgcttacgatttctacaagccggatcttgcaagtgaatacccggttgttgatggaaagttatctcaaacatgctacttgatggctctcgattcatgttataaacagttttgtaccaagtatgaaaagctagtcggagaacagttctcaatatctgatgcagattattgcgtgttccattctccatataataagcttgtgcagaaaagtttcgctcgactcttctttaatgatttcatgcgcaattgcagctcagttgataacgatgctaaagagaagcttctaccttttgcaaatctgaatagtgaagaaagttaccaaagccgtgacttggaaaaggcttctcagcaagttgcaaagcatttgtatgacatcaaagttcaaccgtcaactttgcttccaaaacaaatcggtaacatgtatactgcatctctgtatgcagcactggcctctgtagtctacaacaagcacaacagtctagctggccaacgaatcattatgttctcttatggcagtggcttgacatcgacattgttctcattaagattgcatgagggacaacatcccttcagcctagcaaacattgcttccatgcttgatgtaacagcaaagctcaactcaagacatgtgacaccacctgagaagtttgttgagacattgaagctgatggagcaccgttacggagcaaaggatttcgagacaagccaagacacaagcctgttgccacctggcacattctaccttacaaaagttgattccatgtataggaggttctatgacaagaaagcatctgacgacattgtttggggtaaaaccaaggttagcaatgccctagcaaatagccaatag

SEQ ID NO: 8654 - protein, 471 aa, Sorghum bicolor
  misc_feature: Ceres ANNOT ID no. 6091482
  misc_feature (177)..(451): Pfam Id: HMG_CoA_synt_C Pfam Desc: Hydroxymethylglutaryl-coenzyme A synthase C terminal
  misc_feature (3)..(176): Pfam Id: HMG_CoA_synt_N Pfam Desc: Hydroxymethylglutaryl-coenzyme A synthase N terminal
  misc_feature (5)..(457): NCBI GI: 42795470 NCBI Desc: hmg-coa synthase 2 [hevea brasiliensis]
  misc_feature (5)..(469): NCBI GI: 16417956 NCBI Desc: hydroxymethylglutaryl coenzyme a synthase [hevea brasiliensis]
  misc_feature (5)..(469): NCBI GI: 14916100 NCBI Desc: hydroxymethylglutaryl coenzyme a synthase [hevea brasiliensis]
  misc_feature (5)..(454): NCBI GI: 7799986 NCBI Desc: hmg-coa synthase [brassica juncea]
  misc_feature (5)..(451): NCBI GI: 112490560 NCBI Desc: chain a, enzyme in complex with hmg-coa and covalently bound to hmg- coa
  misc_feature (5)..(457): SWISSPROT Homolog: EC 2.3.3.10 Hydroxymethylglutaryl-CoA synthase
  misc_feature: Useful for making plants with modulated nitrogen use efficiency
  misc_feature: GREAT-hit functional homolog of the protein sequence given in SEQ ID NO 13003
  misc_feature: Useful for making plants with modulated nitrogen use efficiency
  misc_feature: Functional homolog of the protein sequence given in SEQ ID NO 13003
MEEGKDVGILAMDIYFPPTCVQQEALEAHDGASKGKYTIGLGQDCMAFCSEVEDVVSMSLTVVASLLQKYNIDPKLIGRLEVGSETVIDKSKSIKTWLMQIFEESGNTDIEGVDSSNACYGGTAALLNCVNWVESKSWDGRYGLVVCTDSAVYAEGPARPTGGAAAIAMLIGPNAPISFERKYKASHMAHAYDFYKPDLASEYPVVDGKLSQTCYLMALDSCYKQFCTKYEKLVGEQFSISDADYCVFHSPYNKLVQKSFARLFFNDFMRNCSSVDNDAKEKLLPFANLNSEESYQSRDLEKASQQVAKHLYDIKVQPSTLLPKQIGNMYTASLYAALASVVYNKHNSLAGQRIIMFSYGSGLTSTLFSLRLHEGQHPFSLANIASMLDVTAKLNSRHVTPPEKFVETLKLMEHRYGAKDFETSQDTSLLPPGTFYLTKVDSMYRRFYDKKASDDIVWGKTKVSNALANSQ

SEQ ID NO: 8655 - DNA, 1479 bp, Sorghum bicolor
  misc_feature: Ceres ANNOT ID no. 6091489
  misc_feature: Encodes the peptide sequence at SEQ ID NO 8656
atggacgacccgggcgcctccgccgaccccgccggtgccgcgcgccaccacctctcgccgcagcagcagcagcagctcggggggcagccgccagtgccgcgctccccgacgccgctcgacctggcctcctcctccgcagccgccgcggcgtccgggtaccgccgcctctcgccgtcgctccggccgccggcgcacccgcaggcggcgcgcctcccgtcgccctacggccagatcccttcgccaggcggcgccggcgcccaccacgcgcgctcgctctcccagccgctcttcttctcgctcgactcgctcccgctgccgccgccgctgccgccctacgccgatctgggcgccgcgccccccgcgataccgccctccccgccgccgtcgacctcctccgacccgcacccgccgccgccgccgccgctcggcttgccgcccaggagggcaggccaccgccgctcgcagagcgacatccccttcggcttcgcgcagctcagcccgccgctgcccccgccggctcccgtcaagcgcgaggtcaccactgcggccgacggctgcagatcggacggcggcggcggcgatgacgccgcgctctatgatctcgtcaactcgtacatggacctggacgggctggacccgctcaactcctccgaggaccgccacgaagaccgcgacagccgcgccagcggcacgcgcgccgggagcgcggccgagagcagcgagaacgaggcggagagccagtccacgtcggtcgacaggaaggatgggggcaagtcccggcattgtcgtagcctgtctatggatagcttcatgggcaagctcaacttcgccgcaggggatgagtctcctaagctgccgctgccgtctcctggtggcagcctcactaggagtgggagtggctcaatggaaggtggtgctgtcgctctgtttgatatggagtttgccaatggggagtttactgattctgagaagaagaagatcatggcgaatgagcgacttgctgagatagctttgacggatcctaagagggtcaagaggattctggcgaatcggcagtcagcagcaaggtcaaaggagcgcaagatgaggtacattcaggagcttgagcataaggtgcaagtgctgcagacagaggctaccacactctcagcacagttgacaatgctgcagagggactcagctggactggctactcagaacaacgagttgaaaatcaggctgcaagcaatggagcaacaagcacagctgagagacgccctgaatgaagcgttaactgccgaggtccagcgtctgaaactcgcaactggggagataactgatggacatggacggatgccgaaggggctacagcagcagatgaactcccagatgctccagctccagcaactgcaaatacagcagcaggtgccccagacacagcagcagcaaggccagcgacagcagcagcagcagcagcagcagccccagaagtcggcatag

SEQ ID NO: 8656 - protein, 492 aa, Sorghum bicolor
  misc_feature: Ceres ANNOT ID no. 6091489
  misc_feature (338)..(392): Pfam Id: bZIP_2 Pfam Desc: Basic region leucine zipper
  misc_feature (338)..(401): Pfam Id: bZIP_1 Pfam Desc: bZIP transcription factor
  misc_feature (9)..(475): NCBI GI: 115477615 NCBI Desc: os08g0543900 [oryza sativa (japonica cultivar-group)]
  misc_feature (16)..(487): NCBI GI: 92870675 NCBI Desc: camp response element binding (creb) protein [medicago truncatula]
  misc_feature (16)..(486): NCBI GI: 113367236 NCBI Desc: bzip transcription factor bzip28 [glycine max]
  misc_feature (199)..(476): NCBI GI: 113367276 NCBI Desc: bzip transcription factor bzip21 [glycine max]
  misc_feature (233)..(478): NCBI GI: 116308981 NCBI Desc: osigba0101k10.2 [oryza sativa (indica cultivar-group)]
  misc_feature: The sequence is a functional homolog of SEQ ID NO 116 in the 10/225,068US patent application
  misc_feature: The sequence is a functional homolog of SEQ ID NO 2726 in the 10/374,780US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 912 in the 10/374,780US patent application
  misc_feature: The sequence is a functional homolog of SEQ ID NO 913 in the 10/374,780US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13350
  misc_feature: The sequence is a functional homolog of SEQ ID NO 116 in the 20050120408 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO 912 in the 20060162006 US patent application
  misc_feature: The sequence is a functional homolog of SEQ ID NO 186 in the 10/225,068 US patent application
  misc_feature: The sequence is a functional homolog of SEQ ID NO 2802 in the 10/374,780 US patent application
  misc_feature: The sequence is a functional homolog of SEQ ID NO 908 in the 10/225,066 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MDDPGASADPAGAARHHLSPQQQQQLGGQPPVPRSPTPLDLASSSAAAAASGYRRLSPSLRPPAHPQAARLPSPYGQIPSPGGAGAHHARSLSQPLFFSLDSLPLPPPLPPYADLGAAPPAIPPSPPPSTSSDPHPPPPPPLGLPPRRAGHRRSQSDIPFGFAQLSPPLPPPAPVKREVTTAADGCRSDGGGGDDAALYDLVNSYMDLDGLDPLNSSEDRHEDRDSRASGTRAGSAAESSENEAESQSTSVDRKDGGKSRHCRSLSMDSFMGKLNFAAGDESPKLPLPSPGGSLTRSGSGSMEGGAVALFDMEFANGEFTDSEKKKIMANERLAEIALTDPKRVKRILANRQSAARSKERKMRYIQELEHKVQVLQTEATTLSAQLTMLQRDSAGLATQNNELKIRLQAMEQQAQLRDALNEALTAEVQRLKLATGEITDGHGRMPKGLQQQMNSQMLQLQQLQIQQQVPQTQQQQGQRQQQQQQQQPQKSA

SEQ ID NO: 8657 - DNA, 819 bp, Sorghum bicolor
  misc_feature: Ceres ANNOT ID no. 6091494
  misc_feature: Encodes the peptide sequence at SEQ ID NO 8658
atgaatgagctcgtcccccagtcatccttctgctccccagcctccccaacgtccttcttctccgcggcggcaggccaccactctgtcctcgagttcatgtcctgcggggtacccgagcaatggctactcggcgaagaagaagcactcgataataagcacatgcatgatggctctgagtgggtggccggaggctcgcacgactcggcgggctccgacctgtccagcaacccgccggtggctgcggtcgtcatgtccgaccgcacggcgaggagtaggcggggcaggaagcccgggccccggtccgacaaccccggagtcagccacgtcgaggccgagcggcagcggcgggagaagctcaaccgccggttctgcgacctccgggccacggtgccgacggtgtcccggatggacaaggcgtccctgctcgccgacgccaccgcctacatcgccgagctgcgcggtcgcgtggagcagctggaggccgatgccaagcagcaggtcgcggcgaggaagctgggcggcggcaaccccgccatgtgcccggcctcggggggcctcgaggagaagctggaggtgcggatggtcgggcgtcatgcggcggcggtgcgcctgacgacggcctcgacacgccacgcccccgcgctcctcatgggcgcgctgcggtcgctggacctgcccgtgcagaacgcgtgcgtgagccgcgtgggcggcgcggcgacggtgcaggacgccgtcgtggacgtgcccgccgcgctccaggacgaaggctgcctccgtgccgcgctgctccacgtcctgcagcaggacgagagcgcgtag

SEQ ID NO: 8658 - protein, 272 aa, Sorghum bicolor
  misc_feature: Ceres ANNOT ID no. 6091494
  misc_feature (104)..(153): Pfam Id: HLH Pfam Desc: Helix-loop-helix DNA-binding domain
  misc_feature (15)..(267): NCBI GI: 42407849 NCBI Desc: phaseolin g-box binding protein pg1-like [oryza sativa (japonica cultivar-group)]
  misc_feature (63)..(262): NCBI GI: 45421752 NCBI Desc: myc transcription factor [solanum tuberosum]
  misc_feature (63)..(262): NCBI GI: 45421750 NCBI Desc: myc transcription factor [solanum tuberosum]
  misc_feature (67)..(263): NCBI GI: 2943789 NCBI Desc: rd22bp1 [arabidopsis thaliana]
  misc_feature (65)..(263): NCBI GI: 89274228 NCBI Desc: basic helix-loop-helix (bhlh) family transcription factor [brassica oleracea]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 955 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 955 in the 20060162006 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MNELVPQSSFCSPASPTSFFSAAAGHHSVLEFMSCGVPEQWLLGEEEALDNKHMHDGSEWVAGGSHDSAGSDLSSNPPVAAVVMSDRTARSRRGRKPGPRSDNPGVSHVEAERQRREKLNRRFCDLRATVPTVSRMDKASLLADATAYIAELRGRVEQLEADAKQQVAARKLGGGNPAMCPASGGLEEKLEVRMVGRHAAAVRLTTASTRHAPALLMGALRSLDLPVQNACVSRVGGAATVQDAVVDVPAALQDEGCLRAALLHVLQQDESA

SEQ ID NO: 8659 - DNA, 840 bp, Sorghum bicolor
  misc_feature: Ceres ANNOT ID no. 6091495
  misc_feature: Encodes the peptide sequence at SEQ ID NO 8660
atggcaatctcttcctcattcatcagcggaatcatggatgagcttgcctgccgcagctttttctcatccatccctcagtccccagccttcttctccggcgccggcggccaacacccggtgcttgagttctcgtactgcgacgtccccgagcaatggctggaggatgacgacggcggcggcgcagagaagctctgggacggcaccacagcgacagtgttaggcaccggggcggcgacgccctcggcaccggcagcaggcaaccacgacgatgtgtctgacaaactgccggcggcacctgcgccgcccaagaggcggcggggccgcaagcccgggcccaggaccgtcggccccgtcctcagccacgtggaggcggagcggcagcggcgggacaggctcaaccgccggttctgcgacctccgggcagccgtccccacggtgtccaagatggacagggcgtccctcctcgccgacgccacggcctacatcgctgagctgcgcggccgcgcggaacgggtcgagatcgaggccaagcagcagcaggccgtcactgcggtggtgccgccagaggccttcaaggagaagctggaggtgcggatgctggggcagcgcgaggcggcggcgctgcgcctgacgacgacggcagggacgacaccccacgacgccgccgcgcgcctcatggtcgcgctctgctccctggacctgccggtgcagcacgcgtacgtgtgccgcgtgggcggcacgacgaccgtgcaggacgccgtcgtggacgtgcccgtcgcgctgcgggacgacggcgtcctccgagcggtgttgctccggagcctgcaagggagcggatga

SEQ ID NO: 8660 - protein, 279 aa, Sorghum bicolor
  misc_feature: Ceres ANNOT ID no. 6091495
  misc_feature (117)..(166): Pfam Id: HLH Pfam Desc: Helix-loop-helix DNA-binding domain
  misc_feature (27)..(276): NCBI GI: 42407849 NCBI Desc: phaseolin g-box binding protein pg1-like [oryza sativa (japonica cultivar-group)]
  misc_feature (92)..(189): NCBI GI: 1142619 NCBI Desc: phaseolin g-box binding protein pg1
  misc_feature (58)..(175): NCBI GI: 68342448 NCBI Desc: basic helix-loop-helix transcription factor protein [rheum australe]
  misc_feature (78)..(173): NCBI GI: 1142621 NCBI Desc: phaseolin g-box binding protein pg2 [phaseolus vulgaris]
  misc_feature (72)..(180): NCBI GI: 9758512 NCBI Desc: bhlh protein-like [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1276 in the 10/666,642US patent application
  misc_feature: The sequence is a functional homolog of SEQ ID NO 1705 in the 10/374,780US patent application
  misc_feature: The sequence is a functional homolog of SEQ ID NO 1897 in the 10/374,780US patent application
  misc_feature: The sequence is a functional homolog of SEQ ID NO 1898 in the 10/374,780US patent application
  misc_feature: The sequence is a functional homolog of SEQ ID NO 1899 in the 10/374,780US patent application
  misc_feature: The sequence is a functional homolog of SEQ ID NO 1900 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1705 in the 20060162006 US patent application
  misc_feature: The sequence is a functional homolog of SEQ ID NO 1897 in the 20060162006 US patent application
  misc_feature: The sequence is a functional homolog of SEQ ID NO 1898 in the 20060162006 US patent application
  misc_feature: The sequence is a functional homolog of SEQ ID NO 1899 in the 20060162006 US patent application
  misc_feature: The sequence is a functional homolog of SEQ ID NO 1900 in the 20060162006 US patent application
MAISSSFISGIMDELACRSFFSSIPQSPAFFSGAGGQHPVLEFSYCDVPEQWLEDDDGGGAEKLWDGTTATVLGTGAATPSAPAAGNHDDVSDKLPAAPAPPKRRRGRKPGPRTVGPVLSHVEAERQRRDRLNRRFCDLRAAVPTVSKMDRASLLADATAYIAELRGRAERVEIEAKQQQAVTAVVPPEAFKEKLEVRMLGQREAAALRLTTTAGTTPHDAAARLMVALCSLDLPVQHAYVCRVGGTTTVQDAVVDVPVALRDDGVLRAVLLRSLQGSG

SEQ ID NO: 8661 - DNA, 792 bp, Sorghum bicolor
  misc_feature: Ceres ANNOT ID no. 6091496
  misc_feature: Encodes the peptide sequence at SEQ ID NO 8662
atggatgagctcgtctaccccgcctcatcatgcagctctccctcccccacctccttctccgcggccggccactttgaggagctggagttcgtgtcctgggatgtcccggaggaatggatggagggcaacgattggttcgacgagcccttggcggatggagacgagggctgccgctcggcgggcaacggcgacctgtccggatccggcgaaccgccggcgccggcgcctgcgccgaagcggcgtggccggaagcctgggccccggaccaacggccccactatcagccacgtggaggccgagcggcagcggcgggacaagctcaaccgccgcttctgcgagctcagggcagccgtgcccacggtgtccaggatggacagggcgtccctcctcgcggccgccgccgcctacatcggcgagctgcgcgaccgcgtcgagcagctcgaggccgaggccaagcaggcagcctccgccgctgtcaccaccgcggcggcggcggcggccacccaccaccaccactcgttcggtctcctccaggggaagctggggctggaggtgcggatgctcgccgggctggacgcggcggcgctgcgcctgacgacgaccacggcgcgccacgcgccggcgcacctcatgctcgcgctccggtcgctggacctgcaggtgcagcacgcgtgcgtgtgcagggtgaacggcgtggccgtgcaggatgccgtcgtcgacgtgcccgccgggctgcgcgacgagcgcggcctgcgcgctgcgttgctccacaagctgcagcagagcggctag

SEQ ID NO: 8662 - protein, 263 aa, Sorghum bicolor
  misc_feature: Ceres ANNOT ID no. 6091496
  misc_feature (92)..(141): Pfam Id: HLH Pfam Desc: Helix-loop-helix DNA-binding domain
  misc_feature (15)..(260): NCBI GI: 42407849 NCBI Desc: phaseolin g-box binding protein pg1-like [oryza sativa (japonica cultivar-group)]
  misc_feature (10)..(259): NCBI GI: 1465368 NCBI Desc: bhlh protein [arabidopsis thaliana]
  misc_feature (10)..(259): NCBI GI: 27764972 NCBI Desc: at1g32640/f6n18_4 [arabidopsis thaliana]
  misc_feature (10)..(259): NCBI GI: 2943789 NCBI Desc: rd22bp1 [arabidopsis thaliana]
  misc_feature (71)..(263): NCBI GI: 4321762 NCBI Desc: transcription factor myc7e [zea mays]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1276 in the 10/666,642US patent application
  misc_feature: The sequence is a functional homolog of SEQ ID NO 1378 in the 10/374,780US patent application
  misc_feature: The sequence is a functional homolog of SEQ ID NO 1499 in the 10/412,699US patent application
  misc_feature: The sequence is a functional homolog of SEQ ID NO 1501 in the 10/374,780US patent application
  misc_feature: The sequence is a functional homolog of SEQ ID NO 1705 in the 10/374,780US patent application
  misc_feature: The sequence is a functional homolog of SEQ ID NO 1897 in the 10/374,780US patent application
  misc_feature: The sequence is a functional homolog of SEQ ID NO 1900 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 955 in the 10/374,780US patent application
  misc_feature: The sequence is a functional homolog of SEQ ID NO 956 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1499 in the 20040045049 US patent application
  misc_feature: The sequence is a functional homolog of SEQ ID NO 1501 in the 20060162006 US patent application
  misc_feature: The sequence is a functional homolog of SEQ ID NO 1705 in the 20060162006 US patent application
  misc_feature: The sequence is a functional homolog of SEQ ID NO 1897 in the 20060162006 US patent application
  misc_feature: The sequence is a functional homolog of SEQ ID NO 1900 in the 20060162006 US patent application
  misc_feature: The sequence is a functional homolog of SEQ ID NO 955 in the 20060162006 US patent application
  misc_feature: The sequence is a functional homolog of SEQ ID NO 956 in the 20060162006 US patent application
MDELVYPASSCSSPSPTSFSAAGHFEELEFVSWDVPEEWMEGNDWFDEPLADGDEGCRSAGNGDLSGSGEPPAPAPAPKRRGRKPGPRTNGPTISHVEAERQRRDKLNRRFCELRAAVPTVSRMDRASLLAAAAAYIGELRDRVEQLEAEAKQAASAAVTTAAAAAATHHHHSFGLLQGKLGLEVRMLAGLDAAALRLTTTTARHAPAHLMLALRSLDLQVQHACVCRVNGVAVQDAVVDVPAGLRDERGLRAALLHKLQQSG

SEQ ID NO: 8663 - DNA, 849 bp, Sorghum bicolor
  misc_feature: Ceres ANNOT ID no. 6091498
  misc_feature: Encodes the peptide sequence at SEQ ID NO 8664
atggatgaggttgtctgctggcccgccgcctcctgcacctctccgtcgtcgccggccgccttctccacgaccggacagcacccggagctggacttcgtgtccagcgagctcttggagcgatggttggggttggggagcgacgactgcctggatgacggcgccgggtggggcgacgagggctcgcgctcggccggccaagacgacgtcgacgaccagtccggttccggccccggccaaccgctggcacctgcgccaccgaagaggcgtggccggaagcccgggccccggtccaacggtcccgtcatcagccacgtggaggcggagcggcagcggcgcgacaagctcaaccgccgcttctgcgagctccgggccgccgtgcccacggtgacccggatggacaaggcgtccctcctcgcggacgccgccgcctacatcgccgagctgcgcgaccgcgtcgagcagctcgaggccgaggccaagcaggccgcgacgacctccgtcgccgcggccgccgtcacctgcagcgccacgctggtggccggcgtcacccggtctccgacctcgttcggtggcttccatgagaagctcgaggtgcggatggtcgggaagggggcggcggcgctgcgcctgacgacgacgacgaccgcggcgagccatgtccacgcccccgcgcgcttcatgctcgcgctccgctcgctggacctgccggtgcagcacgcgtccgtgtgcagggtgggcgacgtcaccgtgcaggacgccgtcgtcgacgtccctgccgccgcgctgcggagcgagcgcggcctccgggtcgcgttgctgcacagcctgcagcggttcgcggctagctag

SEQ ID NO: 8664 - protein, 282 aa, Sorghum bicolor
  misc_feature: Ceres ANNOT ID no. 6091498
  misc_feature (100)..(149): Pfam Id: HLH Pfam Desc: Helix-loop-helix DNA-binding domain
  misc_feature (17)..(277): NCBI GI: 42407849 NCBI Desc: phaseolin g-box binding protein pg1-like [oryza sativa (japonica cultivar-group)]
  misc_feature (60)..(276): NCBI GI: 1465368 NCBI Desc: bhlh protein [arabidopsis thaliana]
  misc_feature (60)..(276): NCBI GI: 27764972 NCBI Desc: at1g32640/f6n18_4 [arabidopsis thaliana]
  misc_feature (60)..(276): NCBI GI: 2943789 NCBI Desc: rd22bp1 [arabidopsis thaliana]
  misc_feature (54)..(257): NCBI GI: 1142619 NCBI Desc: phaseolin g-box binding protein pg1
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: Useful for making plants with modulated growth and phenotype characteristics
  misc_feature: The sequence is a functional homolog of SEQ ID NO 12 in the 20040045049 US patent application
MDEVVCWPAASCTSPSSPAAFSTTGQHPELDFVSSELLERWLGLGSDDCLDDGAGWGDEGSRSAGQDDVDDQSGSGPGQPLAPAPPKRRGRKPGPRSNGPVISHVEAERQRRDKLNRRFCELRAAVPTVTRMDKASLLADAAAYIAELRDRVEQLEAEAKQAATTSVAAAAVTCSATLVAGVTRSPTSFGGFHEKLEVRMVGKGAAALRLTTTTTAASHVHAPARFMLALRSLDLPVQHASVCRVGDVTVQDAVVDVPAAALRSERGLRVALLHSLQRFAAS

SEQ ID NO: 8665 - DNA, 819 bp, Sorghum bicolor
  misc_feature: Ceres ANNOT ID no. 6091499
  misc_feature: Encodes the peptide sequence at SEQ ID NO 8666
atggatgagctggtcttccctgcctcatccagcagctgtccttccccagcctcgttctccaccgccggacaccaccaggagcacgagttcgtgccctgtgatttcctggagggatggctggggggcgacgacgactggccggacctggacgagcccccaagtggcgtcacgtggggtggcgagggctcgcgctcgctgcgcaacgaccaccacctgtccggcgaaccgccggcaactgcgctgaagaggcgtggccggaaaccagcgtcccgtaacaacaccaacagccccgccctctgccacgtcgaggcggagcggcagcggcgggacaagctgaaccgcctcttctgcgagctccgggccgccgtgcccaccgtgtcccgcatggacaaggcgtccgtcctcgccgacgctaccagctacatcgcccagctgcggcagcgcgtccagcagctcgaggccgaggccaagaagaaggccgcggccgcggccgccgctctcacgacggtggtggcgcccttctcgcactcgttcatcatcagcggcagcggccagcagctcggagagaagctggaggtgcggatggtcgggacagaggcggcggcgctccgcctgacgacggcgaccgcggcggtgcgccacgcccccgcgcgcctcatgctcgcgctccagtcgctggacctgcccgtgcagcacgcgtgcgtgtgcctcgtcggcggcgtcaccgtgcaggacgccgtcgtggaagtgcccgctgcgctgcgggacgaccgcgccctccgcgccgcgttgctccacaggctgctgcggaccggctag

SEQ ID NO: 8666 - protein, 272 aa, Sorghum bicolor
  misc_feature: Ceres ANNOT ID no. 6091499
  misc_feature (97)..(146): Pfam Id: HLH Pfam Desc: Helix-loop-helix DNA-binding domain
  misc_feature (1)..(268): NCBI GI: 42407849 NCBI Desc: phaseolin g-box binding protein pg1-like [oryza sativa (japonica cultivar-group)]
  misc_feature (77)..(264): NCBI GI: 1142621 NCBI Desc: phaseolin g-box binding protein pg2 [phaseolus vulgaris]
  misc_feature (76)..(272): NCBI GI: 4321762 NCBI Desc: transcription factor myc7e [zea mays]
  misc_feature (77)..(184): NCBI GI: 68342448 NCBI Desc: basic helix-loop-helix transcription factor protein [rheum australe]
  misc_feature (76)..(272): NCBI GI: 45477841 NCBI Desc: myc protein [oryza sativa]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 2 in the 10/374,780US patent application
  misc_feature: The sequence is a functional homolog of SEQ ID NO 384 in the 10/412,699US patent application
  misc_feature: The sequence is a functional homolog of SEQ ID NO 464 in the 11/435,388US patent application
  misc_feature: The sequence is a functional homolog of SEQ ID NO 890 in the 11/479,226US patent application
  misc_feature: The sequence is a functional homolog of SEQ ID NO 955 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 384 in the 20040045049 US patent application
  misc_feature: The sequence is a functional homolog of SEQ ID NO 955 in the 20060162006 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MDELVFPASSSSCPSPASFSTAGHHQEHEFVPCDFLEGWLGGDDDWPDLDEPPSGVTWGGEGSRSLRNDHHLSGEPPATALKRRGRKPASRNNTNSPALCHVEAERQRRDKLNRLFCELRAAVPTVSRMDKASVLADATSYIAQLRQRVQQLEAEAKKKAAAAAAALTTVVAPFSHSFIISGSGQQLGEKLEVRMVGTEAAALRLTTATAAVRHAPARLMLALQSLDLPVQHACVCLVGGVTVQDAVVEVPAALRDDRALRAALLHRLLRTG

SEQ ID NO: 8667 - DNA, 927 bp, Sorghum bicolor
  misc_feature: Ceres ANNOT ID no. 6091520
  misc_feature: Encodes the peptide sequence at SEQ ID NO 8668
atggcctccgcggcggcggcgccggtgtttgagagggtggccgggatccgagccatcgccgagtccgggcgctttaaggcatggttcctggaccagtttggcgttcttcacgacgggaagaagccgtacccgggcgccattctggcattggagaagcttgcggggaatggggcaaagatggtgataatcagcaattcctctaggcggtcgtctgtgacaatggagaagctcaagagcctggggttcgacacgtcctgtttcctcgcgaccatcaccagtggggagctcacacatcaacaccttcagaagagaaacgacccatggtttgcagcccttggaaggaagtgtatccatatcacttggggtgacagaggagcaatctctctggagggacttggtttgcaagttgtgaacaatgttgatgatgcagagtttatattagcccacggtactgaagcccttggatcaccttctggtgatcctcttcccaaaagtcttgaggagcttgagcaggttctaatgcttggcctagaaaagcaacttccaatggtggtggctaatccagattatgtcactgtcgaagctcgagatctccgtgtcatgcctggcactctggcagctaaatatgagagccttggtggtgaagtgaaatggatggggaagcctgataagatgatctatacatcagcgatgtccctaccaggtgttgatgctcatgaatgtatcatggtgggtgattcactgcaccacgacatcaaaggagcaaatgtgtcaggaatcgcgtctgcgttcattactggagggattcatgcagatgaacttggacttggtgagtttggagaaactgctgggaaggatgccatcaattcactgtgcagcaagcatggatcatatccttcttatgttttgccttcattcacatggtag

SEQ ID NO: 8668 - protein, 308 aa, Sorghum bicolor
  misc_feature: Ceres ANNOT ID no. 6091520
  misc_feature (25)..(268): Pfam Id: Hydrolase Pfam Desc: haloacid dehalogenase-like hydrolase
  misc_feature (3)..(308): NCBI GI: 92876181 NCBI Desc: haloacid dehalogenase-like hydrolase [medicago truncatula]
  misc_feature (25)..(308): NCBI GI: 92889447 NCBI Desc: haloacid dehalogenase-like hydrolase [medicago truncatula]
  misc_feature (15)..(308): NCBI GI: 50198963 NCBI Desc: at5g10460 [arabidopsis thaliana]
  misc_feature (100)..(302): NCBI GI: 92876180 NCBI Desc: regulator of chromosome condensation, rcc1 [medicago truncatula]
  misc_feature (101)..(302): NCBI GI: 92889448 NCBI Desc: regulator of chromosome condensation, rcc1 [medicago truncatula]
MASAAAAPVFERVAGIRAIAESGRFKAWFLDQFGVLHDGKKPYPGAILALEKLAGNGAKMVIISNSSRRSSVTMEKLKSLGFDTSCFLATITSGELTHQHLQKRNDPWFAALGRKCIHITWGDRGAISLEGLGLQVVNNVDDAEFILAHGTEALGSPSGDPLPKSLEELEQVLMLGLEKQLPMVVANPDYVTVEARDLRVMPGTLAAKYESLGGEVKWMGKPDKMIYTSAMSLPGVDAHECIMVGDSLHHDIKGANVSGIASAFITGGIHADELGLGEFGETAGKDAINSLCSKHGSYPSYVLPSFTW

SEQ ID NO: 8669 - DNA, 1341 bp, Sorghum bicolor
  misc_feature: Ceres ANNOT ID no. 6091523
  misc_feature: Encodes the peptide sequence at SEQ ID NO 8670
atggccgcggttgatacagctaccaaggagatggaggcactgcatgtgggacaaaatgaagaaaccaaagcagatctgattaatgaaggcaaaactgcaaacagcaatggtgtggttcctgcagctcagtcttcacaaccagaggatgatgatgaagcacaagctgatgatccatctcaagatggagcacaagaagctgcaaagaagaagaagaagaaaaacaaatccaaaaagaagaagggtcctcttcagcagacagatcctccatcaatacctgtggacgagctttttccttcaggagaatttcctgagggtgaaattcagcaatataaggatgataatttatggagaacaaccagcgaggaaaagagggagctcgaacgactgcaaaagccaatctacaactctgttcgccgagcagcagaagttcatagacaggtgcggaaatacatgaggagcattattaagcctggaatgttaatgattgatctatgtgaaacactggaaaacatggtcaggaaacttatcaaggagaatggactgcaagctggcattgcctttccaactggatgctccttgaattgggtcgcagctcactggactccaaatgctggtgacaagactgtgctacagtatgatgatgtgatgaagctggattttggaacacatatagatgggtacattgttgattgtgcatttactgttgcattcaatcctatgtatgatccattgcttcaagcaacaagagatgccacaaatacagggatcaaggaagctggaatagatgcacggcttggtgatgttggtgctgcaatccaagaagtaatggaatcatatgaggttgaaatcaatgggaaagttttccaagtaaaaagtattcgaaacctcaatggacatagcattgggccgtatcagatacatggtggaaaatcagttccgattgtgaaaggtggagaacaaacaaaaatggaagagggggagttttatgctattgagacttttggatctactggaaggggatttgtccaggaggacttggaatgcagccattacatgaagaacttcgacgttgggcatgtgcctttgagggtagcaaaggctaagcaactacttgggaccatcaacaacaactttggaacactcgcattttgccgccggtacttggaccgccttggcgagacaaaatacctcctggctctgaaaaatctttgtgatagtggtatcattcagccgtatcctccattgtgcgacgtgaaagggagctatgtctcgcagtttgagcacaccatcttactccggccgacctgtaaagaggtcatatcgagaggcgacgactactga

SEQ ID NO: 8670 - protein, 446 aa, Sorghum bicolor
  misc_feature: Ceres ANNOT ID no. 6091523
  misc_feature (135)..(383): Pfam Id: Peptidase_M24 Pfam Desc: metallopeptidase family M24
  misc_feature (28)..(446): NCBI GI: 82795807 NCBI Desc: methionine aminopeptidase 2 [ananas comosus]
  misc_feature (18)..(446): NCBI GI: 11320962 NCBI Desc: methionine aminopeptidase-like protein [arabidopsis thaliana]
  misc_feature (9)..(446): NCBI GI: 27694969 NCBI Desc: metap2-prov protein [xenopus laevis]
  misc_feature (41)..(446): NCBI GI: 1703275 NCBI Desc: methionine aminopeptidase 2 (metap 2) (peptidase m 2) (initiation factor 2 associated 67 kda glycoprotein) (p67) (p67eif2)
  misc_feature (41)..(446): NCBI GI: 60552705 NCBI Desc: metap2 protein [rattus norvegicus]
  misc_feature (24)..(446): SWISSPROT Homolog: EC 3.4.11.18 Methionine aminopeptidase 2B
MAAVDTATKEMEALHVGQNEETKADLINEGKTANSNGVVPAAQSSQPEDDDEAQADDPSQDGAQEAAKKKKKKNKSKKKKGPLQQTDPPSIPVDELFPSGEFPEGEIQQYKDDNLWRTTSEEKRELERLQKPIYNSVRRAAEVHRQVRKYMRSIIKPGMLMIDLCETLENMVRKLIKENGLQAGIAFPTGCSLNWVAAHWTPNAGDKTVLQYDDVMKLDFGTHIDGYIVDCAFTVAFNPMYDPLLQATRDATNTGIKEAGIDARLGDVGAAIQEVMESYEVEINGKVFQVKSIRNLNGHSIGPYQIHGGKSVPIVKGGEQTKMEEGEFYAIETFGSTGRGFVQEDLECSHYMKNFDVGHVPLRVAKAKQLLGTINNNFGTLAFCRRYLDRLGETKYLLALKNLCDSGIIQPYPPLCDVKGSYVSQFEHTILLRPTCKEVISRGDDY

SEQ ID NO: 8671 - DNA, 729 bp, Sorghum bicolor
  misc_feature: Ceres ANNOT ID no. 6091535
  misc_feature: Encodes the peptide sequence at SEQ ID NO 8672
atggctgcagcagcgtcctcctctgcctcgccgctcctcctcccctcagggccgaggcatgcgtcggcctcggcgacggcgtggcttcgcggcgccagcgcgttcaggagcagggcgctgacctcagaggcgccgtgctgctgcaaggccgccggtgtcggtggaagcgcggcgcaatgcggggcggctgacgagttcttgatcggtggtggcagcagtacccggagggggatggtaggagtggccctgggagcctctgccttggggctggcagcgtttgacgcggtcgccgccgggttgccgccggaggagaagcccaagctctgcgacgccgcctgcgaaaccgagctcgaaaatgtgcctatggtaactacagaatccggtctgcaatacaaggatatcaaagtgggcgaagggccaagtccacccattggtttccaggttgctgcaaattatgttgctatggtgccaaatgggcagattttcgacagttcactggagaaaggtcagccctacatattccgtgttggatcaggacaggtgattaaggggcttgatgaagggattttgtcaatgaaggttggaggactacgtcggttgtacatacctggtccattagcgtttcctaagggtcttacttcagcacctggaaggccaagagtacctccgagcagccctgttgttttcgatgtcaatttactgtacataccaggtctcgatgatgagtga

SEQ ID NO: 8672 - protein, 242 aa, Sorghum bicolor
  misc_feature: Ceres ANNOT ID no. 6091535
  misc_feature (137)..(234): Pfam Id: FKBP_C Pfam Desc: FKBP-type peptidyl-prolyl cis-trans isomerase
  misc_feature (7)..(242): NCBI GI: 140049667 NCBI Desc: peptidylprolyl isomerase, fkbp-type [medicago truncatula]
  misc_feature (72)..(240): NCBI GI: 145340529 NCBI Desc: peptidyl-prolyl cis-trans isomerase, fkbp-type [ostreococcus lucimarinus cce9901]
  misc_feature (122)..(236): NCBI GI: 119484326 NCBI Desc: fkbp-type peptidyl-prolyl cis-trans isomerase [lyngbya sp. pcc 8106]
  misc_feature (119)..(234): NCBI GI: 22298646 NCBI Desc: fkbp-type peptidyl-prolyl cis-trans isomerase [thermosynechococcus elongatus bp-1]
  misc_feature (81)..(236): NCBI GI: 16329650 NCBI Desc: fkbp-type peptidyl-prolyl cis-trans isomerase [synechocystis sp. pcc 6803]
MAAAASSSASPLLLPSGPRHASASATAWLRGASAFRSRALTSEAPCCCKAAGVGGSAAQCGAADEFLIGGGSSTRRGMVGVALGASALGLAAFDAVAAGLPPEEKPKLCDAACETELENVPMVTTESGLQYKDIKVGEGPSPPIGFQVAANYVAMVPNGQIFDSSLEKGQPYIFRVGSGQVIKGLDEGILSMKVGGLRRLYIPGPLAFPKGLTSAPGRPRVPPSSPVVFDVNLLYIPGLDDE

SEQ ID NO: 8673 - DNA, 921 bp, Sorghum bicolor
  misc_feature: Ceres ANNOT ID no. 6091539
  misc_feature: Encodes the peptide sequence at SEQ ID NO 8674
atggccacctctacggagccggagggcacgccgcccgcggctaaggggagtaaaggagaggccaacaggaagcggagcagcgaacagggacagggaggccagggaggcgcaggcagcggcggcggcggcggcggcggctggcagaagcggaagaagaaggaggtcttcatctacggaaactacaagaactactacggctaccggattgatcgcaatgttggtgaagatcctcgccttgaggcgttcaagaagcagtggtttgaaaacaaggattgtctcgatattggatgcaaccagggtttggtaacgattggcttagccatgaaatttaactgtcgaagcattcttggagttgatattgattcaggtttgattgagactgctaagtggaacctacgaaggataatgcggcaggataaggtggctacaaaaaacgtgaaagctcaggaattgccagattctccttctcagagctctacaagagaagtggcatctgagttatcgaatgggaacaggcaccaagatctttttaaaattgtctcttttcgacgtgaaaattttgtagagtgtatggatggatgttcagaacagtatgacaccatactctgtttgagtgtgacaaaatggatccacctgaactggggtgacgatggcctagttactttgttcgtgaagatctggaggcttctaagaccgggaggtgtttttatcatggagcctcaaccatggagttcatataagaacaacagattagtttcagaggttgccaaagagaacttcagcaccatctgtatatacccagagacgtttcgggaggttcttctagacaagattggatttaggtcagtagagttgattgcggacagattggtgggtaccgtcagtggtttcaaccgcccaatagaagtttaccacaaatga

SEQ ID NO: 8674 - protein, 306 aa, Sorghum bicolor
  misc_feature: Ceres ANNOT ID no. 6091539
  misc_feature (197)..(306): Pfam Id: Bin3 Pfam Desc: Bicoid-interacting protein 3 (Bin3)
  misc_feature (93)..(238): Pfam Id: Methyltransf_11 Pfam Desc: Methyltransferase domain
  misc_feature (50)..(306): NCBI GI: 144924816 NCBI Desc: sam (and some other nucleotide) binding motif; bicoid-interacting 3 [medicago truncatula]
  misc_feature (189)..(306): NCBI GI: 61197024 NCBI Desc: bipl1 [mus musculus]
  misc_feature (196)..(306): NCBI GI: 126632792 NCBI Desc: novel protein similar to human and mouse bin3, bicoid-interacting 3, homolog (drosophila) (bcdin3) [danio rerio]
  misc_feature (178)..(306): NCBI GI: 55246451 NCBI Desc: ensangp00000029475 [anopheles gambiae str. pest]
  misc_feature (180)..(306): NCBI GI: 116117003 NCBI Desc: ensangp00000016906 [anopheles gambiae str. pest]
MATSTEPEGTPPAAKGSKGEANRKRSSEQGQGGQGGAGSGGGGGGGWQKRKKKEVFIYGNYKNYYGYRIDRNVGEDPRLEAFKKQWFENKDCLDIGCNQGLVTIGLAMKFNCRSILGVDIDSGLIETAKWNLRRIMRQDKVATKNVKAQELPDSPSQSSTREVASELSNGNRHQDLFKIVSFRRENFVECMDGCSEQYDTILCLSVTKWIHLNWGDDGLVTLFVKIWRLLRPGGVFIMEPQPWSSYKNNRLVSEVAKENFSTICIYPETFREVLLDKIGFRSVELIADRLVGTVSGFNRPIEVYHK

SEQ ID NO: 8675 - DNA, 1992 bp, Sorghum bicolor
  misc_feature: Ceres ANNOT ID no. 6091540
  misc_feature: Encodes the peptide sequence at SEQ ID NO 8676
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atggcgactgcccctttgccctctcgctccctcctggccccggctcatcaatcccatccacggcttcccgccaccctccgcctctgcctctcccaccacaagcaacctcccaccggccccaagcgcccccgacgcgccgccacttcgcatccggccttctctgcacccgcgcggggtcgtgccaagaagattcccgtcgcggacaccgatgagcccgccgccggagtccgcgtcaccgaccgtggcctctcttaccgcctcgacggcgcgccattcgagttccagtatagctacaccgaggccccacgcgcacgccccgtagcgctccgtgaggccccgttcttgccgttcgggcccgaggccacgccacgcccttggacggggaggaagccgctgccaaagagccgcaaggagcttccggagtttgactcgttcgtgctgccaccaccgggcaagaaaggggtgaagcccgtgcagtcaccggggccgttcctcgccggtatggagccgaggtaccagtcggtgtccagagaggacatactcggggagcccctcaccaaggaagaggtgttcgaactcgtgaaaggaagcctcaagactaaacgccaactcaatatgggtagggatggtttgacacataatatgttggagaacattcattcacattggaagaggaaaagagtttgcaagataaagtgcaaaggtgtctgcacggtggatatggataatatctgccagcaactagaggaaaaagttggaggaaaagtaatacaccgccaagggggtgtcatatttctttttcgtggtagaaactacaattacaggacccgcccatgttttccgcttatgctctggaaacccgttgcacctgtgtacccgcgccttgttacgaaggtcccaggtggcttaactccagatgaggccacagaaatgcgcgcaagaggacgtcagttaccaccaatttgcaaacttgggaaaaatggtgtttatgcaaaccttgtgaagcaagtcagagaagcatttgaagcatgtgatcttgtccgtgttgattgctcaggtcttaacaaaagtgattgcagaaaaattggagctaaactaaagtttgagcatatactgatgtggagaggaagtgattggaaatcatctcttcctccattagaagaaaatagttttgaggtggcaaaggtgcaagaaagtttaagtggcaaagaatctaatgaaaaggttacacattcaggaaatgttctgacccagattgagttggtcagtgttgcaacatctcacaagaactgcaacttgggtgaaggtcaagaaaaatttaaagattccattgccagtgatacggtactgaattctgcaaaggaagttcctgcattgttccattctacaggtatatctagaactgaaccctcagcagacactccattggaatattcaccattaaagccagtatgtgatattatggatccatccctgaagtgccaaagtatcccaacaagcaacagtgaaaatagaggtctggtagagaagtcagaacattgtccggatgattataatttggagacaaagaggaaaagaaacgatggtataaaaggtagtggttctaaagttccatcctatatagagggattgttatgtcttctggagcaggccattgacagtggcagggcacttgttctgagtgaagatgagcttgttgattcagatctggtctatgaaaagtctgttgcatttacaaagtcaattccgcgaagactgattttcgagcatactcagaggaagtccagtgccaggagaaatgggccagacaatcatgcaagaattaaaaaacatcttgtagaaaataaactgtccagcagtcatgttgaaaagaaatgtgtcgctaatgtaggatcggcaatgcagacaaatgaccatgcacaagagtttctatctgatgttgttcctcaaggtaccttaagagtagatgaactagcaaagttactggcttaa

SEQ ID NO: 8676 - protein, 663 aa, Sorghum bicolor
  misc_feature: Ceres ANNOT ID no. 6091540
  misc_feature (185)..(268): Pfam Id: CRS1_YhbY Pfam Desc: CRS1 / YhbY domain
  misc_feature (303)..(375): Pfam Id: CRS1_YhbY Pfam Desc: CRS1 / YhbY domain
  misc_feature (1)..(663): NCBI GI: 30349367 NCBI Desc: crs2-associated factor 1 [zea mays]
  misc_feature (45)..(381): NCBI GI: 30349369 NCBI Desc: crs2-associated factor 2 [zea mays]
  misc_feature (174)..(376): NCBI GI: 143955290 NCBI Desc: crs2-associated factor 2, mitochondrial precursor
  misc_feature (174)..(376): NCBI GI: 115475115 NCBI Desc: os08g0188000 [oryza sativa (japonica cultivar-group)]
  misc_feature (185)..(274): NCBI GI: 116310121 NCBI Desc: osigba0130p02.2 [oryza sativa (indica cultivar-group)]
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MATAPLPSRSLLAPAHQSHPRLPATLRLCLSHHKQPPTGPKRPRRAATSHPAFSAPARGRAKKIPVADTDEPAAGVRVTDRGLSYRLDGAPFEFQYSYTEAPRARPVALREAPFLPFGPEATPRPWTGRKPLPKSRKELPEFDSFVLPPPGKKGVKPVQSPGPFLAGMEPRYQSVSREDILGEPLTKEEVFELVKGSLKTKRQLNMGRDGLTHNMLENIHSHWKRKRVCKIKCKGVCTVDMDNICQQLEEKVGGKVIHRQGGVIFLFRGRNYNYRTRPCFPLMLWKPVAPVYPRLVTKVPGGLTPDEATEMRARGRQLPPICKLGKNGVYANLVKQVREAFEACDLVRVDCSGLNKSDCRKIGAKLKFEHILMWRGSDWKSSLPPLEENSFEVAKVQESLSGKESNEKVTHSGNVLTQIELVSVATSHKNCNLGEGQEKFKDSIASDTVLNSAKEVPALFHSTGISRTEPSADTPLEYSPLKPVCDIMDPSLKCQSIPTSNSENRGLVEKSEHCPDDYNLETKRKRNDGIKGSGSKVPSYIEGLLCLLEQAIDSGRALVLSEDELVDSDLVYEKSVAFTKSIPRRLIFEHTQRKSSARRNGPDNHARIKKHLVENKLSSSHVEKKCVANVGSAMQTNDHAQEFLSDVVPQGTLRVDELAKLLA

SEQ ID NO: 8677 - DNA, 1770 bp, Sorghum bicolor
  misc_feature: Ceres ANNOT ID no. 6091542
  misc_feature: Encodes the peptide sequence at SEQ ID NO 8678
  misc_feature: Up-regulated in shoot tissues in response to salicylic acid treatment
atggactcggacgtggagatgaacgccgccagcgacgaggaggtgatggacgacgaggactactacgactactgcgacagcgacatgggcgatgacggcgacggcgggagcgaggaggaagaggagctggtggccggggactacgacgagggcatcgaggccgaggggaccgacgaggtggtgtctaggcgtgagcagacatttgtggttttaaacgaagaagttatatctgagcgtcaagcggaagatgtaagcaaggtatctgccgtgttgttgatcacaagggaagaggcgtgtgccctcctgcatcactataaatggaacatcagcaagttgagtgacgaatggtttgcagatgaagaaaaagtccgccatactgttggcttacttttgaatggaaatcatgatccctgctctaggaagctaacttgtggaatatgttttgaagggtattcttctgatatgatgagctccgctggttgtgctcatttttattgccatgaatgctgggaaggtggtggtccaggatgtttgtcattgagatgccctgatccatcatgtagtgctatggttcttcaagggatgattaataaattagctaaagatgaggataaagaaaaatatgcacgatttctcttacgtgcatatgttgaaggtagcaagaagactaaatggtgtccagctcctgactgtacatgtgctgtggagtttcttggtgatgaaaactatgatgtctcatgcaattgcaagttcagcttttgctggaattgcactgaggaagctcatcgaccagtgaactgcgagactgtttctaagtggatattaaagaacagtgcagaatctgaaaacatgaactggatactggctaattctaagccctgtccgaagtgcaaacggccaatagagaaaaaccagggatgcatgcatatgacatgcacccctccttgcaaattcgaattttgctggttatgtctgggcgcatggtcagatcatggagagagaacaggtggcttttatgcttgcaatcgttatgaatcagcaaagaaagagggagtttatgatgagactgaagcaaggagggaaagagctaagaactctcttgagagatatatgcattactatgaacgctgggcatccaatcagacatcgaggcagaaggcccaagcagatctgctaaaagcggaaaaggatcagcttgcaaatttaactgacatttttgggataccagagacccagcttaagttcataattgaagcttggtcacagattatagaatgcaggcgagtgctgaaatggacatatgcttatggctactatctggatgataaggtcaagagtgaattttttgagtatctgcaaggtgaggctgagtctggcttggaacgtcttcatcagtgcgctgagaaagacttgcaaaaatttttgccttctgtgaaatctgacagcactgaaacgacggcaccaacaccggatgaatttagtgaattccgcgtaaagcttgctgggctcacaagcgttactcgtaattactttgagaaccttgttcaagctttggaagctgggttggaggatgtccgtgccactgcccaggctgctggtacatccagcgctgccaccagctccaagaaaggaggaactaaatccaagaagaagcagcccactaagccatcatctgaccacactgatgatgggtggccctgcgagcgctgcacatttcttaaccctccctcagtggatgcgtgcagcgtctgcgaaaagagtaggtactag

SEQ ID NO: 8678 - protein, 589 aa, Sorghum bicolor
  misc_feature: Ceres ANNOT ID no. 6091542
  misc_feature (206)..(267): Pfam Id: IBR Pfam Desc: IBR domain
  misc_feature (62)..(588): NCBI GI: 115480121 NCBI Desc: os09g0513800 [oryza sativa (japonica cultivar-group)]
  misc_feature (84)..(588): NCBI GI: 50725349 NCBI Desc: ariadne-like protein [oryza sativa (japonica cultivar-group)]
  misc_feature (1)..(588): NCBI GI: 92880995 NCBI Desc: zinc finger, ring-type; zinc finger, ranbp2-type; zinc finger, c6hc-type [medicago truncatula]
  misc_feature (1)..(584): NCBI GI: 38347453 NCBI Desc: osjnba0076n16.22 [oryza sativa (japonica cultivar-group)]
  misc_feature (1)..(584): NCBI GI: 116310337 NCBI Desc: osigba0130b08.12 [oryza sativa (indica cultivar-group)]
  misc_feature: The sequence is a functional homolog of SEQ ID NO 1727 in the 10/374,780US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO 546 in the 11/435,388 US patent application
  misc_feature: Up-regulated in shoot tissues in response to salicylic acid treatment
  misc_feature: The sequence is a functional homolog of SEQ ID NO. 493 in the 11/188,298 US application
MDSDVEMNAASDEEVMDDEDYYDYCDSDMGDDGDGGSEEEEELVAGDYDEGIEAEGTDEVVSRREQTFVVLNEEVISERQAEDVSKVSAVLLITREEACALLHHYKWNISKLSDEWFADEEKVRHTVGLLLNGNHDPCSRKLTCGICFEGYSSDMMSSAGCAHFYCHECWEGGGPGCLSLRCPDPSCSAMVLQGMINKLAKDEDKEKYARFLLRAYVEGSKKTKWCPAPDCTCAVEFLGDENYDVSCNCKFSFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETEARRERAKNSLERYMHYYERWASNQTSRQKAQADLLKAEKDQLANLTDIFGIPETQLKFIIEAWSQIIECRRVLKWTYAYGYYLDDKVKSEFFEYLQGEAESGLERLHQCAEKDLQKFLPSVKSDSTETTAPTPDEFSEFRVKLAGLTSVTRNYFENLVQALEAGLEDVRATAQAAGTSSAATSSKKGGTKSKKKQPTKPSSDHTDDGWPCERCTFLNPPSVDACSVCEKSRY

SEQ ID NO: 8679 - DNA, 1137 bp, Sorghum bicolor
  misc_feature: Ceres ANNOT ID no. 6091543
  misc_feature: Encodes the peptide sequence at SEQ ID NO 8680
atgctgctagcgcgcaacctgcgctccggcctccgcccgccgctcgccgcggcgttctcgtcggccccggcggcgtcggcgtcggcggccgcggcggaggcggagagggcgatacgggacgggccgcggaacgactggagccggcccgagatccaggccgtctacgactccccgctcctcgacctcctcttccacggggctcaggtccacagaaatacccataaattcagagaagtgcagcagtgcacacttctttcaatcaagactggtgggtgcagtgaagattgttcttactgccctcagtcatcaagatacgacactggattgaaggcccaaaaattgatgaacaaagatgctgtcttagaagcagcaaaaaaggcaaaagaggctgggagcacccgtttttgcatgggagctgcatggagagaaaccattggcaggaaaacaaacttcaaccagattcttgaatatgtcaaggaaataaggggtatgggcatggaggtctgttgcacactgggcatgatagagaaacaacaagctgaagaactcaagaaggctggacttacagcatataatcataacctagatacatcaagagagtattatcccaacattattaccacaagatcatatgatgatagactgcagactcttcagcatgtccgtgaagctggaataagcatctgctcaggtggaatcattggtcttggtgaagcagaggaggaccgggtggggttgttgcatacactagccaccttgcctacacacccagagagtgtccctattaatgcattggttgctgtaaaaggcacacctcttgagaaccagaagcctttagagatctgggaaatgatccgcatgatcgccactgctcggatcgtgatgccaaaggcaatggtgaggctttcagcaggtcgagtacggttctccatgccagaacaagcgctctgcttccttgccggggccaactccatctttgctggcgagaaacttctcacaaccgcaaacaacgacttcgacgcggaccaggcgatgttcaagatccttggtctgatccccaaggctccaagctttggcgaggaagaggtggcggctcatgctgacaccgagaggtctgagcaagctgcttcgatgtag

SEQ ID NO: 8680 - protein, 378 aa, Sorghum bicolor
  misc_feature: Ceres ANNOT ID no. 6091543
  misc_feature (261)..(353): Pfam Id: BATS Pfam Desc: Biotin and Thiamin Synthesis associated domain
  misc_feature (86)..(250): Pfam Id: Radical_SAM Pfam Desc: Radical SAM superfamily
  misc_feature (1)..(377): NCBI GI: 2288983 NCBI Desc: biotin synthase (bio b) [arabidopsis thaliana]
  misc_feature (21)..(377): NCBI GI: 114324485 NCBI Desc: biotin synthase [brassica rapa subsp. pekinensis]
  misc_feature (25)..(377): NCBI GI: 140057613 NCBI Desc: elongator protein 3/miab/nifb [medicago truncatula]
  misc_feature (1)..(376): NCBI GI: 82393851 NCBI Desc: biotin synthase [glycine max]
  misc_feature (43)..(354): NCBI GI: 110638853 NCBI Desc: biotin synthase [cytophaga hutchinsonii atcc 33406]
  misc_feature (1)..(377): SWISSPROT Homolog: EC 2.8.1.6 Biotin synthase
MLLARNLRSGLRPPLAAAFSSAPAASASAAAAEAERAIRDGPRNDWSRPEIQAVYDSPLLDLLFHGAQVHRNTHKFREVQQCTLLSIKTGGCSEDCSYCPQSSRYDTGLKAQKLMNKDAVLEAAKKAKEAGSTRFCMGAAWRETIGRKTNFNQILEYVKEIRGMGMEVCCTLGMIEKQQAEELKKAGLTAYNHNLDTSREYYPNIITTRSYDDRLQTLQHVREAGISICSGGIIGLGEAEEDRVGLLHTLATLPTHPESVPINALVAVKGTPLENQKPLEIWEMIRMIATARIVMPKAMVRLSAGRVRFSMPEQALCFLAGANSIFAGEKLLTTANNDFDADQAMFKILGLIPKAPSFGEEEVAAHADTERSEQAASM

SEQ ID NO: 8681 - DNA, 777 bp, Sorghum bicolor
  misc_feature: Ceres ANNOT ID no. 6091559
  misc_feature: Encodes the peptide sequence at SEQ ID NO 8682
atgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaatgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggcatcttgtctggctagccgaatagcagcgtccatcatccgaagacaaaccccacataaagcatag

SEQ ID NO: 8682 - protein, 258 aa, Sorghum bicolor
  misc_feature: Ceres ANNOT ID no. 6091559
  misc_feature (3)..(240): Pfam Id: 14-3-3 Pfam Desc: 14-3-3 protein
  misc_feature (1)..(237): NCBI GI: 37903393 NCBI Desc: 14-3-3-like protein [saccharum hybrid cultivar cp65-357]
  misc_feature (1)..(237): NCBI GI: 46946654 NCBI Desc: 14-3-3-like protein [zea mays]
  misc_feature (1)..(237): NCBI GI: 75294319 NCBI Desc: 14-3-3-like protein gf14-c (g-box factor 14-3-3 homolog c)
  misc_feature (2)..(236): NCBI GI: 2921512 NCBI Desc: gf14 protein [fritillaria agrestis]
  misc_feature (2)..(236): NCBI GI: 6179981 NCBI Desc: 14-3-3-like protein [lilium longiflorum]
  misc_feature: The sequence is a functional homolog of SEQ ID NO 155 in the 11/479,226US patent application
  misc_feature: The sequence is a functional homolog of SEQ ID NO 1777 in the 11/479,226US patent application
  misc_feature: The sequence is a functional homolog of SEQ ID NO 2216 in the 10/374,780US patent application
  misc_feature: The sequence is a functional homolog of SEQ ID NO 2350 in the 10/374,780US patent application
  misc_feature: The sequence is a functional homolog of SEQ ID NO 34 in the 10/412,699US patent application
  misc_feature: The sequence is a functional homolog of SEQ ID NO 342 in the 10/412,699US patent application
  misc_feature: The sequence is a functional homolog of SEQ ID NO 344 in the 10/412,699US patent application
  misc_feature: The sequence is a functional homolog of SEQ ID NO 404 in the 10/374,780US patent application
  misc_feature: The sequence is a functional homolog of SEQ ID NO 52 in the 10/903,236US patent application
  misc_feature: The sequence is a functional homolog of SEQ ID NO 68 in the 11/375,241US patent application
  misc_feature: The sequence is a functional homolog of SEQ ID NO 780 in the 10/225,066US patent application
  misc_feature: The sequence is a functional homolog of SEQ ID NO 782 in the 11/479,226US patent application
  misc_feature: The sequence is a functional homolog of SEQ ID NO 786 in the 11/479,226US patent application
  misc_feature: The sequence is a functional homolog of SEQ ID NO 789 in the 11/479,226US patent application
  misc_feature: The sequence is a functional homolog of SEQ ID NO 790 in the 10/225,066US patent application
  misc_feature: The sequence is a functional homolog of SEQ ID NO 793 in the 11/479,226US patent application
  misc_feature: The sequence is a functional homolog of SEQ ID NO 797 in the 11/479,226US patent application
  misc_feature: The sequence is a functional homolog of SEQ ID NO 801 in the 11/479,226US patent application
  misc_feature: The sequence is a functional homolog of SEQ ID NO 805 in the 11/479,226US patent application
  misc_feature: The sequence is a functional homolog of SEQ ID NO 809 in the 11/479,226US patent application
  misc_feature: The sequence is a functional homolog of SEQ ID NO 864 in the 10/225,066US patent application
  misc_feature: Useful for making plants with modulated drought sensitivity
  misc_feature: Useful for making plants with modulated growth and phenotype characteristics
  misc_feature: GREAT-hit functional homolog of the protein sequence given in SEQ ID NO 13373
  misc_feature: The sequence is a functional homolog of SEQ ID NO 34 in the 20040045049 US patent application
  misc_feature: The sequence is a functional homolog of SEQ ID NO 34 in the 20040045049 US patent application
  misc_feature: The sequence is a functional homolog of SEQ ID NO 342 in the 20040045049 US patent application
  misc_feature: The sequence is a functional homolog of SEQ ID NO 344 in the 20040045049 US patent application
  misc_feature: The sequence is a functional homolog of SEQ ID NO 864 in the 20050160493 US patent application
  misc_feature: The sequence is a functional homolog of SEQ ID NO 1777 in the 20070022495 US patent application
  misc_feature: The sequence is a functional homolog of SEQ ID NO 786 in the 20070022495 US patent application
  misc_feature: The sequence is a functional homolog of SEQ ID NO 789 in the 20070022495 US patent application
  misc_feature: The sequence is a functional homolog of SEQ ID NO 793 in the 20070022495 US patent application
  misc_feature: The sequence is a functional homolog of SEQ ID NO 797 in the 20070022495 US patent application
  misc_feature: The sequence is a functional homolog of SEQ ID NO 801 in the 20070022495 US patent application
  misc_feature: The sequence is a functional homolog of SEQ ID NO 809 in the 20070022495 US patent application
  misc_feature: The sequence is a functional homolog of SEQ ID NO 789 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 801 in the 11/479,226 US patent application
  misc_feature: Useful for making plants with modulated drought sensitivity
  misc_feature: Functional homolog of the protein sequence given in SEQ ID NO 13373
  misc_feature: Useful for making plants with modulated water use efficiency
  misc_feature: Functional homolog of the protein sequence given in SEQ ID NO 13942
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 809 in the 11/479,226 US patent application
  misc_feature: The sequence is a functional homolog of SEQ ID NO. 275 in the 11/188,298 US application
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITASCLASRIAASIIRRQTPHKA

SEQ ID NO: 8683 - DNA, 618 bp, Sorghum bicolor
  misc_feature: Ceres ANNOT ID no. 6091575
  misc_feature: Encodes the peptide sequence at SEQ ID NO 8684
atggatcggaagaatcaaactcctcaaggtcaaatagcacgggtggttgtggaatttcttgaggtagcagtcagctgcatcatcttcctcaaaggcttctatcctcctcgtgcctttgagaggagaaggtatatgaatgtagtggtccagaaagcacggcatcctgaacttgctagctatattcactctgtgactgtcggccttcttcctttcattcagaagggattggtagagagggttgtggtcatcttctatgacaaagagcatgtaccaattgagaagtttgtcttcaagcttgcagtcaaccaatcatattgttccaagttagaggaggcaaacctggagtttgctctgcgagcattcttgatcaagctgactgttgctgagcctgttaccaaaccccttccatcagatggtaactgggagatcactgcctacttccggtccctccctggcgatgacgaccgagaagctcagctgtggattcctacagacaccaagctgtggatgcagcctccgcaaattacccctatcaagtcagttagctgtgaccctctgaagatgcagctttacttggagcaccctagcatcacagaaccgaaggatccggcagcataa

SEQ ID NO: 8684 - protein, 205 aa, Sorghum bicolor
  misc_feature: Ceres ANNOT ID no. 6091575
  misc_feature (8)..(189): Pfam Id: HORMA Pfam Desc: HORMA domain
  misc_feature (3)..(199): NCBI GI: 92887259 NCBI Desc: dna-binding horma [medicago truncatula]
  misc_feature (10)..(193): NCBI GI: 54261574 NCBI Desc: mad2l2-a protein [xenopus laevis]
  misc_feature (10)..(99): NCBI GI: 56203295 NCBI Desc: mad2 mitotic arrest deficient-like 2 (yeast) [homo sapiens]
  misc_feature (10)..(193): NCBI GI: 89272847 NCBI Desc: mad2 mitotic arrest deficient-like 2 (yeast) [xenopus tropicalis]
  misc_feature (10)..(193): NCBI GI: 6006020 NCBI Desc: mad2 homolog [homo sapiens]
MDRKNQTPQGQIARVVVEFLEVAVSCIIFLKGFYPPRAFERRRYMNVVVQKARHPELASYIHSVTVGLLPFIQKGLVERVVVIFYDKEHVPIEKFVFKLAVNQSYCSKLEEANLEFALRAFLIKLTVAEPVTKPLPSDGNWEITAYFRSLPGDDDREAQLWIPTDTKLWMQPPQITPIKSVSCDPLKMQLYLEHPSITEPKDPAA

SEQ ID NO: 8685 - DNA, 3036 bp, Sorghum bicolor
  misc_feature: Ceres ANNOT ID no. 6091576
  misc_feature: Encodes the peptide sequence at SEQ ID NO 8686
atggagggagtcgccaagccgtccacgacgagctcggggtcgggggtcacggatgggccctcctccgccgcggcctccaccgaggagaggttcgccgatctgtgcaagagcaagctgggactggacgagagcacgacgaggcaggcaatgcagcttttcaaggagaccaagaacatcctcaagtccagcgtgtcttccttgggcggcggatcgcccgaggagatcgagaggttctggtctgcctgtgttctttactgtgtgtcaaggctcagcaaagcggggaggtcgaaggaagatggcagtgtctcactttgccagatcttgagggcgtctaagctgaatatcgtggattttttcaaggagatgccacagttctgcttaaaggttgcacacgttttgactggcctatatggttcagattgggaaaagaggcttgagttgaaggaactgcaagcaaatgttgtccatttaagcttgctaagcaggcattacaagcgtgcataccaggagctattcttgtcaaatgatggcaagtgttcaggcaattcttcagaattaatcaaccaagaggcttctgattattatcgctttggatggttgctctttttagccctaagaatccaaacattcagcagattcaaggatcttgtgacatccacgaatgaactggtttctgtgttggctgtacttatcattcatgttcctgtgcggctaaggaactttgatataaaggattcatcctactttgctaagaagtcagataggggagtcagtcttattgcttctctgtgtgaaaaatatcatacctcagaagatgagttgagcaaagcactggagaagacaaatactctcataatggatgttctgaaaaagaagccatgcccagctacttcagcatgccaacaggataatttgtctttcattgatccagaaggcttgacagtttttaaggattttcttcagggagactcattaaaatcaagtctgctaatcctggaaaaagaatatgaaaatgcaattaacacaaaaggcgagctagatgagcgcatgtttgctaatgatgaggacagtttacttggcagtggaagcctttcaggtggagccattaatttaccaggcacaaagagaaagtatgatgttatggcctcacctgcaaaatcaatatcaagcccaaatccaatgtctcctccacgtttttgtctatctcctaaaggaagcaacttttgcaactcaaagatggctcctatcactccagtgagcacagccatgacaactgccaagtggcttcggagtactgtatctccccttccatcaaaaccttctggggaactattgcgcttcttctcagcatgtgataaggatctaactgatgacattgcacacagagctgggattatacttggagccatattcacgagcagttcttttggtgaacggatctgcactaatatgcgaagcgcaaataggatggatgctatctggacagagcaaagaaaaatggaagcccttaagctatattatagggttttggaatctatgtgtagggcggagtcacagatcttgagtgggaacaatcttacatcacttttgtctaatgagcgtttccatcggtgtatgattgcatgttctgcagagttagttcttgcaactcacaagactgtcactatgatgttcccagctgtgttggagaagacgggcattacagcctttgacttgagtaaagtcatagagggttttgttcggcatgaagatacactcccaagagagttgaagcgccatctgaattctcttgaggaacggctgctggaaagcatggcatgggagaaagggtcatcaatgtacaattccttaattgttgctaggccggcactgtctgtagaaataaaccggttaggtttactggctgaaccaatgccatcacttgatgcaattgcagcacatcataatatctcattgggtggcctgccacctcttcccttccagaaacaggaccgtttgcaagataaagatgaagtcaggtctcccaaaagggcatgcactgagaggagaaatgtgctggtggacagcaattcatttcgatcaccagtgaaggacattattaaatcaaagttaccacctcctcttcaatcagcttttgcaagtccaacaagaccgaatcctgcagcgggaggtgaaacatgcgcagagacaggaataggtgtgttctttagcaagatagcaaaactcgcagccattagaatcagaagtctctgtgaaagactgcaactttctcagcaagttctggagcgagtatattcccttgtccagcaaatccttagccaacagactggtcttttcttcaacaggcacattgatcagatcatactatgcagcatatatggagttgccaagatctctcaactggaactttcattcaaggagattattttcggctacaggaaacaacctcaatgcaagccacaagttttccgaagtgtttatgttcattggcccccaagaagccgtaatgggaaaacaggagaagatcatgtggatattatcactttctacaatgaagtatttattcctgctgtcaagcctttgttagtggaggtaggacctggtgctagtccaaagaagaaagaagaggaaaaaggttctgctgatggtccatacccagaatctcctcggctagctcggtttccaaaccttcctgacatgtctccaaagaaggtttctgctactcataatgtgtatgtctcaccacttcgatcgtcaaagatggatactttgctctccccaagctcaaagagctactacgcatgtgtcggcgagagtacctatgcgtttcaaagcccctccaaggacctgaaggctatcaataaccgcctaaatagtgtgtccagtgggaagaaagttaacggacgactgaactttgatgttgtcagtgatctggttgtcgccagtagcctcagcagcgatcaaaatgccaagccggcagccacggaagtggttcccatcaagacaccggtgaaatgcgagccatctgactcgtga

SEQ ID NO: 8686 - protein, 1011 aa, Sorghum bicolor
  misc_feature: Ceres ANNOT ID no. 6091576
  misc_feature (417)..(617): Pfam Id: RB_A Pfam Desc: Retinoblastoma-associated protein A domain
  misc_feature (730)..(860): Pfam Id: RB_B Pfam Desc: Retinoblastoma-associated protein B domain
  misc_feature (1)..(1011): NCBI GI: 74099767 NCBI Desc: retinoblastoma-related 3 [zea mays]
  misc_feature (20)..(1011): NCBI GI: 23429044 NCBI Desc: retinoblastoma-like protein [cocos nucifera]
  misc_feature (4)..(1011): NCBI GI: 7381060 NCBI Desc: retinoblastoma-related protein 1 [populus tremula x populus tremuloides]
  misc_feature (26)..(1002): NCBI GI: 51538007 NCBI Desc: retinoblastoma protein [nicotiana benthamiana]
  misc_feature (6)..(1002): NCBI GI: 89111303 NCBI Desc: retinoblastoma related protein [camellia sinensis]
MEGVAKPSTTSSGSGVTDGPSSAAASTEERFADLCKSKLGLDESTTRQAMQLFKETKNILKSSVSSLGGGSPEEIERFWSACVLYCVSRLSKAGRSKEDGSVSLCQILRASKLNIVDFFKEMPQFCLKVAHVLTGLYGSDWEKRLELKELQANVVHLSLLSRHYKRAYQELFLSNDGKCSGNSSELINQEASDYYRFGWLLFLALRIQTFSRFKDLVTSTNELVSVLAVLIIHVPVRLRNFDIKDSSYFAKKSDRGVSLIASLCEKYHTSEDELSKALEKTNTLIMDVLKKKPCPATSACQQDNLSFIDPEGLTVFKDFLQGDSLKSSLLILEKEYENAINTKGELDERMFANDEDSLLGSGSLSGGAINLPGTKRKYDVMASPAKSISSPNPMSPPRFCLSPKGSNFCNSKMAPITPVSTAMTTAKWLRSTVSPLPSKPSGELLRFFSACDKDLTDDIAHRAGIILGAIFTSSSFGERICTNMRSANRMDAIWTEQRKMEALKLYYRVLESMCRAESQILSGNNLTSLLSNERFHRCMIACSAELVLATHKTVTMMFPAVLEKTGITAFDLSKVIEGFVRHEDTLPRELKRHLNSLEERLLESMAWEKGSSMYNSLIVARPALSVEINRLGLLAEPMPSLDAIAAHHNISLGGLPPLPFQKQDRLQDKDEVRSPKRACTERRNVLVDSNSFRSPVKDIIKSKLPPPLQSAFASPTRPNPAAGGETCAETGIGVFFSKIAKLAAIRIRSLCERLQLSQQVLERVYSLVQQILSQQTGLFFNRHIDQIILCSIYGVAKISQLELSFKEIIFGYRKQPQCKPQVFRSVYVHWPPRSRNGKTGEDHVDIITFYNEVFIPAVKPLLVEVGPGASPKKKEEEKGSADGPYPESPRLARFPNLPDMSPKKVSATHNVYVSPLRSSKMDTLLSPSSKSYYACVGESTYAFQSPSKDLKAINNRLNSVSSGKKVNGRLNFDVVSDLVVASSLSSDQNAKPAATEVVPIKTPVKCEPSDS

SEQ ID NO: 8687 - DNA, 2217 bp, Sorghum bicolor
  misc_feature: Ceres ANNOT ID no. 6091591
  misc_feature: Encodes the peptide sequence at SEQ ID NO 8688
atggtctttatgcgattccgcccccagctcatcttctcctcactcctccgctccacccctaaacccagaacccagcccgccgcaaccctagccgccacagcgcgccgccggcaccacaccaccgtcgccgtcacctccatggccgcgccgtcggaggacgcgctgcggcgcgcgctcgcggagcgccaggccgccgcggacgcgcaggccgaggccgtgcgcgcgctcaaggccggcggcggcgcgtccaaggccgacgtggacgccgcggtcgaggcgctcaaggcgctcaaggtcgaggccggagccgccgcgcgccggctgcagcaggcgctcggggccggcgcgggtggcgccgcgagggaggagctgcggcaggcggtggtgaacacgctcgagcggaagctgttctacataccctccttcaagatctaccgcggtgtcgcggggctctatgattatggcccgcccgggtgccgcgtcaaggccaacgtgctttccttctggcgccagcacttcgttttggaagagaacatgttggaggttgactgcccctgtgtgacgcctgaggttgtcttgaaggcatcaggccatgttgagaagtttactgacctcatggttaaagatgagaagacaggcacatgctaccgtgctgaccacttgttgaaagatttttgcaaggagaaacttgagaaagaccttgccttgccccaagagaaggctgatgaattgaagcgtattcttgccattttggatgacctctcggcagaggaacttggtgcaaagattaaggaatacggcattgttgcccctgatacaaagaatccgctttctgatccctacccattcaatcttatgttccagacatctattggtcccactggtcttagcgtggggtatatgcgaccagagactgcacagggtatttttgtaaacttcaaggacctgtactattacaatggccaaaagctcccctttgcagctgctcaaatcggccaagcttttagaaatgagatctcaccacgacaaggtcttctccgagtgcgtgaatttacattggcagagattgagcattttgtggacccagaggacaaatcacatccaaaatttgttgatgttgctgatctggagttcctgatgtttccaagagagttgcaactctcaggggagtcagccaagctaatgaagcttggggaagcagtttcaaagggaactgttaacaatgagacacttggttacttcatcggaagagtctatcttttcctgacatgtttgggaatcgataagggtaggttgcgcttcaggcagcatctacctaatgagatggctcattatgctgctgactgttgggatgctgagatagagtgctcttatgggtggatagagtgtgtgggtattgctgatagatctgcatatgatttgaaagctcacactgagaaaagtggtgtcccacttgttgctcatgaaaaattctccaaacctagagaggttgagaaacttgtcatagttccctcgaaaaaagacctggggctggcttttaagggcaaccaaaagatggtccttgaagcattggaggctatgagtgagaaggaagcatttgagatgaaagctgaactagaaaccaagggggagacaaattttagagtctgcacacttggaaaagatgtggtgattacaaagaagatggtatcaatcagcatggagaagaagctggaacatcagcgagtcttcaccccttcggtcatcgagccgtcatttggcataggccggatcatctactgcttgtttgagcattcattttacacaaggcctagcaaatcagaagaggaacaactgaatgtcttccggttccctcctcttgtggctcctatcaagtgcaccgtgttccccctcgttaaaaatcaagagtttgatgctgctgccaaagtaatcgctaaggcattaacaactgccggtatctcccacattattgacactactgcaatttctattgggaggagatatgcgaggacagacgagattggtgttccatttgctgtaacagtggattcagcaacaaacgtgacgatccgagagagggacagcaaggagcagatccgtgtggacatcaacgaggtggcatccgtggtgaagcagctgacagaaggccaaagcacctgggcagatgtttctgcaaagtatcctgcccatgttggtccccaaggtgaccaggagtga

SEQ ID NO: 8688 - protein, 738 aa, Sorghum bicolor
  misc_feature: Ceres ANNOT ID no. 6091591
  misc_feature (161)..(458): Pfam Id: tRNA-synt_2b Pfam Desc: tRNA synthetase class II core domain (G, H, P, S and T)
  misc_feature (625)..(713): Pfam Id: HGTP_anticodon Pfam Desc: Anticodon binding domain
  misc_feature (51)..(737): NCBI GI: 2564215 NCBI Desc: glycyl-trna synthetase [arabidopsis thaliana]
  misc_feature (82)..(738): NCBI GI: 116309463 NCBI Desc: h0209h04.1 [oryza sativa (indica cultivar-group)]
  misc_feature (70)..(738): NCBI GI: 38347165 NCBI Desc: osjnba0039c07.11 [oryza sativa (japonica cultivar-group)]
  misc_feature (51)..(566): NCBI GI: 110740563 NCBI Desc: glycyl-trna synthetase [arabidopsis thaliana]
  misc_feature (11)..(738): NCBI GI: 18256043 NCBI Desc: glycyl-trna synthetase [mus musculus]
  misc_feature (51)..(737): SWISSPROT Homolog: EC 6.1.1.14 Glycyl-tRNA synthetase 1, mitochondrial precursor
MVFMRFRPQLIFSSLLRSTPKPRTQPAATLAATARRRHHTTVAVTSMAAPSEDALRRALAERQAAADAQAEAVRALKAGGGASKADVDAAVEALKALKVEAGAAARRLQQALGAGAGGAAREELRQAVVNTLERKLFYIPSFKIYRGVAGLYDYGPPGCRVKANVLSFWRQHFVLEENMLEVDCPCVTPEVVLKASGHVEKFTDLMVKDEKTGTCYRADHLLKDFCKEKLEKDLALPQEKADELKRILAILDDLSAEELGAKIKEYGIVAPDTKNPLSDPYPFNLMFQTSIGPTGLSVGYMRPETAQGIFVNFKDLYYYNGQKLPFAAAQIGQAFRNEISPRQGLLRVREFTLAEIEHFVDPEDKSHPKFVDVADLEFLMFPRELQLSGESAKLMKLGEAVSKGTVNNETLGYFIGRVYLFLTCLGIDKGRLRFRQHLPNEMAHYAADCWDAEIECSYGWIECVGIADRSAYDLKAHTEKSGVPLVAHEKFSKPREVEKLVIVPSKKDLGLAFKGNQKMVLEALEAMSEKEAFEMKAELETKGETNFRVCTLGKDVVITKKMVSISMEKKLEHQRVFTPSVIEPSFGIGRIIYCLFEHSFYTRPSKSEEEQLNVFRFPPLVAPIKCTVFPLVKNQEFDAAAKVIAKALTTAGISHIIDTTAISIGRRYARTDEIGVPFAVTVDSATNVTIRERDSKEQIRVDINEVASVVKQLTEGQSTWADVSAKYPAHVGPQGDQE

SEQ ID NO: 8689 - DNA, 2475 bp, Sorghum bicolor
  misc_feature: Ceres ANNOT ID no. 6091599
  misc_feature: Encodes the peptide sequence at SEQ ID NO 8690
  misc_feature: Down-regulated in root tissues in response to aminocyclopropane carboxylic treatment
  misc_feature: Down-regulated in shoot tissues in response to salicylic acid treatment
atgtatttctccaagctcgatgactcgcccatgttccggacgcagatacaatcacttgaggagagtgctgaattgctgagagagagatgtttgaagttccataaaggttgccgtaagtatactgaagggctaggggaagcatacgatggagatattgcatttgccagctcacttgaaacatttggaggaggccacaatgatccaattagtgttgcttttggtgggcctgtaatgaccaaatttacaattgccttaagagaaattggaacatacaaggaagtccttcgctcccaggtcgagcacatgttaaatgacagattactaaattttgttgacattgatttgcatgatgtgaaggatgctcataagcgctttgacaaggctagcctcttatatgaccagattcgtgagaagtacctatcattgaagaaaggtacccgaccagacataacaacggcaattgaagatgagcttcacagtgctagatcttcatttgagcaagctcgtttcaacctggtcacttcactttctcatgttgaggcaaagaagagatttgaatttttggaggctgttagtgcgacaatggactcacatcttcgatattttaaacaaggatatgaactattgcatcaaatggagccatatattaatcaggttcttgcttatgcacagcaatcaagagaaagagcaaacaaggaacaagcttctcttgtagagaggatgcatgagtacaaaaggcagatagaccgggaaagtcggtcttctataaatggtttgaatgattcttataatggtgatggaatacagacaattggcagaagttcacataaacagatcgaggcagttatgcagtcaacttcaaaaggcaaggttcagaccattcgtcaaggttatctttcgaaaagatcttcaaacttgagagccgactggaaaagaaggttcttcgtacttgatagtcgaggaatgttgtactactatcgaaaacaaattactaggccacctgctggttgctccatgcagagaagcgttaacccccctgaacatggttctgggttgttgagcagattgttctcttctcattaccatggtattatacatgatgaaaagtctgttgcacggcatactgtaaatttgttgacatcaaccattaaagttgatgctgagcaatcagatctgaggttctgtttcagaattatttcacccacaaagatctacacattgcaggcagagagtgcagtagatcagatggattggattgaaaagataactggtgttattgcctctttactgagctcacaatccccagaacagtgttttctgtcaagccctaagggcagtggacatgataggagtaccagtgatggaagctcctttacaagttcagtggaatttgaaccttccacaatcgatgatttagtactggagaagtactctggaaatgggcagcatgatgtcagaggcacacatcatcacagaaccagcgtgaaacctgaaaaaccaattgacttgcttaggaaagttgatggcaataatatgtgtgctgactgtggtgcttcagaacctgattgggcatcattaaaccttggtgcacttctatgcatagagtgttctggggtgcacagaaatctcggagttcatatatcaaaggtaagatctctgacacttgatgtcagagtttgggagccatctgtaatcaatctctttcagtcattaggcaacatgtttgtcaacaatatttgggaagagatgttgccagatgataattcaagtgctgatggatcagacacatcacaatacctctctgttagcaagcctaaacacaaagatgtattctctgccaaggagaagtttattcatgccaagtatgtaaacaaagaattcatacggaaccatagcatggatgagaatcagctagctcagcagatgtggaatagtgtagctgcaaatgacaagaaagcagcatacagtctcattgtgagatcgcgtcccaatgtaaatttagtttatggagagatgccttctagcccatttttgactcttggaaaagcacttcagcaagagcaaccggcttcaccacatgatggaagtcccagatttttcgattgcaattcacatgacaagatttctcctcgagagcccctttcccctgcaagcacgagttcacgcacagatgacatggaggacacttgtgaaggtctctccttgttccatcttgcatgccgtgttgcagatgttgggatggttgaattacttttgcagtatggtgctagtgtaaatatgaatgattctaggggtcggacaccccttcatcactgcattttgaaaggaagacatcagcatgcaaagcttctcctctccagaggggctgattcacaagccatggatcgagatggtaggacagcattacagtatgcaatcgacagtggaacaagcgatgaagacattcttgcgttgttagaggaccatagtagataa

SEQ ID NO: 8690 - protein, 824 aa, Sorghum bicolor
  misc_feature: Ceres ANNOT ID no. 6091599
  misc_feature (498)..(635): Pfam Id: ArfGap Pfam Desc: Putative GTPase activating protein for Arf
  misc_feature (293)..(427): Pfam Id: PH Pfam Desc: PH domain
  misc_feature (731)..(763): Pfam Id: Ank Pfam Desc: Ankyrin repeat
  misc_feature (764)..(796): Pfam Id: Ank Pfam Desc: Ankyrin repeat
  misc_feature (1)..(824): NCBI GI: 115477541 NCBI Desc: os08g0537600 [oryza sativa (japonica cultivar-group)]
  misc_feature (1)..(824): NCBI GI: 115480083 NCBI Desc: os09g0510700 [oryza sativa (japonica cultivar-group)]
  misc_feature (1)..(821): NCBI GI: 79512687 NCBI Desc: van3 (vascular network defective 3) [arabidopsis thaliana]
  misc_feature (151)..(824): NCBI GI: 15240398 NCBI Desc: arf gtpase-activating domain-containing protein [arabidopsis thaliana]
  misc_feature (19)..(463): NCBI GI: 10176916 NCBI Desc: gcn4-complementing protein homolog [arabidopsis thaliana]
  misc_feature: The sequence is a functional homolog of SEQ ID NO 1839 in the 10/374,780US patent application
  misc_feature: The sequence is a functional homolog of SEQ ID NO 1840 in the 10/374,780US patent application
  misc_feature: The sequence is a functional homolog of SEQ ID NO 1846 in the 10/374,780US patent application
  misc_feature: Useful for making plants with modulated growth and phenotype characteristics
  misc_feature: The sequence is a functional homolog of SEQ ID NO 1839 in the 20060162006 US patent application
  misc_feature: The sequence is a functional homolog of SEQ ID NO 1840 in the 20060162006 US patent application
  misc_feature: Down-regulated in root tissues in response to aminocyclopropane carboxylic treatment
  misc_feature: Down-regulated in shoot tissues in response to salicylic acid treatment
  misc_feature: The sequence is a functional homolog of SEQ ID NO. 425 in the 11/188,298 US application
MYFSKLDDSPMFRTQIQSLEESAELLRERCLKFHKGCRKYTEGLGEAYDGDIAFASSLETFGGGHNDPISVAFGGPVMTKFTIALREIGTYKEVLRSQVEHMLNDRLLNFVDIDLHDVKDAHKRFDKASLLYDQIREKYLSLKKGTRPDITTAIEDELHSARSSFEQARFNLVTSLSHVEAKKRFEFLEAVSATMDSHLRYFKQGYELLHQMEPYINQVLAYAQQSRERANKEQASLVERMHEYKRQIDRESRSSINGLNDSYNGDGIQTIGRSSHKQIEAVMQSTSKGKVQTIRQGYLSKRSSNLRADWKRRFFVLDSRGMLYYYRKQITRPPAGCSMQRSVNPPEHGSGLLSRLFSSHYHGIIHDEKSVARHTVNLLTSTIKVDAEQSDLRFCFRIISPTKIYTLQAESAVDQMDWIEKITGVIASLLSSQSPEQCFLSSPKGSGHDRSTSDGSSFTSSVEFEPSTIDDLVLEKYSGNGQHDVRGTHHHRTSVKPEKPIDLLRKVDGNNMCADCGASEPDWASLNLGALLCIECSGVHRNLGVHISKVRSLTLDVRVWEPSVINLFQSLGNMFVNNIWEEMLPDDNSSADGSDTSQYLSVSKPKHKDVFSAKEKFIHAKYVNKEFIRNHSMDENQLAQQMWNSVAANDKKAAYSLIVRSRPNVNLVYGEMPSSPFLTLGKALQQEQPASPHDGSPRFFDCNSHDKISPREPLSPASTSSRTDDMEDTCEGLSLFHLACRVADVGMVELLLQYGASVNMNDSRGRTPLHHCILKGRHQHAKLLLSRGADSQAMDRDGRTALQYAIDSGTSDEDILALLEDHSR

SEQ ID NO: 8691 - DNA, 1860 bp, Sorghum bicolor
  misc_feature: Ceres ANNOT ID no. 6091614
  misc_feature: Encodes the peptide sequence at SEQ ID NO 8692
atggcggccgctctggtggcggcgctggttgcgttggcggggagagcaagcgcgtccccggcggagggcatccagccgctgtccaagatcgccgtccacaaggccaccgtcgaaattcagtcgtcggcgttcgtggaggcgaccccgtcgctgctcggcgagcagggagaagacacggagtgggtgacggtgaagtacggctggacagacccttccgacgacgactggatcggcgtcttctctccatctgaattcaactcgtcggctacgtgtcctaacccatggccagcagaagaaccctatctctgcacagcacccatcaagtatcaattcgccaactactctgaaaactacatcttctggggcaagggcagcatccggctgcagctcatcaaccagcgctccgacttctccttcgccctcttcaccggcggcctcgacaacccgaagctgatcgcggtgtcggagccgatcgccttcaagaaccccaaggcgccggtgttcccacgcctggcgcagggcaagtcccacgacgagatgaccgtgacgtggaccagcggctacgacatcagcgaggcctacccgttcgtggagtggggcgccttgttggtcgccgccgccggcgccgccgccccgccccagcagaccacgcgcgcgcccgccgggacgctcaccttcaaccaaggcagcatgtgcggcgagccggcgcgcaccgtcggctggagagaccccggcttcatccacaccgccttcctcagggacctctggcccaacaaggagtactactacaggatcgggcacgagctccacgacgggtccgtggtgtgggggaagccctactcgttccgcgcgccgccgtcgccggggcagaagtcgctgcagcggatcatcgtgttcggcgacatggggaaggcggagagggacgggtcgaacgagtacgcggcgtaccagccggggtcgctgaacacgacggacgcgctgatcagcgacctggacaactacgacatcgtgttccacatcggcgacatgccgtacgccaacgggtacatctcgcagtgggaccagttcaccgcccaggtggcgcccatcaccgcccggaagccctacatggtggccagcggcaaccacgagcgcgactggcccgacacggcggcgttctgggacgtggaggactccggcggcgagtgcggcgtgccggccgagacctactactactaccccgccgagaacagggcgaacttctggtacaaggtggactacggcatgttccggttctgcgtcgccgactcggagcacgactggcggatcggcacgccgcagtacgagttcatcgagcactgcctgtcgacggtggaccggaagcaccagccgtggctcatcttcgcgacgcaccgcgtgctgggatactcctccaacgcctggtacgccggcgaagggtccttcgaggagcctgagggccgcgagaacctgcagaggctgtggcagaagtaccgcgtcgacatcgcctactttggccacgtccataactacgagaggacctgccctatgtaccagagccagtgcatgaccagcgagaagagccactactccgggacgatgaacgggaccatcttcgtggtggccggcggcggcggctgccacctgtcgagctacacgacggcgatccccaagtggagcatctaccgcgaccatgacttcggcttcacgaagctcacggcgttcaaccactcgtcgctgctgttcgagtacatgaagagcagcgacggcaaggtctacgactccttcaccatccacagggactaccgcgacgtgctccggtgcgtgcacgacagctgcttcccgacaacgctcgccacctga

SEQ ID NO: 8692 - protein, 619 aa, Sorghum bicolor
  misc_feature: Ceres ANNOT ID no. 6091614
  misc_feature (294)..(510): Pfam Id: Metallophos Pfam Desc: Calcineurin-like phosphoesterase
  misc_feature (23)..(615): NCBI GI: 115480025 NCBI Desc: os09g0506000 [oryza sativa (japonica cultivar-group)]
  misc_feature (5)..(619): NCBI GI: 18075958 NCBI Desc: diphosphonucleotide phosphatase 1 [lupinus luteus]
  misc_feature (25)..(415): NCBI GI: 144924941 NCBI Desc: metallophosphoesterase; fibronectin, type iii-like fold [medicago truncatula]
  misc_feature (5)..(619): NCBI GI: 77556256 NCBI Desc: diphosphonucleotide phosphatase 1 [oryza sativa (japonica cultivar-group)]
  misc_feature (16)..(619): NCBI GI: 77556254 NCBI Desc: diphosphonucleotide phosphatase 1 [oryza sativa (japonica cultivar-group)]
MAAALVAALVALAGRASASPAEGIQPLSKIAVHKATVEIQSSAFVEATPSLLGEQGEDTEWVTVKYGWTDPSDDDWIGVFSPSEFNSSATCPNPWPAEEPYLCTAPIKYQFANYSENYIFWGKGSIRLQLINQRSDFSFALFTGGLDNPKLIAVSEPIAFKNPKAPVFPRLAQGKSHDEMTVTWTSGYDISEAYPFVEWGALLVAAAGAAAPPQQTTRAPAGTLTFNQGSMCGEPARTVGWRDPGFIHTAFLRDLWPNKEYYYRIGHELHDGSVVWGKPYSFRAPPSPGQKSLQRIIVFGDMGKAERDGSNEYAAYQPGSLNTTDALISDLDNYDIVFHIGDMPYANGYISQWDQFTAQVAPITARKPYMVASGNHERDWPDTAAFWDVEDSGGECGVPAETYYYYPAENRANFWYKVDYGMFRFCVADSEHDWRIGTPQYEFIEHCLSTVDRKHQPWLIFATHRVLGYSSNAWYAGEGSFEEPEGRENLQRLWQKYRVDIAYFGHVHNYERTCPMYQSQCMTSEKSHYSGTMNGTIFVVAGGGGCHLSSYTTAIPKWSIYRDHDFGFTKLTAFNHSSLLFEYMKSSDGKVYDSFTIHRDYRDVLRCVHDSCFPTTLAT

SEQ ID NO: 8693 - DNA, 921 bp, Sorghum bicolor
  misc_feature: Ceres ANNOT ID no. 6091628
  misc_feature: Encodes the peptide sequence at SEQ ID NO 8694
atggcggcggaggccaaaccggctgcggccagcggggttgccggcgagatggaggtggaagcgtaccgccgcctattcccggtggccttcctggagcgccacctcggcgagtccgtccgcatcgatgcccgccgcctcagagaggcccgccccaccaccatcgccctcggcgccgtctcctccgcgcatggttctgctctcgtccgccttggcgacaccgccatgctcgcgtcggtcaagctcgaggtgatgtcgcccccggctgagcacccagacgaaggatccgtcgctgttgagttccacatgccacccatctgctccccgctggttaggccaggccgatccgctgaggttgcaccagtcatctccaaggcccttgaggacgttttgatgagttctggaatgctaaatttgaaggacctctgtttgatcactgggaaggcttcttggctagcgtacctggatatctattgcttgaatgctgacgggtctctgtttgacgctgcacttatttcagcagtagctgccttcacacatttggagattcctttagtttctgttggtgatgatggtaggttatttactgttggaggcaatgatggaaaaaacaaatttgaattggtcaacagagaaaagaggaagctgacactttgcgatattccattgtcccttacatgcgcgcttcataaagatagtatactagcggacccaacttctgaagaagaatcgataatagagacctatgtgactgttgttgtagattcttcagatcgcctagtgtcattacagaaagttggaggagcagtgacatccatggcgactattaaggagtgcattagcttggcgaaagaaagaagacagagcctaagagaaattctgatagactctgtcaaagccatggaagtcgaccaaactgaataa

SEQ ID NO: 8694 - protein, 306 aa, Sorghum bicolor
  misc_feature: Ceres ANNOT ID no. 6091628
  misc_feature (48)..(183): Pfam Id: RNase_PH Pfam Desc: 3' exoribonuclease family, domain 1
  misc_feature (219)..(285): Pfam Id: RNase_PH_C Pfam Desc: 3' exoribonuclease family, domain 2
  misc_feature (24)..(306): NCBI GI: 115485229 NCBI Desc: os11g0311300 [oryza sativa (japonica cultivar-group)]
  misc_feature (8)..(302): NCBI GI: 83283957 NCBI Desc: 3'-5'-exoribonuclease/rna binding protein-like protein [solanum tuberosum]
  misc_feature (8)..(303): NCBI GI: 83283987 NCBI Desc: 3'-5'-exoribonuclease/rna binding-like protein [solanum tuberosum]
  misc_feature (22)..(301): NCBI GI: 27371055 NCBI Desc: mgc52847 protein [xenopus laevis]
  misc_feature (3)..(300): NCBI GI: 60359866 NCBI Desc: mkiaa4013 protein [mus musculus]
MAAEAKPAAASGVAGEMEVEAYRRLFPVAFLERHLGESVRIDARRLREARPTTIALGAVSSAHGSALVRLGDTAMLASVKLEVMSPPAEHPDEGSVAVEFHMPPICSPLVRPGRSAEVAPVISKALEDVLMSSGMLNLKDLCLITGKASWLAYLDIYCLNADGSLFDAALISAVAAFTHLEIPLVSVGDDGRLFTVGGNDGKNKFELVNREKRKLTLCDIPLSLTCALHKDSILADPTSEEESIIETYVTVVVDSSDRLVSLQKVGGAVTSMATIKECISLAKERRQSLREILIDSVKAMEVDQTE

SEQ ID NO: 8695 - DNA, 1035 bp, Sorghum bicolor
  misc_feature: Ceres ANNOT ID no. 6091630
  misc_feature: Encodes the peptide sequence at SEQ ID NO 8696
atgtcagaaagggctttgaaagatctcaatattgctcaatcagcagatctggagaaaggaaaagacaattctgtgaaatcctgcatcaccaagcctgtgttaaatggcaacaaatgtgccaacaaggaagaaaaagctctgtcagcttgccaagatgctgttgctaatggaaatgaggctgtaattgcagatgtggagtacattgattctgaaaatctagtagatctcccagatgtcaatggagctctaagtaccttagctaaaaggttggattcaaaggactgggttatgacatgtgaagctctaaacaatgttcgccagttggcaatgtatcacaaggagcgactgcaggagcttctggagcctctagttcctcttattgttaaatctgtgaagaatccaagaagtgctgtatgcaaaacagcactgatgacttgtgctgacatctttaaggcctatggtgacttaatggttgactcaattgatccactgctagtacagctgtttttaaaggcttcacaagataagcgatttgtttgtgaagttgctgaggcagctcttatatcaatgacaagttggatctcccctttgctactgttgccaagaatgcagccttacctcaagaacaagaatccacggattcgagcaaaagcatcagtgtgtttcagcaaaagtgtacctcgccttgatgtggtgggaatcaaagaatatggtatggataaactcatccagattgcagcaacccaacttagtgaccagcttccggaatcaagggaggctgctcgcaacctggcactggaactacaagtattctatgagaagtctcaggcctcaacttctgacgaacacgagggcgagccttctgcctcaccagatgctgaatcatgggaggccttctgccagtccaagctctctgcgttaagcgcccaagccattcttcgtgtgacccctactacaaaagagggtgtgacctctaccactacaaaagagggtgtcacctctgccccaaaagaaggcttggccgtgggttgctag

SEQ ID NO: 8696 - protein, 344 aa, Sorghum bicolor
  misc_feature: Ceres ANNOT ID no. 6091630
  misc_feature (121)..(344): NCBI GI: 115477505 NCBI Desc: os08g0534200 [oryza sativa (japonica cultivar-group)]
  misc_feature (71)..(264): NCBI GI: 21064295 NCBI Desc: lp02990p [drosophila melanogaster]
  misc_feature (66)..(264): NCBI GI: 115502237 NCBI Desc: protein kiaa0423
  misc_feature (66)..(264): NCBI GI: 50510481 NCBI Desc: mkiaa0423 protein [mus musculus]
  misc_feature (71)..(264): NCBI GI: 24580567 NCBI Desc: cg4648-pa [drosophila melanogaster]
MSERALKDLNIAQSADLEKGKDNSVKSCITKPVLNGNKCANKEEKALSACQDAVANGNEAVIADVEYIDSENLVDLPDVNGALSTLAKRLDSKDWVMTCEALNNVRQLAMYHKERLQELLEPLVPLIVKSVKNPRSAVCKTALMTCADIFKAYGDLMVDSIDPLLVQLFLKASQDKRFVCEVAEAALISMTSWISPLLLLPRMQPYLKNKNPRIRAKASVCFSKSVPRLDVVGIKEYGMDKLIQIAATQLSDQLPESREAARNLALELQVFYEKSQASTSDEHEGEPSASPDAESWEAFCQSKLSALSAQAILRVTPTTKEGVTSTTTKEGVTSAPKEGLAVGC

SEQ ID NO: 8697 - DNA, 645 bp, Sorghum bicolor
  misc_feature: Ceres ANNOT ID no. 6091637
  misc_feature: Encodes the peptide sequence at SEQ ID NO 8698
atggaggggatgagctggagaacggcgtgctgtttatcggtgctctgcgccgtgctgctgctcttgcgcccggccgagggcatccgcttcgtgatcgacagggaagagtgcttctcgcataacgtggagtacgagggggacactgtccatgtctccttcgtcgtcatcaaggctgacaccccgtggcattacagcgaggaaggcgttgatcttgtggttaaggatcctaatggcggtcaagtccgtgattctcgagataagactagtgataagtttgagttcatagttcagaagagaggtgtccatcgcttctgcttcacgaataaatccccgtatcacgaaactatagactttgatgtgcatgttggccatttttcatatttcgagcagcatgccaaagatgagcattttgcaccacttttcgagcaaatagccaagttagacgaggcactttacaatattcagttcgaacagcactggctagaggcccaaactgaccgtcaagcaatattgaacgaaaacatgagcaggagggcagtacacaaggcactcttcgaatcagcggcactgatcgcagccagcgttatccaagtctatctcctgcgccggctcttcgagcgcaagctgggaacgtctagggtttaa

SEQ ID NO: 8698 - protein, 214 aa, Sorghum bicolor
  misc_feature: Ceres ANNOT ID no. 6091637
  misc_feature (59)..(122): Pfam Id: EMP24_GP25L Pfam Desc: emp24/gp25L/p24 family/GOLD
  misc_feature (1)..(214): NCBI GI: 82780758 NCBI Desc: coated vesicle membrane protein-like [triticum aestivum]
  misc_feature (14)..(214): NCBI GI: 20147305 NCBI Desc: at3g22845/mwi23_22 [arabidopsis thaliana]
  misc_feature (12)..(208): NCBI GI: 54642981 NCBI Desc: ga17522-pa [drosophila pseudoobscura]
  misc_feature (12)..(210): NCBI GI: 54642982 NCBI Desc: ga17526-pa [drosophila pseudoobscura]
  misc_feature (12)..(208): NCBI GI: 18921123 NCBI Desc: cg3564-pa [drosophila melanogaster]
  misc_feature: Useful for making plants with altered cell wall content and/or composition
  misc_feature: GREAT-hit functional homolog of the protein sequence encoded by LOCUS at3g07680
  misc_feature: Useful for making plants with altered cell wall content and/or composition
  misc_feature: Functional homolog of the protein sequence given in SEQ ID NO 14027
  misc_feature: Useful for making plants with altered carbohydrate content
  misc_feature: Functional homolog of the protein sequence given in SEQ ID NO 14028
MEGMSWRTACCLSVLCAVLLLLRPAEGIRFVIDREECFSHNVEYEGDTVHVSFVVIKADTPWHYSEEGVDLVVKDPNGGQVRDSRDKTSDKFEFIVQKRGVHRFCFTNKSPYHETIDFDVHVGHFSYFEQHAKDEHFAPLFEQIAKLDEALYNIQFEQHWLEAQTDRQAILNENMSRRAVHKALFESAALIAASVIQVYLLRRLFERKLGTSRV

SEQ ID NO: 8699 - DNA, 1011 bp, Sorghum bicolor
  misc_feature: Ceres ANNOT ID no. 6091639
  misc_feature: Encodes the peptide sequence at SEQ ID NO 8700
atggagaagcgacgacgaggcggcgtgtcgtccctgatggtgctggcggcggcgttgttgacggtggccgcaatgccgccgccgccccgcgtggcggccgcgctgtcgccggactactacaaggacagctgcccggacctggagtcgatcgtgcggtacgaggtgacgaggaagaagaacgagacggtggtcaccatcccggcgacgctccgcctcgccttccacgactgcatggtcgggggttgcaacgccgccgtcctgattgcgtccaagaagaacgacgccgagaaggacgcgccagacaacgagtcactcgccggcgacggcttcgacaccatcaaccgggtcaaggccgccgtcgagaagaagtgccccggtgtggtctcctgcgccgacatcatcgcactcgccaccagagacgtcgtgtacctggcggatggcccctactggcgcgtggagctcggccggctcgacgccctcgcctccagggccagcgacgtcaaggggaagctgccggacccggacatgcacgtcaaggagctcatgccggtgttccagaggaacggcttcaccaaggtggacttggtcgccctctccggcgcgcacaccgtcggcttcgcgcactgctcccgcttcaccaacaggctctacagctacggcggcaccagctcgcggacggacccgacgttcaaccccgactacgccggtcagctcaagggggcgtgccctgtcaatgtcggcccgaccatcgccgtcaacatggaccctgtcagccccatcaaattcgacaacatctacttcatcaacttgcagtacgggctggggctcttcacctccgaccaggtgctctacaccgacgagacgacgagacccatcgtcgacaagttcgccgccagccagaaggagttctttgatgctttcgtcgccgccatgatcaagctggggaggttaggggtgaagacagggaaggatggagagatcagaagagtctgcactgccttcaaccattag

SEQ ID NO: 8700 - protein, 336 aa, Sorghum bicolor
  misc_feature: Ceres ANNOT ID no. 6091639
  misc_feature (51)..(299): Pfam Id: peroxidase Pfam Desc: Peroxidase
  misc_feature (1)..(336): NCBI GI: 115477493 NCBI Desc: os08g0532700 [oryza sativa (japonica cultivar-group)]
  misc_feature (11)..(332): NCBI GI: 92880604 NCBI Desc: haem peroxidase, plant/fungal/bacterial [medicago truncatula]
  misc_feature (7)..(332): NCBI GI: 4138647 NCBI Desc: peroxidase [trifolium repens]
  misc_feature (30)..(332): NCBI GI: 537319 NCBI Desc: peroxidase [medicago sativa]
  misc_feature (14)..(335): NCBI GI: 28629828 NCBI Desc: peroxidase 1 [artemisia annua]
  misc_feature (32)..(335): SWISSPROT Homolog: EC 1.11.1.7 Peroxidase 51 precursor
  misc_feature: Useful for making plants with altered cell wall content and/or composition
  misc_feature: Functional homolog of the protein sequence encoded by LOCUS at4g37520
  misc_feature: Functional homolog of the protein sequence encoded by LOCUS at4g37530
  misc_feature: Useful for making plants with altered carbohydrate content
  misc_feature: Functional homolog of the protein sequence given in SEQ ID NO 14029
  misc_feature: Useful for making plants with altered cell wall content and/or composition
  misc_feature: Functional homolog of the protein sequence given in SEQ ID NO 13852
MEKRRRGGVSSLMVLAAALLTVAAMPPPPRVAAALSPDYYKDSCPDLESIVRYEVTRKKNETVVTIPATLRLAFHDCMVGGCNAAVLIASKKNDAEKDAPDNESLAGDGFDTINRVKAAVEKKCPGVVSCADIIALATRDVVYLADGPYWRVELGRLDALASRASDVKGKLPDPDMHVKELMPVFQRNGFTKVDLVALSGAHTVGFAHCSRFTNRLYSYGGTSSRTDPTFNPDYAGQLKGACPVNVGPTIAVNMDPVSPIKFDNIYFINLQYGLGLFTSDQVLYTDETTRPIVDKFAASQKEFFDAFVAAMIKLGRLGVKTGKDGEIRRVCTAFNH

SEQ ID NO: 8701 - DNA, 939 bp, Sorghum bicolor
  misc_feature: Ceres ANNOT ID no. 6091659
  misc_feature: Encodes the peptide sequence at SEQ ID NO 8702
atggccgccgcagacccggccaccgcggcctcctccttctcccagttctccttccgccgcgccgtctgcccctccccgctccgcgtccgcttctcgcggccccatccgcccgctcggctccgcgtctcctccaccaccgtcgttgctctccacaagcgcaaccccaagcggctcaagtacgccgcccagcgccagttctcgagaggggatgccgggatgctgcgggtggaggtggagccctccggcgaggacttctggaagctcgaccctattatcgacctcatcaatcgcggcgccgtcggggtgatccctactgacaccgtctactccatcgtctgcgacctgagtaacaatgaatctattgagcgccttcgcagactgaaaggcattggagactcaaagcctctcagcatcctgtgccgctcattacgtgatatcgatacctacacaacaggatttcctcgaggcaccaaccaagggcaagctaacattttccgtgctgtcaagcgtgcaatacctgggccttacacatttattttacctgcaaccaagcaatttcctaaacagtgcataaagcatggttcttccacaaggtatgcaaaaaggaggcaggtcggcgtccgaattccagatgatcccatctgccaggcaatattgcaaaatcttgatgaacctttgatctgcacaagtgtcaaatatctatcggaggatgaatggatacttgatccagtaatcattgctgatctttatgagccactggggcttgattttattgttgatggtggacctagaattgctgatccttctaccgtggtggatatgatgggaacaaaccctactataattcgtcagggaaagggcccaatgctggattggatggtagcaaaagatgaagaggaggaggagacacaatcgatgtttgcttttaaagcagcttga

SEQ ID NO: 8702 - protein, 312 aa, Sorghum bicolor
  misc_feature: Ceres ANNOT ID no. 6091659
  misc_feature (92)..(285): Pfam Id: Sua5_yciO_yrdC Pfam Desc: yrdC domain
  misc_feature (2)..(312): NCBI GI: 42407889 NCBI Desc: translation factor-like [oryza sativa (japonica cultivar-group)]
  misc_feature (77)..(293): NCBI GI: 67920201 NCBI Desc: sua5/ycio/yrdc/ywlc [crocosphaera watsonii wh 8501]
  misc_feature (73)..(289): NCBI GI: 118728829 NCBI Desc: sua5/ycio/yrdc/ywlc family protein [delftia acidovorans sph-1]
  misc_feature (77)..(287): NCBI GI: 113474502 NCBI Desc: sua5/ycio/yrdc/ywlc family protein [trichodesmium erythraeum ims101]
  misc_feature (92)..(296): NCBI GI: 118044356 NCBI Desc: sua5/ycio/yrdc/ywlc family protein [burkholderia phytofirmans psjn]
MAAADPATAASSFSQFSFRRAVCPSPLRVRFSRPHPPARLRVSSTTVVALHKRNPKRLKYAAQRQFSRGDAGMLRVEVEPSGEDFWKLDPIIDLINRGAVGVIPTDTVYSIVCDLSNNESIERLRRLKGIGDSKPLSILCRSLRDIDTYTTGFPRGTNQGQANIFRAVKRAIPGPYTFILPATKQFPKQCIKHGSSTRYAKRRQVGVRIPDDPICQAILQNLDEPLICTSVKYLSEDEWILDPVIIADLYEPLGLDFIVDGGPRIADPSTVVDMMGTNPTIIRQGKGPMLDWMVAKDEEEEETQSMFAFKAA

SEQ ID NO: 8703 - DNA, 2712 bp, Sorghum bicolor
  misc_feature: Ceres ANNOT ID no. 6091661
  misc_feature: Encodes the peptide sequence at SEQ ID NO 8704
atgccggagccgcaggccatcctcccgctccgcgcgctcccgccggacgcgccgctgcccttccccgtccccgcgccgttccacccccaaacgcccggccccggccccggtcccggcgggaccgccccggccacgcccccgaacccgacccctctgcaaccgcaaacccccgccgcgccgccttcctcctcttcgacgcggccgccgcacccatgggagatcgccgcgcgagcctggctagagtccttccccgacggacggccgcccaccgagcccgaggtcgacgcctacatcgacgtgcaccgacccgagctcccctccctcccccgctcccagctacaccagcgcctcctcgctctccgcggcgaccagattttagatgcagaccagagcgcattcccgtacaggttccagcgaactgatctatggaagccagtgtaccagtggttggaatctcttgagctggactcactagttgctacacagcagatatcagactggcttacatcgaacccaaagataatggacaggctggttgagaaacattcaaaatatcatttgattcactacacccagaggatgcacttgaagatgctaaaaaagaagggaaagctgccaaagactctgcaactttctgcggctagagccacagttcgaccaattgccgctgcagtcactccagaagaaaacattgtgccattacagaaaactatacctccagtgacaggtattcccagtgtcagtgcatgcagacaacaaagcagtactgcaggcagatttgaaggtggaaatgcaactcttagggataagaagacgtcattgtccaaaaagaaagaagctttgctcaaatatgaacttttgacagacttgcagaaccaattgactgctgtgctgttaaagcaatgtcgtactgttgccattaaagaaacagattcatcatatgtggaattttcaaatcaagagactaacatgagtatacaaggggccactactgcaaatgcttcagccccttcagaggcaaagaaggtgtttatcaatgaacagtcagttccaggaggagccccagaaagtgaacctgggcataagaggaagagaaaccctatcatcgttacacctgcatggtgttatagtgaagcatcagcagaaatcttgcggaatgaaccaaatactagctcaaatagtgatggttcaagaaatttcaatatttggaaaggacatgctaatccactagtttcacatagagatattaagaaaaatatattattctgtcttgaggggcgtgaaactggtgtcagctgctcccaagctgcttcttatggaggttatgctggacgaaattgtgaaagatggactccatttcttgaaggatggaattcacctgcagtccagtttgaagggcctgctgtacatgttgtgagaaaaagttacctatcttggtgtccaacttcatgtgcttatacgtcaagtgctccttctgctcagcctcatggcaggcaaggtatccgcaaagttcttgatgtaaaatttcatccagaagggttgcctcagcttgtttctagctctaatgaggcacccaatgaattactgcttttcaatcttctttctggaagggcaattcagcttagaggccacaataccaagatccagtctatcgcgtttgcagtcaaaggagcaagtgtagtgtcttgtgcttctaatttattaaaggtatgggactgcattaccggttcttgcctctatacgctgggtggtgatgaccaaaattcagtggggcatactcagaaaataaatgctatggcagtgaataaatggcaatcatgtcttgttgtcactagtggagcaaaaggtgacgggaagcttctactatggaatgctttaagaggtgaacttgcttctgatctaaattcgaacttgaggtcccaggatatgatctatccctcagttgatacaatggagttctatagtgagaatcatctggcatgtggaagcgattgtgactatggtggctcagctgtggtacaattatgggatattgattctccagagtcttatttatctttctctgcaagtgactcttacattacttcccttaaagtcaaccctgctggcaacactctcattacaggttctggcgatgggactattggcttatttgacatccgtacttgttctgcaattagccacttgtcagtgggatctggttgtgaggttacatctgtttcatttagcaactgtggcacctatttttctggttctagcacatcaaataatactttggtttgggatacaaggcttgtcccaataaatcaaagcaaggatgtttcacgaagcagagatatgcgattttttcggcctttacattgctttagccatggtagtcagatgcctacagcagaatacacaagtcaactgccaggtcatgttgacgagggtgatcagggggtaaatgccacacagtggctgcataacgaacctgtacttgttactgtaagtggtgatggcagtgttggaatgtgggatgttactctaggtcaaccttgtgtcagacatatcgtcgctcatactcgatgtgctaatgcggttgctgtagcccctaatgacgaatacctctgcacaggaggaagtgatcagaaagttgttttatatcataatagaagtgggcgtacacatcttaattggcgtctttcacaccctctgcaaggaaatgattga

SEQ ID NO: 8704 - protein, 903 aa, Sorghum bicolor
  misc_feature: Ceres ANNOT ID no. 6091661
  misc_feature (681)..(719): Pfam Id: WD40 Pfam Desc: WD domain, G-beta repeat
  misc_feature (845)..(883): Pfam Id: WD40 Pfam Desc: WD domain, G-beta repeat
  misc_feature (1)..(903): NCBI GI: 115477473 NCBI Desc: os08g0531200 [oryza sativa (japonica cultivar-group)]
  misc_feature (517)..(903): NCBI GI: 23124810 NCBI Desc: cog2319: fog: wd40 repeat [nostoc punctiforme pcc 73102]
  misc_feature (513)..(888): NCBI GI: 126658553 NCBI Desc: peptidase c14, caspase catalytic subunit p20 [cyanothece sp. ccy0110]
  misc_feature (507)..(888): NCBI GI: 119486195 NCBI Desc: wd-40 repeat protein [lyngbya sp. pcc 8106]
  misc_feature (517)..(882): NCBI GI: 23128312 NCBI Desc: cog2319: fog: wd40 repeat [nostoc punctiforme pcc 73102]
  misc_feature: The sequence is a functional homolog of SEQ ID NO. 502 in the 11/188,298 US application
MPEPQAILPLRALPPDAPLPFPVPAPFHPQTPGPGPGPGGTAPATPPNPTPLQPQTPAAPPSSSSTRPPHPWEIAARAWLESFPDGRPPTEPEVDAYIDVHRPELPSLPRSQLHQRLLALRGDQILDADQSAFPYRFQRTDLWKPVYQWLESLELDSLVATQQISDWLTSNPKIMDRLVEKHSKYHLIHYTQRMHLKMLKKKGKLPKTLQLSAARATVRPIAAAVTPEENIVPLQKTIPPVTGIPSVSACRQQSSTAGRFEGGNATLRDKKTSLSKKKEALLKYELLTDLQNQLTAVLLKQCRTVAIKETDSSYVEFSNQETNMSIQGATTANASAPSEAKKVFINEQSVPGGAPESEPGHKRKRNPIIVTPAWCYSEASAEILRNEPNTSSNSDGSRNFNIWKGHANPLVSHRDIKKNILFCLEGRETGVSCSQAASYGGYAGRNCERWTPFLEGWNSPAVQFEGPAVHVVRKSYLSWCPTSCAYTSSAPSAQPHGRQGIRKVLDVKFHPEGLPQLVSSSNEAPNELLLFNLLSGRAIQLRGHNTKIQSIAFAVKGASVVSCASNLLKVWDCITGSCLYTLGGDDQNSVGHTQKINAMAVNKWQSCLVVTSGAKGDGKLLLWNALRGELASDLNSNLRSQDMIYPSVDTMEFYSENHLACGSDCDYGGSAVVQLWDIDSPESYLSFSASDSYITSLKVNPAGNTLITGSGDGTIGLFDIRTCSAISHLSVGSGCEVTSVSFSNCGTYFSGSSTSNNTLVWDTRLVPINQSKDVSRSRDMRFFRPLHCFSHGSQMPTAEYTSQLPGHVDEGDQGVNATQWLHNEPVLVTVSGDGSVGMWDVTLGQPCVRHIVAHTRCANAVAVAPNDEYLCTGGSDQKVVLYHNRSGRTHLNWRLSHPLQGND

SEQ ID NO: 8705 - DNA, 1842 bp, Sorghum bicolor
  misc_feature: Ceres ANNOT ID no. 6091663
  misc_feature: Encodes the peptide sequence at SEQ ID NO 8706
atggcggtcgctctggtggcggccacgttgctggggacggcgagcgcatccccggcggaagggatccagccgctttccaagatcgccgtccacaaggccaccgtcgaaatgcagccgtcggcgtacgtgcgggcgacgccgtcgctgctcggggagcagggagaagatactgaatgggtgacggtgaagtacggccggagaatccctaccatcgacgactggatcgccgtcttctctccagctgatttcaactcgtcagctacgtgtcctaacccatggccagcagaaccgccgtatctctgcacagcacccatcaagtatcagtacgccaattactcggaaaactacatctaccggggcaagggcagcatccggctgcagctcatcaaccagcgctccgacttctccttcgccctcttcaccggcggcctcgacaacccgaagctgatcgcggtgtcggagccgatcgccttcaagaaccccaaggcgccggtgttcccgcgcctggcgcagggcaagtcccacgacgagatgaccgtgacgtggaccagcggctacgacatcagcgaggcctacccgttcgtggagtggggcgccttggtcgccgccggcgccggcgccgcccatccccagcaggccgcgcgcactcccgccgggacgctcaccttcagccgcggcagcatgtgcggcgagccggcgcgcaccgtcgggtggagggaccccggcttcatccacaccgccttcctcagggacctctggcccaacaaagagatcgggcacgagctccacgacgggtccgtggtgtggggcaatcggccctacacgttccgtgcgccgccgtcgccggggcagaagtcgctgcagcgcgtcatcgtgttcggcgacatgggaaaggcggagcgagacgggtcgaacgagtacgcggcgtaccaaccggggtcgctgaacacgacggacgcgctgatcagcgacctggacaactacgacgtcgtgttccacatcggcgacatgccgtacgccaacgggtacatctcgcagtgggaccagttcaccgcccaggtggcgcccatcaccgcccggaagccctacatggtggctagcggcaaccacgagcgtgactggcccgacacggcggcgttctgggacgtggaggactccggcggcgagtgcggcgtgccggccgagacctactactactaccccgccgagaacagggcaaacttctggtacaaggtggactacggcatgttccggttctgcgtcgccgactcggagcacgactggcggatcggcacgccgcagtacgagttcatcgagcactgcctgtcgacggtggaccggaagcaccagccgtggctcgtcttcgcggcgcaccgcgtgctgggctactcctccaacgcctggtacgcgggcgaagggtccttcgaggagcccgagggccgcgagaacctgcagaagctctggcagaagtatcgcgtcgacatcgccttcttcggccacgtccataactacgagaggacctgccctatgtaccagagccagtgcatgaccagcgagaagagccactactccgggacgatgaacgggaccatcttcgtggtggccggcggcggcggctgccacctgtcggagtacacgacggcgatccccaggtggagcatctaccgtgacaaggactacgggttcgtcaagctcacggcgttcaaccactcgtcgctgctgttcgagtacaagaagagcagcgacggcaaggtctatgactctttcaccgtcgacagggagtaccgcgacgtgctcagatgcgtgcatgacagctgctttccgacgacgctcgccacctaa

SEQ ID NO: 8706 - protein, 613 aa, Sorghum bicolor
  misc_feature: Ceres ANNOT ID no. 6091663
  misc_feature (288)..(504): Pfam Id: Metallophos Pfam Desc: Calcineurin-like phosphoesterase
  misc_feature (21)..(609): NCBI GI: 115480025 NCBI Desc: os09g0506000 [oryza sativa (japonica cultivar-group)]
  misc_feature (10)..(613): NCBI GI: 18075958 NCBI Desc: diphosphonucleotide phosphatase 1 [lupinus luteus]
  misc_feature (23)..(409): NCBI GI: 144924941 NCBI Desc: metallophosphoesterase; fibronectin, type iii-like fold [medicago truncatula]
  misc_feature (5)..(613): NCBI GI: 77556256 NCBI Desc: diphosphonucleotide phosphatase 1 [oryza sativa (japonica cultivar-group)]
  misc_feature (5)..(613): NCBI GI: 77556254 NCBI Desc: diphosphonucleotide phosphatase 1 [oryza sativa (japonica cultivar-group)]
MAVALVAATLLGTASASPAEGIQPLSKIAVHKATVEMQPSAYVRATPSLLGEQGEDTEWVTVKYGRRIPTIDDWIAVFSPADFNSSATCPNPWPAEPPYLCTAPIKYQYANYSENYIYRGKGSIRLQLINQRSDFSFALFTGGLDNPKLIAVSEPIAFKNPKAPVFPRLAQGKSHDEMTVTWTSGYDISEAYPFVEWGALVAAGAGAAHPQQAARTPAGTLTFSRGSMCGEPARTVGWRDPGFIHTAFLRDLWPNKEIGHELHDGSVVWGNRPYTFRAPPSPGQKSLQRVIVFGDMGKAERDGSNEYAAYQPGSLNTTDALISDLDNYDVVFHIGDMPYANGYISQWDQFTAQVAPITARKPYMVASGNHERDWPDTAAFWDVEDSGGECGVPAETYYYYPAENRANFWYKVDYGMFRFCVADSEHDWRIGTPQYEFIEHCLSTVDRKHQPWLVFAAHRVLGYSSNAWYAGEGSFEEPEGRENLQKLWQKYRVDIAFFGHVHNYERTCPMYQSQCMTSEKSHYSGTMNGTIFVVAGGGGCHLSEYTTAIPRWSIYRDKDYGFVKLTAFNHSSLLFEYKKSSDGKVYDSFTVDREYRDVLRCVHDSCFPTTLAT

SEQ ID NO: 8707 - DNA, 1188 bp, Sorghum bicolor
  misc_feature: Ceres ANNOT ID no. 6091665
  misc_feature: Encodes the peptide sequence at SEQ ID NO 8708
atgcccgggctcacggcgccgtccgactacgcggaggagccgccgcgtcacccggccctcaagatcaactccaaggagccattcaacgctgagcctcaccgatcagcgctagtcgcatcatacatcaccccagtggatttcttctacaagaggaaccatggacccatccctaaagtcgaggacctctcaagatacactgttaccatttctggtctcatcaacaagtctattcagctatccatgggtgacatttgggctcttccaaagtacaatgtcacagcaactttacagtgtgcgggaaacaggaggactgcgatgagtaatgtacggaaagtgagaggtgttggatgggacatatctgctcttggaactgcaacttggggaggtgccaaactatctgatgtccttgagctagttagaataccaaaactcagttcagtcacatctctaggcgggaagcacgttgagtttgttagcgttgacaagtgtaaagaggaaaaaggtggtccttataaggcatctattccattgaagcaggcaacagatcctgatgctgatgtattacttgcatatgaaatgaatggagaggtactcaatcgggaccatgggtacccactccgggttgttgtgcctggcgttattggtgcacgctctgtaaaatggttggacagtatcaacataaaagaggaggaatgccagggtttttttgtgcaaaaagattacaaaatgtttccaccaaccgtggactgggacaatattaattggtcaactagaaggccacagatggatttccctgtgcagtctgctatctgtacactggaagatgtagatgttatcaaggaaggaaaggctaggattgctggatatgcactttcaggtggtggccgtggcattgagagagtggatatatctgttgatgggggtaaaacatggattgaggctcgtcgatatcagaaagacaatgtggcgtacgtatcagatggacctcaaagtgataagtgggcttgggttctctttgaggctacattagacataccagcaaatgctgagatcgtagctaaggcggtggactcggctgcaaatgttcaaccggaaaaggtagaagacatatggaatctgagaggaatcctcaacacgtcttggcatcggatcaaaatacagaactcttcaggaagatctaagctgtga

SEQ ID NO: 8708 - protein, 395 aa, Sorghum bicolor
  misc_feature: Ceres ANNOT ID no. 6091665
  misc_feature (49)..(238): Pfam Id: Oxidored_molyb Pfam Desc: Oxidoreductase molybdopterin binding domain
  misc_feature (258)..(389): Pfam Id: Mo-co_dimer Pfam Desc: Mo-co oxidoreductase dimerisation domain
  misc_feature (1)..(387): NCBI GI: 114186917 NCBI Desc: sulfite oxidase [solanum lycopersicum]
  misc_feature (1)..(387): NCBI GI: 82621174 NCBI Desc: sulfite oxidase-like [solanum tuberosum]
  misc_feature (1)..(387): NCBI GI: 82941457 NCBI Desc: sulfite oxidase [codonopsis lanceolata]
  misc_feature (1)..(395): NCBI GI: 6468008 NCBI Desc: sulfite oxidase [arabidopsis thaliana]
  misc_feature (96)..(395): NCBI GI: 79295451 NCBI Desc: sox (sulfite oxidase); oxidoreductase/ sulfite oxidase [arabidopsis thaliana]
  misc_feature (1)..(395): SWISSPROT Homolog: EC 1.8.3.1 Sulfite oxidase
MPGLTAPSDYAEEPPRHPALKINSKEPFNAEPHRSALVASYITPVDFFYKRNHGPIPKVEDLSRYTVTISGLINKSIQLSMGDIWALPKYNVTATLQCAGNRRTAMSNVRKVRGVGWDISALGTATWGGAKLSDVLELVRIPKLSSVTSLGGKHVEFVSVDKCKEEKGGPYKASIPLKQATDPDADVLLAYEMNGEVLNRDHGYPLRVVVPGVIGARSVKWLDSINIKEEECQGFFVQKDYKMFPPTVDWDNINWSTRRPQMDFPVQSAICTLEDVDVIKEGKARIAGYALSGGGRGIERVDISVDGGKTWIEARRYQKDNVAYVSDGPQSDKWAWVLFEATLDIPANAEIVAKAVDSAANVQPEKVEDIWNLRGILNTSWHRIKIQNSSGRSKL

SEQ ID NO: 8709 - DNA, 1371 bp, Sorghum bicolor
  misc_feature: Ceres ANNOT ID no. 6091669
  misc_feature: Encodes the peptide sequence at SEQ ID NO 8710
atggaggacgtgatggtctcctccgtgggtccccacttcagcgggctccgcctcgactcgcgccgcctctcctcctcgctctcgccgtcctcctccccctcccgctccgccaacgccgacgcctcgctggggttcgcatccccgaaggcggacgggaccaggaggcccttcgtcataggcgtatgtggagggaccgcgtcggggaagacgacggtgtgcgacatgataattcagcagctccacgaccaccgcgtcgtgctcgtcaaccaggattcattctaccgtggtttaactgaggaacagtctgagcaggtgcaagactacaattttgatcaccctgatgcattcgatacagatcaacttttggtgtgcatgggaaagctgaaaagtggacagtccgtgaatattcctatatatgattttaagaatcacaggcgatgctctgaaaaatttaggaaggtcaatgaatcagatgtcatcattttggaggggatcttggtttttcatgatcagagggttcgtgatttgatggacatgaaaatttttgttgacacagatgctgatattagacttgctagacgtataaggcgtgatactgttgaaagaggtagagatgttacctcagtgcttgagcagtatgttagatttgtcaagcctgcatttgatgcttttgtcctgccttcgaagaaatatgctgatgtgatcataccaaaagggggagataaccatgttgcaattgatctaattgtgcaacatatccacacaaaacttggtcagcataacctgtgcaaagtctacccaaatgtctttgtcgtacacacaactttccagatacgaggaatgcatactctcattcgtgacaagaacattactacacctgactttgttttctactcagataggctgattcgtctggtggttgagcatggtcttgggcatttgccatttacagagaagcaggtggttacaccaacaggatctgtttacatgggagttgacttctgcaagaagctctgtggagtgtctattgttcgaagtggcgaaagcatggaaatgcactgcgtgcttgttctcatataccataagctgcccgtggatattgctgaacgtcatgttttgcttttggaccctgtgcttggtacaggcaattcagctaatcaagccattgagcttcttatgaggaaaggagttcctgagcagcggatcatttttctgactctcatctcggcccctgaaggcatccattgtgtgtgcaagcgcttccctgatttgaagattgtaacctcagagattgatagcggattgaacgatgaatatcgtgtcatcccaggacttggagagtatggtgatcgatacttcggcacagactaa

SEQ ID NO: 8710 - protein, 456 aa, Sorghum bicolor
  misc_feature: Ceres ANNOT ID no. 6091669
  misc_feature (58)..(245): Pfam Id: PRK Pfam Desc: Phosphoribulokinase / Uridine kinase family
  misc_feature (284)..(417): Pfam Id: Pribosyltran Pfam Desc: Phosphoribosyl transferase domain
  misc_feature (1)..(351): NCBI GI: 115480023 NCBI Desc: os09g0505800 [oryza sativa (japonica cultivar-group)]
  misc_feature (3)..(351): NCBI GI: 92874915 NCBI Desc: phosphoribosyltransferase; aaa atpase; phosphoribulokinase/uridine kinase [medicago truncatula]
  misc_feature (3)..(351): NCBI GI: 110737140 NCBI Desc: uracil phosphoribosyl transferase like protein [arabidopsis thaliana]
  misc_feature (186)..(328): NCBI GI: 8778301 NCBI Desc: f14j16.5 [arabidopsis thaliana]
  misc_feature (75)..(351): NCBI GI: 30687242 NCBI Desc: uracil phosphoribosyltransferase / ump pyrophosphorylase (upt1) [arabidopsis thaliana]
  misc_feature (335)..(456): SWISSPROT Homolog: EC 2.4.2.9 Uracil phosphoribosyltransferase
  misc_feature (56)..(253): SWISSPROT Homolog: EC 2.7.1.48 Uridine-cytidine kinase 2
  misc_feature: The sequence is a functional homolog of SEQ ID NO. 532 in the 11/188,298 US application
MEDVMVSSVGPHFSGLRLDSRRLSSSLSPSSSPSRSANADASLGFASPKADGTRRPFVIGVCGGTASGKTTVCDMIIQQLHDHRVVLVNQDSFYRGLTEEQSEQVQDYNFDHPDAFDTDQLLVCMGKLKSGQSVNIPIYDFKNHRRCSEKFRKVNESDVIILEGILVFHDQRVRDLMDMKIFVDTDADIRLARRIRRDTVERGRDVTSVLEQYVRFVKPAFDAFVLPSKKYADVIIPKGGDNHVAIDLIVQHIHTKLGQHNLCKVYPNVFVVHTTFQIRGMHTLIRDKNITTPDFVFYSDRLIRLVVEHGLGHLPFTEKQVVTPTGSVYMGVDFCKKLCGVSIVRSGESMEMHCVLVLIYHKLPVDIAERHVLLLDPVLGTGNSANQAIELLMRKGVPEQRIIFLTLISAPEGIHCVCKRFPDLKIVTSEIDSGLNDEYRVIPGLGEYGDRYFGTD

SEQ ID NO: 8711 - DNA, 3216 bp, Sorghum bicolor
  misc_feature: Ceres ANNOT ID no. 6091690
  misc_feature: Encodes the peptide sequence at SEQ ID NO 8712
atggcggcggcgaccggcgcaggtgcggtgagcgaggggatgcggcggctcacgcagctctcgctcgtctccaaggtctgctcggagctggagtcccacctcggcgtcgcggaccgcgtcctggccgagttcgtcgtcgacctgggccgcgcctccgcctccgccgccgccttcgccgccgcgctcagggaccacggcgccgagctgccggactacctcgtccgctccctccacgccgtcatcaccgccatcccggacagcggccccgctccccccgcctcccgtggtgctggtgcccgggggcgcgtggacaaggcggcgggggcgggggcggacgaggaccaggagccggagttgaaccaggtgcgccgggggaggatcacccgggtgggcgacgccgggtgcttcgtccgcctcggcgccggcgcgcgcggccgcgagggcctcgtgcacgtctcccagatgcccggcggccgccgcgccaccgtcacgcgcgggcaggaggtgttcgtcaaggtcgtctcggtggatggcgccaagctgggactgtcgatgcgagacgtcgatcaggataccggaagggatctcctgcctatgcctcgaaaccgtggggaggaggacgcgccgagggcaaatccgccagctgatcgtgccggagccgccgggaggaggaggaagggggtttctgggattttcgttcccgatgagaacgaggacaaggctggtcctgcgcctcgcaggccaactaggcggatgacctcaccggagaggtgggaggtgaagcagctgattgcgtcgggggtgttggatgccaaggactacccggtgttggatgaggatgatcaggggatgttctaccaggaggaagaagtggagcttgagattgaactcaatgaggatgagccggcgttcttgcggggaaaggggcgatcctcggctgacatgtctccagtgaggatttccatgaatcccgaggggtcgatgagccgtgcggcagcactgcagtctgcgcttatcaaggagaggcgtgatattcgcacccaggagcaaagaggaatggttgatgcaatccccaaggaccttaaccggtcatgggaggatcccatgtcaagtggtggaaggtatctgatgcaggagctggtgggcactggactatcagcacagagtgtgccggaatggaagatgacatatgggaaggccggaacatatgggcagaagtcgaggctttcgattcaggagcagagacaaagccttccaatattcaagctgaaaaaggagctgatcaatgctgttaatgacaaccaagtcttggtggttatcggtgagactggctcagggaaaacaacccaggttacgcagtacctcgccgaggcagggtatactacaaagggaaagattgcatgtactcaacctcgcagggttgctgcagagtcgattgcaaagcgagtagcagaggaggttggctgtcgagtgggtgaggaagttggttattctatacgctttgatgattgcacaggacctgaaactgtcatcaagtacatgacagacggcatgctcctacgtgagattttgatggatggagacctgtcttcttattcagtggtcatgcttgatgaggcacatgagagaaccatctacacagacattctcttcagtttgctaaagcagctaattaagcggagaagtgacctcaagttaatagtcacttcagccactcttgatgctgagaagttctctggttatttttttgattgcaatattttcacaattcctggaagaacgtttccagttgagatactacatactaaacagccagagagtgactacatggatgctgcactgatcacggtattgcagatccatctgactgaacccgaaggagatatcctattgttcctgactggccaggaagagattgatcatgcttgcgaacgtctccatgagaggatgaaggcattcggtggggacataccagagctgataatttgtcctgtgtacagtgctcttcctactgaagttcagtcgaagatattcgaaccagctcctcctggtaagaggaaggtggtcgtggccaccaacatagcagaagcatctattaccatagatggaatttactatgttgttgacccaggctttgcaaagctaaatgtctataacccaaaactgggtctggattcactggttatcaccccgatctctcaggcatcagctaagcaaagagcagggcgtgctggacgtacaggtccaggtaaatgttaccgtctatacactgagagtgcctatcgcaatgaaataccaccaacaaccactccagaaattcagagggctaacttggggtggacggttcttaatatgaaggcaatgggaataaatgaccttttgtcatttgacttcatggatcctccagcatctcaagcacttatatcagctatggaacaactgtacagtctcggtgccttagatgaagagggtcttcttaccaggctagggagaaaaatgtccgaatttccacaagaaccacctctttctaagatgctccttgctagtgtagaccttggatgcagtgacgaaatactgacaatcattgcaatgattcagactgggaacatattctatcgaccaagggagaagcaagcacaagcagatcggaaaagatcgaactttttccagccggaaggcgatcatctcaccctactcactgtgtatgaggcatggaaggcaaaggggttttctggaccatggtgtgttgagaatttcattcaggtaaactcactaaggagggcacaggatgtgaggaaacagcttcttgagattatggacaagttcaagctcaatgtcatctctgctgggaacaattccaccaagatagggaaagcccttgccgctggattcttcttccacgctgcaaggaaggaccccagtggagggtaccgtaccctcgctgatcatcagcaggtttatatccacccgagcagcgctctctttcaccagcagccacagttggtgatctaccatgaaattgttatgacaacgaaagagtatatgagggaggtcacggcggtggacccaagatggttagtagagttggcaccgaggttctataggtcagtggacccaatgaagatcagtaagcgaaaacgccaagaaaggatcgagcctttgtacgatagatacaatgagcccaactcatggcgcctgagcaagcgccgctggtga

SEQ ID NO: 8712 - protein, 1071 aa, Sorghum bicolor
  misc_feature: Ceres ANNOT ID no. 6091690
  misc_feature (809)..(899): Pfam Id: HA2 Pfam Desc: Helicase associated domain (HA2)
  misc_feature (654)..(748): Pfam Id: Helicase_C Pfam Desc: Helicase conserved C-terminal domain
  misc_feature (116)..(186): Pfam Id: S1 Pfam Desc: S1 RNA binding domain
  misc_feature (421)..(578): Pfam Id: DEAD Pfam Desc: DEAD/DEAH box helicase
  misc_feature (95)..(1070): NCBI GI: 1402875 NCBI Desc: rna helicase [arabidopsis thaliana]
  misc_feature (115)..(1068): NCBI GI: 4826690 NCBI Desc: deah (asp-glu-ala-his) box polypeptide 8 [homo sapiens]
  misc_feature (115)..(1068): NCBI GI: 60360134 NCBI Desc: mkiaa4096 protein [mus musculus]
  misc_feature (115)..(1068): NCBI GI: 56699440 NCBI Desc: deah (asp-glu-ala-his) box polypeptide 8 [mus musculus]
  misc_feature (115)..(1068): NCBI GI: 127801176 NCBI Desc: deah (asp-glu-ala-his) box polypeptide 8 [homo sapiens]
MAAATGAGAVSEGMRRLTQLSLVSKVCSELESHLGVADRVLAEFVVDLGRASASAAAFAAALRDHGAELPDYLVRSLHAVITAIPDSGPAPPASRGAGARGRVDKAAGAGADEDQEPELNQVRRGRITRVGDAGCFVRLGAGARGREGLVHVSQMPGGRRATVTRGQEVFVKVVSVDGAKLGLSMRDVDQDTGRDLLPMPRNRGEEDAPRANPPADRAGAAGRRRKGVSGIFVPDENEDKAGPAPRRPTRRMTSPERWEVKQLIASGVLDAKDYPVLDEDDQGMFYQEEEVELEIELNEDEPAFLRGKGRSSADMSPVRISMNPEGSMSRAAALQSALIKERRDIRTQEQRGMVDAIPKDLNRSWEDPMSSGGRYLMQELVGTGLSAQSVPEWKMTYGKAGTYGQKSRLSIQEQRQSLPIFKLKKELINAVNDNQVLVVIGETGSGKTTQVTQYLAEAGYTTKGKIACTQPRRVAAESIAKRVAEEVGCRVGEEVGYSIRFDDCTGPETVIKYMTDGMLLREILMDGDLSSYSVVMLDEAHERTIYTDILFSLLKQLIKRRSDLKLIVTSATLDAEKFSGYFFDCNIFTIPGRTFPVEILHTKQPESDYMDAALITVLQIHLTEPEGDILLFLTGQEEIDHACERLHERMKAFGGDIPELIICPVYSALPTEVQSKIFEPAPPGKRKVVVATNIAEASITIDGIYYVVDPGFAKLNVYNPKLGLDSLVITPISQASAKQRAGRAGRTGPGKCYRLYTESAYRNEIPPTTTPEIQRANLGWTVLNMKAMGINDLLSFDFMDPPASQALISAMEQLYSLGALDEEGLLTRLGRKMSEFPQEPPLSKMLLASVDLGCSDEILTIIAMIQTGNIFYRPREKQAQADRKRSNFFQPEGDHLTLLTVYEAWKAKGFSGPWCVENFIQVNSLRRAQDVRKQLLEIMDKFKLNVISAGNNSTKIGKALAAGFFFHAARKDPSGGYRTLADHQQVYIHPSSALFHQQPQLVIYHEIVMTTKEYMREVTAVDPRWLVELAPRFYRSVDPMKISKRKRQERIEPLYDRYNEPNSWRLSKRRW

SEQ ID NO: 8713 - DNA, 684 bp, Sorghum bicolor
  misc_feature: Ceres ANNOT ID no. 6091691
  misc_feature: Encodes the peptide sequence at SEQ ID NO 8714
atgtacgccgacaggacctcggggcggaagcgctctgtaatggaccgcctcgggtcgggcggcgcctcgcgctcgcggtctgatgacgcaaaaaggtttcgccgggatgatgggacgtggagacgtgagctttataaggattctagaggaacccaaacttcatctgaacctactttaagaaatctgcaatcgaaccaaaaatctcaagtgcagaaaaggattgaggttgtgaagaaatcaccagtttcagatctccgtgaaaagttatctggtgtaccaaaccagcgccctcaacttagcagtactgttcaggtgccaaaacctgtaaaagaggttattaagagcgacaagcctgttcaaaagagagacccccctccagctgctgccccaattgtcattaagaaagtcagtgcacctgcacctgaaccagcaccgtctgcactaccaaagcaatcccaggacaaggttgatgcttcgcttgacagtttactgaagtctcttgatctagagaagtatttgataaatttccaggctgaagaggttgatatgaaagcactggtttacatgaacgaagaagatatgaagtctttaggaattccaatgggtcccaggaaaaagatactatcagcattggctcacagaaagaggaagtcttcgaagtcattgcctaccagtgccagttga

SEQ ID NO: 8714 - protein, 227 aa, Sorghum bicolor
  misc_feature: Ceres ANNOT ID no. 6091691
  misc_feature (154)..(215): Pfam Id: SAM_1 Pfam Desc: SAM domain (Sterile alpha motif)
  misc_feature (153)..(217): Pfam Id: SAM_2 Pfam Desc: SAM domain (Sterile alpha motif)
  misc_feature (1)..(214): NCBI GI: 116634831 NCBI Desc: osigba0135c09.6 [oryza sativa (indica cultivar-group)]
  misc_feature (1)..(214): NCBI GI: 115457974 NCBI Desc: os04g0378200 [oryza sativa (japonica cultivar-group)]
  misc_feature (112)..(217): NCBI GI: 116310123 NCBI Desc: osigba0130p02.4 [oryza sativa (indica cultivar-group)]
  misc_feature (112)..(217): NCBI GI: 38347059 NCBI Desc: osjnba0060p14.15 [oryza sativa (japonica cultivar-group)]
  misc_feature (152)..(227): NCBI GI: 28374267 NCBI Desc: ddhd2 protein [mus musculus]
MYADRTSGRKRSVMDRLGSGGASRSRSDDAKRFRRDDGTWRRELYKDSRGTQTSSEPTLRNLQSNQKSQVQKRIEVVKKSPVSDLREKLSGVPNQRPQLSSTVQVPKPVKEVIKSDKPVQKRDPPPAAAPIVIKKVSAPAPEPAPSALPKQSQDKVDASLDSLLKSLDLEKYLINFQAEEVDMKALVYMNEEDMKSLGIPMGPRKKILSALAHRKRKSSKSLPTSAS

SEQ ID NO: 8715 - DNA, 591 bp, Sorghum bicolor
  misc_feature: Ceres ANNOT ID no. 6091748
  misc_feature: Encodes the peptide sequence at SEQ ID NO 8716
atgtccgccggagcgggtggcggcggcggtatggaaatggaccatcagcatccggacagcgctggcagtgcgactgcggtggcgaggcggtgcgccgcgtgcaagtatctccggcggaggtgcgcccccgactgcgtcctcgcgccctacttcccggcgtcgcagccgcggaggtacgccgacgtgcacgccgtcttcggcaccagcaacctcaccagagtgctccaggagcgaggccgggcggcggacacgatggcgacggaggcgcactggcgggtgcaggacccggtgtacggctgcacggggatcatccacggcctgcagcaggagatccgcgacgtgcagcaacagctcgccaccacgcgggcgcagctcgccatgcacttgcacggcagtggcacggcgccgccgtcgtcgtcgcctcagccgcctctcgctgctgctgcagcggctacggtgacagtgaacagcggcggacgacatcgcgtcagcgtgcacgaggacgacgaggagcagcagcaggaggaggaggaggaggaggcgccgttgatggaccccgacgagttcctcgacctcgatggccggctctga

SEQ ID NO: 8716 - protein, 196 aa, Sorghum bicolor
  misc_feature: Ceres ANNOT ID no. 6091748
  misc_feature (28)..(143): NCBI GI: 51972120 NCBI Desc: at1g31320 [arabidopsis thaliana]
  misc_feature (20)..(165): NCBI GI: 62997483 NCBI Desc: asymmetric leaves2 [zea mays]
  misc_feature (31)..(161): NCBI GI: 120431393 NCBI Desc: ial1 [zea mays]
  misc_feature (20)..(154): NCBI GI: 84104903 NCBI Desc: ramosa 2 [zea mays]
  misc_feature (31)..(154): NCBI GI: 17227156 NCBI Desc: lob domain 6 [arabidopsis thaliana]
MSAGAGGGGGMEMDHQHPDSAGSATAVARRCAACKYLRRRCAPDCVLAPYFPASQPRRYADVHAVFGTSNLTRVLQERGRAADTMATEAHWRVQDPVYGCTGIIHGLQQEIRDVQQQLATTRAQLAMHLHGSGTAPPSSSPQPPLAAAAAATVTVNSGGRHRVSVHEDDEEQQQEEEEEEAPLMDPDEFLDLDGRL

SEQ ID NO: 8717 - DNA, 3210 bp, Sorghum bicolor
  misc_feature: Ceres ANNOT ID no. 6091749
  misc_feature: Encodes the peptide sequence at SEQ ID NO 8718
atggcgcaggggagttcgccgccgccgccggagatccgctcgccggacgaccggcccgcggcggaggatgccgccgaggccgaggctgaggcggaggtggaggaggtcttcgacgacgccttcgatataccccacaagaacgcgccgcatgaccggttgcgccggtggaggcaagctgctcttgttcttaatgcttcacgacgttttagatatactctagaccttaaaaaggaagaagagaaagagattataagaaggaagatccggtcccacgcgcaagttatacgggcagcatttcttttcaaagaagctggccaaaaagatatcacagaagcttatactggtataaatcttgcaacggcctctcgcagttttccaattgaactggaaaagcttaacacattaaacagggaccatgacaatgttcttcttcaagaaattggaggggttaggggactgtcagatttgttgaagagtaatttagagaagggagttagtccaaatgaggatgaattgttacgaaggaggaatgtctatgggtcaaatacatatccacgcaagaagaggaaaaacatactgcgttttgtatttgaagcatgccaagatttaactcttgtcattctgatggtagctgctgctatatcactgacattgggtatgaccacagagggtgttgatgaaggatggtatgatggtggaagtatctttttagccgttttccttgtgatacttgttactgcgacaagtgattatagacaatctctacagtttcgacatctgaatgaggagaaacagaacatacaagtggaggttgttagaggtggtaaaagatttggaacttcaatctttgaccttgttgttggtgatgtagttcctctcaaaattggtgatcaagttcctgctgatggtgtcctgatatctggccattctcttgcaatagatgaatcaagtatgactggagagtcaaaagttgtccacaaggatcaaagggcaccattcttgatgtctggttgcaaagttgcagatggctatggttctatgttggtaacaggggtgggtacaaatactgaatggggtcagttgatggctaacctttcagaagataatggtgaagaaacaccgttacaggttcgcttgaatggtgttgcaacttttattggtttggtaggcttgtctgtagctggtgcagtacttgttgtgctttggataagatattttactggacataccgagaatcctgatgggacgactcaatttgttgctggaactactggtgtgaagcaaggatttatgggggcaattagaattttgactattgctgtgaccattgtagttgttgctgtgcccgagggactcccattggcagtaacactgacgcttgcatattccatgaaaaagatgatgcgagacaaagctctggtgaggcggctctcgtcatgtgaaacaatgggatcagctactacaatatgcagtgataagacaggaacccttacattgaataagatgacggtcgtggaagcatattttgctggaacaaagttggatccatgcgatgatgttagccagatgacagacagtgcagtatcacttattattgaaggaattgcacagaacacaacgggaactgtatttctgccagaggatgggggaacagctgaactttccggttcacctactgaaaaggccattctttcttggggccttaagatagggatggatttccatgacgtgaggacaaaatcttcagttattcatgtttttccatttaactcggagaagaaacgtggcgctgttgcagtacagtcagatgatggtgttcacatccactggaaaggtgcagctgaaatagtgttatcatcttgcaaaagctggctttctgtcaacggctcggttcagtcaatgagtgctgagaagcacgatgaattcaagaaatcaattgaagacatggcagcgaattcattacgctgtgttgcttttgcatactgttcctttgacactgaaatgatcccagaggaagacatagcaagctgggagttgcccgaggatggcctgaccctgcttggcatcataggaataaaggacccctgtcgcccaggtgtaaaggatgctgtacgactgtgcaccactgcaggtgttaaggtgcgcatggttacaggagataatattgaaacagctaaagctatagctctggagtgtggaatactagatgcaaatagtgttatttcagagccagttgtaattgagggaaaagtgttccgtgagatgtctgaaagtgcaagaggagatgccgctgacaagataattgtgatggggaggtcctcgccaaatgataaacttttgcttgtccaagctttaaaaagaaaaggccatgttgtagctgttactggtgatggcacaaatgacgcccctgcattgcacgaggccgatataggtctttcaatgggcatttcagggacagaagtcgctaaagaaagctctgacattataatcttggatgatgacttcacgtcagttgtcaaggttgttcgttggggacgatctgtctacgctaatattcagaaattcattcagttccagctcactgtcaatgttgctgcactcgtgattaatgtggttgctgctgtgtcctctggtgatgtgcccctaaatgctgttgagcttctctgggtgaaccttatcatggacacacttggagctcttgcattggcgactgagcctccaacagacaaccttatgaagagaaatcctgttggtcgaaggcatgccctttaccaagtagcaattcttctgattttcgattttgctggagtaaggattttgcgtctgcagaatgaaagccgatctgacgctgagaagataacaaataccttcatctttaacacatttgtattttgccagatcttcaacgagttcaatgcgcgaaaacccgaggagaagaatgtcttcaaaggggtaacaaagaatcacctattcatgggaataattggtataacgacagtatttcagatactgataattcagttcctggggaagttcttcaaaatagtgaggcttgattggagattatggctggtttcagttgctattggccttgtgagttggcccctggcttatctgggtaaatttattcctgtgcccgtaagacccttcccggactatttcaagcctcgctgttgtcagaaattgtcgcgccgaggtgagtctccatga

SEQ ID NO: 8718 - protein, 1069 aa, Sorghum bicolor
  misc_feature: Ceres ANNOT ID no. 6091749
  misc_feature (234)..(482): Pfam Id: E1-E2_ATPase Pfam Desc: E1-E2 ATPase
  misc_feature (486)..(818): Pfam Id: Hydrolase Pfam Desc: haloacid dehalogenase-like hydrolase
  misc_feature (141)..(219): Pfam Id: Cation_ATPase_N Pfam Desc: Cation transporter/ATPase, N-terminus
  misc_feature (905)..(1046): Pfam Id: Cation_ATPase_C Pfam Desc: Cation transporting ATPase, C-terminus
  misc_feature (16)..(1055): NCBI GI: 9280219 NCBI Desc: ca2+-transporting atpase [arabidopsis thaliana]
  misc_feature (19)..(1055): NCBI GI: 8919831 NCBI Desc: plasma membrane ca2+-atpase [arabidopsis thaliana]
  misc_feature (19)..(1055): NCBI GI: 8843813 NCBI Desc: ca2+-transporting atpase-like protein [arabidopsis thaliana]
  misc_feature (39)..(996): NCBI GI: 38346912 NCBI Desc: osjnbb0015n08.12 [oryza sativa (japonica cultivar-group)]
  misc_feature (128)..(1069): NCBI GI: 115444569 NCBI Desc: os02g0176700 [oryza sativa (japonica cultivar-group)]
  misc_feature (19)..(1055): SWISSPROT Homolog: EC 3.6.3.8 Calcium-transporting ATPase 8, plasma membrane-type
MAQGSSPPPPEIRSPDDRPAAEDAAEAEAEAEVEEVFDDAFDIPHKNAPHDRLRRWRQAALVLNASRRFRYTLDLKKEEEKEIIRRKIRSHAQVIRAAFLFKEAGQKDITEAYTGINLATASRSFPIELEKLNTLNRDHDNVLLQEIGGVRGLSDLLKSNLEKGVSPNEDELLRRRNVYGSNTYPRKKRKNILRFVFEACQDLTLVILMVAAAISLTLGMTTEGVDEGWYDGGSIFLAVFLVILVTATSDYRQSLQFRHLNEEKQNIQVEVVRGGKRFGTSIFDLVVGDVVPLKIGDQVPADGVLISGHSLAIDESSMTGESKVVHKDQRAPFLMSGCKVADGYGSMLVTGVGTNTEWGQLMANLSEDNGEETPLQVRLNGVATFIGLVGLSVAGAVLVVLWIRYFTGHTENPDGTTQFVAGTTGVKQGFMGAIRILTIAVTIVVVAVPEGLPLAVTLTLAYSMKKMMRDKALVRRLSSCETMGSATTICSDKTGTLTLNKMTVVEAYFAGTKLDPCDDVSQMTDSAVSLIIEGIAQNTTGTVFLPEDGGTAELSGSPTEKAILSWGLKIGMDFHDVRTKSSVIHVFPFNSEKKRGAVAVQSDDGVHIHWKGAAEIVLSSCKSWLSVNGSVQSMSAEKHDEFKKSIEDMAANSLRCVAFAYCSFDTEMIPEEDIASWELPEDGLTLLGIIGIKDPCRPGVKDAVRLCTTAGVKVRMVTGDNIETAKAIALECGILDANSVISEPVVIEGKVFREMSESARGDAADKIIVMGRSSPNDKLLLVQALKRKGHVVAVTGDGTNDAPALHEADIGLSMGISGTEVAKESSDIIILDDDFTSVVKVVRWGRSVYANIQKFIQFQLTVNVAALVINVVAAVSSGDVPLNAVELLWVNLIMDTLGALALATEPPTDNLMKRNPVGRRHALYQVAILLIFDFAGVRILRLQNESRSDAEKITNTFIFNTFVFCQIFNEFNARKPEEKNVFKGVTKNHLFMGIIGITTVFQILIIQFLGKFFKIVRLDWRLWLVSVAIGLVSWPLAYLGKFIPVPVRPFPDYFKPRCCQKLSRRGESP

SEQ ID NO: 8719 - DNA, 1092 bp, Sorghum bicolor
  misc_feature: Ceres ANNOT ID no. 6091762
  misc_feature: Encodes the peptide sequence at SEQ ID NO 8720
atggaggctctcgcgggctccgcatcctcctccattctccccgcgcgccacccgccttcccgcgtggccgcgcagtccctcgcgctccgccctagccgctgcggtcccctccgcgcggccggcgccggcggtggcaaggacgatgcccagaccgcccccgctgccaacgggtctcccgtcctcaagctgaggagcaattcgagtcaaaatggagtcctaccgatcacggctgacaagtcgcagaaggcttcatcaaccagtgttagtactgactcaagtggatccagagctggcctgtttagaacacccatatcaggtggtgtgcagagtgcaactttcgcccatggtctgcctccgccggctttggctgttcgcaatttgatggaacaggcgcggtttgcccacctgtgctctgtcatgtctggcatgcatcatcgccgtactggatatccatttggttcactcgtcgactttgctaatgattcaatgggccacccaatattttcattgtcacccttagcaatccatacgaggaacttactcgctgacccaagatgtacgcttgttgtccaggtgcctggatggagtggactgtcgaacgcgcgagtcaccatatttggtgatgtttaccctttgccagctgaacaacaggaatgggcacataagcaatatgtagcaaaacatcagcagtgggcatcacagcagtggggaaatttttactattacaggatgcacaacataagtgacatatacttcatcgggggctttggaacagttgcatggatagatgttaaggagtatgaaactattcaacctgacaagatagcagttgatggtggtgacttgcaaagtttaaaggagttgaatgctattttttctaaaccacttcgagaagtcctatcatcagaaggggaggtcgatgatgctgctcttatatcagtagatagcaaaggcatagacatacgggttcgtcagggtgcacagttcaatattcagaggctagcatttgatgtccctcataaggttgagactctggaggaagccaagaaagcactacacaagataatcaaagacaagcagcaaataaagtga

SEQ ID NO: 8720 - protein, 363 aa, Sorghum bicolor
  misc_feature: Ceres ANNOT ID no. 6091762
  misc_feature (117)..(216): Pfam Id: Pyridox_oxidase Pfam Desc: Pyridoxamine 5'-phosphate oxidase
  misc_feature (101)..(357): NCBI GI: 116228192 NCBI Desc: pyridoxamine 5'-phosphate oxidase-related, fmn-binding [solibacter usitatus ellin6076]
  misc_feature (120)..(357): NCBI GI: 82400120 NCBI Desc: root border cell-specific protein-like protein [solanum tuberosum]
  misc_feature (125)..(358): NCBI GI: 75674547 NCBI Desc: pyridoxamine 5'-phosphate oxidase-related, fmn-binding [nitrobacter winogradskyi nb-255]
  misc_feature (139)..(325): NCBI GI: 146308700 NCBI Desc: pyridoxamine 5'-phosphate oxidase-related, fmn-binding [pseudomonas mendocina ymp]
  misc_feature (149)..(339): NCBI GI: 67156125 NCBI Desc: pyridoxamine 5'-phosphate oxidase [azotobacter vinelandii avop]
MEALAGSASSSILPARHPPSRVAAQSLALRPSRCGPLRAAGAGGGKDDAQTAPAANGSPVLKLRSNSSQNGVLPITADKSQKASSTSVSTDSSGSRAGLFRTPISGGVQSATFAHGLPPPALAVRNLMEQARFAHLCSVMSGMHHRRTGYPFGSLVDFANDSMGHPIFSLSPLAIHTRNLLADPRCTLVVQVPGWSGLSNARVTIFGDVYPLPAEQQEWAHKQYVAKHQQWASQQWGNFYYYRMHNISDIYFIGGFGTVAWIDVKEYETIQPDKIAVDGGDLQSLKELNAIFSKPLREVLSSEGEVDDAALISVDSKGIDIRVRQGAQFNIQRLAFDVPHKVETLEEAKKALHKIIKDKQQIK

SEQ ID NO: 8721 - DNA, 735 bp, Sorghum bicolor
  misc_feature: Ceres ANNOT ID no. 6091763
  misc_feature: Encodes the peptide sequence at SEQ ID NO 8722
atgacgggtggcggcgcggcggcggcggcgcaggcgtacggcgaggcctggtactgggacgagcgctaccgcaaggaggccgggcccttcgactggtaccagaagtacccggccctcgcgccgctgctccgcctctacgtcgcgccgcaccaacgccttctcctcgtcgggtgcggcaactccgtatttggtgaaaacatgatcgatgatggttatcaagatgttgtcaacatcgatatatcttctgtggtaattgagcaaatgaagaagaaataccacgataagcctcaacttaaatacatgaagatggatgtaaagaacatgtcagattttgggtctggttcatttgatgctgttattgacaaaggaacactagattctctcatgtgtggccaaaattcccaagagaatgcaacgaagatgctagaggaggtgaacagaatcctcaaggaaaatggtgtctacatgctgatcacttatggggatccaagttaccgcttgcgtctcttgaaggacatggaaaattggacagtaaagctccatgtcatagaaagatgggagaaaagctcaaaccagaataaatgggaactgacaaaaccattgcctttagatgacgatagcacatcactagttgcacttcttggcccgaaacctgatgtccactacatctatgtctgtgtaaagggcaacggtggcgcaagtgcgggttctaaagttggagaagctgccaattga

SEQ ID NO: 8722 - protein, 244 aa, Sorghum bicolor
  misc_feature: Ceres ANNOT ID no. 6091763
  misc_feature (54)..(157): Pfam Id: Methyltransf_11 Pfam Desc: Methyltransferase domain
  misc_feature (54)..(155): Pfam Id: Methyltransf_12 Pfam Desc: Methyltransferase domain
  misc_feature (13)..(240): NCBI GI: 146186037 NCBI Desc: protein kinase domain containing protein [tetrahymena thermophila sb210]
  misc_feature (13)..(230): NCBI GI: 66359066 NCBI Desc: methylase [cryptosporidium parvum]
  misc_feature (13)..(230): NCBI GI: 46228382 NCBI Desc: methylase [cryptosporidium parvum]
  misc_feature (13)..(230): NCBI GI: 67596256 NCBI Desc: p0700d12.13 [cryptosporidium hominis]
  misc_feature (13)..(230): NCBI GI: 54656980 NCBI Desc: p0700d12.13 [cryptosporidium hominis]
MTGGGAAAAAQAYGEAWYWDERYRKEAGPFDWYQKYPALAPLLRLYVAPHQRLLLVGCGNSVFGENMIDDGYQDVVNIDISSVVIEQMKKKYHDKPQLKYMKMDVKNMSDFGSGSFDAVIDKGTLDSLMCGQNSQENATKMLEEVNRILKENGVYMLITYGDPSYRLRLLKDMENWTVKLHVIERWEKSSNQNKWELTKPLPLDDDSTSLVALLGPKPDVHYIYVCVKGNGGASAGSKVGEAAN

SEQ ID NO: 8723 - DNA, 2982 bp, Sorghum bicolor
  misc_feature: Ceres ANNOT ID no. 6091787
  misc_feature: Encodes the peptide sequence at SEQ ID NO 8724
  misc_feature: Up-regulated in root tissues in response to salicylic acid treatment
atggctactgagagtgctgtccgattaattggtgggacaggggctagggactggagtaagggatttggtgcatttgactcttcagtgggtggcctttcaggggaagatttaggatttgtggataacggcactggggtttatgggggctggagcaaatctgttccaaatcgcagtggaagcgcaccacctagcatggaaggatctcttgctgctcttggccatctcattggccagcagagtgggagctttgaagctagtttggcaaccttggataacataactgacagttcgaagtctgaggagcaactacgtgctgatccagcatattttgagtattatggctccaaggtgaatctgaatccaaggctccctccgccacttatttcaagagagagccgccgattaatgaaccgtgttggcaaggctaaagagtggagggtagtctcccaagataacagcagcaaaggctcgatatatgttcctcgatctacactgtcaactcacaaagaagaaccggaggatgataaatctccaagattggattcaagttcagtggaggatgcccagattatctccagtgcatccaactttcagagccaggattttagtctggagagctttcaacagaatgctgcttctttgcctgatagttcatcttctaatccttcaaatagcaacactggtgattctatgcctgtatattctgacataaatttgtcaaggagtttgtcagttgatgctgtcaagcaatcggacctgaactcttggaaatcaaaaaacccactgaaaagtaatgttagcagtgacctttcatcgccgccccttcccagttcatcatattctggtagcaaaactggtatgcaaacttctcagcaagaaaaggcggctgtagacaccaaacatggaaatgttgtgcttggcagtggtgcagctgttactgaacttgataatgtggactccagtatgaagaatttgaagttaagtttggatggccatacatcctcacctgtgaagcagaggtggcaggacaatgtcttgcagcagtatggctcctttctccaagcccaaggtgatcctattcaaatgactactcaaggaccccatcttccccatataccttttgttgataacttgtctcatgctcagctcaagttacctgctggtgacttgcaccaatttttaccgcagcctagtatgacaacacctttctatacaccaaattcttttggaaacccttattatcagaatttgcaccctgctaatgcttttccaacctcaattggaactggtgggtacgctgtaagtggttccattttgccaccttttatggctggctatgctccccaaggtcctcttggtacacctcttgacagtcctatgactccaagctttagtggcaggccatctggatttcctccagcagggaatcttacagggggaacagattttatgcagtcatataaagtatacggacaacttggggctggtatgcagtcgtccattcctgatccaaacttcattcatttctttcagcatccctctttatttcagtatactagtggaaatcaatacaatacaatgggtccaagatttactgttgttgggaatccagctgaaagctttgatccacaaaagatgataccgcaagcagcatatccatctgatcagaggcttccacttccaagaactggctttcctaattctactacacccagaagagggactgttccaaattatcaaggcatatcatcctacgttggagtgccgatgacttatcctacaagtccagtgtttcagggacaaacgttgcctggagtattgcctcctggtaggagaaatgactctgttggatttcagtccccctcaagaaatatcactgatagtcctgggattcaagggcagcgagaaagacagaagtttgatgaatcaaagacctgctctttcttagaagagttaaagtccaacagagcacgcagggttgagctatctgacatcacaggtcgtatagttgaatacagtgctgaccaacatggtagccgattcatccagcagaagttggaaaactgcactgccgaagagaaggcagctgtgtttgcggaggttcttcctcatgcttcatcattaatgactgacgttttcgggaattacgtgatccaaaagttttttgaacatggaactcgtgagcaaaggagggatcttgccaccaaacttgttggtcatgttttgcctttgagtcttcagatgtatggctgccgtgtaattcagaaggctcttgaagttatggaacttgaccagaaaatagatctagttcatgagcttgatggacatgttatgcgatgtgtccgtgatcaaaatggaaatcatgttatacagaagtgcattgagtgtgtccccacagaacatattggttttgtagtatctgcttttcagggacaagttgctagcctttcaatgcacccatatggttgccgtgtaattcagagagttttggagcattgcggtggtaactcacaagggcagtgcataatagatgaaatattgcagtcggcgtgcatccttgcgcaagatcagtatggcaactatgttacacagcatgttctagaaagaggaaaagctcatgagaggagccaaattattactaaattggctgggcaggttgttaccatgagccaaaataaatttgcatcaaatgtgatagagaggtgttttcaacatggtgatattgcggagcgggatcttctgatcaggcagattgtggagcagacagagggcaatgacaatttgctggcaatgatgaaggaccagtatgctaattatgtggttcagaagatacttgaaacatgcaatgagaatcagcgggaactcctgctcagccgtgtaaagggtcatatgcaagcattgaggaagtacacatacggcaagcacattgtaagccgagttgagcagctctgtggtgatggaactgccgagtcggattcttga

SEQ ID NO: 8724 - protein, 993 aa, Sorghum bicolor
  misc_feature: Ceres ANNOT ID no. 6091787
  misc_feature (664)..(698): Pfam Id: PUF Pfam Desc: Pumilio-family RNA binding repeat
  misc_feature (700)..(734): Pfam Id: PUF Pfam Desc: Pumilio-family RNA binding repeat
  misc_feature (736)..(770): Pfam Id: PUF Pfam Desc: Pumilio-family RNA binding repeat
  misc_feature (772)..(806): Pfam Id: PUF Pfam Desc: Pumilio-family RNA binding repeat
  misc_feature (808)..(842): Pfam Id: PUF Pfam Desc: Pumilio-family RNA binding repeat
  misc_feature (845)..(879): Pfam Id: PUF Pfam Desc: Pumilio-family RNA binding repeat
  misc_feature (881)..(915): Pfam Id: PUF Pfam Desc: Pumilio-family RNA binding repeat
  misc_feature (923)..(957): Pfam Id: PUF Pfam Desc: Pumilio-family RNA binding repeat
  misc_feature (1)..(993): NCBI GI: 115477332 NCBI Desc: os08g0519800 [oryza sativa (japonica cultivar-group)]
  misc_feature (1)..(964): NCBI GI: 8071634 NCBI Desc: pumilio domain-containing protein ppd1 [populus tremula x populus tremuloides]
  misc_feature (1)..(993): NCBI GI: 115479929 NCBI Desc: os09g0497100 [oryza sativa (japonica cultivar-group)]
  misc_feature (411)..(991): NCBI GI: 62002537 NCBI Desc: puf-domain rna-binding protein [physcomitrella patens]
  misc_feature (379)..(987): NCBI GI: 87241276 NCBI Desc: nucleic acid binding nabp [medicago truncatula]
  misc_feature: Up-regulated in root tissues in response to salicylic acid treatment
MATESAVRLIGGTGARDWSKGFGAFDSSVGGLSGEDLGFVDNGTGVYGGWSKSVPNRSGSAPPSMEGSLAALGHLIGQQSGSFEASLATLDNITDSSKSEEQLRADPAYFEYYGSKVNLNPRLPPPLISRESRRLMNRVGKAKEWRVVSQDNSSKGSIYVPRSTLSTHKEEPEDDKSPRLDSSSVEDAQIISSASNFQSQDFSLESFQQNAASLPDSSSSNPSNSNTGDSMPVYSDINLSRSLSVDAVKQSDLNSWKSKNPLKSNVSSDLSSPPLPSSSYSGSKTGMQTSQQEKAAVDTKHGNVVLGSGAAVTELDNVDSSMKNLKLSLDGHTSSPVKQRWQDNVLQQYGSFLQAQGDPIQMTTQGPHLPHIPFVDNLSHAQLKLPAGDLHQFLPQPSMTTPFYTPNSFGNPYYQNLHPANAFPTSIGTGGYAVSGSILPPFMAGYAPQGPLGTPLDSPMTPSFSGRPSGFPPAGNLTGGTDFMQSYKVYGQLGAGMQSSIPDPNFIHFFQHPSLFQYTSGNQYNTMGPRFTVVGNPAESFDPQKMIPQAAYPSDQRLPLPRTGFPNSTTPRRGTVPNYQGISSYVGVPMTYPTSPVFQGQTLPGVLPPGRRNDSVGFQSPSRNITDSPGIQGQRERQKFDESKTCSFLEELKSNRARRVELSDITGRIVEYSADQHGSRFIQQKLENCTAEEKAAVFAEVLPHASSLMTDVFGNYVIQKFFEHGTREQRRDLATKLVGHVLPLSLQMYGCRVIQKALEVMELDQKIDLVHELDGHVMRCVRDQNGNHVIQKCIECVPTEHIGFVVSAFQGQVASLSMHPYGCRVIQRVLEHCGGNSQGQCIIDEILQSACILAQDQYGNYVTQHVLERGKAHERSQIITKLAGQVVTMSQNKFASNVIERCFQHGDIAERDLLIRQIVEQTEGNDNLLAMMKDQYANYVVQKILETCNENQRELLLSRVKGHMQALRKYTYGKHIVSRVEQLCGDGTAESDS

SEQ ID NO: 8725 - DNA, 1437 bp, Sorghum bicolor
  misc_feature: Ceres ANNOT ID no. 6091794
  misc_feature: Encodes the peptide sequence at SEQ ID NO 8726
atgctgtgccgcggccgccgccgtccggggctgtggcgttggccggtggagctgcggcggctgtcccggctggctccgccggcgcctgcggctgccgacccggtggtggtccgcgtggacgccagcaacgtcgcgcggttggggccgcccaagcccgggccgaggccgcggcagctgctctcgctgccggcgttccccgcagggctggaccctctcccgggaaggaaggcggcgccgcgtcgcgtgacggtggtgagctgggtgaagcactacttcgccgacgtgccgcacgaggctgtgcaggcgcacttcaacaggagaacggttttttctgagtgctctgaccacgaggtttcagctgacagcattcgaactcagaagcatcatctgaaaaagattaaacataatgatgctatggagcctggaatgagaattcaccttcctgtttcagtggctgagggcgagataaagaagcgttatgagaccattccgactgccacattgcatcctaataaagatgagattgagtacctgaggaggcttgttatccacagggactctgctatattggtgcttaacaagccccccaaagtgcccatgaaaggacatttgccagtacataacagcatggatgtgcttgcagctgcagcactgtcatatggaaacaaagagggtccgaaattggtccatcgattggacagagaaagcagcggtttgattttgatgggcagaacaaaagaaagttttactcggctgcactggcttttcactagtgtaaatttagctagaacatcttctcagacatggaataaagcctgtgaagcatacgtgcagaagtattgggcactagtcattggtactcctaaagaaagggaaggagttatatgtgctcctatctcaaaggtacttcttgatgacgggaaagctgagagggtcattctggcacatccttctggcatagatggcgcacaagaggcaataacagagtatcgggtgatgggaccaaccatcaacgggtgctcatggatcgagctacgcccattaactgggcggaagcaccagctccgagtccactgtgccgaagccctcggcactcccattgtcggggattacaaatatggttggtttgtgcaccaaacatggaagcaaaatccccagcctgactttgagccgttcactggagagccatacaagctgagacggccagaaggcttggagattcagaagggcagtgttctgtcaaaagtccctttgctacacctgcattgccgggagatggtcatccccaacattgcaaagttcctgagcagcactggagaatggcacgaaaacggcgccccatgggccaaggagaaacccaatctcctaagattcgtcgcaccaatgcctccacacatgaaaattagttggaatataatgtcttcatacctagtgtaa

SEQ ID NO: 8726 - protein, 478 aa, Sorghum bicolor
  misc_feature: Ceres ANNOT ID no. 6091794
  misc_feature (188)..(361): Pfam Id: PseudoU_synth_2 Pfam Desc: RNA pseudouridylate synthase
  misc_feature (1)..(478): NCBI GI: 115477338 NCBI Desc: os08g0520100 [oryza sativa (japonica cultivar-group)]
  misc_feature (16)..(478): NCBI GI: 53850479 NCBI Desc: at1g78910 [arabidopsis thaliana]
  misc_feature (83)..(354): NCBI GI: 51091882 NCBI Desc: ribosomal large subunit pseudouridine synthase c-like [oryza sativa (japonica cultivar-group)]
  misc_feature (103)..(374): NCBI GI: 126461165 NCBI Desc: pseudouridine synthase, rlua family [rhodobacter sphaeroides atcc 17029]
  misc_feature (103)..(374): NCBI GI: 146278539 NCBI Desc: pseudouridine synthase, rlua family [rhodobacter sphaeroides atcc 17025]
MLCRGRRRPGLWRWPVELRRLSRLAPPAPAAADPVVVRVDASNVARLGPPKPGPRPRQLLSLPAFPAGLDPLPGRKAAPRRVTVVSWVKHYFADVPHEAVQAHFNRRTVFSECSDHEVSADSIRTQKHHLKKIKHNDAMEPGMRIHLPVSVAEGEIKKRYETIPTATLHPNKDEIEYLRRLVIHRDSAILVLNKPPKVPMKGHLPVHNSMDVLAAAALSYGNKEGPKLVHRLDRESSGLILMGRTKESFTRLHWLFTSVNLARTSSQTWNKACEAYVQKYWALVIGTPKEREGVICAPISKVLLDDGKAERVILAHPSGIDGAQEAITEYRVMGPTINGCSWIELRPLTGRKHQLRVHCAEALGTPIVGDYKYGWFVHQTWKQNPQPDFEPFTGEPYKLRRPEGLEIQKGSVLSKVPLLHLHCREMVIPNIAKFLSSTGEWHENGAPWAKEKPNLLRFVAPMPPHMKISWNIMSSYLV

SEQ ID NO: 8727 - DNA, 1344 bp, Sorghum bicolor
  misc_feature: Ceres ANNOT ID no. 6091796
  misc_feature: Encodes the peptide sequence at SEQ ID NO 8728
atgaacggcgccgggggcagccaccaccagcagcagcagcagaggctccggcagcagcagcagcagcaggcgctcctgatgcagcaggcgctgcagcagcagcagcagtaccagtccggcgtcctcgccgccgcggcagcggcggccatgacccagatggaacctatttccaatggcaaccttccacctgggtttgatccttccacttgtcgcagtgtgtatgttggaaatgtgaaccctaacgtcacggagagccttttgattgaagttttccagagtgctggccttgtggaaagatgcaagctcatacggaaagagaagtcttcctttgggtttgtggactactatgatcgaagatctgctgctctagcaatcatgacccttcatggccgtcacatatatggacaagcaatcaaggtgaactgggcatatgcaagtacgcagagggaggatacatcagggcatttccatatttttgttggtgatttaagttctgaagtgaatgatgcaactctttatgcctgtttctcagcatatccttcttgttccgatgctcgagtcatgtgggacaacaaaactggacgctccaggggttatggttttgtctccttccgtaatcaacaggaagctgaaactgctataacagaaatgactggaaaatggcttggaagcagacaaataaggtgcaactgggcaacaaagaacaattcagaagagaaaccagaaactgacaatcataatgcagttgtactaacaaatggtagctccagcaattcagcaacggatgcaagccaggatggaggaagtaaagagaacccagagaacaatcctgattgcactactgtatatgttggcaacctcggacatgaggttaaccgggatgagcttcaccgccacttctatagcttgggggtcggggcaatcgaggaaatccgtgttcaacaggataaagggtttgggtttgtgagatatagcacccatggggaagcagcattagctattcagatgggcaatggattggtagtccgtgggaaaccaattaagtgctcatggggtaacaaaccaactccacctgggacaagttccaagcccctacctcctccagttgctccataccagcctgctgtagcaatgccaggtgtcccgcaaggtttcacagcagcagaacttcttgcttatcagaggcagcttgccttaagccaggctgcagccgggcagattgctggccagcatggtctcgcgggtcaggtttctgcaggtcttcttgctgctgctggttcccaggccctctacgatggctacccaaaccagtcatcagcccagcagcttatgtactacaactag

SEQ ID NO: 8728 - protein, 447 aa, Sorghum bicolor
  misc_feature: Ceres ANNOT ID no. 6091796
  misc_feature (73)..(140): Pfam Id: RRM_1 Pfam Desc: RNA recognition motif. (a.k.a. RRM, RBD, or RNP domain)
  misc_feature (158)..(229): Pfam Id: RRM_1 Pfam Desc: RNA recognition motif. (a.k.a. RRM, RBD, or RNP domain)
  misc_feature (282)..(349): Pfam Id: RRM_1 Pfam Desc: RNA recognition motif. (a.k.a. RRM, RBD, or RNP domain)
  misc_feature (12)..(446): NCBI GI: 82400162 NCBI Desc: oligouridylate binding protein-like protein [solanum tuberosum]
  misc_feature (12)..(406): NCBI GI: 6996560 NCBI Desc: oligouridylate binding protein [nicotiana plumbaginifolia]
  misc_feature (26)..(430): NCBI GI: 92891800 NCBI Desc: rna-binding region rnp-1 (rna recognition motif) [medicago truncatula]
  misc_feature (184)..(445): NCBI GI: 4680498 NCBI Desc: tia-1 related protein [oryza sativa]
  misc_feature (52)..(220): NCBI GI: 8778484 NCBI Desc: f1l3.2 [arabidopsis thaliana]
  misc_feature: Useful for making plants with altered Lignin content
  misc_feature: Functional homolog of the protein sequence given in SEQ ID NO 12901
  misc_feature: Useful for making plants with altered lignin content
  misc_feature: Functional homolog of the protein sequence given in SEQ ID NO 12901
  misc_feature: The sequence is a functional homolog of SEQ ID NO. 339 in the 11/188,298 US application
  misc_feature: The sequence is a functional homolog of SEQ ID NO. 458 in the 11/188,298 US application
MNGAGGSHHQQQQQRLRQQQQQQALLMQQALQQQQQYQSGVLAAAAAAAMTQMEPISNGNLPPGFDPSTCRSVYVGNVNPNVTESLLIEVFQSAGLVERCKLIRKEKSSFGFVDYYDRRSAALAIMTLHGRHIYGQAIKVNWAYASTQREDTSGHFHIFVGDLSSEVNDATLYACFSAYPSCSDARVMWDNKTGRSRGYGFVSFRNQQEAETAITEMTGKWLGSRQIRCNWATKNNSEEKPETDNHNAVVLTNGSSSNSATDASQDGGSKENPENNPDCTTVYVGNLGHEVNRDELHRHFYSLGVGAIEEIRVQQDKGFGFVRYSTHGEAALAIQMGNGLVVRGKPIKCSWGNKPTPPGTSSKPLPPPVAPYQPAVAMPGVPQGFTAAELLAYQRQLALSQAAAGQIAGQHGLAGQVSAGLLAAAGSQALYDGYPNQSSAQQLMYYN

SEQ ID NO: 8729 - DNA, 582 bp, Sorghum bicolor
  misc_feature: Ceres ANNOT ID no. 6091797
  misc_feature: Encodes the peptide sequence at SEQ ID NO 8730
atggtgatggtgtcaggcggcggggggaacgcatgggcgaaggagatgaccatccgccgcaggatagccagcatattcaacaagacgcaggaacatttccctactctgaaggattacaacgattatctagaagaagttgaggatatgactttcaacctgattgaagggatagatgtcgaggcgattgaagcaaaaattgcaagatatcaacaggaaaatgcggagcagatatacttgtccagagctaaaagggcagaagatcttgcagcagcacttaaagcaagcaggatgaaccctgtaaagaccgaggccaatgatacggctgctgggagttctcagggtattagtggcggggcaggagttcagggccagtatgcacctgccgccgttcttgggggagtggctcagcctcgccccacaggtatggctccccaactaatcggcagtcggtcagaccctcaaggagatgacgaggagaccaggagactacgcgcagagcgagcagcacgagctggcggatggactgctgagttgagtaagagaagagcgctggaggaggcgtttagcgccatatttatctag

SEQ ID NO: 8730 - protein, 193 aa, Sorghum bicolor
  misc_feature: Ceres ANNOT ID no. 6091797
  misc_feature (14)..(192): Pfam Id: MAT1 Pfam Desc: CDK-activating kinase assembly factor MAT1
  misc_feature (10)..(193): NCBI GI: 92877889 NCBI Desc: cdk-activating kinase assembly factor (mat1) [medicago truncatula]
  misc_feature (26)..(193): NCBI GI: 7269983 NCBI Desc: puative protein [arabidopsis thaliana]
  misc_feature (14)..(89): NCBI GI: 1708933 NCBI Desc: cdk-activating kinase assembly factor mat1 (ring finger protein mat1) (menage a trois) (cdk7/cyclin h assembly factor)
  misc_feature (14)..(96): NCBI GI: 7444286 NCBI Desc: cyclin g1 interacting protein - human
  misc_feature (14)..(96): NCBI GI: 119601194 NCBI Desc: menage a trois homolog 1, cyclin h assembly factor (xenopus laevis), isoform cra_b [homo sapiens]
MVMVSGGGGNAWAKEMTIRRRIASIFNKTQEHFPTLKDYNDYLEEVEDMTFNLIEGIDVEAIEAKIARYQQENAEQIYLSRAKRAEDLAAALKASRMNPVKTEANDTAAGSSQGISGGAGVQGQYAPAAVLGGVAQPRPTGMAPQLIGSRSDPQGDDEETRRLRAERAARAGGWTAELSKRRALEEAFSAIFI

SEQ ID NO: 8731 - DNA, 1077 bp, Sorghum bicolor
  misc_feature: Ceres ANNOT ID no. 6091824
  misc_feature: Encodes the peptide sequence at SEQ ID NO 8732
atgtcttctcaggtggacagccgcagccaatccgccgggaagcgcgcgcgcaccgacggcagccggcgtgaggacgactgggtttgccccagctgcaagaacgtcaacttcgccttccgcaccacttgcaacatgcgcagctgtaaccagtccaggccagcagatcacacggccatgcagaagcctatgcagaccccgcctcactatcccgcatcagggggctacatgggcccagggacgccaccgtcgatgtaccttggtgggggtgctcccccatatggctcctcaatgtttaacgggcctgcaatgccacgctatggcatcccacagtaccctgggggttctgcgtatccatatggatatggtggtcgcataccaatggggagcccctacgggccaatgcaaatggctgggccaactccatactctggtggatctatgatgggagcaggtggaatgtatggaatgcccatggacaggtatgggccaatacctgttggtcctggtccaatgggcacaagggctggctcatattctgatgaaggttctcagaagaagcctgcaggagctggccgtgataatgattgggagtgtccaaattgccacaacatcaactttggctttcgcacagtctgtaatatgagaaagtgcaacacacctagacctgaaaaccagggatctaagcccgatggtttaagaggctcaaaaccaaagatgccagagggcagttggaagtgtgagcagtgcaataatataaactatcctttccgaacaaagtgcaatcgtccccaatgtggagcagaaaagccatcacagacaaacaatgtaaatgattcagcgacagatcaggacaatcagtttttgtcatgtaacattacgaagcttttatcaaagctacgacttctgcatgaatttcaagacagcagtgagcagacagatggatcttcctggtcctactgccgaagtaccgacattacagcagtgagcagacagatggatcttcctggtcctactgccagagtaccgacattgcggatggcagcactcagtgaattgcagaacaatcttacaaactga

SEQ ID NO: 8732 - protein, 358 aa, Sorghum bicolor
  misc_feature: Ceres ANNOT ID no. 6091824
  misc_feature (240)..(271): Pfam Id: zf-RanBP Pfam Desc: Zn-finger in Ran binding protein and others
  misc_feature (1)..(356): NCBI GI: 42407323 NCBI Desc: p53 binding protein-like [oryza sativa (japonica cultivar-group)]
  misc_feature (1)..(356): NCBI GI: 42407324 NCBI Desc: p53 binding protein-like [oryza sativa (japonica cultivar-group)]
  misc_feature (1)..(286): NCBI GI: 42407325 NCBI Desc: p53 binding protein-like [oryza sativa (japonica cultivar-group)]
  misc_feature (45)..(285): NCBI GI: 9828626 NCBI Desc: f1n21.14 [arabidopsis thaliana]
  misc_feature (183)..(271): NCBI GI: 18698995 NCBI Desc: p53 binding protein [oryza sativa]
MSSQVDSRSQSAGKRARTDGSRREDDWVCPSCKNVNFAFRTTCNMRSCNQSRPADHTAMQKPMQTPPHYPASGGYMGPGTPPSMYLGGGAPPYGSSMFNGPAMPRYGIPQYPGGSAYPYGYGGRIPMGSPYGPMQMAGPTPYSGGSMMGAGGMYGMPMDRYGPIPVGPGPMGTRAGSYSDEGSQKKPAGAGRDNDWECPNCHNINFGFRTVCNMRKCNTPRPENQGSKPDGLRGSKPKMPEGSWKCEQCNNINYPFRTKCNRPQCGAEKPSQTNNVNDSATDQDNQFLSCNITKLLSKLRLLHEFQDSSEQTDGSSWSYCRSTDITAVSRQMDLPGPTARVPTLRMAALSELQNNLTN

SEQ ID NO: 8733 - DNA, 1002 bp, Sorghum bicolor
  misc_feature: Ceres ANNOT ID no. 6091834
  misc_feature: Encodes the peptide sequence at SEQ ID NO 8734
atggagctcaccaacatcccctatattgcgtcatcttcctcgtccagctgcttctactacagctacagtcgctgtggctgcagagttagaagagatgggaagctggtaataaaagcttctatagctggtagtaagcatgctgctgattcagtatgttcacaactttttgagcaggaaactgaagatcccctttcagttgctagatcttcctggcatataagaaggagagacttggcttctgccattttactcccttttctgcttcctcgtgttaacatctccatcgcggctgagatatatgatgcatcaattattcgaagtggtgttaggaatattttaaccaaggccaaggctgctggtgtgcttcgattggttttccatgatgcagggactttcgaaattggtggcaaatcaggtggcatgaatggctctataatttatgaagttgacagacctgaaaatactgggctaaatagatccataaagatactaacaaaagcaaaagaaggaattgacaacgttcagaaagtgtcatgggcggatttgattgccgtggctggtgctgaggctgttgcgctctgtggtgggcctgagattccagtaaggctaggaagattagattctagcactgctgatccaactggtaaacttcctgaagaaacattggatgcaacttccttaaaaacattattcaacaagaagggcttttcggcgcaggagatggttgttttatctggagcgcacacaattggaggtaaaggattcgggagtccaattgttttcgataacacctatttcaaggtgctccttgagaagccgcaaacatcttcgactggcatggcggcaatggttgggctgcgcacggactgggcactcaccgaagatgacgagtgcttaagatggatcagggtctatgcagaggaccaagctagatttttcgatgacttcagggatgcatacatcaagctcgtagacagtggagcctcgtggagaacagcttaa

SEQ ID NO: 8734 - protein, 333 aa, Sorghum bicolor
  misc_feature: Ceres ANNOT ID no. 6091834
  misc_feature (105)..(308): Pfam Id: peroxidase Pfam Desc: Peroxidase
  misc_feature (177)..(275): NCBI GI: 7270136 NCBI Desc: l-ascorbate peroxidase-like protein [arabidopsis thaliana]
  misc_feature (101)..(327): NCBI GI: 53748453 NCBI Desc: ascorbate peroxidase [plantago major]
  misc_feature (109)..(327): NCBI GI: 91806409 NCBI Desc: l-ascorbate peroxidase 1b [arabidopsis thaliana]
  misc_feature (109)..(327): NCBI GI: 1523789 NCBI Desc: l-ascorbate peroxidase [arabidopsis thaliana]
  misc_feature (106)..(327): NCBI GI: 92878898 NCBI Desc: haem peroxidase, plant/fungal/bacterial [medicago truncatula]
MELTNIPYIASSSSSSCFYYSYSRCGCRVRRDGKLVIKASIAGSKHAADSVCSQLFEQETEDPLSVARSSWHIRRRDLASAILLPFLLPRVNISIAAEIYDASIIRSGVRNILTKAKAAGVLRLVFHDAGTFEIGGKSGGMNGSIIYEVDRPENTGLNRSIKILTKAKEGIDNVQKVSWADLIAVAGAEAVALCGGPEIPVRLGRLDSSTADPTGKLPEETLDATSLKTLFNKKGFSAQEMVVLSGAHTIGGKGFGSPIVFDNTYFKVLLEKPQTSSTGMAAMVGLRTDWALTEDDECLRWIRVYAEDQARFFDDFRDAYIKLVDSGASWRTA

SEQ ID NO: 8735 - DNA, 1176 bp, Sorghum bicolor
  misc_feature: Ceres ANNOT ID no. 6091836
  misc_feature: Encodes the peptide sequence at SEQ ID NO 8736
atggtgaaggatacgcgctactacgacgtgctgggcgtggacccgtccgccaccgagtccgagatcaagaaggcgtactacgtcaaggcgaggctggtccaccccgataagaacccgaatgatcctcaggcagcggagaagttccaggaactaggagaagcataccaagttctcagtgaccccacacaacgccaagcctatgactcacatgggaaagacggcatctcaacggaaggaattattgatccagcagcgatttttgcaatgctatttggtagtgagctttttgaggattacattggtcaactggcaatggcatcaatggcttcacttgataattttggtgaagatgagcagattgatgcaaaaaagctgcaagagagaatgcaggctgttcaaaaggaacgggaagagaaacttgcagagtcactgaaaaaccggctacacatttatgttcaaggaaatagggatgaattcatccagcatgctgaagcagaggtgtccaaacttagcaatgcagcatatggaattgttatgttgaacactattggctatgtatattcaaggcaagctgcaaaagaacttggaaagaaagcaatgtttttgggggttccatttattgctgaatggtttagagacaaagggcattttatcaaatcccaagtaacagctgccacaggtgcaatagcgcttatgcagttgcaagaggacttgaggaagtatatgagtgccgagggccagtacacagaggaggaacttgaaatgtacatggaaaaccacaagaaaatcatggttgattccttgtggaagcttaacgttgcggacatagaagccacattatcccatgtctgtcaaatggtacttcaagacagtagtgccaggaaggaggaattgcgccttcgtgctaaaggcttaaaaactttaggaagaattttccagcgggtggttaagctcaaccctagcgagggagaaacatcacaagtgaagaatatagacaacatggacgacaatgatggcagctcccctgactcatccccaaagagggaggcacagttcactcctaatcagcctcctgtcccgagcccatatgtggaggcacctcatgttaacggagtctattgtccgttcccaatgccagcagctccacctggtgcgcagagggatcgaatcccatga

SEQ ID NO: 8736 - protein, 391 aa, Sorghum bicolor
  misc_feature: Ceres ANNOT ID no. 6091836
  misc_feature (6)..(68): Pfam Id: DnaJ Pfam Desc: DnaJ domain
  misc_feature (1)..(391): NCBI GI: 42407725 NCBI Desc: dnaj protein family-like [oryza sativa (japonica cultivar-group)]
  misc_feature (1)..(391): NCBI GI: 115479909 NCBI Desc: os09g0493800 [oryza sativa (japonica cultivar-group)]
  misc_feature (1)..(387): NCBI GI: 57340266 NCBI Desc: dnaj-like protein [brassica juncea]
  misc_feature (1)..(391): NCBI GI: 2230757 NCBI Desc: dnaj-like protein [arabidopsis thaliana]
  misc_feature (1)..(354): NCBI GI: 30699227 NCBI Desc: dnaj heat shock n-terminal domain-containing protein [arabidopsis thaliana]
  misc_feature: Useful for making plants with modulated heat sensitivity
  misc_feature: Functional homolog of the protein sequence given in SEQ ID NO 13683
MVKDTRYYDVLGVDPSATESEIKKAYYVKARLVHPDKNPNDPQAAEKFQELGEAYQVLSDPTQRQAYDSHGKDGISTEGIIDPAAIFAMLFGSELFEDYIGQLAMASMASLDNFGEDEQIDAKKLQERMQAVQKEREEKLAESLKNRLHIYVQGNRDEFIQHAEAEVSKLSNAAYGIVMLNTIGYVYSRQAAKELGKKAMFLGVPFIAEWFRDKGHFIKSQVTAATGAIALMQLQEDLRKYMSAEGQYTEEELEMYMENHKKIMVDSLWKLNVADIEATLSHVCQMVLQDSSARKEELRLRAKGLKTLGRIFQRVVKLNPSEGETSQVKNIDNMDDNDGSSPDSSPKREAQFTPNQPPVPSPYVEAPHVNGVYCPFPMPAAPPGAQRDRIP

SEQ ID NO: 8737 - DNA, 1785 bp, Sorghum bicolor
  misc_feature: Ceres ANNOT ID no. 6091851
  misc_feature: Encodes the peptide sequence at SEQ ID NO 8738
atgccgacggtgagcgtcggccgggaccgtctcttcgccgccctcggtcggacctacacacaggaggaattcgaggcgctctgcttcgagttcggcatcgagctcgacgacgtgacgacggagaaggctattatcaggaaggagaagcacctcgaggacgacggcgaggtggacgacgatgacgaggtcatctacaagatagaggttgccgccaacaggtatgatttgctatgtcttgagggattagcaagagcactccgtgttttcacggggactgaagcgagtcctgtattccaagtttcatccatccctcgtggttcaattcttcagatgcatgttaaaccagagacttcaaaaattagaccatacgtagtttgtgctgtgctaagaggggtaacttttgatgaagcaagatacaacagcttcattgatcttcaagacaaactccaccaaaatatctgccggaagagaactctcgttgctattggcacccatgatctggacactctgcaaggacccttctcatatgaggctctaccaccacatgaaatcaactttgtcccattaaagcaggagaaaagcttcagagctgataagctgatggaattctataaatcagacatgaaactgaagaagttcttgcatataattgaaaattctccagtgtacccagttatctatgatagcaacaggactgtattatcattacctcctatcatcaatggtgcacattcagctatcacccttgcaacaaggaatgtctttattgaatgtacagctactgaccttaccaaagcaaatatagtgctgaatacaatggttaccatgttctctgagtattgtgagactaaatttgaagcggaacctgttgaagtggtacatcatgatggcaggaaaacagtttaccctgatctttcatgttacaaaatggatgtttcactatctgacattcttgggcctattggtatctcccaggacgagaaacaggttgtctgtcttttgaataaaatgcaactgcaagctgaaagtcgctcattgaagggggagccttgcatttcagtgtctgttcctccaacaagaagtgatattctgcatgcccgtgatttgtcggaggatgttgctatagcttatggattcaacaatgtgccaaaatcaaagccgaagtgtatgacaataggaggaaggcaaccattaaacaggttctcagataaaattcgtgccgaggttgcaagagctggttatatggaggtgctcacatttatcttgtcttcacacgaagaaaactttgacatgttaaacagagcagacgacaaaagtaaagcagtcattatcgcaaaccctcgcacttctgaattcgaggttgttagaactagtctgatgtcgtgtttattgaaaacactgaaacataatatagatcatccaagacctataaagattttcgaagttggtgatgtcgtgatgctggactcgtcacgtgatgttggtgcctctaataatcgcaggcttgcagctttgtactgcaatagggtttctggatttgaggaaattatgggattggtggatagtattgtcaaagttgtcagagctccgcatgtcaactttggcaagaattattatgtacctacagatgaacctgagttcttcccaaaaagacaatgtaaaattgttacaagtgatggcaagcaagttggctacttaggaattgtccatgctgaggtgctaaggaaatttggcattccggatccctgcactttcgttgagatggaccttgaagcactgttgtaa

SEQ ID NO: 8738 - protein, 594 aa, Sorghum bicolor
  misc_feature: Ceres ANNOT ID no. 6091851
  misc_feature (307)..(379): Pfam Id: B5 Pfam Desc: tRNA synthetase B5 domain
  misc_feature (120)..(282): Pfam Id: B3_4 Pfam Desc: B3/4 domain
  misc_feature (1)..(594): NCBI GI: 92878505 NCBI Desc: b3/4 [medicago truncatula]
  misc_feature (1)..(572): NCBI GI: 30698883 NCBI Desc: trna synthetase beta subunit family protein [arabidopsis thaliana]
  misc_feature (1)..(594): NCBI GI: 55715799 NCBI Desc: zgc:92055 [danio rerio]
  misc_feature (1)..(591): NCBI GI: 21355211 NCBI Desc: cg5706-pa [drosophila melanogaster]
  misc_feature (1)..(591): NCBI GI: 55240977 NCBI Desc: ensangp00000010460 [anopheles gambiae str. pest]
  misc_feature (1)..(594): SWISSPROT Homolog: EC 6.1.1.20 Phenylalanyl-tRNA synthetase beta chain
MPTVSVGRDRLFAALGRTYTQEEFEALCFEFGIELDDVTTEKAIIRKEKHLEDDGEVDDDDEVIYKIEVAANRYDLLCLEGLARALRVFTGTEASPVFQVSSIPRGSILQMHVKPETSKIRPYVVCAVLRGVTFDEARYNSFIDLQDKLHQNICRKRTLVAIGTHDLDTLQGPFSYEALPPHEINFVPLKQEKSFRADKLMEFYKSDMKLKKFLHIIENSPVYPVIYDSNRTVLSLPPIINGAHSAITLATRNVFIECTATDLTKANIVLNTMVTMFSEYCETKFEAEPVEVVHHDGRKTVYPDLSCYKMDVSLSDILGPIGISQDEKQVVCLLNKMQLQAESRSLKGEPCISVSVPPTRSDILHARDLSEDVAIAYGFNNVPKSKPKCMTIGGRQPLNRFSDKIRAEVARAGYMEVLTFILSSHEENFDMLNRADDKSKAVIIANPRTSEFEVVRTSLMSCLLKTLKHNIDHPRPIKIFEVGDVVMLDSSRDVGASNNRRLAALYCNRVSGFEEIMGLVDSIVKVVRAPHVNFGKNYYVPTDEPEFFPKRQCKIVTSDGKQVGYLGIVHAEVLRKFGIPDPCTFVEMDLEALL

SEQ ID NO: 8739 - DNA, 414 bp, Sorghum bicolor
  misc_feature: Ceres ANNOT ID no. 6091852
  misc_feature: Encodes the peptide sequence at SEQ ID NO 8740
atggcgtcgccatccatcggctgcccctcctccgccccgactgctctctccgcgggagccggcgcgcgccgaccgccgtcctgcgtccacctgttgtgccaccgccaccagcagcatcggtcgaggcgagtggtgatggcggcagcgaggcggcggtacagggggacggtgaggagggaggcggcgctggcggagctggtggagcggaaagtggcggaggcgatggaggcgtgcggggagcgcgggcaggaccgcgacgacgaggggtgccgcgtggcgtgggacgaggtggaggaggtgagccaggccagggccgacctccggcgccgcatcgccgaggcccccggcgacccgctcgagcacttctgcgcgcacaaccccaccgccgacgactgcgccgtcgtctacgagtga

SEQ ID NO: 8740 - protein, 137 aa, Sorghum bicolor
  misc_feature: Ceres ANNOT ID no. 6091852
  misc_feature (63)..(138): Pfam Id: CP12 Pfam Desc: CP12 domain
  misc_feature (6)..(137): NCBI GI: 87331070 NCBI Desc: cp12 [marchantia polymorpha]
  misc_feature (1)..(137): NCBI GI: 87331089 NCBI Desc: cp12 [mesostigma viride]
  misc_feature (41)..(137): NCBI GI: 121077663 NCBI Desc: calvin cycle protein cp12 [volvox carteri f. nagariensis]
  misc_feature (60)..(132): NCBI GI: 21555170 NCBI Desc: cp12 protein precursor-like protein [arabidopsis thaliana]
  misc_feature (63)..(132): NCBI GI: 25990286 NCBI Desc: chloroplast protein 12 [nicotiana tabacum]
MASPSIGCPSSAPTALSAGAGARRPPSCVHLLCHRHQQHRSRRVVMAAARRRYRGTVRREAALAELVERKVAEAMEACGERGQDRDDEGCRVAWDEVEEVSQARADLRRRIAEAPGDPLEHFCAHNPTADDCAVVYE

SEQ ID NO: 8741 - DNA, 1314 bp, Sorghum bicolor
  misc_feature: Ceres ANNOT ID no. 6091853
  misc_feature: Encodes the peptide sequence at SEQ ID NO 8742
atgtcggggcccgacgccgacgccgatgccatcgccatcgccatcgccgcggcgacggatccctccccggccccggccccggcaccgccggtggtcgagtggcccgagggcggcgcgctgacgccggactgggtggcggggctggaatccacgctggactggtgctcgcggcacctccccgcggatcggctcccgtcggtgctgccggccgcgctggtccagcgcctggtcttggccgccgccgccatcctgcaccgcgagcccaacctcatccgcgtcgacccgcgccccggccagtccgttgtcgtcgtcggggacgtccacggccagctccacgacgtcatcttcctactccgcgacgccgggttcccgtccgaggaacgcatcttcgtcttcaacggcgactatgtcgaccgcggcgcctggggcgtcgaaaccttcttgctcctcctcgcctggaaggtgctactcccgaattgtgtgtttcttctccggggaaaccacgaatccaagtactgcacatcagtatatggtttcgagaaggaggtaatggctaaatacaaagatcagggccctcaagtttataggaagtttttaagatgtttcgaggaccttcctctagcgacaataatagcaggatgtgtgtacactgcacatggaggtgtcttccgtggaacaattgtagtgccatcaaaaaaatcaaaaaagggaaagaagggccgcaaatataaggcagattttactgttgatctgaattccataaaacttggatccttggatgagttactgaaagcaaggagaactgttctagaccctccctgggaaggcacaaatctgatccctggagatgtgctctggtctgacccttccttgcagatgggtctttctccaaataaagaacgaggcattggtttgctttggggtcctgatatcactcaacagtttctgcagacaaatcatttgaagctaatcatcaggtcacatgaaggtcctgacgcaagagacaagcgacatgatctcttagaaatggataatggatatacaattgatcatgaagtagaatgtggaaaactaatcactctcttcagtgcaccggactacccacaatttcaggcttcagaggagcgacataacaatcgtggagcatatattgtccttaatccacctgattttgcgacccctgttttccacagctttgaagctgtaaagcctcgacctgcggcgcatccattctatgattttgaagaagtgatcgactcagatgaagagttgaatttggacgccatggacagtggcacgtcgggcttgtcatga

SEQ ID NO: 8742 - protein, 437 aa, Sorghum bicolor
  misc_feature: Ceres ANNOT ID no. 6091853
  misc_feature (99)..(332): Pfam Id: Metallophos Pfam Desc: Calcineurin-like phosphoesterase
  misc_feature (17)..(429): NCBI GI: 92887306 NCBI Desc: serine/threonine-specific protein phosphatase and bis(5-nucleosyl)-tetraphosphatase [medicago truncatula]
  misc_feature (29)..(431): NCBI GI: 10177675 NCBI Desc: ser/thr protein phosphatase catalytic subunit-like protein [arabidopsis thaliana]
  misc_feature (29)..(431): NCBI GI: 2791900 NCBI Desc: pp7 [arabidopsis thaliana]
  misc_feature (34)..(434): NCBI GI: 15221080 NCBI Desc: calcineurin-like phosphoesterase family protein [arabidopsis thaliana]
  misc_feature (34)..(434): NCBI GI: 8778513 NCBI Desc: f21d18.16 [arabidopsis thaliana]
MSGPDADADAIAIAIAAATDPSPAPAPAPPVVEWPEGGALTPDWVAGLESTLDWCSRHLPADRLPSVLPAALVQRLVLAAAAILHREPNLIRVDPRPGQSVVVVGDVHGQLHDVIFLLRDAGFPSEERIFVFNGDYVDRGAWGVETFLLLLAWKVLLPNCVFLLRGNHESKYCTSVYGFEKEVMAKYKDQGPQVYRKFLRCFEDLPLATIIAGCVYTAHGGVFRGTIVVPSKKSKKGKKGRKYKADFTVDLNSIKLGSLDELLKARRTVLDPPWEGTNLIPGDVLWSDPSLQMGLSPNKERGIGLLWGPDITQQFLQTNHLKLIIRSHEGPDARDKRHDLLEMDNGYTIDHEVECGKLITLFSAPDYPQFQASEERHNNRGAYIVLNPPDFATPVFHSFEAVKPRPAAHPFYDFEEVIDSDEELNLDAMDSGTSGLS

SEQ ID NO: 8743 - DNA, 1122 bp, Sorghum bicolor
  misc_feature: Ceres ANNOT ID no. 6091858
  misc_feature: Encodes the peptide sequence at SEQ ID NO 8744
atggaggtgaggtccgagcaagggctgatggcagggagggatctattcggcatgccgaagagcccgccggcgccggtgcctgggccgccggcgtccgcggccatgcagagcgtgcgcatggcgtacactgcggacggcaccgctgtgtacgctccggtgagctcctcggccgcgacgccgtcttaccagccgcagggcccagcccacggcactagcatgtctgcggcgacggtcgttggtggcaatggcgcgtcagctgtgcctggcatgggggagccggtggccaagaagaagcgcgggcgaccaagaaagtacgggcccgacgggtccatggcgctggcattggtgcctgcgtcggcggctacgggatcaccggctacagggtcaccagcgacagggcagggttcttccgggccgttctcaccggctgggttaaatccggcgagctctctgctagtggtgtcgccagatggatttaagaagcggggccggcctaagggttctaccaacaagccgcgcgtggatgctgctgggtcatcaggagctggatttacacctcatgttattacagttcaagctggggaggatgtgtcatcaaagattatgtcattttctcagcatggaacgcgtgcaatttgtgttctttcagcaaatggtgccatatcaaatgtgacgcttcgtcagactgctacatcaggtggaactgtaacatacgagggtcgatttgagatactatcactgtcaggctcattcctcctggtggagaatggtggtcagcgtagtcgaactggaggactcagtgtgtccctggctggtcctgatggtcgtctgttgggtggtggagttgcgggacttctcatagcagcttcaccagttcagatagtactgggaagcttcaattctggaggcaaaaaagagtcaaaaaagcatgctccttcagaacccacatcagtgccactgaaggtcgctccgaccaccgggatgggacccaacagccctccttcaagaggtacattgagcgagttatctggtggcactggaagcccaccaccactgcatcaaggcatggctgctagcaataataaccaaccgccgttcctgtctagcatgccttggaaatga

SEQ ID NO: 8744 - protein, 373 aa, Sorghum bicolor
  misc_feature: Ceres ANNOT ID no. 6091858
  misc_feature (96)..(373): NCBI GI: 115477244 NCBI Desc: os08g0512400 [oryza sativa (japonica cultivar-group)]
  misc_feature (2)..(373): NCBI GI: 119657406 NCBI Desc: tpa: at-hook motif nuclear localized protein 2 [oryza sativa (japonica cultivar-group)]
  misc_feature (80)..(373): NCBI GI: 2598227 NCBI Desc: at-hook protein 1 [arabidopsis thaliana]
  misc_feature (80)..(373): NCBI GI: 20196849 NCBI Desc: at-hook dna-binding protein (ahp1) [arabidopsis thaliana]
  misc_feature (80)..(373): NCBI GI: 14326504 NCBI Desc: at2g33620/f4p9.39 [arabidopsis thaliana]
  misc_feature: The sequence is a functional homolog of SEQ ID NO 10 in the 10/225,066US patent application
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1012 in the 10/225,066US patent application
  misc_feature: The sequence is a functional homolog of SEQ ID NO 124 in the 10/374,780US patent application
  misc_feature: The sequence is a functional homolog of SEQ ID NO 136 in the 11/375,241US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 1873 in the 11/479,226US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 304 in the 10/374,780US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 830 in the 11/435,388US patent application
  misc_feature: The sequence is a functional homolog of SEQ ID NO 838 in the 10/225,066US patent application
  misc_feature: The sequence is a functional homolog of SEQ ID NO 90 in the 10/669,824US patent application
  misc_feature: Useful for making plants with modulated growth and phenotype characteristics
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 64 in the 20040128712 US patent application
  misc_feature: The sequence is a functional homolog of SEQ ID NO 90 in the 20040128712 US patent application
  misc_feature: The sequence is a functional homolog of SEQ ID NO 10 in the 20050160493 US patent application
  misc_feature: The sequence is a functional homolog of SEQ ID NO 1012 in the 20050160493 US patent application
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
MEVRSEQGLMAGRDLFGMPKSPPAPVPGPPASAAMQSVRMAYTADGTAVYAPVSSSAATPSYQPQGPAHGTSMSAATVVGGNGASAVPGMGEPVAKKKRGRPRKYGPDGSMALALVPASAATGSPATGSPATGQGSSGPFSPAGLNPASSLLVVSPDGFKKRGRPKGSTNKPRVDAAGSSGAGFTPHVITVQAGEDVSSKIMSFSQHGTRAICVLSANGAISNVTLRQTATSGGTVTYEGRFEILSLSGSFLLVENGGQRSRTGGLSVSLAGPDGRLLGGGVAGLLIAASPVQIVLGSFNSGGKKESKKHAPSEPTSVPLKVAPTTGMGPNSPPSRGTLSELSGGTGSPPPLHQGMAASNNNQPPFLSSMPWK

SEQ ID NO: 8745 - DNA, 954 bp, Sorghum bicolor
  misc_feature: Ceres ANNOT ID no. 6091859
  misc_feature: Encodes the peptide sequence at SEQ ID NO 8746
atggcggacgaggcggagctcgccgcggaccagcacgtccgctacatcgtcaccgtggagaagaagaaggactcgttcgagtcgctggtgatggagcacatccgcctcaacggcgcctactggggcctcaccacgctcgacctcctccacaagctccacgccgtcgacgccgccgaggtcgtcgactggatcatgtcctgctaccaccccgaatctggcggatttggagggaacgttgggcacgacccgcatgtcctctacacgcttagcgccgtgcaggtcctctgcctcttcgaccggctcgatgtccttgacgtcgacaaggttgctgattatgttgcgggactgcaaaacaaggatggatcattttctggcgatacttggggtgaagttgacactaggttctcgtatattgccctatgtaccttatcattactgcaccgtctgcataaaatagatgtgcaaaaagctgtagacttcgttgttagctgtaagaacttggatggtggatttggtgctatgccaggaggggagtctcatgctggacaaatattttgttgtgtcggcgcacttgcaatcactgggtccctgcatcacattgatagagatctcctcggatggtggctctgtgagcgtcagtgtaaagatggaggacttaatgggcggcctgagaaattagcagatgtttgctactcatggtgggtgttatcaagcttagtaatgattgatagagtgcattggattgacaaggaaaagctaacaaaattcatactaaactgtcaggacaaagagagtggtggcatttcagataggccagacaatgcagtcgatatctatcacacatactttggaattgcaggactttcattaatggagtaccctggggtgaagcctttggatcctgcctatgcactgccgttggatgttgtcaatagggttttcatgaaaaaatag

SEQ ID NO: 8746 - protein, 317 aa, Sorghum bicolor
  misc_feature: Ceres ANNOT ID no. 6091859
  misc_feature (55)..(99): Pfam Id: Prenyltrans Pfam Desc: Prenyltransferase and squalene oxidase repeat
  misc_feature (104)..(147): Pfam Id: Prenyltrans Pfam Desc: Prenyltransferase and squalene oxidase repeat
  misc_feature (152)..(195): Pfam Id: Prenyltrans Pfam Desc: Prenyltransferase and squalene oxidase repeat
  misc_feature (200)..(243): Pfam Id: Prenyltrans Pfam Desc: Prenyltransferase and squalene oxidase repeat
  misc_feature (248)..(292): Pfam Id: Prenyltrans Pfam Desc: Prenyltransferase and squalene oxidase repeat
  misc_feature (6)..(317): NCBI GI: 21594047 NCBI Desc: rab geranylgeranyltransferase, beta subunit [arabidopsis thaliana]
  misc_feature (6)..(286): NCBI GI: 140056641 NCBI Desc: polynucleotidyl transferase, ribonuclease h fold [medicago truncatula]
  misc_feature (7)..(313): NCBI GI: 119626802 NCBI Desc: rab geranylgeranyltransferase, beta subunit, isoform cra_d [homo sapiens]
  misc_feature (7)..(313): NCBI GI: 1552549 NCBI Desc: rab geranylgeranyl transferase [homo sapiens]
  misc_feature (7)..(313): NCBI GI: 1216504 NCBI Desc: geranylgeranyl transferase type ii beta-subunit
  misc_feature (7)..(313): SWISSPROT Homolog: EC 2.5.1.60 Geranylgeranyl transferase type-2 subunit beta
MADEAELAADQHVRYIVTVEKKKDSFESLVMEHIRLNGAYWGLTTLDLLHKLHAVDAAEVVDWIMSCYHPESGGFGGNVGHDPHVLYTLSAVQVLCLFDRLDVLDVDKVADYVAGLQNKDGSFSGDTWGEVDTRFSYIALCTLSLLHRLHKIDVQKAVDFVVSCKNLDGGFGAMPGGESHAGQIFCCVGALAITGSLHHIDRDLLGWWLCERQCKDGGLNGRPEKLADVCYSWWVLSSLVMIDRVHWIDKEKLTKFILNCQDKESGGISDRPDNAVDIYHTYFGIAGLSLMEYPGVKPLDPAYALPLDVVNRVFMKK

SEQ ID NO: 8747 - DNA, 315 bp, Sorghum bicolor
  misc_feature: Ceres ANNOT ID no. 6091861
  misc_feature: Encodes the peptide sequence at SEQ ID NO 8748
atggtgataacaataatcctgtgtgcatttcctgattgctggcgttctcagagcacggagctgaaagtggagatggtggcattgcatgagaagcgggtacgcaaatgcctgtccaaagtgaaagggatcgagcgggtggaggtggaggcgagcctgcagaaggtggtggtgacggggtgcgtgaaccggagcaagatcctcaaggcgctccgccgggtggggctccgcgccgagccatggtcgccgcacaacgagctgctcagcgcctacgccaccaccaccctcatgttcaacaactcctacgccttcttttga

SEQ ID NO: 8748 - protein, 104 aa, Sorghum bicolor
  misc_feature: Ceres ANNOT ID no. 6091861
  misc_feature (17)..(94): NCBI GI: 145333005 NCBI Desc: metal ion binding [arabidopsis thaliana]
  misc_feature (17)..(84): NCBI GI: 15221451 NCBI Desc: copper-binding family protein [arabidopsis thaliana]
  misc_feature (17)..(84): NCBI GI: 8927670 NCBI Desc: contains similarity to a copper homeostasis factor (ccm) mrna from arabidopsis thaliana gbu88711 and contains a heavy-metal-associated pf00403 domain
  misc_feature (30)..(83): NCBI GI: 57900370 NCBI Desc: copper-binding protein-like [oryza sativa (japonica cultivar-group)]
  misc_feature (17)..(94): NCBI GI: 92899055 NCBI Desc: heavy metal transport/detoxification protein [medicago truncatula]
  misc_feature: The plant produces a reduced number of seeds.
  misc_feature: Useful for biocontainment applications
  misc_feature: Functional homolog of the protein sequence given in SEQ ID NO 13156
MVITIILCAFPDCWRSQSTELKVEMVALHEKRVRKCLSKVKGIERVEVEASLQKVVVTGCVNRSKILKALRRVGLRAEPWSPHNELLSAYATTTLMFNNSYAFF

SEQ ID NO: 8749 - DNA, 1938 bp, Sorghum bicolor
  misc_feature: Ceres ANNOT ID no. 6091881
  misc_feature: Encodes the peptide sequence at SEQ ID NO 8750
atgacggccagatcggacgatcccggcgtgtctccggggacctcggcggcggccggcggcgagatctggggcacgtgggaggagctcctcctggcttgcgccgtgcggaagcacggcacggccagctgggactccgtggccatggagatgctgtcccgctgccctcccgccgcggccgacagcctcacgcccgccgggtgccgcctccgttatcgcctccttcaccgccggttcgccgccggcgccggctccgaaaacgacgacggcgacgaggagcccgatgccgcctccgccgacgggtgcgtcgaggagctccgcaagctgcgcgtcgccgagctccgccgcgaggtcgagcgatacgatctctcgatcgggtcgttgcaatccaaagtggaacggctcaaggaggagagggagaggagcatctccgtcgaggccaatccaccggcggtgaaggaggaggacgacgaggaggaggagccggcgacagggaaaggatcgctggaggaggacgatgccggcgtcggcgaggatcgtgtctccggcggcgagtccgggcggtcgtgcaaggagtccaactcgtcagatctgaagcggccgcggacggcgcaggacgccggcggcaccgccgacgccggggacggcgacgcggcggaggcgagaggggaggacgagggggcaggagacgccgctgcagcccgcgagtcgtcggccgtgaagcgcgagcaggcctccggcgagtcggtggccgggtcaaaggacacgccggcggaggacgcggagaaggagagcagcgacgtgcagagctcggccagcccgtcccgccggcgcgagccggagatcgctgccggtgaggacgcggaggcggaggaggcctcagcgccgccgccgccggcgcctccgcccgccccggtcctccccgcgtcggaggccgaggcgctgcgcgcgttcctcgagtcggtgcggaccagcaagccgggctccgtgttcgagcgccggctcgagagccaggacgacgcgaaatacaggagcaccatcaggcgccacgtggacctgcagacggtgaggtcgaggctggacggtggggccgggagctacgcctcggcgaccgagttctaccgcgatctgctcctgctgtgcgccaacgcgctggtcttctacccgcgcggctcgcccgagcactcggccgcggcgcggacgcgcgcgctcgtcgccaagcacatgtccaaggaccagccggcggggacctcgggcaaggcggccgcggggccgggggcgtcgaagaaggccaaggcggaggccgacgtcgggtcgctgctggagaagacggcgcccatcatcgtgtgccggaagcggagctccatcgccaaggccgcggcgaaggtggagacggacgacaaggaggagcagcaggaggcggcggtgggcaagaggaaggcggcggcggccgccaatgccaaggaccgggcggcgcggggcccgaggacgaccaagacccgcggcgggcctgctgtccggaaggctgcgaaggcggctgcggcggacaacggctcggacagcgacgcgccgccagaggaggccaagaagcagcctgctgctgacaagaaaggcggcggcagcggcggtgccggcgtcgctaagaagcgcaacgccgtcaacttcctcaaccggatgaagcaaggcgggtcggcgccgtccacggagcgcgtgtcgctgctggagacgctgaagctgtcggcccaggcggagcagaagaaggccgggaagggggagggcaagaaggagcccgcgggcgggtccgggtctgggtccaagaagaccccgccggggaggaggaacgtgggcaggccaccgaaacgcgcggccgcgccgccgtcccctccaccgtccaagagggcgaagggcggcggcggcgggaagcgcgggggcaggaagtga

SEQ ID NO: 8750 - protein, 645 aa, Sorghum bicolor
  misc_feature: Ceres ANNOT ID no. 6091881
  misc_feature (314)..(399): Pfam Id: Bromodomain Pfam Desc: Bromodomain
  misc_feature (20)..(75): Pfam Id: Myb_DNA-binding Pfam Desc: Myb-like DNA-binding domain
  misc_feature (1)..(645): NCBI GI: 28411872 NCBI Desc: dna-binding protein family-like [oryza sativa (japonica cultivar-group)]
  misc_feature (310)..(640): NCBI GI: 23308237 NCBI Desc: at3g60110/t2o9_90 [arabidopsis thaliana]
  misc_feature (100)..(505): NCBI GI: 53850535 NCBI Desc: at1g61215 [arabidopsis thaliana]
  misc_feature (310)..(640): NCBI GI: 18411475 NCBI Desc: dna-binding bromodomain-containing protein [arabidopsis thaliana]
  misc_feature (23)..(293): NCBI GI: 140060508 NCBI Desc: homeodomain-related [medicago truncatula]
MTARSDDPGVSPGTSAAAGGEIWGTWEELLLACAVRKHGTASWDSVAMEMLSRCPPAAADSLTPAGCRLRYRLLHRRFAAGAGSENDDGDEEPDAASADGCVEELRKLRVAELRREVERYDLSIGSLQSKVERLKEERERSISVEANPPAVKEEDDEEEEPATGKGSLEEDDAGVGEDRVSGGESGRSCKESNSSDLKRPRTAQDAGGTADAGDGDAAEARGEDEGAGDAAAARESSAVKREQASGESVAGSKDTPAEDAEKESSDVQSSASPSRRREPEIAAGEDAEAEEASAPPPPAPPPAPVLPASEAEALRAFLESVRTSKPGSVFERRLESQDDAKYRSTIRRHVDLQTVRSRLDGGAGSYASATEFYRDLLLLCANALVFYPRGSPEHSAAARTRALVAKHMSKDQPAGTSGKAAAGPGASKKAKAEADVGSLLEKTAPIIVCRKRSSIAKAAAKVETDDKEEQQEAAVGKRKAAAAANAKDRAARGPRTTKTRGGPAVRKAAKAAAADNGSDSDAPPEEAKKQPAADKKGGGSGGAGVAKKRNAVNFLNRMKQGGSAPSTERVSLLETLKLSAQAEQKKAGKGEGKKEPAGGSGSGSKKTPPGRRNVGRPPKRAAAPPSPPPSKRAKGGGGGKRGGRK

SEQ ID NO: 8751 - DNA, 888 bp, Sorghum bicolor
  misc_feature: Ceres ANNOT ID no. 6091882
  misc_feature: Encodes the peptide sequence at SEQ ID NO 8752
atggagtaccgcgccttcgacagcagcgtagtggcatggaacatgcttgattggtttctttcagtgactggtgatgagctccctccagcatatcaaattagaggaccaagagtgcatttcagtgggaatggaaggtcattagcaggcacactttctcagccaagatcgcacatcaagttggatagcgatatacatcagattgagcaacaggcctatactggtgttctcagagcattcaaaatgcaatcggatgccctgacatgggaaaaggaaagtttaatcactgaactaagaagagagttgaaagtctctgatgtggaacacagaatgctattaaacatggtcaatgaagaggaggctgtccatagaataaggcagtcaaggcagggaggtggaatgcaatctagcttgcctcataacagcatagttgatcacaaccatggacctctcaagaggcagaagaaatcccattccatgtattcactccctgtggatccccactcacccgtaatgcctctgcaagcaatcatgggcaacaagacatatagactggcacctgaaaacacaagacgggactctgtctatcaaacccttccaaatcagggaggttggctggcgtttgatggtgttatgaaaggtatggatgggagaagcggaaggtatcatgcggacgagtattatgcttcacccaataacatggggcttttgagcttcaatcatattgacatacctaatactgaaagtcttgtgaaaaaggtggaaagcgtattatctgatccagatgtgtatagaattgaaagggcaaagaaactgcttataaaccaagagcagtcattgcttgatgcaattgccaaactcgatgaagcatctgatcacgaaaatggatag

SEQ ID NO: 8752 - protein, 295 aa, Sorghum bicolor
  misc_feature: Ceres ANNOT ID no. 6091882
  misc_feature (60)..(133): Pfam Id: ENT Pfam Desc: ENT domain
  misc_feature (21)..(176): NCBI GI: 115461072 NCBI Desc: os04g0659400 [oryza sativa (japonica cultivar-group)]
  misc_feature (21)..(149): NCBI GI: 140060504 NCBI Desc: ent [medicago truncatula]
  misc_feature (21)..(221): NCBI GI: 30684221 NCBI Desc: emsy n terminus domain-containing protein / ent domain-containing protein [arabidopsis thaliana]
  misc_feature (21)..(194): NCBI GI: 42569914 NCBI Desc: emsy n terminus domain-containing protein / ent domain-containing protein [arabidopsis thaliana]
  misc_feature (62)..(255): NCBI GI: 49388834 NCBI Desc: emsy n terminus domain-containing protein-like [oryza sativa (japonica cultivar-group)]
MEYRAFDSSVVAWNMLDWFLSVTGDELPPAYQIRGPRVHFSGNGRSLAGTLSQPRSHIKLDSDIHQIEQQAYTGVLRAFKMQSDALTWEKESLITELRRELKVSDVEHRMLLNMVNEEEAVHRIRQSRQGGGMQSSLPHNSIVDHNHGPLKRQKKSHSMYSLPVDPHSPVMPLQAIMGNKTYRLAPENTRRDSVYQTLPNQGGWLAFDGVMKGMDGRSGRYHADEYYASPNNMGLLSFNHIDIPNTESLVKKVESVLSDPDVYRIERAKKLLINQEQSLLDAIAKLDEASDHENG

SEQ ID NO: 8753 - DNA, 2235 bp, Sorghum bicolor
  misc_feature: Ceres ANNOT ID no. 6091885
  misc_feature: Encodes the peptide sequence at SEQ ID NO 8754
atggagcaccgcgcggcggcgccggacgatgtgatcgttcaggtgaacgccgccgccgttgcggccgtggacgagaggatctcgacgggtcagatcaccgaggaggaagtcatcggcatcgacggcggcaagcagcagatcggcggcggcggcggcggcctcacccgccggaccttcagccagtcgtacaagatgaggcaccgcaaccctgtggagctgacggggtggcagttggcgctgctggggtaccagtcgctgggcgtggtgtacggcgacatcgggacgtcgccgctgtacaccttctcgtcgttcacgctgccggaccccggggccgacgatgtcctcggcatcctcagcctcatcctctggacgctcacactcgtcagcctcgtcaagtacgtcttcatcgtcctccacgcagatgaccacggagaaggtggcacctttgccctgtactcgctcttgcgccagcacgtcaatttcagcggcaagtcgatgccggtgccggtcactcggctggcatcagatgccaacctcaagttccacagcaaacagagcagcctgcaaccaaggatgctcaagttcctggaaggcagccccattgcacaggcagtcatcacctaccttgtgttggttgggacttgcatggtgatgggtgatggtgccctcactccatccatctcagtcctgtcagctgtccaaggaatccaatcaagatcttctagcattaaacaaggtcacgttgtcctcctatgtgtggttatcctggtcatccttttccttttccaacagtatggcacaagcaaagtcggcttcactttttctcccattatgctcgtgtggtttgcgttgattgcatccattggactacacaatatgatcaagtattatccgccggttctgaaagccatatcaccacattacatatatcttttctttgcgagaaacaaaagggctggctgggagcaatttggaacagttgttttgtgcataacaggtgctgaagctatgtttgctgacttgggtcatttcaacaagaaatcaatccagatggcgtactcatgcttagtttacccagcactgatacttgcatatgctggccaggcagcatttttgatcaagaacccatctaagctcagcacaacattttatagtagcgtcccagatccgctgttttggcccatgtttattgtggctactttggctgccatcgttgcaagccaggcactgatatctgccagtttctccatcatcaggcaatcaattgctttaggttgttttcctagagttaccatgaagcacacctcaaagaaatatgaaggccgagtatactctccagagatcaactacttcttgatgattgcttgtatattgattactgttggttttaagggtggaccagagattgggcaagcctatggtgttgcagtgatatgggttatgcttattacaacacatctgatcacagtggtcatggtaataatatggcaaactcattctgcaatagcagggtcattttatattatctacactgccattgaaggtcttatgacgatatcactcctatataagattgcacaaggtggctgggttccatttgcaataactgcattttttcttataattacactttcttggacctatggccgaagcaagaaaaatgaatatgaagcgagtaacttgatggataggcaggaattcattaaaacagtgaacatgagcaacagagtacctggaatatgcatcttttgcacagacttgatgaatggcatcccaccaatagtgcgccattacgttcagcacatgggttgtctccgcgaactgatggtgtttgtcactgtgaggcatctacctgtgacatcagtcctgcctgaagagcgcttcctcgtcgacagactagagccttttggtgtttataggtgcatagtccaatatggttatatggacacccagaatatggaggatgatgattatgttctatcaatcattgcatccctcaaggaaatagctcaaagtaatgatgagaccatgattatggattcagctttagcaaatggaacgacctttgtacttggaagggttattttaaaaatgagctccaagcaaagctgtttcaagcgctttgttgttaacaacctttacaggttcttgcagaagaacttcaggtccaacatttccagtctaaagatagctcctagtaaaactttgcagattggaatgcaatatgaaatttga

SEQ ID NO: 8754 - protein, 744 aa, Sorghum bicolor
  misc_feature: Ceres ANNOT ID no. 6091885
  misc_feature (80)..(744): Pfam Id: K_trans Pfam Desc: K+ potassium transporter
  misc_feature (73)..(668): NCBI GI: 37201992 NCBI Desc: at4g13420 [arabidopsis thaliana]
  misc_feature (76)..(744): NCBI GI: 82592899 NCBI Desc: probable potassium transporter 17 (oshak17)
  misc_feature (80)..(743): NCBI GI: 75131123 NCBI Desc: probable potassium transporter 4 (oshak4)
  misc_feature (80)..(743): NCBI GI: 38194466 NCBI Desc: kup-related potassium transporter [lotus corniculatus var. japonicus]
  misc_feature (76)..(685): NCBI GI: 93115179 NCBI Desc: kup1 [vitis vinifera]
  misc_feature: The sequence is a functional homolog of SEQ ID NO. 279 in the 11/188,298 US application
MEHRAAAPDDVIVQVNAAAVAAVDERISTGQITEEEVIGIDGGKQQIGGGGGGLTRRTFSQSYKMRHRNPVELTGWQLALLGYQSLGVVYGDIGTSPLYTFSSFTLPDPGADDVLGILSLILWTLTLVSLVKYVFIVLHADDHGEGGTFALYSLLRQHVNFSGKSMPVPVTRLASDANLKFHSKQSSLQPRMLKFLEGSPIAQAVITYLVLVGTCMVMGDGALTPSISVLSAVQGIQSRSSSIKQGHVVLLCVVILVILFLFQQYGTSKVGFTFSPIMLVWFALIASIGLHNMIKYYPPVLKAISPHYIYLFFARNKRAGWEQFGTVVLCITGAEAMFADLGHFNKKSIQMAYSCLVYPALILAYAGQAAFLIKNPSKLSTTFYSSVPDPLFWPMFIVATLAAIVASQALISASFSIIRQSIALGCFPRVTMKHTSKKYEGRVYSPEINYFLMIACILITVGFKGGPEIGQAYGVAVIWVMLITTHLITVVMVIIWQTHSAIAGSFYIIYTAIEGLMTISLLYKIAQGGWVPFAITAFFLIITLSWTYGRSKKNEYEASNLMDRQEFIKTVNMSNRVPGICIFCTDLMNGIPPIVRHYVQHMGCLRELMVFVTVRHLPVTSVLPEERFLVDRLEPFGVYRCIVQYGYMDTQNMEDDDYVLSIIASLKEIAQSNDETMIMDSALANGTTFVLGRVILKMSSKQSCFKRFVVNNLYRFLQKNFRSNISSLKIAPSKTLQIGMQYEI

SEQ ID NO: 8755 - DNA, 1230 bp, Sorghum bicolor
  misc_feature: Ceres ANNOT ID no. 6091891
  misc_feature: Encodes the peptide sequence at SEQ ID NO 8756
atggagtccggtggcgccagtggcggcggcggcggcggcggcggggacgaccagctgcacggcctcaagttcggcaagaagatctacttcgaggacgccgccgcggccggctccagcagcggtggcggtggcggtggcagtggcaatgctagcgcgaccaccgcggctccagcgacgcagcagccgtccccgccgcaggccgcttcgcccagggcagccagcggcggcggcggcaggaggggcagggccgcgggcggcccctccccggcgcccgcgcccgcgcgctgccaggtcgacggctgcaacgtggacctcaccgacgtcaagccctactactgccgccacaaggtctgcaaaatgcactccaaggagccccgcgtcgtcgtcaacggcctcgagcagcgcttctgccagcagtgcagcaggttccaccagctgcctgaatttgaccaactaaaaaaaagctgccgcagacgtctcgcaggccacaatgaacgccggaggaggccacctcctggacctcttgcaacacgatatggtcgccttgctgcatcattcggtgaagagcccggcaggttccgaagctttatgttggatttctcatacccaagggttccaaccgccatgagggatgggtttccagcagttcgacctggtgaaagggcgcctggtagtatccagtggcaagcgagcttagatcctcatcatcatcaaagtgcggtcgcaggatacagtgctcactcatatgggagccagggtagctcgtcgtcaaggccaccggtgttccctggtccggagatccccccaggtggatgtcttgcaggagtcccctcggactctagctgtgctctctctcttctgtcaactcagccatgggatactacccacagctctggccacagccatgctgcatcaatgcctgcaacagcaggttttgacggcaaccctgtggcaccctccctcatggcgagtagctacattgcgccaagcccctggactgactcccggggccatgaaggcgggcggaacgtgcctcagttgccacctgacgtccccctcagcgaggtgcactctggctcaagcagccatcacggccagttctcaggtgagctcgagcttgccctgcagggaaacaggccagcaccagggtcagcgccagcgccgcgcaatgatcagggctccacaggcgcattcgaccagtccggcaacacaatggactggtcactctag

SEQ ID NO: 8756 - protein, 409 aa, Sorghum bicolor
  misc_feature: Ceres ANNOT ID no. 6091891
  misc_feature (95)..(173): Pfam Id: SBP Pfam Desc: SBP domain
  misc_feature (87)..(409): NCBI GI: 5931786 NCBI Desc: sbp-domain protein 5 [zea mays]
  misc_feature (103)..(295): NCBI GI: 5931788 NCBI Desc: sbp-domain protein 6 [zea mays]
  misc_feature (79)..(298): NCBI GI: 5931641 NCBI Desc: squamosa promoter binding protein-homologue 4 [antirrhinum majus]
  misc_feature (79)..(298): NCBI GI: 5931643 NCBI Desc: squamosa promoter binding protein-homologue 5 [antirrhinum majus]
  misc_feature (69)..(409): NCBI GI: 5931675 NCBI Desc: squamosa promoter binding protein-like 9 [arabidopsis thaliana]
  misc_feature: The sequence is a functional homolog of SEQ ID NO 1411 in the 11/479,226US patent application
  misc_feature: The sequence is a functional homolog of SEQ ID NO 1781 in the 11/479,226US patent application
  misc_feature: The sequence is a functional homolog of SEQ ID NO 1844 in the 11/479,226US patent application
  misc_feature: The sequence is a functional homolog of SEQ ID NO 2344 in the 10/374,780US patent application
  misc_feature: The sequence is a functional homolog of SEQ ID NO 2492 in the 10/374,780US patent application
  misc_feature: The sequence is a functional homolog of SEQ ID NO 270 in the 10/374,780US patent application
  misc_feature: The sequence is a functional homolog of SEQ ID NO 298 in the 10/374,780US patent application
  misc_feature: The sequence is a functional homolog of SEQ ID NO 4 in the 10/225,066US patent application
  misc_feature: The sequence is a functional homolog of SEQ ID NO 430 in the 10/374,780US patent application
  misc_feature: The sequence is a functional homolog of SEQ ID NO 46 in the 10/225,066US patent application
  misc_feature: The sequence is a functional homolog of SEQ ID NO 460 in the 10/225,066US patent application
  misc_feature: The sequence is a functional homolog of SEQ ID NO 52 in the 10/225,066US patent application
  misc_feature: The sequence is a functional homolog of SEQ ID NO 528 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 46 in the 20050160493 US patent application
  misc_feature: The sequence is a functional homolog of SEQ ID NO 460 in the 20050160493 US patent application
  misc_feature: The sequence is a functional homolog of SEQ ID NO 52 in the 20050160493 US patent application
  misc_feature: The sequence is a functional homolog of SEQ ID NO 528 in the 20050160493 US patent application
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO. 452 in the 11/188,298 US application
MESGGASGGGGGGGGDDQLHGLKFGKKIYFEDAAAAGSSSGGGGGGSGNASATTAAPATQQPSPPQAASPRAASGGGGRRGRAAGGPSPAPAPARCQVDGCNVDLTDVKPYYCRHKVCKMHSKEPRVVVNGLEQRFCQQCSRFHQLPEFDQLKKSCRRRLAGHNERRRRPPPGPLATRYGRLAASFGEEPGRFRSFMLDFSYPRVPTAMRDGFPAVRPGERAPGSIQWQASLDPHHHQSAVAGYSAHSYGSQGSSSSRPPVFPGPEIPPGGCLAGVPSDSSCALSLLSTQPWDTTHSSGHSHAASMPATAGFDGNPVAPSLMASSYIAPSPWTDSRGHEGGRNVPQLPPDVPLSEVHSGSSSHHGQFSGELELALQGNRPAPGSAPAPRNDQGSTGAFDQSGNTMDWSL

SEQ ID NO: 8757 - DNA, 4425 bp, Sorghum bicolor
  misc_feature: Ceres ANNOT ID no. 6091901
  misc_feature: Encodes the peptide sequence at SEQ ID NO 8758
atggcgggcatgtgcgggagcccattttgctccaaggaagcttcagcgtcatgtggatgggaggaaatactcaactcctccacttgcacgaatcatatcctggcgattggcatcgctactctgatcgtcatcgttcttgcaatccatcttttcgtcaggatcgcaaagagcagaccacatgtgcagctgcttgtcgcactcacttcgccactgcagttggctgctgtagtgttcaatggctgcttgggtctcatttatcttggccttgcattgtggatgctggggaccaacttcagccagcatgcctctgtttaccttccacatcgatggttggtgaacttgtctcagggagtcagtttgatccttatcagctttgctttcagcatcagatcacagttccttggagcagcatttttccgggtttggtcagttctgctaaccacatatgctgcattcgtttgctgtacctcggttgtttacatgattgcagataaggttctaggcatgaaggcttgtttggatgttctatccttaccaggtgcactactgctccttgtttatgggatttggcacgtcagggaagatggcaatggaggagttgaaagtgctttatataagcctctgaacactgagactcacgaagatacagctggttctgagagtcatgtaaccccgtttgctaaagccgggattttcagcgtgatgacattttggtggctaaatcctatgatgaaggtgggttatgagaagcctcttgaggacaaagacatgccacttttaggtccctcggatcgagcatatagccagtacttgatgtttttagagaatctgaacaggaagaagcagttgcaggcatatggaaatccgtcagtcttttggactatcgtttcttgtcacaaaagtgaaatcttggtttcaggtttctttgcattgctcaaagtggttacattgtcttcgggtccagtgattttgaaagcattcatcaatgtttcacttgggaaaggctcctttaaatatgaagcctatattttagctgcaacaatgtttgttactaaatgctttgaatctttgtcacaaaggcagtggtatttccgtactcggaggttaggactccaagtgcggtcattcctatcggctgccatctataagaaacaacagaagctgtcgagctcttcaaaactgaagcattcttctggagagatcataaactatgtcactgttgatgcctaccggattggtgagttcccatactggttccatcagacatggacgacaagtgtccaactctgcattgctctagtgattctgtataatgcagtcggtcttgctatgattgcatcactggttgtcatcgttctcactgtaatttgcaatgctcctctagccaagttgcaacacaaatttcagagtaaacttatggaagcacaagatgtgagactaaaggcgatgtcagagtccttaattcacatgaaggtcttgaaactttatgcatgggagactcatttcaagaaggtcattgaggggttaagggaaactgaaatcaagtggttgtcagcattccagcttaggaaatcgtacaacagtttcctattctggacatcacctgttttagtttcgtctgcaaccttttttacatgctatcttttgaaaattcctcttgatgctagcaacgtattcacatttgtggccactctgcgccttgttcaagatccaattaggcagataccagatgtaattggagtcgttatacaagctaaagttgctttcactaggataacaaagtttcttgatgcgcctgagctgaatggacaggttaggaagaaatactgtgtgggcaatgaatatcctatagtgatgaactcttgcagtttctcatgggatgagaacccatcaaaaccaactctgaagaatataaatttggtagtcaaagctggagagaaggttgcaatctgcggcgaggtaggatcggggaagtcaacacttttggctgcagttcttggagaggttcctaaaactgaaggcatgatccaagtttgtgggaaaatagcatatgtttctcaaaatgcatggatccaatcaggaaccgtgcaagacaatattctctttgggtcttcgatggacaggcaaagataccaagaaacacttgagaggtgttctttagtaaaagaccttgaaatgttgccatatggagataatactcaaatcggggagaggggtgtcaatcttagcggtggtcagaagcagcgtgttcagcttgctcgtgcattataccaaaatgcagacctttatcttcttgatgaccctttcagcgctgttgatgctcacacagcaactagtctttttaatgaatatgtcatgggagctctgtcagataagactgtccttttggtgacccaccaagtcgattttttgcctgtatttgattctgttctgttaatgtcagatggaaaaattattcgttctgcaccttatcaagatttattggcatattgtcaagaatttcagaaccttgtaaatgcccataaagacactatcggtgtttcagatcttaacagagtcggcccccacagaggaaatgaaatattgatcaagggatcgattgatattcgtggaaccctatacaaagagtctttgaagccatcaccagcagatcagttgatcaagacagaggaaagagaaatgggtgacactggtctcaagccttatatcctttacttgcgtcagaataaaggcttcttcaatgcctctctgggtgttctttgccatataattttcttatctggccaaatatcgcagaattcatggatggctgctaatgttcagaatcctgatgttaatacacttaagttgatttctgtgtacattgcaattggaatcttcacagtgttcttcttgctatttagatcgttagcacttgtcgttcttggggtccagacatcaagatctttattttcccagttactcaactcattgttccgtgcaccaatgtccttttttgattctacccctcttggaagggtacttagccgggtatcttcagatttgagtattgttgaccttgatgttccatttggattgatgtttgctgctggtgccagcttaaacgcatatagcaatctgggggtattggctgttgttacatggcaagttctgttcgtcatagtgccgatgatggttttggcactcaggttgcagaggtactatttagcctcagctaaggaattgatgaggatcaatggcactaccaaatcagctctggctaatcacttgggcgagtcagttgcaggggcaataacaataagggcttttgaggaagaagatcgtttctttgaaaaaaatttggaacttattgacaagaatgctggttcatatttctataattttgcagcaactgaatggctgattcaacgtctggagacaatgagtgctgcagttctttctttttctgcctttattatggctcttcttcctccaggaacttttagctctgggtttataggaatggcattgtcttatggtctatccctaaataattcatttgttttctctatccaaaatcagtgccagctatcaaatcaaataatctctgtggaaagggtgaaccagtacatggacataccaagtgaagcagcagagattattgaagaaaatcgaccatcaccaaactggccgcaagttggtagggtggatcttagagatttgaagatcagatacaggcaagatgctcctcttgtactacatggaatcacatgcactttcgaaggtggagataagatcggtatagttggccggacaggaagtggaaagacaactttaattggtgcattgtttcgtcttgttgagccaactggagggaaaataattatagactctgtagatatcactacaattggcttacatgacctgcgttcacgtttgggtatcattccgcaagatccgacactctttcagggaaccataagatataatctagatcctcttgggcaattttcggatcaacaaatatgggaggttcttgacaaatgtcagcttcttgaagctgtccaggagaaggaacagggattggactcacttgttgtggaggatggttcgaactggagcatgggtcaaaggcagctcttctgtttgggacgtgcacttctaagaagatgtcgtatcttagttctcgatgaggccacggcatctatagacaatgctactgatgctatccttcagaaaacaatcagggcagaattcagagattgcactgttatcactgttgcacaccgtatacccactgttatggactgcaatatggtacttgcaatgagtgacgggaaactagtggagtatgacaaacctacaaagctcatggaaacggaaggatctctcttccgtgacctcgtcaaagagtactggtcatacacatcgaatggaaatatttag

SEQ ID NO: 8758 - protein, 1474 aa, Sorghum bicolor
  misc_feature: Ceres ANNOT ID no. 6091901
  misc_feature (645)..(816): Pfam Id: ABC_tran Pfam Desc: ABC transporter
  misc_feature (1256)..(1439): Pfam Id: ABC_tran Pfam Desc: ABC transporter
  misc_feature (303)..(572): Pfam Id: ABC_membrane Pfam Desc: ABC transporter transmembrane region
  misc_feature (908)..(1180): Pfam Id: ABC_membrane Pfam Desc: ABC transporter transmembrane region
  misc_feature (6)..(1471): NCBI GI: 47717725 NCBI Desc: multidrug-resistance associated protein 3 [zea mays]
  misc_feature (7)..(1468): NCBI GI: 92883856 NCBI Desc: cyclic peptide transporter [medicago truncatula]
  misc_feature (7)..(1468): NCBI GI: 140063323 NCBI Desc: cyclic peptide transporter [medicago truncatula]
  misc_feature (26)..(1473): NCBI GI: 22331862 NCBI Desc: abc transporter family protein [arabidopsis thaliana]
  misc_feature (141)..(1473): NCBI GI: 7529757 NCBI Desc: abc transporter-like protein [arabidopsis thaliana]
  misc_feature (141)..(1473): SWISSPROT Homolog: EC 3.6.3.44 Multidrug resistance-associated protein 14
MAGMCGSPFCSKEASASCGWEEILNSSTCTNHILAIGIATLIVIVLAIHLFVRIAKSRPHVQLLVALTSPLQLAAVVFNGCLGLIYLGLALWMLGTNFSQHASVYLPHRWLVNLSQGVSLILISFAFSIRSQFLGAAFFRVWSVLLTTYAAFVCCTSVVYMIADKVLGMKACLDVLSLPGALLLLVYGIWHVREDGNGGVESALYKPLNTETHEDTAGSESHVTPFAKAGIFSVMTFWWLNPMMKVGYEKPLEDKDMPLLGPSDRAYSQYLMFLENLNRKKQLQAYGNPSVFWTIVSCHKSEILVSGFFALLKVVTLSSGPVILKAFINVSLGKGSFKYEAYILAATMFVTKCFESLSQRQWYFRTRRLGLQVRSFLSAAIYKKQQKLSSSSKLKHSSGEIINYVTVDAYRIGEFPYWFHQTWTTSVQLCIALVILYNAVGLAMIASLVVIVLTVICNAPLAKLQHKFQSKLMEAQDVRLKAMSESLIHMKVLKLYAWETHFKKVIEGLRETEIKWLSAFQLRKSYNSFLFWTSPVLVSSATFFTCYLLKIPLDASNVFTFVATLRLVQDPIRQIPDVIGVVIQAKVAFTRITKFLDAPELNGQVRKKYCVGNEYPIVMNSCSFSWDENPSKPTLKNINLVVKAGEKVAICGEVGSGKSTLLAAVLGEVPKTEGMIQVCGKIAYVSQNAWIQSGTVQDNILFGSSMDRQRYQETLERCSLVKDLEMLPYGDNTQIGERGVNLSGGQKQRVQLARALYQNADLYLLDDPFSAVDAHTATSLFNEYVMGALSDKTVLLVTHQVDFLPVFDSVLLMSDGKIIRSAPYQDLLAYCQEFQNLVNAHKDTIGVSDLNRVGPHRGNEILIKGSIDIRGTLYKESLKPSPADQLIKTEEREMGDTGLKPYILYLRQNKGFFNASLGVLCHIIFLSGQISQNSWMAANVQNPDVNTLKLISVYIAIGIFTVFFLLFRSLALVVLGVQTSRSLFSQLLNSLFRAPMSFFDSTPLGRVLSRVSSDLSIVDLDVPFGLMFAAGASLNAYSNLGVLAVVTWQVLFVIVPMMVLALRLQRYYLASAKELMRINGTTKSALANHLGESVAGAITIRAFEEEDRFFEKNLELIDKNAGSYFYNFAATEWLIQRLETMSAAVLSFSAFIMALLPPGTFSSGFIGMALSYGLSLNNSFVFSIQNQCQLSNQIISVERVNQYMDIPSEAAEIIEENRPSPNWPQVGRVDLRDLKIRYRQDAPLVLHGITCTFEGGDKIGIVGRTGSGKTTLIGALFRLVEPTGGKIIIDSVDITTIGLHDLRSRLGIIPQDPTLFQGTIRYNLDPLGQFSDQQIWEVLDKCQLLEAVQEKEQGLDSLVVEDGSNWSMGQRQLFCLGRALLRRCRILVLDEATASIDNATDAILQKTIRAEFRDCTVITVAHRIPTVMDCNMVLAMSDGKLVEYDKPTKLMETEGSLFRDLVKEYWSYTSNGNI

SEQ ID NO: 8759 - DNA, 720 bp, Sorghum bicolor
  misc_feature: Ceres ANNOT ID no. 6091914
  misc_feature: Encodes the peptide sequence at SEQ ID NO 8760
atggaggccggcctgcgcgcgcttggccaccgctactgcggcggcggcggctgcggaatcagcctcggtgggttcgccgccgcgcgtgccatccggctccggcgccaacgccagcgtcgcgcggccgccttctgctcccttgctactgttggtggagatgggaatggcgccgcgggtggtggccccgtgaggagcggcgtcgaggtggcgcgcgccaggaggatgctccatgtcgtgctcgtctcgccgctgataccaggaaatacagggtccattgcaaggacatgtgctgcatctgcagttggcctgcatcttgtcggggtaagatacgttgttgtcaagattcatgactcttgggaccacttcttcgattatttcatgaagcaggagggagataaaaggctgttggcattcaccaaaagaggcacacaaatccattcagatttctcctacaggccaggggactggctagtctttggttctgaaacaaaaggattgcctcaacaagcccttgaggattgctgtagagaaggcctaggtggtggaaccctccgaattcccatggtggaaacctacgtccggtgcctgaacctctccgtcagcgttggaatcgcactgtatgaggcagctagacagctgaactacgaacagcttcagtatcagcctgagcttccggaggaagcacaggggctattcccagcagaggacatttatgcatga

SEQ ID NO: 8760 - protein, 239 aa, Sorghum bicolor
  misc_feature: Ceres ANNOT ID no. 6091914
  misc_feature (75)..(207): Pfam Id: SpoU_methylase Pfam Desc: SpoU rRNA Methylase family
  misc_feature (142)..(239): NCBI GI: 2191177 NCBI Desc: belongs to the spou family of rrna methylases [arabidopsis thaliana]
  misc_feature (75)..(215): NCBI GI: 113474137 NCBI Desc: trna/rrna methyltransferase (spou) [trichodesmium erythraeum ims101]
  misc_feature (75)..(214): NCBI GI: 67923250 NCBI Desc: trna/rrna methyltransferase (spou) [crocosphaera watsonii wh 8501]
  misc_feature (75)..(215): NCBI GI: 75909401 NCBI Desc: rna methyltransferase trmh, group 2 [anabaena variabilis atcc 29413]
  misc_feature (70)..(214): NCBI GI: 37520268 NCBI Desc: probable trna/rrna methyltransferase [gloeobacter violaceus pcc 7421]
MEAGLRALGHRYCGGGGCGISLGGFAAARAIRLRRQRQRRAAAFCSLATVGGDGNGAAGGGPVRSGVEVARARRMLHVVLVSPLIPGNTGSIARTCAASAVGLHLVGVRYVVVKIHDSWDHFFDYFMKQEGDKRLLAFTKRGTQIHSDFSYRPGDWLVFGSETKGLPQQALEDCCREGLGGGTLRIPMVETYVRCLNLSVSVGIALYEAARQLNYEQLQYQPELPEEAQGLFPAEDIYA

SEQ ID NO: 8761 - DNA, 930 bp, Sorghum bicolor
  misc_feature: Ceres ANNOT ID no. 6091915
  misc_feature: Encodes the peptide sequence at SEQ ID NO 8762
atgcggctctactcacctgcgctctgtctgcggcgatcaagcacgcattcccatcctaaccagttacgaggaggattcacgcagagtatggcctcatggaagtgcccgcactcacagtcaagcctgtaccatccgaagtcgggtttagttgatttttcccttagcaagaatgtaaagtcttctcagtcacaaagtataaagtactttgtcagcttaatgggccagcagttccgttgtggactatcaaccagagagggtagcctaagtgtgaagcttgacattccttcacatgaaaaatcgaggataggctggaactggaaaaacatgcaccacaagatagggggtgcagccggtggtctttgctttggtttttcggttactggattagcatgtgctgaggttccagtcattagaatcaaagacaatgctgaaacctcatcatcatctaccagttcaactcatgggaagaaagtctacacagattattctgtcactggtattcctggagatggaagatgtttgttccgctccgtggtacatggtgcgtgcattaggtcagggagacccatacctaatgaagatcttcagagaaaactagctgatgaactgagagcaatggtcgccgatgaatttgtcaagaggcgggaagagactgaatggtttgttgagggagattttgatacatatgtatcccatatcagggagccacatgtgtggggaggcgagccagaattgttcatggcgtcccatgttcttcagatgccaataacggtttacatgcgcgatgaggatgctggtggtctgatagcaattgcagaatatggccagcagtatggtaaagaagacccaatccaagtcttgtatcatggttttggccattacgatgctctacagattccagcaaaggttggttcaaagaggaaactgtag

SEQ ID NO: 8762 - protein, 309 aa, Sorghum bicolor
  misc_feature: Ceres ANNOT ID no. 6091915
  misc_feature (168)..(294): Pfam Id: OTU Pfam Desc: OTU-like cysteine protease
  misc_feature (1)..(306): NCBI GI: 42408919 NCBI Desc: auxin-regulated protein-like [oryza sativa (japonica cultivar-group)]
  misc_feature (1)..(309): NCBI GI: 115479867 NCBI Desc: os09g0487700 [oryza sativa (japonica cultivar-group)]
  misc_feature (167)..(309): NCBI GI: 115441655 NCBI Desc: os01g0900900 [oryza sativa (japonica cultivar-group)]
  misc_feature (221)..(298): NCBI GI: 56784864 NCBI Desc: auxin-regulated protein-like [oryza sativa (japonica cultivar-group)]
  misc_feature (166)..(207): NCBI GI: 20161602 NCBI Desc: b1065g12.4 [oryza sativa (japonica cultivar-group)]
MRLYSPALCLRRSSTHSHPNQLRGGFTQSMASWKCPHSQSSLYHPKSGLVDFSLSKNVKSSQSQSIKYFVSLMGQQFRCGLSTREGSLSVKLDIPSHEKSRIGWNWKNMHHKIGGAAGGLCFGFSVTGLACAEVPVIRIKDNAETSSSSTSSTHGKKVYTDYSVTGIPGDGRCLFRSVVHGACIRSGRPIPNEDLQRKLADELRAMVADEFVKRREETEWFVEGDFDTYVSHIREPHVWGGEPELFMASHVLQMPITVYMRDEDAGGLIAIAEYGQQYGKEDPIQVLYHGFGHYDALQIPAKVGSKRKL

SEQ ID NO: 8763 - DNA, 1440 bp, Sorghum bicolor
  misc_feature: Ceres ANNOT ID no. 6091924
  misc_feature: Encodes the peptide sequence at SEQ ID NO 8764
atggtgatctcggtggccactccccggcgctccacctccatacgcgacgccgtgctgggcggcgtgctcggcggcggcgggcgccagctgtaccagcccctccgctgcgccttctacgacggcacagccgggggcggtggcggtggcttacccggggacggcctgtccgccgcgctctccgaggagcccgcccgcgtctccgctgccggcggcggcaataagcagaagcaggcggcgaggaacgtgctgatcctgatgagcgacaccggcggcggccaccgcgcgtcggctgaggccctccgcgatgccttccgcatcgagttcggcgacacctacaaggtgttcgtgacggatttggggaaggagtacggcgggtggccgctgaacgacatggagcggtcgtacaagttcatgatccgacatgtgaggctctggaaggtggcgttccacggcacctccccgcgatgggtgcacggcatgtacctcgccgcgcttgcctactactacgccaacgaggtggtggctgggatcatgaagtacgagccggacatcatcatcagcgtgcacccgctgatgcagcacatcccgctgtgggtgctcaagtggcagagcctacaccccaaggtgcccttcgtcaccgtcatcaccgacctcaacacctgccacccgacatggttccaccacggcgtgacaaggtgctattgcccatccaccgaggtggcgaacagggccctgctccggggcctcggcccgtcccaggtccgcgtcttcgggcttcccatccggccctccttctgccgcgccgtgctcgacaaggatgaggtgaggaaagagcttggactggatcctcagctgccggctgttctactgatgggaggcggcgaggggatgggtccggtggaagagaccgcgagggccctcggcgaggagctctacgaccaccggagacggcgccgggtggggcaggtcgttgtcatatgcggcaggaaccaggcgctgcgatccaccctgcagtccctcagatggaaggtccctgtcaagatcagagggttcgaaacacagatggagaagtggatggccgcctgcgactgcatcatcacaaaagctggtcctggtacaattgcagaggcacttataagaggacttcctattatcctgaacgacttcatccctggacaggaagttggaaacgtgccttatgtcgtggacaacggtgccggtgtgttctcgaaggacccaagggaggctgcaagacaggttgtccgctggttcagcacagatgaggatgagctcaagagatactcacgtaacgcgctgaagctagcacaacccgaagccgtgttccacatcgtaaaggacatccacaagctccagcaacagccagctgcggttacccggatcccctactcgttgacctcatcgtttccttaccatatatga

SEQ ID NO: 8764 - protein, 479 aa, Sorghum bicolor
  misc_feature: Ceres ANNOT ID no. 6091924
  misc_feature (93)..(261): Pfam Id: MGDG_synth Pfam Desc: Monogalactosyldiacylglycerol (MGDG) synthase
  misc_feature (287)..(450): Pfam Id: Glyco_tran_28_C Pfam Desc: Glycosyltransferase family 28 C-terminal domain
  misc_feature (74)..(479): NCBI GI: 115475782 NCBI Desc: os08g0299400 [oryza sativa (japonica cultivar-group)]
  misc_feature (86)..(475): NCBI GI: 18700258 NCBI Desc: at5g20410/f5o24_300 [arabidopsis thaliana]
  misc_feature (45)..(475): NCBI GI: 92884240 NCBI Desc: monogalactosyldiacylglycerol synthase [medicago truncatula]
  misc_feature (31)..(473): NCBI GI: 76800636 NCBI Desc: monogalactosyldiacylglycerol synthase type a [vigna unguiculata]
  misc_feature (40)..(473): NCBI GI: 9884651 NCBI Desc: mgdg synthase type a [glycine max]
MVISVATPRRSTSIRDAVLGGVLGGGGRQLYQPLRCAFYDGTAGGGGGGLPGDGLSAALSEEPARVSAAGGGNKQKQAARNVLILMSDTGGGHRASAEALRDAFRIEFGDTYKVFVTDLGKEYGGWPLNDMERSYKFMIRHVRLWKVAFHGTSPRWVHGMYLAALAYYYANEVVAGIMKYEPDIIISVHPLMQHIPLWVLKWQSLHPKVPFVTVITDLNTCHPTWFHHGVTRCYCPSTEVANRALLRGLGPSQVRVFGLPIRPSFCRAVLDKDEVRKELGLDPQLPAVLLMGGGEGMGPVEETARALGEELYDHRRRRRVGQVVVICGRNQALRSTLQSLRWKVPVKIRGFETQMEKWMAACDCIITKAGPGTIAEALIRGLPIILNDFIPGQEVGNVPYVVDNGAGVFSKDPREAARQVVRWFSTDEDELKRYSRNALKLAQPEAVFHIVKDIHKLQQQPAAVTRIPYSLTSSFPYHI

SEQ ID NO: 8765 - DNA, 531 bp, Sorghum bicolor
  misc_feature: Ceres ANNOT ID no. 6091930
  misc_feature: Encodes the peptide sequence at SEQ ID NO 8766
atggcgcagcgcgacaagaaggtggaggagccgacggagctgcgggcgccggagctcacgctgtgcgccaacagctgcggcttcccggggaacccggccaccaacaacctctgccaggcctgcttccaggccgccacggcttcctccgcctcagcctccgtctcgccgccgtcgccttcctcctcgttgtctccgtccccggcggtgttcaagttcgacgagcagcagcacgcgaggccgtctgcgacggcggtgttcgccgaccggcctgcggagcaaccgccggcgccggcgtccgccaggccgatccggacgacgtcgacttcgtcgtcgtcgtccgtcaaccggtgccagagctgccggaagcgcgtcgggctgacggggttccggtgccgctgcggggagctcttctgcggcgcgcaccgctactcggaccgccacgactgctgcttcgactacaaggccgtcggcagggacgccatcgccagggagaaccccgtcgtgcgcgccgccaagatcgtcaggttctga

SEQ ID NO: 8766 - protein, 176 aa, Sorghum bicolor
  misc_feature: Ceres ANNOT ID no. 6091930
  misc_feature (117)..(157): Pfam Id: zf-AN1 Pfam Desc: AN1-like Zinc finger
  misc_feature (19)..(43): Pfam Id: zf-A20 Pfam Desc: A20-like zinc finger
  misc_feature (1)..(176): NCBI GI: 75147526 NCBI Desc: zinc finger a20 and an1 domain-containing stress-associated protein 11 (ossap11)
  misc_feature (1)..(176): NCBI GI: 68565615 NCBI Desc: multiple stress-responsive zinc-finger protein isap1 (stress-associated protein 1) (osisap1)
  misc_feature (1)..(176): NCBI GI: 37548823 NCBI Desc: multiple stress-associated zinc-finger protein [oryza sativa (indica cultivar-group)]
  misc_feature (1)..(176): NCBI GI: 115479855 NCBI Desc: os09g0486500 [oryza sativa (japonica cultivar-group)]
  misc_feature (1)..(176): NCBI GI: 112819496 NCBI Desc: stress-tolerance zinc finger protein [chrysanthemum x morifolium]
  misc_feature: Useful for making plants with modulated water use efficiency
  misc_feature: Functional homolog of the protein sequence given in SEQ ID NO 14030
MAQRDKKVEEPTELRAPELTLCANSCGFPGNPATNNLCQACFQAATASSASASVSPPSPSSSLSPSPAVFKFDEQQHARPSATAVFADRPAEQPPAPASARPIRTTSTSSSSSVNRCQSCRKRVGLTGFRCRCGELFCGAHRYSDRHDCCFDYKAVGRDAIARENPVVRAAKIVRF

SEQ ID NO: 8767 - DNA, 2085 bp, Sorghum bicolor
  misc_feature: Ceres ANNOT ID no. 6091931
  misc_feature: Encodes the peptide sequence at SEQ ID NO 8768
atggacgaggcggacgatgaacttcgcaccttgaaggtcggcttcaccgccgccggagaggagcagttccggaagctcgtggcggagaagctgcgggggttcaagagggacgtggaccacaccctcgtggaatatgttactatcatgctcaagaatggaaagcgtaaggatctcgccagtaaagaactccgtgtatttctaggggatgatactgcagtattcatttcctggttgtgggaccatctttctctaaatatgtacttatatgtgcaagcacaagaacaaactcaggaggttaaggatgatgaagcccccaaagaagtatctggaagagaaaaatcatcagatgtgctcccgagaagcaaatgtcaaactcatagtgagcacacagttgaatcaagtgcagctagtactaggaaacggaataagcgggaatggaaaggaattggtcgggagggtaatgaaaaatttccacttcgaaatgtactaactgatattcttcacggggaggagaaaagatcgcaaaagtccaatgaaatacgacaccctccatcaaaacaacagaacggcagaaagcgtgacagggatgatgagccacagcaaacaaagagagacgtctcatcacgccccatgcttggtggtggtgcttcccgtcgtcttctacagtttgctgttcgagatgcagtaaaagctgtacagccaaccagcaccaatgctgaaccagcatccaagcgtctgcgctctgtggttgccactacttctgcagagaacatgcatgataggagatcagaaagatctcaggactacctgaacgatagaagatcagaaagatctcaagacaacttgagtgacagaagatcagaaagaactaggccaatgctacaggtacaaggagctgctttagctcttagagctgcagcggaagctgctgcagattctacaaaggttagatctactggaagtgttttcaagcgattgggtcaagggaatgttgtgaaacagccatctcgttctcgtgatgagaagagagatttcgaagattttgagccagctacgaccgcagatgaacatgattctgatcgatatgttaataatgaggaatctgaagaggaatctggagagctgaccatggcagatagggtagctggaatgaatgttgattcgagctctgaggatgatatggaccgagatgaggggattacaagataccaaacttctctttcacatgaagatactttctcaccatttgcagagaagaaaactgtatcagcacaatgcagcgtcgaaccagagaccgatgcaataaggccttcaagtgtgaatgacaaggagcaacctgttccttcatcaacaaaaacagcaagtaaagctgtggctatttctgttgatgtaaatatggtggaaccttccagttatgaaacaccaaaagatgttcatgttgtggagaagccttatgttacacccatgaattcaaatgccaccacactggctaccaatgccaaagaagtaggccatgcagaagctcaaaaggattctcagcggtctgcaccatctgttccggtttcatatagcacagcgcatccgacggaggatgcagattcgagaacactttatgttagcaatgttcactttgctgccaccaaggactcattatctcgccatttcaacaagtttggtgcagttctaaaagtagtcattgtcactaatgctgcaacgggccagccaacagggtctgcctatgtagagttcttacacaaagaatcagctgaacgagcgttgtcgttgaatggcacatcatttatgactcgcattctcaaggtcgtccggcgaagttctcatgaagcagctcacttttatggttggcctggtagtggacggtcatcattatatggtaggcatggtaggatggcatacccaagagctgttctccccggtggttcctttagagggcgtgctccgatgaaagctggcgctagaagtttacagtggaaacgggagccttcaggcactgattcaagtgcaggtgcgaaaactgacatgagtgtgccattttcctctgaacaggtgctcccacctgcaacatag

SEQ ID NO: 8768 - protein, 694 aa, Sorghum bicolor
  misc_feature: Ceres ANNOT ID no. 6091931
  misc_feature (537)..(607): Pfam Id: RRM_1 Pfam Desc: RNA recognition motif. (a.k.a. RRM, RBD, or RNP domain)
  misc_feature (9)..(694): NCBI GI: 42407676 NCBI Desc: rna recognition motif (rrm)-containing protein-like [oryza sativa (japonica cultivar-group)]
  misc_feature (216)..(692): NCBI GI: 38344812 NCBI Desc: osjnbb0022f23.5 [oryza sativa (japonica cultivar-group)]
  misc_feature (216)..(692): NCBI GI: 116310267 NCBI Desc: b0806h07.2 [oryza sativa (indica cultivar-group)]
  misc_feature (216)..(683): NCBI GI: 115458922 NCBI Desc: os04g0472400 [oryza sativa (japonica cultivar-group)]
  misc_feature (185)..(673): NCBI GI: 145338423 NCBI Desc: rna binding / nucleic acid binding [arabidopsis thaliana]
  misc_feature: The sequence is a functional homolog of SEQ ID NO. 458 in the 11/188,298 US application
MDEADDELRTLKVGFTAAGEEQFRKLVAEKLRGFKRDVDHTLVEYVTIMLKNGKRKDLASKELRVFLGDDTAVFISWLWDHLSLNMYLYVQAQEQTQEVKDDEAPKEVSGREKSSDVLPRSKCQTHSEHTVESSAASTRKRNKREWKGIGREGNEKFPLRNVLTDILHGEEKRSQKSNEIRHPPSKQQNGRKRDRDDEPQQTKRDVSSRPMLGGGASRRLLQFAVRDAVKAVQPTSTNAEPASKRLRSVVATTSAENMHDRRSERSQDYLNDRRSERSQDNLSDRRSERTRPMLQVQGAALALRAAAEAAADSTKVRSTGSVFKRLGQGNVVKQPSRSRDEKRDFEDFEPATTADEHDSDRYVNNEESEEESGELTMADRVAGMNVDSSSEDDMDRDEGITRYQTSLSHEDTFSPFAEKKTVSAQCSVEPETDAIRPSSVNDKEQPVPSSTKTASKAVAISVDVNMVEPSSYETPKDVHVVEKPYVTPMNSNATTLATNAKEVGHAEAQKDSQRSAPSVPVSYSTAHPTEDADSRTLYVSNVHFAATKDSLSRHFNKFGAVLKVVIVTNAATGQPTGSAYVEFLHKESAERALSLNGTSFMTRILKVVRRSSHEAAHFYGWPGSGRSSLYGRHGRMAYPRAVLPGGSFRGRAPMKAGARSLQWKREPSGTDSSAGAKTDMSVPFSSEQVLPPAT

SEQ ID NO: 8769 - DNA, 357 bp, Sorghum bicolor
  misc_feature: Ceres ANNOT ID no. 6091936
  misc_feature: Encodes the peptide sequence at SEQ ID NO 8770
atgatctcacgagataactccagcatggactcagacaagggtgcctccgtgcagttccaggacttcctgccagtgatggcgaggaggctcggcgtggagggcctgatgcaggagctatgcaaggggttccagctgctcatggagcccagggcaggaaagatcaccttccggagcctgaagcagaacgcggccaggctcgggcttggccagctccgggatgatgaactcctggagatgatgaaggaaggtgacatggatggggacggggcgctggatcagttggagttctgcatcctcatggtcagactgagccctgagctgatggaagaagaggcacacatgatgtttcagcattga

SEQ ID NO: 8770 - protein, 118 aa, Sorghum bicolor
  misc_feature: Ceres ANNOT ID no. 6091936
  misc_feature (75)..(103): Pfam Id: efhand Pfam Desc: EF hand
  misc_feature (1)..(110): NCBI GI: 9255753 NCBI Desc: ef-hand ca2+-binding protein ccd1 [triticum aestivum]
  misc_feature (14)..(110): NCBI GI: 144923867 NCBI Desc: calcium-binding ef-hand [medicago truncatula]
  misc_feature (19)..(115): NCBI GI: 56542451 NCBI Desc: avr9/cf-9 rapidly elicited protein 20 [nicotiana tabacum]
  misc_feature (1)..(109): NCBI GI: 21536724 NCBI Desc: ef-hand ca2+-binding protein ccd1 [arabidopsis thaliana]
  misc_feature (11)..(109): NCBI GI: 92873884 NCBI Desc: calcium-binding ef-hand [medicago truncatula]
  misc_feature: Useful for making plants with altered glycerol content
  misc_feature: Functional homolog of the protein sequence given in SEQ ID NO 13517
  misc_feature: Useful for making plants with altered glycerol content
  misc_feature: Functional homolog of the protein sequence given in SEQ ID NO 13517
MISRDNSSMDSDKGASVQFQDFLPVMARRLGVEGLMQELCKGFQLLMEPRAGKITFRSLKQNAARLGLGQLRDDELLEMMKEGDMDGDGALDQLEFCILMVRLSPELMEEEAHMMFQH

SEQ ID NO: 8771 - DNA, 585 bp, Sorghum bicolor
  misc_feature: Ceres ANNOT ID no. 6091937
  misc_feature: Encodes the peptide sequence at SEQ ID NO 8772
atggcatcacgtaagcttctcatgggcctcacaaccaggaggcgactacaatcccgcactcagcaactattctggaccaccagtctccctgaagctaccacctctcggtccctcgtggtggctgctggtacagcgcagctatccggcaggtctccagcagctcttctcttctcttcaaggaccgtctcgtcgacgcagcccgtgacacagtcggcaggagatgtgtctggctctggcccatctgcagtggatcacaagttggcaatgcaagaggatgagtttcacaaattagcagatgagacgattcatgatttgcttgaaaaacttgaggtgatggatggtttcgacatagagtatgggaatcaggttttgacattaaggcttggggatttggggacatatgttataaacaagcaaacgccaaacaaacaaatctggctatcttcacctgtgagtggcccttctaggtttgattgggatgcaacaactaatggttggatatacaagaggactggagtgaaccttgtgcagcttctggagaaggagattggtgagctctgtggtaaaccagtagaactttcataa

SEQ ID NO: 8772 - protein, 194 aa, Sorghum bicolor
  misc_feature: Ceres ANNOT ID no. 6091937
  misc_feature (89)..(194): Pfam Id: Frataxin_Cyay Pfam Desc: Frataxin-like domain
  misc_feature (85)..(194): NCBI GI: 11513844 NCBI Desc: chain a, mature human frataxin
  misc_feature (85)..(194): NCBI GI: 31077081 NCBI Desc: frataxin isoform 1 preproprotein [homo sapiens]
  misc_feature (1)..(151): NCBI GI: 124360476 NCBI Desc: frataxin-like [medicago truncatula]
  misc_feature (85)..(194): NCBI GI: 1237439 NCBI Desc: frataxin
  misc_feature (91)..(194): NCBI GI: 21730873 NCBI Desc: chain a, the solution structure of the the c-terminal domain of frataxin, the protein responsible for friedreich ataxia
MASRKLLMGLTTRRRLQSRTQQLFWTTSLPEATTSRSLVVAAGTAQLSGRSPAALLFSSRTVSSTQPVTQSAGDVSGSGPSAVDHKLAMQEDEFHKLADETIHDLLEKLEVMDGFDIEYGNQVLTLRLGDLGTYVINKQTPNKQIWLSSPVSGPSRFDWDATTNGWIYKRTGVNLVQLLEKEIGELCGKPVELS

SEQ ID NO: 8773 - DNA, 1554 bp, Sorghum bicolor
  misc_feature: Ceres ANNOT ID no. 6091945
  misc_feature: Encodes the peptide sequence at SEQ ID NO 8774
atgatggcaggcccgggccgagctcatggccacagaaaccgcctccgccgcctcatcccgcggctcctcctcctcgtcttcgccctctacgccgcctccttcgcgatctacctcctcctccagtccgagtccgagtcccagtcccagtcccaccaccagtcgccgccggaccctaccccgatgactgaagcccgtgaaggcgtcggggcgccgccgtcctcgcagaagccgtggccgcgcctcccctccttcctaccctgggtgtccagccgagcgccgccgccgcacacctgcgaggcctacttcggcaacggcttctcccgcctcgtggacgtcctccctgcgggcggcggcggcggctggttccggtgccaccacagcgagacgctgggaagctcgatctgcgagggcgccagggtgcggcttgacccggcgctcatcgcgatgtcccgcggcggggagcctctggagcaggtgatgggccgcgccgaggaggaggagctgcccaagtacgagcccggcgcgctgcaggttgaggggccggcggcgggtaggacagcgcccctggtggacgctgggttcctcaacgactacgtgcccaccggcgggatcggtatgcacactatgaaggcgctgctcgagtcagcgcgcgttgtgccgcccggtgagctacactgctcccagtgggttgaagaaccgacactgttggtcactcgttttgaatatgcgaaccttttccacacaattacagactggtacagtgcatatgttagttccagagtcacgaatttaccaaaccgtcctaatgttatattcgtggatgggcattgcaaggcacaattggaggaaacatgggaagcacttttctcaagtgtgacatatgctaagaatttctctggtcctgtttgtttccgacatgccattctttcaccattgggctatgagactgccttgtttaagggccttagcgagagcttcagctgtgaaggtgcctccgcagagtccctccgagaaaaaacggactatgagaaaacatcacggttatctgaattcggggaaatgattgtagcttcgtttgatcttctgcaggatgacatcatgtcatccaaaaaatcaaatgggctcaatgttctctttgttcggcgagaagactacttggcccacccccgccacagtggtaaggttgaatccagactaagcaatgagcaggaggtgtatgatgcaattgacaagtgggcacaaggcctgaaatgcaaagtgaatgtcgtcaacggtctttttgcccacatgaccatgaaggagcaactgcgtgctatcctggaagcttcagtggtaataggggctcatggagccggtctaacacacttagtttcagcaactcctgatacaaaggttcttgagattatcagcagcatgtaccggcgcccacattttgcactgatctcacactggaagtctttagagtaccatgccataaatctccctgggtcatttgcaaggatcacagatgccatcagtgagttgagaaaaatactggaaggtctcggatgctga

SEQ ID NO: 8774 - protein, 517 aa, Sorghum bicolor
  misc_feature: Ceres ANNOT ID no. 6091945
  misc_feature (1)..(517): NCBI GI: 68303942 NCBI Desc: beta 1,2-xylosyltransferase [zea mays]
  misc_feature (1)..(517): NCBI GI: 83715789 NCBI Desc: beta-1,2-xylosyltransferase [zea mays]
  misc_feature (1)..(517): NCBI GI: 55956968 NCBI Desc: beta-2-xylosyltransferase [saccharum officinarum]
  misc_feature (63)..(517): NCBI GI: 83715783 NCBI Desc: beta-1,2-xylosyltransferase [sorghum bicolor]
  misc_feature (1)..(517): NCBI GI: 83715781 NCBI Desc: beta-1,2-xylosyltransferase [hordeum vulgare]
  misc_feature (180)..(517): SWISSPROT Homolog: EC 2.4.2.38 Beta-(1,2)-xylosyltransferase
MMAGPGRAHGHRNRLRRLIPRLLLLVFALYAASFAIYLLLQSESESQSQSHHQSPPDPTPMTEAREGVGAPPSSQKPWPRLPSFLPWVSSRAPPPHTCEAYFGNGFSRLVDVLPAGGGGGWFRCHHSETLGSSICEGARVRLDPALIAMSRGGEPLEQVMGRAEEEELPKYEPGALQVEGPAAGRTAPLVDAGFLNDYVPTGGIGMHTMKALLESARVVPPGELHCSQWVEEPTLLVTRFEYANLFHTITDWYSAYVSSRVTNLPNRPNVIFVDGHCKAQLEETWEALFSSVTYAKNFSGPVCFRHAILSPLGYETALFKGLSESFSCEGASAESLREKTDYEKTSRLSEFGEMIVASFDLLQDDIMSSKKSNGLNVLFVRREDYLAHPRHSGKVESRLSNEQEVYDAIDKWAQGLKCKVNVVNGLFAHMTMKEQLRAILEASVVIGAHGAGLTHLVSATPDTKVLEIISSMYRRPHFALISHWKSLEYHAINLPGSFARITDAISELRKILEGLGC

SEQ ID NO: 8775 - DNA, 1671 bp, Sorghum bicolor
  misc_feature: Ceres ANNOT ID no. 6091946
  misc_feature: Encodes the peptide sequence at SEQ ID NO 8776
atggacaagcgcggcagctcgtccgacgacgtggaggcgccgctgctcccgccgccgccgcccgcgcgcgacgacggtgccaaggaacggccgtcgtcgtcttgggtgcgcgcgctgctcgcgcacaggtacccggcggtggcgtcgggcccggcggcggccgcggccgtgtgcgtgctcgtggacctcggcttcggcgctgggggcgcccacgccaaccaccaccaccaccgcgaggcccgcaacatgctcgccgtgctcgcctgggtcttcctctggtgggtcacgggcgccgtcccgctggccgtcgcctccatggcgccgctcttcctcttcccgctcttcggcgtcgcctccgccgacgccgtcgccaaggcctacatggacgacgtcatctcgctcgtcctcggcagcttcatcctcgcgctcgccatcgagcactaccaaatccaccgccgcctcgccctcaacatcacgtcgctcttctgcggggacccggtgcggccgccgctgctgctgctgggcatcaccggcaccaccttcttcgtcagcatgtggatccacaacacggcgtgcacggtcatgatgatgccagtggcgacagggatcttgcagaggctgccgcgcggaggcggcgacgccggggcgcacggggaggtccgccgcttctccaaggcggtggtgctcggcgtcgtctacgcgtcggctatcggcgggatggccacgctggcgggcaccggcgtcaacatcattctcgtcgggatgtggtccacctacttcccggagcagcagcccatcaccttcagctcctggatgtgcttcggcctccccatggcgctcatcctcttcttggcactctggatcacgctctgccacatgtactgctccaaaaacaccggaaaggcactctctgctcacctcgacagaagccatctcagaagagagctcagcttgttagagaagatggtcttggcagtgtttgggggtctaattgtgctatggatgaccaggaaccttacagatgacatgccagggtggggagctctcttccacaacaaagttggagacggaacagtcaccatcatgatggccacgctactcttcataattccaagccggaagaacaagggcgagaagctgatggactggaacaagtgtaggaagctccagtgggacattatcctcctcctgggggcaggattcgccattgccgaaggattcaggtcaagcggcctcactgatatcctctctgacgggctcaggttcctgaagggtgcagagacggcggtcattgtacctgtggcctgcatcgtcagtggtgtcatcacggagttcacctctgacgatgcgaccacgacgctggtgctccccctgttcgctgaattggcgaaggcgatcaatgtgcacccagcgttccttatggtttctggagctgttggggctcagctttcctacttgttacctactggatcgccgtcaaacgtaattgggttcagtagtggccacattaccatcaaggatcttgtgatcacaggactgcccctgaaagttgtcgggatcgcagctctgacaatcttgatgccaactctagggcttcagccgtgcaagaaaaagaaaattgtttatctttccttttctgaagcaagcagcggaaaactctatgcaacttga

SEQ ID NO: 8776 - protein, 556 aa, Sorghum bicolor
  misc_feature: Ceres ANNOT ID no. 6091946
  misc_feature (44)..(533): Pfam Id: Na_sulph_symp Pfam Desc: Sodium:sulfate symporter transmembrane region
  misc_feature (6)..(531): NCBI GI: 115479845 NCBI Desc: os09g0484900 [oryza sativa (japonica cultivar-group)]
  misc_feature (7)..(531): NCBI GI: 116804319 NCBI Desc: vacuolar citrate/h+ symporter [citrus sinensis]
  misc_feature (6)..(531): NCBI GI: 21536650 NCBI Desc: sodium-dicarboxylate cotransporter-like [arabidopsis thaliana]
  misc_feature (6)..(531): NCBI GI: 12057074 NCBI Desc: sdat(at) [arabidopsis thaliana]
  misc_feature (83)..(531): NCBI GI: 9758784 NCBI Desc: sodium-dicarboxylate cotransporter-like [arabidopsis thaliana]
MDKRGSSSDDVEAPLLPPPPPARDDGAKERPSSSWVRALLAHRYPAVASGPAAAAAVCVLVDLGFGAGGAHANHHHHREARNMLAVLAWVFLWWVTGAVPLAVASMAPLFLFPLFGVASADAVAKAYMDDVISLVLGSFILALAIEHYQIHRRLALNITSLFCGDPVRPPLLLLGITGTTFFVSMWIHNTACTVMMMPVATGILQRLPRGGGDAGAHGEVRRFSKAVVLGVVYASAIGGMATLAGTGVNIILVGMWSTYFPEQQPITFSSWMCFGLPMALILFLALWITLCHMYCSKNTGKALSAHLDRSHLRRELSLLEKMVLAVFGGLIVLWMTRNLTDDMPGWGALFHNKVGDGTVTIMMATLLFIIPSRKNKGEKLMDWNKCRKLQWDIILLLGAGFAIAEGFRSSGLTDILSDGLRFLKGAETAVIVPVACIVSGVITEFTSDDATTTLVLPLFAELAKAINVHPAFLMVSGAVGAQLSYLLPTGSPSNVIGFSSGHITIKDLVITGLPLKVVGIAALTILMPTLGLQPCKKKKIVYLSFSEASSGKLYAT

SEQ ID NO: 8777 - DNA, 423 bp, Sorghum bicolor
  misc_feature: Ceres ANNOT ID no. 6091956
  misc_feature: Encodes the peptide sequence at SEQ ID NO 8778
atgagcgtggagatcctagacgggagcacggtgcggagcttcgtcgaggacgaaggcgccttcaactcctcggtggacggccggttcgccgcgctggacgccgaccacgacggcctgctcacctacgccgagatggcaggggagctcatgagcctgcgtgtgctggagaagcatttcggcgtggacgaggccgcggtggcgcccgacgagctcgcagggctgtaccgcagtctcttcgcgcggttcgacagggacggcagcgggatggtggaccgccatgagttccgggcggagatgaaggaggtgatgctcgcagtggccaacgggctcggcttcctccccgtgcagatggtcgtcgaggaaggcagcttcctcaaggtcgccgtcgacagggagctcggccagcttgccaaagctgcctga

SEQ ID NO: 8778 - protein, 140 aa, Sorghum bicolor
  misc_feature: Ceres ANNOT ID no. 6091956
  misc_feature (74)..(102): Pfam Id: efhand Pfam Desc: EF hand
  misc_feature (1)..(137): NCBI GI: 115453495 NCBI Desc: os03g0411300 [oryza sativa (japonica cultivar-group)]
  misc_feature (45)..(122): NCBI GI: 115480916 NCBI Desc: os10g0116300 [oryza sativa (japonica cultivar-group)]
  misc_feature (1)..(133): NCBI GI: 140046306 NCBI Desc: calcium-binding ef-hand [medicago truncatula]
  misc_feature (5)..(135): NCBI GI: 15221845 NCBI Desc: calcium-binding ef hand family protein [arabidopsis thaliana]
  misc_feature (6)..(125): NCBI GI: 3550661 NCBI Desc: 39 kda ef-hand containing protein [solanum tuberosum]
MSVEILDGSTVRSFVEDEGAFNSSVDGRFAALDADHDGLLTYAEMAGELMSLRVLEKHFGVDEAAVAPDELAGLYRSLFARFDRDGSGMVDRHEFRAEMKEVMLAVANGLGFLPVQMVVEEGSFLKVAVDRELGQLAKAA

SEQ ID NO: 8779 - DNA, 423 bp, Sorghum bicolor
  misc_feature: Ceres ANNOT ID no. 6091963
  misc_feature: Encodes the peptide sequence at SEQ ID NO 8780
atgagcgtggagatcctcgacgggagcactgtccggagcttcgtggaggacgaaggcgccttcaactcctcggtggacggccggttcgccgcgctggacgccgaccacgatggtctgctcacctacgccgagatggccgacgagctcatgagcctgcgcgtgttggagaagcacttcggcgtggatgaggccgtggcggcgccggaggagctcgcagggctgtaccgcagcctgttcgcgcggtttgacagggacggcagcggcaaggttgacaggcaggagttccgggcagagatgaaggaggtgatgctcgctgttgccaacgggctgggcttcctccccgtgcagatggtcgtcgaggaaggcagtttcctcaaggtcgccgtcgacagggagctcggccagctcgccaaagctgcctga

SEQ ID NO: 8780 - protein, 140 aa, Sorghum bicolor
  misc_feature: Ceres ANNOT ID no. 6091963
  misc_feature (74)..(102): Pfam Id: efhand Pfam Desc: EF hand
  misc_feature (1)..(137): NCBI GI: 115453495 NCBI Desc: os03g0411300 [oryza sativa (japonica cultivar-group)]
  misc_feature (45)..(122): NCBI GI: 115480916 NCBI Desc: os10g0116300 [oryza sativa (japonica cultivar-group)]
  misc_feature (1)..(133): NCBI GI: 140046306 NCBI Desc: calcium-binding ef-hand [medicago truncatula]
  misc_feature (5)..(135): NCBI GI: 15221845 NCBI Desc: calcium-binding ef hand family protein [arabidopsis thaliana]
  misc_feature (6)..(125): NCBI GI: 3550661 NCBI Desc: 39 kda ef-hand containing protein [solanum tuberosum]
MSVEILDGSTVRSFVEDEGAFNSSVDGRFAALDADHDGLLTYAEMADELMSLRVLEKHFGVDEAVAAPEELAGLYRSLFARFDRDGSGKVDRQEFRAEMKEVMLAVANGLGFLPVQMVVEEGSFLKVAVDRELGQLAKAA

SEQ ID NO: 8781 - DNA, 1971 bp, Sorghum bicolor
  misc_feature: Ceres ANNOT ID no. 6092003
  misc_feature: Encodes the peptide sequence at SEQ ID NO 8782
atggaagagagcagaatagctccgatttcagtcacatggaggggcagacagcttgatgtggatgccgatccaagctgtactgtgaaagagtttgggcaactgctgcaggacttgactagtgttaagccagagacattgaagctcattgttccacaatctacaaacaaaggctccaagctcatcacgccattttcagatccacattcgaggttgacactgaatgaagcggatattagcgagggaaaacctatccggatgatgggggtttatgatgatgaaattgaggaggtatctgacaatggcaaaagacctgaccaacgtttaattggatttgatgaagaagaacagcggcttaggcaaagatcatcaggcaggccacagatttcactcaaacttcctcagggacaatacatcttctgtgattttcggacacttcacttacctgggattgagctgaatcctccaccttcggaagctctgaaacgaatgcacatgcttgcatgcgaccctggtataattgcgatcatgaaaaagcataaatggagagtcggaatcatgactgagatggctcctgttggatatgtaggcgttagtccgaaatgtattttaggtttcaataagaacatgggagaggagatatctcttcgcctacgaactgatgacttgaagggattcaggaagtacgaaagtatcaagaaaactctacttcatgagcttgcacatatggtgcactctgagcatgatgcaaatttttttgctcttaataagcagttgaatgaggaagctgcttccatggactggaccaagtctacaggtcatatgttgagtggtcgcaaaatctttgattcatatgaagaggaatttgttctagaaccagagataactgttgctggtcacaggcttgggggagaatcaagttcgctggctagtgctcgtgcattgtcaggggctgctgcttaccagcgctttttggatgcatctgctaaggcggatcatgatgcttcaggcactaaaattgaatataatcctgatgatgttcctcaagattttgttcatgaaactttgaaggtacagccagatccagatgatgctatgcatgtggattcagcagctgggatatcattggcaggacagcctactatcagttactctgagcctgatcctgatgatgttgagaagcatgagaagcaaagttctgatagatgcctacaacctgatcctgatgttccctcaaatgctaataatctgaaccaggagctgaggtttgatggaagaccccatagcaaacctgatcctgatgatagtactaatgaagttgttccggaatctggaaacaagatggaagtggatagtgaactgacaaacagcgtcacagtcttgaagtatgaacctgaccctgctgattcctcaaatgctattgtcaaacaggatttggtcatcgatgggaagcatggtgaagaacctgatcctgatgatactgcttgtcaagatgttttaaaatctggaaatttgacagaaaggataacagaacagagcagaaactccacagttttgaagtctgaacctgatcctgacgatcatgttgttgattcaaacagcaatgagctgcaaaggattgaagaaccagtggcagccctctgttcacgactccagaagtcaattgagacgctccggttgcaagcgacacctgcagaggcagagtctgctattcatacactctttaagattatcaagaatgttatagagcatccaaatgatattaagtataagagattgcgtaagtccaacccacatttccaaaggagtgtagcaaactataaagctgcaatggaggttcttgaattgattggtttctgcgaggatgtgatctcagatgagattgggcgtgcagagacttacctggtattgaaaaggaacgatcctggattgctatggctggcaaaatcttctcttgaagtctctctggcttga

SEQ ID NO: 8782 - protein, 656 aa, Sorghum bicolor
  misc_feature: Ceres ANNOT ID no. 6092003
  misc_feature (139)..(324): Pfam Id: WLM Pfam Desc: WLM domain
  misc_feature (1)..(656): NCBI GI: 42407752 NCBI Desc: zinc metalloproteinase-like [oryza sativa (japonica cultivar-group)]
  misc_feature (154)..(286): NCBI GI: 3790252 NCBI Desc: spcc1442.07c [schizosaccharomyces pombe]
  misc_feature (147)..(345): NCBI GI: 8778309 NCBI Desc: f14j16.17 [arabidopsis thaliana]
  misc_feature (150)..(337): NCBI GI: 44984511 NCBI Desc: afr042cp [eremothecium gossypii]
  misc_feature (150)..(337): NCBI GI: 45198560 NCBI Desc: afr042cp [eremothecium gossypii]
MEESRIAPISVTWRGRQLDVDADPSCTVKEFGQLLQDLTSVKPETLKLIVPQSTNKGSKLITPFSDPHSRLTLNEADISEGKPIRMMGVYDDEIEEVSDNGKRPDQRLIGFDEEEQRLRQRSSGRPQISLKLPQGQYIFCDFRTLHLPGIELNPPPSEALKRMHMLACDPGIIAIMKKHKWRVGIMTEMAPVGYVGVSPKCILGFNKNMGEEISLRLRTDDLKGFRKYESIKKTLLHELAHMVHSEHDANFFALNKQLNEEAASMDWTKSTGHMLSGRKIFDSYEEEFVLEPEITVAGHRLGGESSSLASARALSGAAAYQRFLDASAKADHDASGTKIEYNPDDVPQDFVHETLKVQPDPDDAMHVDSAAGISLAGQPTISYSEPDPDDVEKHEKQSSDRCLQPDPDVPSNANNLNQELRFDGRPHSKPDPDDSTNEVVPESGNKMEVDSELTNSVTVLKYEPDPADSSNAIVKQDLVIDGKHGEEPDPDDTACQDVLKSGNLTERITEQSRNSTVLKSEPDPDDHVVDSNSNELQRIEEPVAALCSRLQKSIETLRLQATPAEAESAIHTLFKIIKNVIEHPNDIKYKRLRKSNPHFQRSVANYKAAMEVLELIGFCEDVISDEIGRAETYLVLKRNDPGLLWLAKSSLEVSLA

SEQ ID NO: 8783 - DNA, 1902 bp, Sorghum bicolor
  misc_feature: Ceres ANNOT ID no. 6092027
  misc_feature: Encodes the peptide sequence at SEQ ID NO 8784
atggggaagaggcagaggaagactcccgggcgcgcacaggcaccaaagtccaagcggaccgatgagctagcggctatgtctgattctgacaacgacgaaattgatgccttccacaagcagcgggacatgatcccctttgacaccagtgatgtaagggagtcggaggacgacgatgtggagcagcctgtgtttgaccttgagggtgtttctgatagcgaaagtgatgacagcaaaggagaagagtctggtgacatggctgaagctgattatgaagaatgggacaaagggtatatttcaaaattaaaaagggcacagagggctgtcaaacaaattgctggaggtgatgatagcatggatgagcaggaggatgaaacaaaagaaaatgtttggggcagaggtaaaaatgcatactatgctgctggtgaacagtctggtgatgatgaggtggattacgaggaggctcaaaggatccaaaaaaatcaggaaaaaaaactgtctatgaaagattttggactagaagatggtgaaagtgatgaagagaataatgtcacaaaggtatccaaccatgaaaccaaaatgaaagaagactttgctgtcttatcaggcgatgacaaaatggatgtggtatacagttctgcccctgaactcgttagcttgttgtctgagttgaaggatgcccatgaagaacttagggctataggacagcttaccagtgaggtcacgtcttgtctaggcaaagataaaatgcaaccttttgaagtgaagaaagcttgtttgcttgctcattgtcaagctattaccttctatctccttatgaaatctgaggggttgtccgtacaggatcatcctgtaatttctcgcttgatagagaccaagaatatggtagagaagataaagcaagtcaccatgaattcagcgaggcaaaaagggagcactgatgaccatattatgcatagcggcaccatccaaacagataagaatgtcgcactggacaaacaggaaggcaaatttagcaatgtactagcactggataaagtgatccaaggtgctgaagtctctgaatcaagaaagagtgagccttctaaaaatgatttccatgaagtcaacgaacagaagaacaaggatgaacatatgggtttgcatagcctggaaatgttgaaggtaagagcagatcttgaggaaagattaaagaaaaaagggctctataatttgaaaaagtcgaagccagagaagttgtcaaaaaccaggacaactagtaataaaaggggcctgcagacattggatgactttgatgatgaagtgctgaagaataatcaaataatgaaacctagcaagcttgttgcagctgctgctaaatcaaataaaagcatgtttgtttctggtgatgatgaccttccgaagagagacaatattggagaaagacggagaaaacacgagcttcgcgttctatcaagagtaggagctaactcagtggaagatcatgagttgccagatggtgacgcttctgaagatgacgcttctgaagatgaccatgagtcttcagaaggtggtgatgcttctgaagatggcttctatgaggatgttaaaagacagaggactgaaaaactatcaatcaagaatgctctgtactcgagaactccgggcattgaacctccagaggaagaaactgaaggcgacggcaagaggacgatttcataccagatcttgaagaaccgggggttgactcgttccaggaacaagaaaaagaagaatccgagaaagaactacagggataaacataaaaacaagcttgtcaagcggaaaggccaagtgcgtgatatcaagaagccgtctggtccatatggaggtgaaatgtctggcatcaacccgaatgtcagccgaagtgttcggttcaagagttga

SEQ ID NO: 8784 - protein, 633 aa, Sorghum bicolor
  misc_feature: Ceres ANNOT ID no. 6092027
  misc_feature (215)..(297): Pfam Id: Sas10_Utp3 Pfam Desc: Sas10/Utp3 family
  misc_feature (212)..(633): NCBI GI: 140070032 NCBI Desc: something about silencing protein 10 , related [medicago truncatula]
  misc_feature (329)..(632): NCBI GI: 113205290 NCBI Desc: integrase core domain containing protein [solanum demissum]
  misc_feature (26)..(408): NCBI GI: 18858223 NCBI Desc: cg4202-pa [drosophila melanogaster]
  misc_feature (2)..(301): NCBI GI: 12061569 NCBI Desc: charged amino acid rich leucine zipper factor-1 [mus musculus]
  misc_feature (547)..(633): NCBI GI: 54643722 NCBI Desc: ga18026-pa [drosophila pseudoobscura]
MGKRQRKTPGRAQAPKSKRTDELAAMSDSDNDEIDAFHKQRDMIPFDTSDVRESEDDDVEQPVFDLEGVSDSESDDSKGEESGDMAEADYEEWDKGYISKLKRAQRAVKQIAGGDDSMDEQEDETKENVWGRGKNAYYAAGEQSGDDEVDYEEAQRIQKNQEKKLSMKDFGLEDGESDEENNVTKVSNHETKMKEDFAVLSGDDKMDVVYSSAPELVSLLSELKDAHEELRAIGQLTSEVTSCLGKDKMQPFEVKKACLLAHCQAITFYLLMKSEGLSVQDHPVISRLIETKNMVEKIKQVTMNSARQKGSTDDHIMHSGTIQTDKNVALDKQEGKFSNVLALDKVIQGAEVSESRKSEPSKNDFHEVNEQKNKDEHMGLHSLEMLKVRADLEERLKKKGLYNLKKSKPEKLSKTRTTSNKRGLQTLDDFDDEVLKNNQIMKPSKLVAAAAKSNKSMFVSGDDDLPKRDNIGERRRKHELRVLSRVGANSVEDHELPDGDASEDDASEDDHESSEGGDASEDGFYEDVKRQRTEKLSIKNALYSRTPGIEPPEEETEGDGKRTISYQILKNRGLTRSRNKKKKNPRKNYRDKHKNKLVKRKGQVRDIKKPSGPYGGEMSGINPNVSRSVRFKS

SEQ ID NO: 8785 - DNA, 999 bp, Sorghum bicolor
  misc_feature: Ceres ANNOT ID no. 6092030
  misc_feature: Encodes the peptide sequence at SEQ ID NO 8786
atgtcggcgccctccgatgccgcagcggcagtagccgcgcccgcgcccacgacgaccgccgccgcctcctccagcggcggcttcaccttcaagctccacccgctcgtcatcgtgaacgtctccgaccaccacacccgcgtcaaggcccaggccgcctgctccggggacagctcctcctcctcgtctgcggcggggtccgggcagccgccgagggtgttcgggtgcgtgatcggggtgcagcgcgggcggaccgtggagatcttcaacagcttcgagctcgtgctcgaccccgtctccggcaccctcgaccgcgccttcctcgagaagaagcaggagctctataagaaggtgttccccgacttttacgtgcttggttggtactccactggaagtgatgtgcacgagaccgacatgcaaatccacaaagccttgatggatgttaacgaaagccctgtttatcttctattaaatcctacaatcaacctctcccagaaggatctccctgtgactatctatgagagtgagttgcatgtcatcgatgggagtcctcagctcatttttgtaagatccaattatacaattgagactgtagaggctgagaggatatctgtcgaccatgttgcccatctcaaaccttctgatggtggctcagcagcaactcagttggctgctcatcttacaggaatacacagtgccatcaagatgctcaatagcagggtccgtgttatccatcagtatcttgttgccatgcaaaaaggtgacattccagtggataattcactgcttaggcaagtctcaagcctcgtaagaaggctaccagctatggagtcacagaaattccaagatgacttcttaatggaatacaacgacactctcctcatgacttacttggcaatgttcactaactgttcaagcacaatgaacgagttggtcgagaagatcaacacaagctatgaaagaccgactgccaggagaggaggccgaggtgctttcatgtag

SEQ ID NO: 8786 - protein, 332 aa, Sorghum bicolor
  misc_feature: Ceres ANNOT ID no. 6092030
  misc_feature (25)..(150): Pfam Id: Mov34 Pfam Desc: Mov34/MPN/PAD-1 family
  misc_feature (1)..(332): NCBI GI: 89267201 NCBI Desc: cop9 signalosome subunit 6 [oryza sativa]
  misc_feature (1)..(332): NCBI GI: 113624121 NCBI Desc: os08g0500000 [oryza sativa (japonica cultivar-group)]
  misc_feature (21)..(332): NCBI GI: 15809663 NCBI Desc: cop9 complex subunit 6 [arabidopsis thaliana]
  misc_feature (21)..(332): NCBI GI: 18056665 NCBI Desc: csn complex subunit 6a [arabidopsis thaliana]
  misc_feature (21)..(332): NCBI GI: 17940314 NCBI Desc: cop9 signalosome subunit 6 [arabidopsis thaliana]
  misc_feature: The plant is abnormally small.
  misc_feature: Useful for making plants with modulated biomass
  misc_feature: GREAT-hit functional homolog of the protein sequence given in SEQ ID NO 12948
  misc_feature: Useful for making plants with modulated biomass
  misc_feature: Functional homolog of the protein sequence given in SEQ ID NO 12948
MSAPSDAAAAVAAPAPTTTAAASSSGGFTFKLHPLVIVNVSDHHTRVKAQAACSGDSSSSSSAAGSGQPPRVFGCVIGVQRGRTVEIFNSFELVLDPVSGTLDRAFLEKKQELYKKVFPDFYVLGWYSTGSDVHETDMQIHKALMDVNESPVYLLLNPTINLSQKDLPVTIYESELHVIDGSPQLIFVRSNYTIETVEAERISVDHVAHLKPSDGGSAATQLAAHLTGIHSAIKMLNSRVRVIHQYLVAMQKGDIPVDNSLLRQVSSLVRRLPAMESQKFQDDFLMEYNDTLLMTYLAMFTNCSSTMNELVEKINTSYERPTARRGGRGAFM

SEQ ID NO: 8787 - DNA, 2241 bp, Sorghum bicolor
  misc_feature: Ceres ANNOT ID no. 6092041
  misc_feature: Encodes the peptide sequence at SEQ ID NO 8788
atggcggggagcgacctcgagccgctgcgcacgggcgcggcggcgctgccgtcctcgtcggacccggactcgccagccgcgaccccgcgccggagccgcgtgaaggacctgctgcgcaacctggaccgccggctctccaaccggagccgcggcggcgagggcgtgggcgtgggcgcggccgcggggcacggcggcggggaggccggggtgtcgccgaggaggggcgaggaggatagcgacgagcttggcgacggcgcgccgcccgagtgggcgcttctgctcgtcggttgcctcctcgggctcgccaccggcatctgcgtcgccgcgttcaatcgcggagtacatgtcatacatgaatgggcatgggcaggcactcccactgagggtgctgcttggcttcgtctgcagaggcttgctgatacttggcataggatattgttaattccagtgactggtggagtagttgtgggtatgatgcatggattattggagatttttgagcagataaagcaatcgttatcatctcaaagggagggtattgatttcatgtctgcgatttttcccacaatcaaagccatccaagctgcaattactttagggacagggtgttcactggggccagaaggacccagtgttgatattggtaaatcgtgtgcaaatgggtgtgctgaaatgatggagaacaatagggagcgtagaattgctcttgttgctgctggatcagctgctggaatcgcttcagttgctggatgcttttttgctatcgaaacagtattaaggccacttcgagcagaaaattctccaccatttactactgctatgattatattggcatcagttatatcatcaactgtttccaatgttttgctaggggaaaaggcagcatttattgtcccgacgtatgaactaaaatctgctgctgagctgccactctaccttattctgggcatgctttgtggtgttgtgagcgtggcattcaggcagttggttgtttggttcactaagacctttgacttgataaggaagaagtttggccttcctgctgtagtatgtcctgctctaggtggtcttggagctggtttaatagctctaaggtatcctggaatattgtattggggtttcaccaatgtcgatgagattctacatacgggtaaaagtgcttcagcccctggaatctggctcttggctcaattagctgctgcgaaagttgtagcaacggcactttgcaaaggttctggtcttgttggtggcctttatgctccaagtttgatgattggcgctgctgtcggtgctgtttttggaggctcagcagcagaattaataaactctgcgattccaggtaacactgctgtcgcacatcctcaagcttatgcactggtgggaatggctgctacgctggcttcagtgtgttctgttccattgacgtctgtgctgctgctctttgaattgactaaggattacagaattctacttcctctaatgggagctgttggtttagcaatatgggtgccatctgttgtaaatcaatctggtagcaaagatacattcgaggcaacatcacctcgtcatggctattcgtcactgttacctcccacagatagaaatgagacagattggaggcgacaagatggagacgatgtggaactcgcaattctagacgttgatccctaccactatggtagtaacaatgaggagatgcttcttgatgacttgaaggtatcacaagcaatgacaaagcattatttgaaggtcacagctacattcactatcgaggagactacaaggcttatgcaagagaagcagcaaagctgtgttgttgttgtagataacgaagattttcttgagggaattgtaacattaggtgaccttcgtcgtaaaggatttgtgccaagtgaaaactctgatagtacccaggcaaattcatcgaccttggatgcaaattcttctcttgtgtcatcatgcctcactcgaggttttcagttccatggcaatgaaagagggctagtgacctgctttccagatacagacctgagcactgccaaggttcttatggaagttaaagggattaaacaactaccagtagtcaaacgtggtgctggccgtagaaatgatgggaggcgtaaggtccttggccttcttcattatgattcaataggatggtgcttaagggaagagcttgagcggtggaaggcactataccagagagagaatttccagcagtcaacagttaatgggcactga

SEQ ID NO: 8788 - protein, 746 aa, Sorghum bicolor
  misc_feature: Ceres ANNOT ID no. 6092041
  misc_feature (150)..(506): Pfam Id: Voltage_CLC Pfam Desc: Voltage gated chloride channel
  misc_feature (575)..(714): Pfam Id: CBS Pfam Desc: CBS domain pair
  misc_feature (41)..(655): NCBI GI: 8778501 NCBI Desc: f20n2.5 [arabidopsis thaliana]
  misc_feature (246)..(579): NCBI GI: 86438776 NCBI Desc: chloride channel-f protein [brachypodium sylvaticum]
  misc_feature (158)..(746): NCBI GI: 30695978 NCBI Desc: voltage-gated chloride channel family protein [arabidopsis thaliana]
  misc_feature (76)..(695): NCBI GI: 41688502 NCBI Desc: chloride channel protein clc-e (atclc-e)
  misc_feature (76)..(695): NCBI GI: 14039799 NCBI Desc: clc-e chloride channel protein [arabidopsis thaliana]
MAGSDLEPLRTGAAALPSSSDPDSPAATPRRSRVKDLLRNLDRRLSNRSRGGEGVGVGAAAGHGGGEAGVSPRRGEEDSDELGDGAPPEWALLLVGCLLGLATGICVAAFNRGVHVIHEWAWAGTPTEGAAWLRLQRLADTWHRILLIPVTGGVVVGMMHGLLEIFEQIKQSLSSQREGIDFMSAIFPTIKAIQAAITLGTGCSLGPEGPSVDIGKSCANGCAEMMENNRERRIALVAAGSAAGIASVAGCFFAIETVLRPLRAENSPPFTTAMIILASVISSTVSNVLLGEKAAFIVPTYELKSAAELPLYLILGMLCGVVSVAFRQLVVWFTKTFDLIRKKFGLPAVVCPALGGLGAGLIALRYPGILYWGFTNVDEILHTGKSASAPGIWLLAQLAAAKVVATALCKGSGLVGGLYAPSLMIGAAVGAVFGGSAAELINSAIPGNTAVAHPQAYALVGMAATLASVCSVPLTSVLLLFELTKDYRILLPLMGAVGLAIWVPSVVNQSGSKDTFEATSPRHGYSSLLPPTDRNETDWRRQDGDDVELAILDVDPYHYGSNNEEMLLDDLKVSQAMTKHYLKVTATFTIEETTRLMQEKQQSCVVVVDNEDFLEGIVTLGDLRRKGFVPSENSDSTQANSSTLDANSSLVSSCLTRGFQFHGNERGLVTCFPDTDLSTAKVLMEVKGIKQLPVVKRGAGRRNDGRRKVLGLLHYDSIGWCLREELERWKALYQRENFQQSTVNGH

SEQ ID NO: 8789 - DNA, 660 bp, Sorghum bicolor
  misc_feature: Ceres ANNOT ID no. 6092058
  misc_feature: Encodes the peptide sequence at SEQ ID NO 8790
atggagaactgtaacaacggaccggcggctgccgacaatttcaaggtggtggtgccggagcatccactgatcagccactgggtctcagtgctccgcgatcgcttcaccccttcccatgccttcaggagtgcgatgggagagttagggagattgctaatctatgaggcaactcgggattggctgccgacagtaacacgggagatccagacaccagtgggaactgcggttgttgaatctgtcagtgagatggagccaatcatgattgtacctattcttagagcagggcttgctcttgcagatcttgcaacatcaattttgccatcaactaaaactttccatttaggtatgtccagggatgagacaacgctgctgccctctgtttacttaaataagctacctgatagattcccaaaaggatgtaatatactccttgtggatcctatgctagcaactgcagttgatctggttaaggagcgtggagctgaaatcagtcagataagaatcatatcagctgttgctgctcctcctgcaatcaagaagctcaatcaaagattcccagggatttgtgtgtatacaggaactatggatcaaattgtgaatgagaaaggtttcatagttccaggccttggggatgctggagaccgcagctatggaacatga

SEQ ID NO: 8790 - protein, 219 aa, Sorghum bicolor
  misc_feature: Ceres ANNOT ID no. 6092058
  misc_feature (63)..(191): Pfam Id: Pribosyltran Pfam Desc: Phosphoribosyl transferase domain
  misc_feature (6)..(219): NCBI GI: 1848214 NCBI Desc: uracil phosphoribosyltransferase [nicotiana tabacum]
  misc_feature (16)..(219): NCBI GI: 21536984 NCBI Desc: uracil phosphoribosyltransferase-like protein [arabidopsis thaliana]
  misc_feature (11)..(219): NCBI GI: 16329360 NCBI Desc: uracil phosphoribosyltransferase [synechocystis sp. pcc 6803]
  misc_feature (15)..(219): NCBI GI: 53687805 NCBI Desc: cog0035: uracil phosphoribosyltransferase [nostoc punctiforme pcc 73102]
  misc_feature (11)..(219): NCBI GI: 81169405 NCBI Desc: uracil phosphoribosyltransferase [synechococcus elongatus pcc 7942]
  misc_feature (6)..(219): SWISSPROT Homolog: EC 2.4.2.9 Uracil phosphoribosyltransferase
MENCNNGPAAADNFKVVVPEHPLISHWVSVLRDRFTPSHAFRSAMGELGRLLIYEATRDWLPTVTREIQTPVGTAVVESVSEMEPIMIVPILRAGLALADLATSILPSTKTFHLGMSRDETTLLPSVYLNKLPDRFPKGCNILLVDPMLATAVDLVKERGAEISQIRIISAVAAPPAIKKLNQRFPGICVYTGTMDQIVNEKGFIVPGLGDAGDRSYGT

SEQ ID NO: 8791 - DNA, 741 bp, Sorghum bicolor
  misc_feature: Ceres ANNOT ID no. 6092060
  misc_feature: Encodes the peptide sequence at SEQ ID NO 8792
atggcgaccggcggtggcagcatcccgaatgtccacagcaacaccgacagcagcaacaagacgctgctcaagagccaagccctgtacaagtacatcctggacacgacggtgctgccgaacgagccggagtgcatgcgcgagctgcgcctcctcacggacaagcacgagcggaggaacatggcgacgccgccggacgaggcgcagctgctgcggatgctgatcaagctgagcggcgcgaggaacgccatcgaggtgggcgtcttcaccggctgctcgctcctggccacggcgctggcgctgcccgacgacgggaaggtggtcgccgtcgacgtgagccgcgagtactacgacctcggccgccccatcatcgacaaggccggtgtggcgcacaaggtggacttccgggagggccctgcgctggagcacctggacgcgctgctcgccgacgaggccaaccacggcgcgttcgacttcgccttcgtcgacgccgacaagcccaactacgtgcggtaccacgagcagctgctccgcctggtgcgcgtcggcggcgccgtcgtgtacgacaacacgctgtgggacggcaccgtggcgctgccgcccgacgcgcccatgtcggaccacgaccgccgcatctccgccgccgtccgcgacctcaacgcccgcctctcggcggacccgcgcgtcgaggtctgccagctcgccatcgccgacggcgtcaccatctgccgccgcgtcgtgtga

SEQ ID NO: 8792 - protein, 246 aa, Sorghum bicolor
  misc_feature: Ceres ANNOT ID no. 6092060
  misc_feature (33)..(245): Pfam Id: Methyltransf_3 Pfam Desc: O-methyltransferase
  misc_feature (39)..(245): NCBI GI: 145845830 NCBI Desc: caffeoyl-coa o-methyltransferase [phyllostachys edulis]
  misc_feature (1)..(245): NCBI GI: 57639629 NCBI Desc: caffeoyl coa 3-o-methyltransferase [betula platyphylla]
  misc_feature (1)..(245): NCBI GI: 82941443 NCBI Desc: caffeoyl-coa-o-methyltransferase [codonopsis lanceolata]
  misc_feature (2)..(245): NCBI GI: 37221605 NCBI Desc: caffeoyl-coa 3-o-methyltransferase 1 [zea mays]
  misc_feature (4)..(245): NCBI GI: 32347451 NCBI Desc: caffeoyl coa 3-o-methyltransferase [zea mays]
  misc_feature (2)..(245): SWISSPROT Homolog: EC 2.1.1.104 Caffeoyl-CoA O-methyltransferase 1
  misc_feature: Useful for making plants with altered Lignin content
  misc_feature: Useful for making plants with altered cell wall content and/or composition
  misc_feature: Functional homolog of the protein sequence given in SEQ ID NO 13248
  misc_feature: Useful for making plants with altered carbohydrate content
  misc_feature: Functional homolog of the protein sequence given in SEQ ID NO 14031
  misc_feature: Useful for making plants with altered cell wall content and/or composition
  misc_feature: Useful for making plants with altered lignin content
  misc_feature: Functional homolog of the protein sequence given in SEQ ID NO 13248
MATGGGSIPNVHSNTDSSNKTLLKSQALYKYILDTTVLPNEPECMRELRLLTDKHERRNMATPPDEAQLLRMLIKLSGARNAIEVGVFTGCSLLATALALPDDGKVVAVDVSREYYDLGRPIIDKAGVAHKVDFREGPALEHLDALLADEANHGAFDFAFVDADKPNYVRYHEQLLRLVRVGGAVVYDNTLWDGTVALPPDAPMSDHDRRISAAVRDLNARLSADPRVEVCQLAIADGVTICRRVV

SEQ ID NO: 8793 - DNA, 741 bp, Sorghum bicolor
  misc_feature: Ceres ANNOT ID no. 6092063
  misc_feature: Encodes the peptide sequence at SEQ ID NO 8794
atggcgcccagcggcgacaccatcgcgcaggtccacaccggcctcgacagcagcaacaagacgctgctcaagagcgaggccctctacaagtacgtcctggacacgtcggtgctgccacacgagcccgactgcatgcgtgagctccgcctcgtcaccgacaagcaccagtgggggttcatgcagtcgtcccccgacgaggcgcagctcctccggatgctgctcaagctcaccggcgcacgcaacacgctcgaggtcggcgtgttcacgggctactcccttctcgccacggcgctcgccctccccgacgacggcaaggtggtggcgttcgacgtgagcagggagtactacgacatcggccgccctttcatcgagagcgccggcgtcgcgcacaaggtcgacttccgggaaggcccggcgctggacggcctggacgcgctgctcgccgacgaggccaaccacggcgcgttcgacttcgcgttcgtcgacgccgacaagcccaactacgtgcggtaccacgagcagctgctccgtctggtgagggtgggcgggagcatcgtgtatgacaacacgctgtgggccgggaccgtggcgttgccgccggagacgcccatgaatgacctggaccggaggttctcggcggcgatcaaggacctcaatgtcaggctgtctaaggatgagcgcgtcgaggtctgccagctcgccatcgccgacggcatcaccatctgccgccgcctcgtctga

SEQ ID NO: 8794 - protein, 246 aa, Sorghum bicolor
  misc_feature: Ceres ANNOT ID no. 6092063
  misc_feature (33)..(245): Pfam Id: Methyltransf_3 Pfam Desc: O-methyltransferase
  misc_feature (39)..(245): NCBI GI: 145845830 NCBI Desc: caffeoyl-coa o-methyltransferase [phyllostachys edulis]
  misc_feature (1)..(245): NCBI GI: 82941443 NCBI Desc: caffeoyl-coa-o-methyltransferase [codonopsis lanceolata]
  misc_feature (1)..(245): NCBI GI: 57639629 NCBI Desc: caffeoyl coa 3-o-methyltransferase [betula platyphylla]
  misc_feature (19)..(245): NCBI GI: 5101868 NCBI Desc: caffeoyl coa o-methyltransferase [zea mays]
  misc_feature (19)..(245): NCBI GI: 37221605 NCBI Desc: caffeoyl-coa 3-o-methyltransferase 1 [zea mays]
  misc_feature (19)..(245): SWISSPROT Homolog: EC 2.1.1.104 Caffeoyl-CoA O-methyltransferase 1
  misc_feature: Useful for making plants with altered Lignin content
  misc_feature: Useful for making plants with altered cell wall content and/or composition
  misc_feature: Functional homolog of the protein sequence given in SEQ ID NO 13248
  misc_feature: Useful for making plants with altered carbohydrate content
  misc_feature: Functional homolog of the protein sequence given in SEQ ID NO 14031
  misc_feature: Useful for making plants with altered cell wall content and/or composition
  misc_feature: Useful for making plants with altered lignin content
  misc_feature: Functional homolog of the protein sequence given in SEQ ID NO 13248
MAPSGDTIAQVHTGLDSSNKTLLKSEALYKYVLDTSVLPHEPDCMRELRLVTDKHQWGFMQSSPDEAQLLRMLLKLTGARNTLEVGVFTGYSLLATALALPDDGKVVAFDVSREYYDIGRPFIESAGVAHKVDFREGPALDGLDALLADEANHGAFDFAFVDADKPNYVRYHEQLLRLVRVGGSIVYDNTLWAGTVALPPETPMNDLDRRFSAAIKDLNVRLSKDERVEVCQLAIADGITICRRLV

SEQ ID NO: 8795 - DNA, 741 bp, Sorghum bicolor; identical to SEQ ID NO: 8793
  misc_feature: Ceres ANNOT ID no. 6092066
  misc_feature: Encodes the peptide sequence at SEQ ID NO 8796

SEQ ID NO: 8796 - protein, 246 aa, Sorghum bicolor; identical to SEQ ID NO: 8794
  misc_feature: Ceres ANNOT ID no. 6092066
  misc_feature (33)..(245): Pfam Id: Methyltransf_3 Pfam Desc: O-methyltransferase
  misc_feature (39)..(245): NCBI GI: 145845830 NCBI Desc: caffeoyl-coa o-methyltransferase [phyllostachys edulis]
  misc_feature (1)..(245): NCBI GI: 82941443 NCBI Desc: caffeoyl-coa-o-methyltransferase [codonopsis lanceolata]
  misc_feature (1)..(245): NCBI GI: 57639629 NCBI Desc: caffeoyl coa 3-o-methyltransferase [betula platyphylla]
  misc_feature (19)..(245): NCBI GI: 5101868 NCBI Desc: caffeoyl coa o-methyltransferase [zea mays]
  misc_feature (19)..(245): NCBI GI: 37221605 NCBI Desc: caffeoyl-coa 3-o-methyltransferase 1 [zea mays]
  misc_feature (19)..(245): SWISSPROT Homolog: EC 2.1.1.104 Caffeoyl-CoA O-methyltransferase 1
  misc_feature: Useful for making plants with altered Lignin content
  misc_feature: Useful for making plants with altered cell wall content and/or composition
  misc_feature: Functional homolog of the protein sequence given in SEQ ID NO 13248
  misc_feature: Useful for making plants with altered carbohydrate content
  misc_feature: Functional homolog of the protein sequence given in SEQ ID NO 14031
  misc_feature: Useful for making plants with altered cell wall content and/or composition
  misc_feature: Useful for making plants with altered lignin content
  misc_feature: Functional homolog of the protein sequence given in SEQ ID NO 13248

SEQ ID NO: 8797 - DNA, 1311 bp, Sorghum bicolor
  misc_feature: Ceres ANNOT ID no. 6092068
  misc_feature: Encodes the peptide sequence at SEQ ID NO 8798
atgtcgcagcacgacgacgacctcgccggagttcattcggaagaaggagaccgccacggcgttgtaatggatgactccgactacgaggacgatgagttggaccaatctactagtaaagcgactgaacacatcacggctatggatgtgaagaaggggaaggatatacaagggatcccctgggacatgatggcgactacaagagacaagtacaggcagtcaaggctgcagcggtatgccaactttgagaacgtacctaattccggaaggatttcagagaaggaatgcatgcctgcagagaaaggccaactctactatgagtttcagcatagcacgaggtcggtgaaatcgaccatccttcatttccagttgagaaatttagtatgggcaacgacaaggcacgatgtgtatcttatgtcaaacttttctgtgcttcattggtcagcactgacttgtaaaaagcaagaagtcattgatcttcaagcacatgtcacaccatgtgagaagcaccatgggaattactatgagggattttatcggactccagttagtactttggcagtgaagcataatttgcttgttactggtggatttcatggggaaataatatgcaagtttctggatcgtcaaggagtaagctactgttgcaagtcaacacaagatgacaatggtattactaattctttggaaatatttgagaaacctagtggttctctgcacttcctggcgtcaaataatgattgtggacttagagactttgacgtggaaagatttcaaatatgcaatcacttccgttttgcttggcccgtgaatcatacgtcactgagccctgatggtaaacttgctgctattgtgggggacaatcctgatggacttgtgattgatcccagttcaggaaagacgattcacgaactccgtggccatttggattactcctttgcgtcagcatggaatccagatggccgaacatttgccactggaaaccaagacaagacatgcagggtctgggacatccgcaatctctccaaatcagttgctgtattgggtggcaacatcggagccatcaggtcgattcgctacacatctgatgggaagttcatggcaatgactgaaccagcagatttcatccacatctttgatgtagagagtgggtatagcaggaagcaggaactggacttctttggtgagatcgcgggaatatcgttcagtcctgacactgaagctctttttgttggtgtgcatgatcgcgtattcagctgcctcctccagtttaatcggcgaaggttctactcgtaccttgattcgcctgtgtga

SEQ ID NO: 8798 - protein, 436 aa, Sorghum bicolor
  misc_feature: Ceres ANNOT ID no. 6092068
  misc_feature (298)..(336): Pfam Id: WD40 Pfam Desc: WD domain, G-beta repeat
  misc_feature (41)..(434): NCBI GI: 86438777 NCBI Desc: gibberellin myb transcription factor [brachypodium sylvaticum]
  misc_feature (1)..(434): NCBI GI: 22655036 NCBI Desc: at3g13340/mdc11_13 [arabidopsis thaliana]
  misc_feature (3)..(434): NCBI GI: 18423837 NCBI Desc: wd-40 repeat family protein [arabidopsis thaliana]
  misc_feature (3)..(434): NCBI GI: 21536732 NCBI Desc: wd-repeat protein-like [arabidopsis thaliana]
  misc_feature (3)..(434): NCBI GI: 9758639 NCBI Desc: wd-repeat protein-like [arabidopsis thaliana]
  misc_feature: The sequence is a functional homolog of SEQ ID NO. 502 in the 11/188,298 US application
MSQHDDDLAGVHSEEGDRHGVVMDDSDYEDDELDQSTSKATEHITAMDVKKGKDIQGIPWDMMATTRDKYRQSRLQRYANFENVPNSGRISEKECMPAEKGQLYYEFQHSTRSVKSTILHFQLRNLVWATTRHDVYLMSNFSVLHWSALTCKKQEVIDLQAHVTPCEKHHGNYYEGFYRTPVSTLAVKHNLLVTGGFHGEIICKFLDRQGVSYCCKSTQDDNGITNSLEIFEKPSGSLHFLASNNDCGLRDFDVERFQICNHFRFAWPVNHTSLSPDGKLAAIVGDNPDGLVIDPSSGKTIHELRGHLDYSFASAWNPDGRTFATGNQDKTCRVWDIRNLSKSVAVLGGNIGAIRSIRYTSDGKFMAMTEPADFIHIFDVESGYSRKQELDFFGEIAGISFSPDTEALFVGVHDRVFSCLLQFNRRRFYSYLDSPV

SEQ ID NO: 8799 - DNA, 1455 bp, Sorghum bicolor
  misc_feature: Ceres ANNOT ID no. 6092078
  misc_feature: Encodes the peptide sequence at SEQ ID NO 8800
atgggtagcagggtggccgcggcgctgctccggcggggcagggaccaggcatccgccctgctgatgcctcgtctgccgaggaacgcccctgctccggccccaacgcctagggttggatccgcctcctcctcctcctgcggcggcggcggtggcggaagctgcctcctcccgccgaggccggggccagcgggggccttctctccggcttcccggttcggctccttctacgccttccgatccctcgcccccaaggtcatgtttggccaatgcacaaggagaatgtcaactaccgcggcaacactgaactcagctgcggccagtggagcagcaaattcaggattgaagctacttgttacgaaagggcctcaagcacagaaggcagtcgggatatggctctttgggtgtgctgcctgggtgttcagcttggtcatactcggagggattactcggctcacacgttctgggctgtcaatgactgactggaagttcacaggggaaatacctccaattacagacgatgcatggcagctggaatttgagaaatacaagcaatcacctgagtacaagagggtgaacaaaggaatgagccttgaagatttcaaatttatatactggatggagtatgcacacagaatgtggggaagagctttgggctttgtatttgcaggtccttttgcatacttcatcgcaaaaggttatgttacccgccaacttgggctcaggctgtcggctctttttgcacttggtggtgcacaaggactcattggctggtggatggtgaaaagtggccttgaggaaccaacatcggagtatgttcaaccaagggttagcccttacaggctggcaactcacctgacatctgcatttgttatatactgtggtatattgtggactgctttatcagtagtgatgcctgatcctccaaccggatcaatgagttgggtaaatggtgcagcaaaaatcagaaagttggcaattcctgtcagtgctgttgtaggcattactgcaatatctggagcatttgttgcaggcaatgatgcagggcacgcatacaattcattcccaaagatgggtgacagttggattcctgaagatgtatttagcatggagcctttcatacgcaatttttttgagaatacatctacagtacagctcaatcaccgaattctcgcaacaagcacattactctctgtgggtggattatggttggctgcaaggaaaatagacatgcatccagcagtcaagtcgctgatcggaagcacacttgggatggctgctctccaggttacattgggcatatctacactattgatgtatgttccaacctctttgggctcagcgcaccaagctggagcattgactctattgtcacttatgatccttctcactcacacgctaagaaggccgtcaccagctcttcttaaatcaatcgcaactgctgtgaaatcaacctga

SEQ ID NO: 8800 - protein, 484 aa, Sorghum bicolor
  misc_feature: Ceres ANNOT ID no. 6092078
  misc_feature (118)..(468): Pfam Id: COX15-CtaA Pfam Desc: Cytochrome oxidase assembly protein
  misc_feature (101)..(483): NCBI GI: 92897854 NCBI Desc: cytochrome oxidase assembly [medicago truncatula]
  misc_feature (109)..(468): NCBI GI: 18204496 NCBI Desc: cox15 protein [mus musculus]
  misc_feature (53)..(467): NCBI GI: 116116172 NCBI Desc: ensangp00000013266 [anopheles gambiae str. pest]
  misc_feature (82)..(468): NCBI GI: 3603230 NCBI Desc: cytochrome oxidase assembly factor [homo sapiens]
  misc_feature (103)..(468): NCBI GI: 61359162 NCBI Desc: cox15-like cytochrome c oxidase assembly protein [synthetic construct]
MGSRVAAALLRRGRDQASALLMPRLPRNAPAPAPTPRVGSASSSSCGGGGGGSCLLPPRPGPAGAFSPASRFGSFYAFRSLAPKVMFGQCTRRMSTTAATLNSAAASGAANSGLKLLVTKGPQAQKAVGIWLFGCAAWVFSLVILGGITRLTRSGLSMTDWKFTGEIPPITDDAWQLEFEKYKQSPEYKRVNKGMSLEDFKFIYWMEYAHRMWGRALGFVFAGPFAYFIAKGYVTRQLGLRLSALFALGGAQGLIGWWMVKSGLEEPTSEYVQPRVSPYRLATHLTSAFVIYCGILWTALSVVMPDPPTGSMSWVNGAAKIRKLAIPVSAVVGITAISGAFVAGNDAGHAYNSFPKMGDSWIPEDVFSMEPFIRNFFENTSTVQLNHRILATSTLLSVGGLWLAARKIDMHPAVKSLIGSTLGMAALQVTLGISTLLMYVPTSLGSAHQAGALTLLSLMILLTHTLRRPSPALLKSIATAVKST

SEQ ID NO: 8801 - DNA, 2253 bp, Sorghum bicolor
  misc_feature: Ceres ANNOT ID no. 6092080
  misc_feature: Encodes the peptide sequence at SEQ ID NO 8802
atgacggtgggcgccgggatcgccgtccaggacggcagcctcctggcgctgggggccaaggtcctgcgggaggtgcgccccaacgtgctcgtcacgcccgccgccggcggaggcctcaccaacggcgcgttcctcggcgtccgctccgcacccgccggcagccgcagcgtcttccccgtcggcaagctccgtgaccagcgattcatgtgcacgttccggttcaagatgtggtggatgacgcagaggatgggctcatcaggccgcgacatccccttcgagacgcagttcctgatcgtcgaaggcaccgatggactgcagtccaccggcgatggcaccggcgagcagcctgtcgtgtacaccatcttcctccccatattggagggctcattccgtgctgttcttcaggggaacgctgacgatgagctggagatttgcttagagagcggcgatccagatgtggaatccttcgaaggctcccatctggtcttcgttggcgccggatcggatccgttcgaggtcatcacaaattcagtaaaagtcgttgagaggcacttgcagacgttttctcacagggaaaagaaaaagatgccagacatgctcaactggtttggttggtgcacatgggatgcattctacaccaatgtcactgctcaaggagtgaagaaaggattgcagagctttgagaaaggtggggtttctcctagatttgtcataattgacgatggatggcagtcggtcgctatggatcctgtgggaatcgcttgcttatctgataactcagccaagttgactcacattaaggagaaccacaagtttcagaaaaatggcagggagggtcacagggaagatgatccagcaaagggcctagcacacatcgtcaatgaaatcaaagggaaacatgagctgaagtacgtgtatgtatggcatgccattaccggttactggggtggagtcaggccaggtgtagctggaatggagcactacgaatcaaagatgcagcagcctgtgtcatcaccaggggttcagaaaaacgagccctgtgatgctttggacagcataacgaccaatggaatgggccttgtgaaccctgagaaagtattcagtttctacaatgaactccactcgtatcttgcatctgctgggatcgacggggtcaaggtagacgtgcagaacatccttgagacgctaggtgctggccatggtggaagggtactgctagctagaaagtaccagcaggctctagaagcttccgtcgctaggaacttccctgacaatggcatcatatcatgcatgagccacaacactgacaacttatacagttcaaaacggagcgcggtgattagagcctctgatgatttctggccgagagaccctgcttcccataccatacacattgcatctgtcgcctataacaccgtctttcttggtgaattcatgcagccagattgggacatgttccatagtgttcatccgatggctgaataccatgctgcagctcgagcggttggtggttgtgccatatatgtgagtgacaagcctggaaaccatgacttcaatctgcttaagaagcttgtgcttcctgatggatcgatcctgcgtgcaaaactccctgggagaccaactagagattgcctcttctcagatcccgcaagggacggcaaaagcattctcaagatatggaacctgaacgaacactccggtgtcattggcgccttcaactgccaaggcgccggctggtgccaggtagggaagaagaacctcatccacgacgagcagcccggaacagtgacaggcgtcatccgggcacaggatgtgggctaccttgcaaaggttgctgatcagagctggaacggtgacgtgatcgtgtattcccacgtaggaggggaggtggtgtacctgccgaagaacgcctcgctgcctgtgacgctgagatcacgcgagtacgaggtgttcaccgtggtccctctgaagcacctgccaaacggcgtctccttcgcgccgatcggcctggtcggcatgttcaactccggtggcgcggtgagggaggtgaggttcagtgaggatgccgacgtcgagctcaaagtgcggggctcgggcacggtcggcgcttattcctcgacgaggccgaggagtgtcaccatcgattcgaaggcggttggtttttgctacgatgacgcctgtggccagctcacctttgagcttggcctctccgaacaagaactatacttttggacagtttcagtgggctactga

SEQ ID NO: 8802 - protein, 750 aa, Sorghum bicolor
  misc_feature: Ceres ANNOT ID no. 6092080
  misc_feature (7)..(734): Pfam Id: Raffinose_syn Pfam Desc: Raffinose synthase or seed imbibition protein Sip1
  misc_feature (1)..(750): NCBI GI: 33323027 NCBI Desc: alkaline alpha galactosidase 3 [zea mays]
  misc_feature (1)..(748): NCBI GI: 23452226 NCBI Desc: alkaline alpha-galactosidase seed imbibition protein [lycopersicon esculentum]
  misc_feature (1)..(748): NCBI GI: 87128422 NCBI Desc: alkaline alpha galactosidase i [cucumis sativus]
  misc_feature (1)..(748): NCBI GI: 29838629 NCBI Desc: alkaline alpha galactosidase i [cucumis melo]
  misc_feature (224)..(546): NCBI GI: 8778496 NCBI Desc: f20n2.14 [arabidopsis thaliana]
  misc_feature: Useful for making plants with altered carbohydrate content
  misc_feature: Functional homolog of the protein sequence given in SEQ ID NO 14032
MTVGAGIAVQDGSLLALGAKVLREVRPNVLVTPAAGGGLTNGAFLGVRSAPAGSRSVFPVGKLRDQRFMCTFRFKMWWMTQRMGSSGRDIPFETQFLIVEGTDGLQSTGDGTGEQPVVYTIFLPILEGSFRAVLQGNADDELEICLESGDPDVESFEGSHLVFVGAGSDPFEVITNSVKVVERHLQTFSHREKKKMPDMLNWFGWCTWDAFYTNVTAQGVKKGLQSFEKGGVSPRFVIIDDGWQSVAMDPVGIACLSDNSAKLTHIKENHKFQKNGREGHREDDPAKGLAHIVNEIKGKHELKYVYVWHAITGYWGGVRPGVAGMEHYESKMQQPVSSPGVQKNEPCDALDSITTNGMGLVNPEKVFSFYNELHSYLASAGIDGVKVDVQNILETLGAGHGGRVLLARKYQQALEASVARNFPDNGIISCMSHNTDNLYSSKRSAVIRASDDFWPRDPASHTIHIASVAYNTVFLGEFMQPDWDMFHSVHPMAEYHAAARAVGGCAIYVSDKPGNHDFNLLKKLVLPDGSILRAKLPGRPTRDCLFSDPARDGKSILKIWNLNEHSGVIGAFNCQGAGWCQVGKKNLIHDEQPGTVTGVIRAQDVGYLAKVADQSWNGDVIVYSHVGGEVVYLPKNASLPVTLRSREYEVFTVVPLKHLPNGVSFAPIGLVGMFNSGGAVREVRFSEDADVELKVRGSGTVGAYSSTRPRSVTIDSKAVGFCYDDACGQLTFELGLSEQELYFWTVSVGY

SEQ ID NO: 8803 - DNA, 993 bp, Sorghum bicolor
  misc_feature: Ceres ANNOT ID no. 6092083
  misc_feature: Encodes the peptide sequence at SEQ ID NO 8804
atgaccgacggcgcgcgcgtcgaggcggcgcccaggctcgcgcaatggcgcgtcgaggcgctcccctgctacacctatcgcaagtcactccccttccgcatcggcctctggaactggtacctgtctgtggagagaaataacaagcaaacttgtgttaagctctttgcagagaatccaaattctcccaagaacggcccctcagccccaatagcttcctttatcaccaaacttctcatatctcttccacctaatcaacagaccatagtccacccagggattttcgacaaacagctgaaacacgacggttttgtgtgggcaatcgatagcactgtgacagggagatttgtgattgagatagagtttcttgacctgaaggtcgctgatccatctggtggcgaaccagcctcaatctgggcctcccgccagatcaagcagtgttcagacagcaccgctctgtcctccctggctcggatgctgcacgaggacatcctcaccgacatcaccatcaacgcggcggacggcagcgtgcgtgcgcaccgcgccatcctggcgacgcggtcgccggtgttccggagcatgttctcgcacgacctcagggagaaggagctctccaccgtggacatctccgacatgtccctggacgcgtgccgcgccttcctcagctacatctacggcgacgtgagcggcgaggagttcctggcgaaccggctggcgctgctccgtgccgccgacaagtacgacatcgacgacctcagggaggcctgccacgagagcctgctggaggacatcaacatgggcaacgtgctggagcggctgcagacggcgcacctgtaccagctgcccaggctcaagggcggctgccttaggttcctggtggacttcaggaaggtgtacgagatgcacgacgacctcaacgcgttcctgcagacggccgacagggacctcgtggccgaggtgttccatggcgtccttgctgcgtggagcggccggtga

SEQ ID NO: 8804 - protein, 330 aa, Sorghum bicolor
  misc_feature: Ceres ANNOT ID no. 6092083
  misc_feature (155)..(263): Pfam Id: BTB Pfam Desc: BTB/POZ domain
  misc_feature (1)..(330): NCBI GI: 42408860 NCBI Desc: poz domain protein family-like [oryza sativa (japonica cultivar-group)]
  misc_feature (1)..(329): NCBI GI: 92874921 NCBI Desc: btb/poz; traf-like [medicago truncatula]
  misc_feature (1)..(292): NCBI GI: 8778495 NCBI Desc: f20n2.15 [arabidopsis thaliana]
  misc_feature (6)..(324): NCBI GI: 92870505 NCBI Desc: btb/poz; traf-like [medicago truncatula]
  misc_feature (40)..(327): NCBI GI: 50725708 NCBI Desc: poz domain protein family-like [oryza sativa (japonica cultivar-group)]
MTDGARVEAAPRLAQWRVEALPCYTYRKSLPFRIGLWNWYLSVERNNKQTCVKLFAENPNSPKNGPSAPIASFITKLLISLPPNQQTIVHPGIFDKQLKHDGFVWAIDSTVTGRFVIEIEFLDLKVADPSGGEPASIWASRQIKQCSDSTALSSLARMLHEDILTDITINAADGSVRAHRAILATRSPVFRSMFSHDLREKELSTVDISDMSLDACRAFLSYIYGDVSGEEFLANRLALLRAADKYDIDDLREACHESLLEDINMGNVLERLQTAHLYQLPRLKGGCLRFLVDFRKVYEMHDDLNAFLQTADRDLVAEVFHGVLAAWSGR

SEQ ID NO: 8805 - DNA, 1209 bp, Sorghum bicolor
  misc_feature: Ceres ANNOT ID no. 6092086
  misc_feature: Encodes the peptide sequence at SEQ ID NO 8806
atggggtcgtggtgctccaaggagaacacgccggggggcaggcagcagcagcacgatcacaaccacaaccacaatcacagcagcggtgccgcgagtaaagggggcaagaatcggtacgccaacttcggcgatgattaccacactctggagcaggttaccaatgcccttgcacatgctggtctggagtcctctaatctgattgttgggattgatttcacaaagagcaacgaatggacaggccaagtgtccttcaacaaccggagcttgcatgcaatgggaaacactccaaacccatatgagcaggccatatccatcatagggagaaccctcgcacgatttgatgaggacaacctcataccatgctttggatttggcgacacaactactcatgatcaatctgtatttagcttctaccgtgataaccaaccgtgtgatggctttgagcaagcacttgctcggtacagggaacttgttccgcaacttaatttggctggtcccacttcatttgcgccaatcattgagactgctattggaattgttgatagtagtggtggccagtatcatgttttgcttataatagcagatggacaggttacacgcagcgttgaaacaggcaatggtcagttgagccgacaggaaagggagaccatagatgccattgtgaaggctagtgactacccactttcaattgttcttgttggtgttggggatgggccatgggacatgatgaggcaattcgatgacaacataccttcccgcgcattcgacaattttcagtttgtgaacttcacacagatcatgtcaaggcctatacccaccagcaaaaaggaggcagaatttgctctttcagcactgatggagattccagaacaattcaaggcagcactgagcctccagcttcttggaaaacaaagaggatttctgaaccggccagtgctgcctccacctgggaacggtgggctgaaatactctggatggtcagcagtaaaaccgactgaatgcactagctacggatcagcgcctgagaagccatctgcgcctcgactggacagtgacataggtgatccacagacctgtccaatctgctggagccaaacaaaggaccttgctttcgggtgtgggcatcagacgtgttctgactgcgcgaaggatctgaaggtgtgcccgatatgccagagagcgatctccacaagactgaagctctactga

SEQ ID NO: 8806 - protein, 402 aa, Sorghum bicolor
  misc_feature: Ceres ANNOT ID no. 6092086
  misc_feature (88)..(236): Pfam Id: Copine Pfam Desc: Copine
  misc_feature (1)..(402): NCBI GI: 42408845 NCBI Desc: copine i-like [oryza sativa (japonica cultivar-group)]
  misc_feature (28)..(402): NCBI GI: 56785364 NCBI Desc: copine iii-like [oryza sativa (japonica cultivar-group)]
  misc_feature (28)..(402): NCBI GI: 109627815 NCBI Desc: copine-like protein [oryza sativa (japonica cultivar-group)]
  misc_feature (25)..(402): NCBI GI: 30697566 NCBI Desc: copine-related [arabidopsis thaliana]
  misc_feature (25)..(402): NCBI GI: 46390797 NCBI Desc: copine i-like protein [oryza sativa (japonica cultivar-group)]
MGSWCSKENTPGGRQQQHDHNHNHNHSSGAASKGGKNRYANFGDDYHTLEQVTNALAHAGLESSNLIVGIDFTKSNEWTGQVSFNNRSLHAMGNTPNPYEQAISIIGRTLARFDEDNLIPCFGFGDTTTHDQSVFSFYRDNQPCDGFEQALARYRELVPQLNLAGPTSFAPIIETAIGIVDSSGGQYHVLLIIADGQVTRSVETGNGQLSRQERETIDAIVKASDYPLSIVLVGVGDGPWDMMRQFDDNIPSRAFDNFQFVNFTQIMSRPIPTSKKEAEFALSALMEIPEQFKAALSLQLLGKQRGFLNRPVLPPPGNGGLKYSGWSAVKPTECTSYGSAPEKPSAPRLDSDIGDPQTCPICWSQTKDLAFGCGHQTCSDCAKDLKVCPICQRAISTRLKLY

SEQ ID NO: 8807 - DNA, 2523 bp, Sorghum bicolor
  misc_feature: Ceres ANNOT ID no. 6092090
  misc_feature: Encodes the peptide sequence at SEQ ID NO 8808
atgtcgccggccgccggagagcagctctctggagcccacagagagggcaggggcgtggaggcgcggagggtcttcataggcgccggctgcaaccgcgtggtgaacaacgtctcgtggggagcctgcggtctcgtcgccttcggcacccagaacgctgtcgccctcttctctcccctgagaggtgagatcgtgacaacgcttccggggcacaaagcaccggtgaactgcacgctatggcttcccacgaagaaggatgtgctccaagttcgtggcaaggaaacacactatctactctcaggaagtgctgatggtactatcatggcttggaagattgcttctggcaaaggagagctcccagggatgcataagaaagggatcacctgtcttgctggaaggatggtatctgatactgttgcaatttttgcttctacttcttcagatggtattgttgttatttgggagatggagattgagcccaccacccctggtggcgattgcaaagtgtcttgcctgcatgctctgtccgttggtttgaaaccaatggtttcactttcattagctgtattgccagaacaaggaggccatctcattttggcgatgggcggtttagatcacaagatccacatctattgtggggataaggcaggcaagttcgttaaggcctgtgagcttaaaggtcattctgattggatcagaagtttagacttttctttacctgtgatgatgggtggtgagaagcacaatcttttccttgttagttcatctcaggaccgaaccatccggatatggaaaatgacttcagaagctgctgcttctggctcctccgtaccattgaggaaaggagctattgagatgacctcatatattgaaggacctctatttgtggctggcagtacaagttaccaagtatcattggagtctcttcttgttgggcatgaggattgggtatattccgtcgagtggcagccgcctacattgttaactggggatgaagctcatcagccaatgagcatactatctgcatccatggacaagatgatgatgatgtggaggccagagaaaaatactggcctttggattaattcagtgacagttggtgaattaagtcactccgcacttgggttttatggtggtcattggcagtctgatggtagatccattcttgcacatggttacggtggatcatttcatatgtggagagatgttggactggattctgaaaattggcagcctcagatagtcccgtctggtcattttgcacctgtgtctgacttgacatgggctagatctggccaatatttgctttcaacaacacgcatatttgctccttggagaaatcaagttaaccctggagacatggtctattggcgtgaaattgcccgcccgcaaattcatggccatgatctcaactgtgtgacattcattcagggtagtgggaaccatcgctttgttagtggtgctgatgaaaaggtatctagagtttttgaagctcccttatcatttttgaagaccctacaacaagcaactctgttgaaacctgacatctctgaggattttggcaatgttcaagtccttggagcaaatatgtctgctcttgggctttcacagaaacccatatatacgcatgcaggagtcaaggaatccccaagcggtaattctaatgatggcccagattctatggagacaattcctgatgcagtgcctactgtattcactgagcctcctgtggaggaccaacttgcgtggaatactctatggcctgaatcacacaaactatatggtcatggaaacgagctcttctcgatatgctgtgattatgaagggaagcttgttgcgtcatcttgcaaggctcaatcagcagcagttgctgagatctggctatgggaggttggaacatggaaagctgttggccgcttgcaatctcacaatctaacagtgacacaaatggagttctctcgtgataatgtgtttcttttaagtgtttcaagagatcgccatttgtctatcttttcaatcagcaaaactgaagaaggagcagagcaccgtctggtcgcaaagcttgaagcacacaaaagaattatatgggcatgctcatggaacccctttggctatgaatttgcaactggatcaagggacaagagtgtcaagatatggtgtgttaaagacgcatcttctgtgaagctacttgcaacattgcctcagttccgtgacagtgtaactgcattagcatggatgtgccatgaccgtgcttctaatgctggtgtcctcgctgttggcatggataatggattgatcgagctctggagtgtttcaggtggaagagcttctgcaggcagtactccagactctccactcagcgtggcatgcacgcttcgatttgaccctgtcttatgccacgtgtcaactgttcaccgtttacggtggcgggaacccagttccaccgatgaggaatcaacacttgagctcgcttcttgtggagctgaccacactgtaagggtgtttgaggtccgcgacaccatatag

SEQ ID NO: 8808 - protein, 840 aa, Sorghum bicolor
  misc_feature: Ceres ANNOT ID no. 6092090
  misc_feature (61)..(110): Pfam Id: WD40 Pfam Desc: WD domain, G-beta repeat
  misc_feature (218)..(264): Pfam Id: WD40 Pfam Desc: WD domain, G-beta repeat
  misc_feature (303)..(351): Pfam Id: WD40 Pfam Desc: WD domain, G-beta repeat
  misc_feature (633)..(671): Pfam Id: WD40 Pfam Desc: WD domain, G-beta repeat
  misc_feature (681)..(719): Pfam Id: WD40 Pfam Desc: WD domain, G-beta repeat
  misc_feature (15)..(837): NCBI GI: 145336554 NCBI Desc: nucleotide binding [arabidopsis thaliana]
  misc_feature (170)..(809): NCBI GI: 123905222 NCBI Desc: elongator complex protein 2 (elp2)
  misc_feature (244)..(567): NCBI GI: 28850432 NCBI Desc: similar to arabidopsis thaliana (mouse-ear cress). f13f21.2 protein [dictyostelium discoideum]
  misc_feature (197)..(836): NCBI GI: 119621780 NCBI Desc: signal transducer and activator of transcription 3 interacting protein 1, isoform cra_c [homo sapiens]
  misc_feature (19)..(836): NCBI GI: 48146655 NCBI Desc: statip1 [homo sapiens]
  misc_feature: The sequence is a functional homolog of SEQ ID NO. 502 in the 11/188,298 US application
MSPAAGEQLSGAHREGRGVEARRVFIGAGCNRVVNNVSWGACGLVAFGTQNAVALFSPLRGEIVTTLPGHKAPVNCTLWLPTKKDVLQVRGKETHYLLSGSADGTIMAWKIASGKGELPGMHKKGITCLAGRMVSDTVAIFASTSSDGIVVIWEMEIEPTTPGGDCKVSCLHALSVGLKPMVSLSLAVLPEQGGHLILAMGGLDHKIHIYCGDKAGKFVKACELKGHSDWIRSLDFSLPVMMGGEKHNLFLVSSSQDRTIRIWKMTSEAAASGSSVPLRKGAIEMTSYIEGPLFVAGSTSYQVSLESLLVGHEDWVYSVEWQPPTLLTGDEAHQPMSILSASMDKMMMMWRPEKNTGLWINSVTVGELSHSALGFYGGHWQSDGRSILAHGYGGSFHMWRDVGLDSENWQPQIVPSGHFAPVSDLTWARSGQYLLSTTRIFAPWRNQVNPGDMVYWREIARPQIHGHDLNCVTFIQGSGNHRFVSGADEKVSRVFEAPLSFLKTLQQATLLKPDISEDFGNVQVLGANMSALGLSQKPIYTHAGVKESPSGNSNDGPDSMETIPDAVPTVFTEPPVEDQLAWNTLWPESHKLYGHGNELFSICCDYEGKLVASSCKAQSAAVAEIWLWEVGTWKAVGRLQSHNLTVTQMEFSRDNVFLLSVSRDRHLSIFSISKTEEGAEHRLVAKLEAHKRIIWACSWNPFGYEFATGSRDKSVKIWCVKDASSVKLLATLPQFRDSVTALAWMCHDRASNAGVLAVGMDNGLIELWSVSGGRASAGSTPDSPLSVACTLRFDPVLCHVSTVHRLRWREPSSTDEESTLELASCGADHTVRVFEVRDTI

SEQ ID NO: 8809 - DNA, 3213 bp, Sorghum bicolor
  misc_feature: Ceres ANNOT ID no. 6092105
  misc_feature: Encodes the peptide sequence at SEQ ID NO 8810
atgaggttgactgttcgtgtgatcgaggcccgcaacctgcgggccatggattccaacggtttcagcgacccgtacgtgaagctgcagctcgggaagcagcgattcaagaccaaggtgatcaagatgaacctgaacccgacttgggatcaggagttcagcttccttgtcggcgatgtcaaagatgtgctcaagcttgatgtctatgacgaggacatcctccagatggatgacttcctggggcagttaagggtgccattggaggatgtgctggctgccgatgacctgtcgcttggtacccggtggtaccagcttcttcccaagggcaaaaccaacaagacggttgattgtggggagatttgtgtctcaatatcgttagaatcatctggagccttgcgatcatggtctgaggaccttggagccgaaataactgatattcagagagactattcattgtcaagccaaagcacagctccatctattgcatttgcttatcgagaaactgaaacttttaaagaagacgatgagtgttctgttagatctgaaatccctgtagaagatagtagtagtgaagttactgatagaaatcaagctgctgcagaggacaagccaaatgggaattctagtgcagctttgaatggaactgaaacttctagtggtaaaacagataagtctgataagctatcatttgttgatcgtgtctgccaaatatttgctaaaaaaaatggcgaaacagtgccaacctcctctggaagctctgaggctttagaagaaattcaagaggaagcaagtggatgtgagctttcagtgagtcaaactgataatgtgtgcccagagactccattcagtgaactactgaaatctcttgaatcacgacatgaaggagtcgagatgcctgtgaatctacaaggaattcttgttaatcagtcgtatcttgcctcacctagtgatctgaataaccttctcttctcaccagattcagattttaaacaaacaatggttgagcttcaaggctgtactgatttcaaaactgaaccctggagtcttgataatgatggggactccttgaagagagtggtaacatacacaactgcaccatcaaaattggttaaagccgttcgagcaacagaggagcaaacttacttgaaggctgatggaaaagagtatgcagttttgttgagtgtgagtactcctgatgttccctgtggtacttattttcggacggaaattcttttccgtatcatgccaggtcctgaagttgattctcagcaacagacatcacatttggtaatatcctggcgcatgaattttcttcagagtaccatgatgaaaagtatgatagaaaatggagcaagacagggcctggagcaaaactatgcacagttttcggatttactatcacaaaaggtcaagccaattgacgtagaaggttctgggtctgacaaggaacaggtcttggcctctttgcaagggggcgaggaatctgattggaagatagcatttctgtacttctgcaactttggtgtcttatcctccctttttgtgtctctttacattattctgcatgttctacgagtgaatccaagtgctgttcaaggtcttgagttcccaggattagatttgccagattcgctcagtgaaattatcatgggtgggctgttgtttcttcaagtacagcgcatactgaagaatattacatgctttgttcaagcaagaggacaaaaaggtggtgatcatggcgtgaaagcaaaaggtgatggatggctgttaacggtcgctttaattgagggaatcaaattggctccagttgatgctactggtttctctgatccttatgtggtatttacttgcaatggcaaaacaagaacaagttcaattaagttccaaacactagaacctcagtggaacgaaatctttgaatttgacgcaatggatgatccaccatcagtgatgagtgtacatgtatatgattttgatggaccattcgatgaagttacatcccttggacatgcggaaattaactttgtaaaatcaaacttgtcagagttagctgatgtatggattcctcttaaaggtaaccttgctcagtcttggcagtccaagttgcatctgaggattttcttgaacaactcaaaggggactggcatggtcactgagtatctgagcaaaatggagaaagaggttggtaagaagatgacgttgaggtctcctcggaccaatacagcattccaggaactcttctctctgccagcagaagaatttctcatcagcagttttacctgctatttgaagaggaaattgcctacacagggtcatcttttcttatctccaagaacaattgggttttattcaagcatgtttgggaggaaaacaaaattttactttttatgggaggatattgaagacatacagggaatacctcaatcaatatcatcatggagtccatccattataataactcttcacaaaggtagaggcatggatgcaaagcatggtgcaaagagcatggacaatggaaagcttaagttctgcttgcagtcttttgcatcatttagtgtggccaataggacaataatggcattatggaaggcaagatctttgagcacggagctaaaagtacagcttgctgaagaacagtcccaaattaacaccctgcagagtgaggacagtggggtttttgttggtattgaggatgccaagagccttcagatgactgaagtttactcctcaactatttcgaccaatatggcctcgcttatggaggtgtttgcaggaggttctttggaaatgaaggtaatggagaaagttggatgccagaaatactcggctacacagtgggaatcagataaacccaatgagtatcaacgacaaattcattacaagtttagcaagaagctgtctcctgttggcggagaagtgacaggaacccagcagaaatctcctatgcccaataagaaaggatggattattgaagaggtgatggagctccaaggagtccttctcggcgacttctttacgctccacataaagtaccaaatcgaggaccttgctcccaagcaaagatcaagcaacgtccaagtctccctgggaatcgagtggtcgaagagcaccaggcaccagaagcgaatcgagaagaacgtcttctccagctcatccgctcgcctgaaggagatgttcaacctggcgtcaagggagctctcacacggcgccaaatag

SEQ ID NO: 8810 - protein, 1070 aa, Sorghum bicolor
  misc_feature: Ceres ANNOT ID no. 6092105
  misc_feature (3)..(83): Pfam Id: C2 Pfam Desc: C2 domain
  misc_feature (589)..(671): Pfam Id: C2 Pfam Desc: C2 domain
  misc_feature (740)..(806): Pfam Id: GRAM Pfam Desc: GRAM domain
  misc_feature (1)..(1066): NCBI GI: 51814441 NCBI Desc: no pollen; osnop [oryza sativa (japonica cultivar-group)]
  misc_feature (195)..(1066): NCBI GI: 15218791 NCBI Desc: c2 domain-containing protein / gram domain-containing protein [arabidopsis thaliana]
  misc_feature (214)..(1066): NCBI GI: 116310301 NCBI Desc: osigba0106g07.15 [oryza sativa (indica cultivar-group)]
  misc_feature (214)..(1066): NCBI GI: 38344486 NCBI Desc: osjnba0022h21.21 [oryza sativa (japonica cultivar-group)]
  misc_feature (405)..(770): NCBI GI: 115458962 NCBI Desc: os04g0476600 [oryza sativa (japonica cultivar-group)]
MRLTVRVIEARNLRAMDSNGFSDPYVKLQLGKQRFKTKVIKMNLNPTWDQEFSFLVGDVKDVLKLDVYDEDILQMDDFLGQLRVPLEDVLAADDLSLGTRWYQLLPKGKTNKTVDCGEICVSISLESSGALRSWSEDLGAEITDIQRDYSLSSQSTAPSIAFAYRETETFKEDDECSVRSEIPVEDSSSEVTDRNQAAAEDKPNGNSSAALNGTETSSGKTDKSDKLSFVDRVCQIFAKKNGETVPTSSGSSEALEEIQEEASGCELSVSQTDNVCPETPFSELLKSLESRHEGVEMPVNLQGILVNQSYLASPSDLNNLLFSPDSDFKQTMVELQGCTDFKTEPWSLDNDGDSLKRVVTYTTAPSKLVKAVRATEEQTYLKADGKEYAVLLSVSTPDVPCGTYFRTEILFRIMPGPEVDSQQQTSHLVISWRMNFLQSTMMKSMIENGARQGLEQNYAQFSDLLSQKVKPIDVEGSGSDKEQVLASLQGGEESDWKIAFLYFCNFGVLSSLFVSLYIILHVLRVNPSAVQGLEFPGLDLPDSLSEIIMGGLLFLQVQRILKNITCFVQARGQKGGDHGVKAKGDGWLLTVALIEGIKLAPVDATGFSDPYVVFTCNGKTRTSSIKFQTLEPQWNEIFEFDAMDDPPSVMSVHVYDFDGPFDEVTSLGHAEINFVKSNLSELADVWIPLKGNLAQSWQSKLHLRIFLNNSKGTGMVTEYLSKMEKEVGKKMTLRSPRTNTAFQELFSLPAEEFLISSFTCYLKRKLPTQGHLFLSPRTIGFYSSMFGRKTKFYFLWEDIEDIQGIPQSISSWSPSIIITLHKGRGMDAKHGAKSMDNGKLKFCLQSFASFSVANRTIMALWKARSLSTELKVQLAEEQSQINTLQSEDSGVFVGIEDAKSLQMTEVYSSTISTNMASLMEVFAGGSLEMKVMEKVGCQKYSATQWESDKPNEYQRQIHYKFSKKLSPVGGEVTGTQQKSPMPNKKGWIIEEVMELQGVLLGDFFTLHIKYQIEDLAPKQRSSNVQVSLGIEWSKSTRHQKRIEKNVFSSSSARLKEMFNLASRELSHGAK

SEQ ID NO: 8811 - DNA, 1488 bp, Sorghum bicolor
  misc_feature: Ceres ANNOT ID no. 6092138
  misc_feature: Encodes the peptide sequence at SEQ ID NO 8812
atggggcttcaaggggataaggcgacgcacgacttcctctcgctctacaccgccgccaaggacgccgccctgccgctgctccacgagtccaagctgccgccgccgccgacgacgacgacgtctcatcaaggtttgttcctcaagacgcacgacttgctgcagccgctggagaggccaccaccaccgcaagcccccgctgagaagccgctccaccagcacttgctgcccggcggcatcggcacgttcagcatcagcccaggcccgcgcgggcgcggcgcggcggccgtcgtgaagcaggagcagcagacgcccttcgcgctctgggggcagccggaccctcgaggtcacccgtggtcgctccccttcgccgcgcgctgcgtcgccgtcgcctccgccaggccacaacaaccccagccacagcaacagaggccgccggagcggaaggcgtgcggcggcttcatggacgccggctccagatccagcggcggcgcgggattcgacgacgacgatggcctcgctgcccgccgcgaggtctcctcctcgctcaaagaccacagagtggaggctaagggcgggagctgcagcggcagcgccggaacggaccagctgcccaacacgccacgctccaagcactccgccacggagcagcgcaggcgcagcaagatcaatgacaggtttcagatacttagagaaatcttgccgcaaaatgatcaaaagcgagacaaagcatcatttctcctagaggtcattgaatacatacggtttttgcaagagaaagtagaaaagcacgaggcttcacaaccagagtggaaccaagaaaatgcaaagatcatgccatggtctaacatctacttccggtcttcctggaaaaattcacagaacaaggacgaagtaaacggagatacaaccaccgatgcatcactagtcataaaaaatggctcctccccacggtttccttttgctgcaaagcctggggaccttaacaatgcagctgcgtttgaaactgcctcgggtgcacatgaacgggtagaactagaaccaaagggttgtgtgcctcgcaaagaagatgaaactcccaataatgttacaaataatgttgccacccagcaagcagcagaaacacagttgacaaatccgtcaccctcagacgacttggcaggcaacaatgggatgctgaacaaccctgagttggccatagatgaggggacaatcagcttgtcgagccaatattccgaaggcttgcttactaccttgaatcttgcgctgcaaaactcgggcgtagatttatcgcaagctagcatctcggtgcagatcaatctcggtaagcgggctatcaagaggtgcaatgatcctgggccaaaccccacttccaaggatctcatgaaccacatgtctcatgatcaagagattgggcagcagctaataaggtcaggggacggcgctagagaacgctcgcgggcaactaagcggcacagatcagagagataa

SEQ ID NO: 8812 - protein, 495 aa, Sorghum bicolor
  misc_feature: Ceres ANNOT ID no. 6092138
  misc_feature (207)..(257): Pfam Id: HLH Pfam Desc: Helix-loop-helix DNA-binding domain
  misc_feature (1)..(494): NCBI GI: 42408484 NCBI Desc: bhlh protein family-like [oryza sativa (japonica cultivar-group)]
  misc_feature (1)..(493): NCBI GI: 50726634 NCBI Desc: bhlh protein family-like [oryza sativa (japonica cultivar-group)]
  misc_feature (153)..(282): NCBI GI: 8346550 NCBI Desc: myc-like protein [arabidopsis thaliana]
  misc_feature (156)..(413): NCBI GI: 46390601 NCBI Desc: bhlh protein-like [oryza sativa (japonica cultivar-group)]
  misc_feature (153)..(282): NCBI GI: 30682248 NCBI Desc: basic helix-loop-helix (bhlh) family protein [arabidopsis thaliana]
  misc_feature: The sequence is a functional homolog of SEQ ID NO 1378 in the 10/374,780US patent application
  misc_feature: The sequence is a functional homolog of SEQ ID NO 1499 in the 10/412,699US patent application
  misc_feature: The sequence is a functional homolog of SEQ ID NO 532 in the 10/666,642US patent application
  misc_feature: Useful for making plants with modulated growth and phenotype characteristics
  misc_feature: The sequence is a functional homolog of SEQ ID NO 1499 in the 20040045049 US patent application
  misc_feature: The sequence is a functional homolog of SEQ ID NO 532 in the 20070033671 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MGLQGDKATHDFLSLYTAAKDAALPLLHESKLPPPPTTTTSHQGLFLKTHDLLQPLERPPPPQAPAEKPLHQHLLPGGIGTFSISPGPRGRGAAAVVKQEQQTPFALWGQPDPRGHPWSLPFAARCVAVASARPQQPQPQQQRPPERKACGGFMDAGSRSSGGAGFDDDDGLAARREVSSSLKDHRVEAKGGSCSGSAGTDQLPNTPRSKHSATEQRRRSKINDRFQILREILPQNDQKRDKASFLLEVIEYIRFLQEKVEKHEASQPEWNQENAKIMPWSNIYFRSSWKNSQNKDEVNGDTTTDASLVIKNGSSPRFPFAAKPGDLNNAAAFETASGAHERVELEPKGCVPRKEDETPNNVTNNVATQQAAETQLTNPSPSDDLAGNNGMLNNPELAIDEGTISLSSQYSEGLLTTLNLALQNSGVDLSQASISVQINLGKRAIKRCNDPGPNPTSKDLMNHMSHDQEIGQQLIRSGDGARERSRATKRHRSER

SEQ ID NO: 8813 - DNA, 1239 bp, Sorghum bicolor
  misc_feature: Ceres ANNOT ID no. 6092151
  misc_feature: Encodes the peptide sequence at SEQ ID NO 8814
atgggtggagtgacttcgtccgtggcctccaagatggcgttcttccctcccgacccgccgtcttacggcgtggccaacgaggaggacgagccagcggcggcgtcggtggaggatgcgtcgtcgcgtaaggtggcaaccaggagggtggtgatgacgggcgtgcggtggagcgtgggcgtggaggcgaggcgggtgcggacgcggcggggctcggagatcatcgccgtgtacgtccggcaccccggcgccagcctcaccgtcctcttctcccacggcaacgccgccgacctcggcaagatgtacgggatcttcgtcgagctcagcgcacgactccacgtcaacctcatggggtatgattactctggttatgggcggtcatcaggcaagccaagtgaagctaatacctttgctgacatagaggctgcatacaagtgccttgtggacgtttatggaactagggaagaagacattgttctgtatggtcagtctgttggcagcggaccaaccctcgatttagctgttcgtttccatcgcgtaagagctgtggttctgcacagtccaatcctgtctggattgcgtgtcatgtattctgtgaagaaaacatactggtttgacatatacaagaacatcgacaaaatcccgcatgttaaatgcccagttctggttatccatggcacaaaagatgacgtcgtggactgctcccatgggaagcggctctatgagctgtgccaacacaagtatgagcctctgtggatcgagggaggcgaccatggcaacctggagaaattcccggtgtacatacgacatctgaagaagtttttatcgaccataaagaagctgccatctgaaaaagatgccgcagctgagcatgagacatgggcagctgaaaacagagcgcagcctgacagtgaaaccatctccgagactccttctcgcatgatctcgcgaaggctagagccgtcgaagaagagcacgatccatgaggaccctacgctgagcacggagcatgtagataagcgcaggcgaagcacgggccacagggagaaggcgaggtccagcacagataggagatccaggaggagcgtggactgcttcgacagcatcctcgaacatgagcaacaggaaaagccaaggaaaagctttgataggatcggagagaagattagagccatgggtctgtgcaatgtcgactgcttcaaagagcctccagacagcgctgagctcagccgaggtcgatga

SEQ ID NO: 8814 - protein, 412 aa, Sorghum bicolor
  misc_feature: Ceres ANNOT ID no. 6092151
  misc_feature (1)..(400): NCBI GI: 51535771 NCBI Desc: cgi67 serine protease-like [oryza sativa (japonica cultivar-group)]
  misc_feature (1)..(389): NCBI GI: 124359459 NCBI Desc: esterase/lipase/thioesterase [medicago truncatula]
  misc_feature (1)..(342): NCBI GI: 56784467 NCBI Desc: cgi67 serine protease-like [oryza sativa (japonica cultivar-group)]
  misc_feature (1)..(342): NCBI GI: 115439289 NCBI Desc: os01g0689800 [oryza sativa (japonica cultivar-group)]
  misc_feature (60)..(280): NCBI GI: 140067578 NCBI Desc: c2; esterase/lipase/thioesterase [medicago truncatula]
MGGVTSSVASKMAFFPPDPPSYGVANEEDEPAAASVEDASSRKVATRRVVMTGVRWSVGVEARRVRTRRGSEIIAVYVRHPGASLTVLFSHGNAADLGKMYGIFVELSARLHVNLMGYDYSGYGRSSGKPSEANTFADIEAAYKCLVDVYGTREEDIVLYGQSVGSGPTLDLAVRFHRVRAVVLHSPILSGLRVMYSVKKTYWFDIYKNIDKIPHVKCPVLVIHGTKDDVVDCSHGKRLYELCQHKYEPLWIEGGDHGNLEKFPVYIRHLKKFLSTIKKLPSEKDAAAEHETWAAENRAQPDSETISETPSRMISRRLEPSKKSTIHEDPTLSTEHVDKRRRSTGHREKARSSTDRRSRRSVDCFDSILEHEQQEKPRKSFDRIGEKIRAMGLCNVDCFKEPPDSAELSRGR

SEQ ID NO: 8815 - DNA, 2367 bp, Sorghum bicolor
  misc_feature: Ceres ANNOT ID no. 6092152
  misc_feature: Encodes the peptide sequence at SEQ ID NO 8816
atggcgccggctttgagcgggactctgggcgcgtcgtcggtggcggcgctacggccctgcgcgggaaggagggcgccctccgccgcgacctcggttgctccgcgggggagtggggtggcgaggtgcgccagaggtctcaggtgggaggcccacaggagcagggggaggtcgctcagggtgaggtgcgatgcggccgtcgccgaaaagcccgccggggaggaggcggctggggagcagttcgagtaccaggcggaggtgagccggttaatggatttgatcgtccatagtctgtacagtcataaggaggtatttctccgcgagcttgttagcaacgcgagtgatgcattggataaactgaggttccttggcgtgactgattcttctttgcttgctgacggtggtgagctggaaataaggattaagcctgaccctgatgctgggacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttgggttttactcagcttttcttgttgcagagaagattgtggtgtccaccaagagtccaaaatcagataaacagtatgtgtgggaagctgtcgctgacagtagctcttatatcatcaaggaagagactgatcctgagaaaatgcttacacgtggaactcagattactctgtttctaaggtctgatgataagtacgagtttgcggacccttcaaggattcaaggcttagtaaaaaactactctcagtttgtgtctttccccatatacacatggcaggagaaatcaagaactgttgaggttgaagaggacgaagagccgaaagaaggtgaagaggcaacagagggtgagaaaaagaaaaagaagaagactgttactgagaaatattgggactgggaactagccaatgaaacaaaacccatatggatgagaaatccaaaggaaattgagaacaccgaatacaatgagttctataagaagacattcaatgagtttttggacccccttgcccacactcacttcacaacagagggtgaggtggaattcaggagtgttctttatgttccaggcatggcaccgcttagtaatgaggagataatgaatcccaagaccaaaaatatccggctatatgttaaaagagtcttcatctctgatgactttgatggtgaactgtttccaagatacttgagctttgttaaaggtgtggtggattcaaatgaccttcccctcaatgtttctcgggagattcttcaagaaagtcgaattgtaagaattatgcgcaagcgacttgtcaggaagacatttgatatgattgaagagattgccgaaaaggaagataaggaggattataagaagttttgggagagctttggcaagtttattaagcttggttgcattgaggacacagggaatcacaagcgccttgctccattgttgcgcttccactcttctaaaaatgagggagacacgataagtcttgatcaatatgtagagagcatgcctgaaagtcaaaaggcaatctactacatcgctacagatagtctccagagcgcaaagactgctcctttcttggaaaagctggtccagaaagatattgaagttctctaccttattgagccaatagatgaggttgccattcagaacttgcagacctacaaagagaagaaatttgtggatatcagcaaagaggatttggaattgggtgatgaagaggaagagactaaagaaaccaagcaggagtttactctcctatgtgattgggttaaacaacagcttggtgacaaggttgcgaaggtccaaatatcgaagcgtttaagttcatctccatgtgttcttgtatctggcaagttcggttggtccgctaatatggaaaggctcatgaaggctcaaacacttggtgacacatcaagcttggaattcatgaggggaagaaggattttcgaaatcaaccctgaccacccaattatcaaggatttgagtgctgcttgcaaaaatgagcccgatagcacagaagccaagagggctgttgagctcctatatgaggctgctttaatctcaagtggatatactccagagagtccagcagagttgggtggcaagatctatgagatgatggcgattgccctcggtgggagatggggaaggtccgacatggaggagactgagacatcaatgagtgaggccagcgcagagtcagactcatctgaaggcaccgtaacagaggtgattgagccctcagaagttagacccgagagcgacccatggagggattag

SEQ ID NO: 8816 - protein, 788 aa, Sorghum bicolor
  misc_feature: Ceres ANNOT ID no. 6092152
  misc_feature (265)..(778): Pfam Id: HSP90 Pfam Desc: Hsp90 protein
  misc_feature (100)..(261): Pfam Id: HATPase_c Pfam Desc: Histidine kinase-, DNA gyrase B-, and HSP90-like ATPase
  misc_feature (1)..(788): NCBI GI: 556673 NCBI Desc: heat-shock protein [secale cereale]
  misc_feature (1)..(788): NCBI GI: 20453106 NCBI Desc: at2g04030/f3c11.14 [arabidopsis thaliana]
  misc_feature (56)..(788): NCBI GI: 1906830 NCBI Desc: heat shock protein [arabidopsis thaliana]
  misc_feature (1)..(565): NCBI GI: 115479725 NCBI Desc: os09g0474300 [oryza sativa (japonica cultivar-group)]
  misc_feature (59)..(779): NCBI GI: 145338243 NCBI Desc: atp binding [arabidopsis thaliana]
MAPALSGTLGASSVAALRPCAGRRAPSAATSVAPRGSGVARCARGLRWEAHRSRGRSLRVRCDAAVAEKPAGEEAAGEQFEYQAEVSRLMDLIVHSLYSHKEVFLRELVSNASDALDKLRFLGVTDSSLLADGGELEIRIKPDPDAGTITITDTGVGMTKDELKDCLGTIAQSGTSKFLKALKENKDLGADNGLIGQFGVGFYSAFLVAEKIVVSTKSPKSDKQYVWEAVADSSSYIIKEETDPEKMLTRGTQITLFLRSDDKYEFADPSRIQGLVKNYSQFVSFPIYTWQEKSRTVEVEEDEEPKEGEEATEGEKKKKKKTVTEKYWDWELANETKPIWMRNPKEIENTEYNEFYKKTFNEFLDPLAHTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKTFDMIEEIAEKEDKEDYKKFWESFGKFIKLGCIEDTGNHKRLAPLLRFHSSKNEGDTISLDQYVESMPESQKAIYYIATDSLQSAKTAPFLEKLVQKDIEVLYLIEPIDEVAIQNLQTYKEKKFVDISKEDLELGDEEEETKETKQEFTLLCDWVKQQLGDKVAKVQISKRLSSSPCVLVSGKFGWSANMERLMKAQTLGDTSSLEFMRGRRIFEINPDHPIIKDLSAACKNEPDSTEAKRAVELLYEAALISSGYTPESPAELGGKIYEMMAIALGGRWGRSDMEETETSMSEASAESDSSEGTVTEVIEPSEVRPESDPWRD

SEQ ID NO: 8817 - DNA, 882 bp, Sorghum bicolor
  misc_feature: Ceres ANNOT ID no. 6092156
  misc_feature: Encodes the peptide sequence at SEQ ID NO 8818
atggcttcctcgtcgatccacatccaccgtccccggctcgccggcgacgagattcaccggaccctggaggcctcctactcccccagcgcgtcttactgctccgacgacgccttcgtccctgtcttccgcccggatccgtccgccccgtccgcgtccgcgtcggcggcggtggctgcggcggccgaccgcgtccgcagcctcttcagctccgtcgacgtcgccctgttccgcgacgcgctcttcgctcccgtgtgcgacggcgacggcgaccgcgacggcctcgggttcacggacgcggacgcggaggcggcagagtacgacggcgatctcacctccatctgctgggattgcctcgagatcgaggacgccgacgacccgctcgtcgcctcccccgccgccgaggatttcgagtgggaggaggtcgtgtccccctcgggcgccgccggggaagccccggagcccgagtgggaggtgctcgccgacgtgcccccgccgcccgccaccgctgccgacgccgaggacgggtttgtgtacacctcccaccacagggaggaggcggcggcgtacgaggtgctcgtggcaggcggggaggggatgttcctcaagaacaagcccccggccgccagatccgccgttgaggcgctcccgtccgccgtcgtcgcggctggccaggaaggggagggagacgagtgcgcggtgtgcaaggatggagtcgccgccggccagcgcgtcaagaggctgccgtgctcgcaccgctaccacgacgactgcatcgtgccgtggctccaggtgcgcaactcgtgcccgctctgccgcttcgagctgcccaccgacgacccggagtacgagtcctggaaagccggccgagccgtggcccggtga

SEQ ID NO: 8818 - protein, 293 aa, Sorghum bicolor
  misc_feature: Ceres ANNOT ID no. 6092156
  misc_feature (231)..(271): Pfam Id: zf-C3HC4 Pfam Desc: Zinc finger, C3HC4 type (RING finger)
  misc_feature (1)..(292): NCBI GI: 42408255 NCBI Desc: zinc finger protein family-like [oryza sativa (japonica cultivar-group)]
  misc_feature (93)..(292): NCBI GI: 46390610 NCBI Desc: zinc finger -like [oryza sativa (japonica cultivar-group)]
  misc_feature (201)..(293): NCBI GI: 92889026 NCBI Desc: zinc finger, ring-type; ringv [medicago truncatula]
  misc_feature (205)..(286): NCBI GI: 115482626 NCBI Desc: os10g0487400 [oryza sativa (japonica cultivar-group)]
  misc_feature (184)..(289): NCBI GI: 61211690 NCBI Desc: ubiquitin ligase protein cip8 (cop1-interacting protein 8)
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
MASSSIHIHRPRLAGDEIHRTLEASYSPSASYCSDDAFVPVFRPDPSAPSASASAAVAAAADRVRSLFSSVDVALFRDALFAPVCDGDGDRDGLGFTDADAEAAEYDGDLTSICWDCLEIEDADDPLVASPAAEDFEWEEVVSPSGAAGEAPEPEWEVLADVPPPPATAADAEDGFVYTSHHREEAAAYEVLVAGGEGMFLKNKPPAARSAVEALPSAVVAAGQEGEGDECAVCKDGVAAGQRVKRLPCSHRYHDDCIVPWLQVRNSCPLCRFELPTDDPEYESWKAGRAVAR

SEQ ID NO: 8819 - DNA, 1446 bp, Sorghum bicolor
  misc_feature: Ceres ANNOT ID no. 6092249
  misc_feature: Encodes the peptide sequence at SEQ ID NO 8820
atggtggccgctcgcctccgcctcgcgctgctgctactcctccccgtgttcctctgctccgcgtgggcgcgcccacgcctcgagcccaccatccgcctgccgtccgaccgcgcggacgacgccgtcgggacacgctgggccgtgctcgtcgccggttccaatggctactacaactaccgccaccaggcggacatctgccatgcgtaccaaatcatgaagaagggaggactcaaggacgagaacatcattgtcttcatgtacgatgacatcgcacatagcccggagaatccgaggccaggtgtcctcattaaccatccccagggtggcgatgtctatgctggggttccaaaggattacactgggcgagaggtcagtgtcaacaatttcttcgctgttctgcttggcaacaaaactgctctgaaaggtgggagcggcaaggttgtggacagtggccccaatgatcatatctttgttttctacagtgaccatggaggtcctggtgtccttggaatgcctacgtatccgtatctctacggtgatgacctcgtagatgtcctgaagaagaagcatgctgctgggacctacaaaagcctggtcttttaccttgaagcatgcgaatctgggagcatctttgagggcctcctgccggatgacatcaatgtgtatgccaccaccgcgtcaaatgcagaggagagcagttgggggacgtactgccctggagaattcccaagccctccaccggagtatgacacatgcttgggagacctgtatagtgtttcttggatggaagacagtgatttccacaatctgcgaactgaatctctcaagcagcagtacaagttggtcaaggataggacagcagttcaggatacattcagctatggctcccatgtgatgcaatatggctcattggagttgaatgttcagaaattgttttcgtacattggcacaaaccctgctaacgatggcaacacatttgtagaagataactcattgccatcattttcaaaagctgttaatcagcgtgatgctgatcttgtctacttctggcagaagtaccggaaattggctgatgactcatctaagaaaaatgaagctcggaaggaattgcttgaagtgatggcccaccggtctcatgttgacaacagtgttgagctcattggaagccttctctttggctctgaggacggtccaagggttctgaaagccgtccgtgcagctggtgaacctctggttgatgattggagttgtctcaagtccatggttcgtacttttgaggcacaatgtgggtcattggcgcagtatgggatgaagcacatgcgatccttcgcaaacatctgcaatgctggcatccttcctgaagcagtgtcaaaggtcgccgctcaggcttgcaccagcattccttccaacccctggagctctatcgacaagggttttagcgcctaa

SEQ ID NO: 8820 - protein, 481 aa, Sorghum bicolor
  misc_feature: Ceres ANNOT ID no. 6092249
  misc_feature (45)..(317): Pfam Id: Peptidase_C13 Pfam Desc: Peptidase C13 family
  misc_feature (1)..(481): NCBI GI: 93139442 NCBI Desc: legumain precursor [saccharum officinarum]
  misc_feature (1)..(481): NCBI GI: 6634705 NCBI Desc: legumain-like protease [zea mays]
  misc_feature (1)..(481): NCBI GI: 4154281 NCBI Desc: c13 endopeptidase np1 precursor [zea mays]
  misc_feature (1)..(481): NCBI GI: 6634703 NCBI Desc: legumain-like protease [zea mays]
  misc_feature (8)..(481): NCBI GI: 18844931 NCBI Desc: asparaginyl endopeptidase [oryza sativa (japonica cultivar-group)]
  misc_feature (24)..(481): SWISSPROT Homolog: EC 3.4.22.34 Legumain precursor
MVAARLRLALLLLLPVFLCSAWARPRLEPTIRLPSDRADDAVGTRWAVLVAGSNGYYNYRHQADICHAYQIMKKGGLKDENIIVFMYDDIAHSPENPRPGVLINHPQGGDVYAGVPKDYTGREVSVNNFFAVLLGNKTALKGGSGKVVDSGPNDHIFVFYSDHGGPGVLGMPTYPYLYGDDLVDVLKKKHAAGTYKSLVFYLEACESGSIFEGLLPDDINVYATTASNAEESSWGTYCPGEFPSPPPEYDTCLGDLYSVSWMEDSDFHNLRTESLKQQYKLVKDRTAVQDTFSYGSHVMQYGSLELNVQKLFSYIGTNPANDGNTFVEDNSLPSFSKAVNQRDADLVYFWQKYRKLADDSSKKNEARKELLEVMAHRSHVDNSVELIGSLLFGSEDGPRVLKAVRAAGEPLVDDWSCLKSMVRTFEAQCGSLAQYGMKHMRSFANICNAGILPEAVSKVAAQACTSIPSNPWSSIDKGFSA

SEQ ID NO: 8821 - DNA, 1953 bp, Sorghum bicolor
  misc_feature: Ceres ANNOT ID no. 6092283
  misc_feature: Encodes the peptide sequence at SEQ ID NO 8822
atgaactcgatggacgaaatcaacctgcttcggcaggcgcagcggcagcatcagcaccacctcatggtgcgcggcatcggcgaggagatcgacctcgagatcggccccggcgacgacccctcgttctccggggcttccttagttgccgtcacgtccacgcacgacgccgtcgtccacgccgacgaccacaagagcctcctcatcccgtgttctcagaccggcgcggcggacgggctggcgccgcagcagcagcacctggcgcagggggaggaagagcatgacgggatgctcaggcagccgtcggggcacaccaagaagaagaagaaggtggtgaagaaatggcgggaggagtgggcggacacctacaagtgggcctacgtcgccgtgcacgacaacaccaccaggatcttctgctcggtgtgcaaggagtacggccggaagcaccgccggaatccatatggcaacgagggaagcaggaatatgcagatgagtgcgcttgaggagcacaacaatagcttgttgcataaggaggcgctccggttgcagatggcctccaaggagaagttgcagcctcctgagatcgagaggccggtctatgtcaaagctttatcgaaaacagcggcgtcaatacttgaatgtgttctaaggagggatccccatgaagctgaatatatacagtccatccaggaggtggttcattccttagaacctgttttggtgaagaatacccaatatattcaaattttggagcgtttgttggaacctgagagatgctttattttcagagtgccatggattgatgacagaggtgaagcacatgtcaatagaggtttccgtgtgcaattcagtcaggcgttaggtccatgcaggggcggtcttcgatttcacccatccatgagcttaagtgtggcaaagtttctggcctttgaacatactttgaagaatgctttgtcactatataaacttggaggtgctgctggaggaagcgattttgatccaaagggtaaaagtgataatgagataatgcgcttttgccaaagtttcatggatgagctgtatagatatttgggccctgaccaggattttcccgctgaagatattggtgttggtccaagggaaatgggttacctttttgggcagtatagacgtctttctggtcattttcagggaaattttacaggacctaaaattttctggtcagggtcaagttttcgaacagaagctactggatacgggctggtgttttttgcgcgtattttacttgctgaaatgaacaaagagcttaaaggattaagatgtgtgatcagtggttctggaaagatagcaatgcatgttttggaaaaacttttgccttgtggagccattcctgttactgtctcagattcaaagggatatttgttagatgaagatggattcgattatatgaaatattcacttctaagggatattaaggctcagcaaaagagcctcaaggagtacttgaaatcatatccacatgccaagtatattgatgatgcaaaaccatggagcgagcagtgtgatgttgcattcccttgtgcatcacataatgagattgaccaaggggaggccgttgcgatcatcaactctggttgtcgtgttcttgtcgaatgttcaaatatgccatgcactgttcaagctgttgatatcctaagaaaggcaaaagttattgttgctccagcaaaggcaactgctgctggtggggtagcacttggagagcttgaattgaatccagagtttaatttgatgcagttgtcagtggaggattttgagaataaaattcaagatgcaataaagcaaacatatgaaaggtcgatcaaagctgctcaagattacgggatcatgaaagagagccctgagtctttggtccatggcgcgaacatttgtgctttccttaatattgcgcaagccatggctgaccagggatgtgtttag

SEQ ID NO: 8822 - protein, 650 aa, Sorghum bicolor
  misc_feature: Ceres ANNOT ID no. 6092283
  misc_feature (401)..(648): Pfam Id: ELFV_dehydrog Pfam Desc: Glutamate/Leucine/Phenylalanine/Valine dehydrogenase
  misc_feature (255)..(385): Pfam Id: ELFV_dehydrog_N Pfam Desc: Glu/Leu/Phe/Val dehydrogenase, dimerisation domain
  misc_feature (186)..(648): NCBI GI: 82915173 NCBI Desc: glutamate dehydrogenase [plasmodium yoelii yoelii str. 17xnl]
  misc_feature (186)..(648): NCBI GI: 23485755 NCBI Desc: glutamate dehydrogenase [plasmodium yoelii yoelii]
  misc_feature (210)..(650): NCBI GI: 124540392 NCBI Desc: glutamate dehydrogenase (nadp(+)) [methanococcus vannielii sb]
  misc_feature (209)..(650): NCBI GI: 145622978 NCBI Desc: glutamate dehydrogenase (nadp(+)) [petrotoga mobilis sj95]
  misc_feature (205)..(648): NCBI GI: 125972895 NCBI Desc: glutamate dehydrogenase (nadp(+)) [clostridium thermocellum atcc 27405]
MNSMDEINLLRQAQRQHQHHLMVRGIGEEIDLEIGPGDDPSFSGASLVAVTSTHDAVVHADDHKSLLIPCSQTGAADGLAPQQQHLAQGEEEHDGMLRQPSGHTKKKKKVVKKWREEWADTYKWAYVAVHDNTTRIFCSVCKEYGRKHRRNPYGNEGSRNMQMSALEEHNNSLLHKEALRLQMASKEKLQPPEIERPVYVKALSKTAASILECVLRRDPHEAEYIQSIQEVVHSLEPVLVKNTQYIQILERLLEPERCFIFRVPWIDDRGEAHVNRGFRVQFSQALGPCRGGLRFHPSMSLSVAKFLAFEHTLKNALSLYKLGGAAGGSDFDPKGKSDNEIMRFCQSFMDELYRYLGPDQDFPAEDIGVGPREMGYLFGQYRRLSGHFQGNFTGPKIFWSGSSFRTEATGYGLVFFARILLAEMNKELKGLRCVISGSGKIAMHVLEKLLPCGAIPVTVSDSKGYLLDEDGFDYMKYSLLRDIKAQQKSLKEYLKSYPHAKYIDDAKPWSEQCDVAFPCASHNEIDQGEAVAIINSGCRVLVECSNMPCTVQAVDILRKAKVIVAPAKATAAGGVALGELELNPEFNLMQLSVEDFENKIQDAIKQTYERSIKAAQDYGIMKESPESLVHGANICAFLNIAQAMADQGCV

SEQ ID NO: 8823 - DNA, 2376 bp, Sorghum bicolor
  misc_feature: Ceres ANNOT ID no. 6092308
  misc_feature: Encodes the peptide sequence at SEQ ID NO 8824
atgtcaggagggggtggctcatccgggcgcgcggccccgcggtacgccccggatgacccgacgctgcccaagccgtggcgcggcctcgtcgacggcaccaccggctacctctactactggaacccggagaccaacgtgacgcagtacgagcggcctacgccccccgataaccagctactaccgcccccgcccccgttgcctcccccgcctccccggagtcgcgaccgccgcgacaggtccaggtctcgatcccgatcccgcaccccgccccggcgcgaccacagggaccgcgaccgcgaccgtgacaggcgccacgatgagcacgcgtcctccaagtcggcgtctgcccaccaccatccggctccggtagccgccgccgccgccgatccgtcgaccgaggcatatcgccgacgccatgagatcaccgtcacgggggataacgtgccggctccaataacttcatttgaggctggtggcttcccgtcagaaattctgaaggagttacaacgtgctggatttgcaagcccaacacctatccaagcccagtcatggccaattgctatgcaaagtcaagatgtagtagctattgcgaagactggatcaggcaaaactcttgggtatctacttcctggatttatgcatatcaagcgcctgcagaacagcactaggaatggtccaacagtcctagttttggccccaacaagggaacttgcaacacagattctggatgaagctgtgaaatttggaagatcttctagaatttcttgcacgtgcctatatggtggtgctcctaaaggtcctcagttgagagatttagatagaggggttgatgttgttgttgcaacacctggaaggttaaatgacattttggagatgcgaagggtaagtcttaagcaagtgtcatatcttgttctggatgaggctgatcgcatgctggacatgggctttgagccacaaatacggaagatagtgaaagagatgcctcaccgtcggcaaacccttatgtacactgctacttggccgaaggaagtccgaaggattgcagatgatcttcttgttcatcctgtacaggtgacaattggaagtgttgatgagcttgttgctaatagtgctattactcagcatgtagaggtcataacaccctcagaaaaacaacggcgcctggagcagatattacgatcccaggattcgggttcaaagatattaatattttgtaccaccaagaggatgtgtgaccaacttgcaaggacactcaccaggcagtttggagcttcggccattcatggtgacaagtcccagagtgaaagggagaaggttctgaatcattttcgatctgggcggtcacctattttagtggcgactgatgttgctgcacgaggtttggacatcaaagatatcagggtagtgatcaactatgacttccccactggtgttgaagactatgttcacaggattggcaggacaggaagggctggtgccactggtgttgcatatacatttttctgtgatcaggattcaaaatatgctgcggacctaatcaaaattctggaaggggcaaaccaaaaggtgccccgtgatttagaggatatggcttctcgtggtggtgggcgaggtaggaagaggaaccgttgggcatcccactctgacaggggtggttcacgttctgaactggattcaaggagtggtcgtggcagtcatggaagggatgattatggtagccgtggcaggtatgactctggtgaaactgatgggcgatctcgtaggtctgctagaggtcgcagtagaagccgtagcagaagtcacagtagaagccgtagcccaagtcccaagaggtctcgccgacatgaagctagacgtagcaggactaagagccggagtaggagcaggagcaggagctatagaaaccatcgtgctagccgcagcaagagtcgcagccctgttgctagccgaaggtatgaaaagactgctgctatttcaggatctgctcggcctaactcggggcatgcagagcacaaaagccctccaagatctcactctgtggatgaccatgtgaaccactctgaccacaaggatgaccacatggaagatgggaagatggaaagggttgatcttgatcgctcgcccagcccacaagatgacaagtctgctccatatagtcctgtgtacaatggcaaagccagtggctcgatgagccccaacgttcagccagaggcagatgccaaatatgtcaaaccttctgggaaacctgagcctgcatctccagtgcgccacagcaaaggcagagatgatgatgaggaaggtatcatagacgaggatggagagattgctgaggatgatccacgtgcaaatgcagctgtgcagaatggtaataactga

SEQ ID NO: 8824 - protein, 791 aa, Sorghum bicolor
  misc_feature: Ceres ANNOT ID no. 6092308
  misc_feature (177)..(347): Pfam Id: DEAD Pfam Desc: DEAD/DEAH box helicase
  misc_feature (416)..(492): Pfam Id: Helicase_C Pfam Desc: Helicase conserved C-terminal domain
  misc_feature (22)..(52): Pfam Id: WW Pfam Desc: WW domain
  misc_feature (14)..(609): NCBI GI: 79295442 NCBI Desc: drh1 [arabidopsis thaliana]
  misc_feature (14)..(609): NCBI GI: 17065030 NCBI Desc: rna helicase, drh1 [arabidopsis thaliana]
  misc_feature (7)..(700): NCBI GI: 92894148 NCBI Desc: ww/rsp5/wwp; helicase, c-terminal [medicago truncatula]
  misc_feature (14)..(609): NCBI GI: 32306509 NCBI Desc: at3g01540 [arabidopsis thaliana]
  misc_feature (131)..(585): NCBI GI: 115486693 NCBI Desc: os11g0689400 [oryza sativa (japonica cultivar-group)]
MSGGGGSSGRAAPRYAPDDPTLPKPWRGLVDGTTGYLYYWNPETNVTQYERPTPPDNQLLPPPPPLPPPPPRSRDRRDRSRSRSRSRTPPRRDHRDRDRDRDRRHDEHASSKSASAHHHPAPVAAAAADPSTEAYRRRHEITVTGDNVPAPITSFEAGGFPSEILKELQRAGFASPTPIQAQSWPIAMQSQDVVAIAKTGSGKTLGYLLPGFMHIKRLQNSTRNGPTVLVLAPTRELATQILDEAVKFGRSSRISCTCLYGGAPKGPQLRDLDRGVDVVVATPGRLNDILEMRRVSLKQVSYLVLDEADRMLDMGFEPQIRKIVKEMPHRRQTLMYTATWPKEVRRIADDLLVHPVQVTIGSVDELVANSAITQHVEVITPSEKQRRLEQILRSQDSGSKILIFCTTKRMCDQLARTLTRQFGASAIHGDKSQSEREKVLNHFRSGRSPILVATDVAARGLDIKDIRVVINYDFPTGVEDYVHRIGRTGRAGATGVAYTFFCDQDSKYAADLIKILEGANQKVPRDLEDMASRGGGRGRKRNRWASHSDRGGSRSELDSRSGRGSHGRDDYGSRGRYDSGETDGRSRRSARGRSRSRSRSHSRSRSPSPKRSRRHEARRSRTKSRSRSRSRSYRNHRASRSKSRSPVASRRYEKTAAISGSARPNSGHAEHKSPPRSHSVDDHVNHSDHKDDHMEDGKMERVDLDRSPSPQDDKSAPYSPVYNGKASGSMSPNVQPEADAKYVKPSGKPEPASPVRHSKGRDDDEEGIIDEDGEIAEDDPRANAAVQNGNN

SEQ ID NO: 8825 - DNA, 1167 bp, Sorghum bicolor
  misc_feature: Ceres ANNOT ID no. 6092363
  misc_feature: Encodes the peptide sequence at SEQ ID NO 8826
atggcgctgctgagcccgcgcgtgccgcggctgccgccctccaccttcaccttcaccttcgccgccgcggccggtgccccgtgctttggccgtgccgcgaggtgccaggcgacggcggcgggcggcgtggcggccgcggggcccccgtcgtcggagctggaggccgtccagtggggcagcgccaagctgcagggcgttcgcgacgagatggaggatgagatcttgctccgcccgggctccctcctcgacggcttctccttcgccgccgtcttggatggacacgccggcttctccgccgtccagttcctcagggacgagctgtacaaggagtgcgcagccgcgttggacggcggcgcggtgctcagcactaagaacctcgacgctatcacggtctccatccagcgtgccttcgccgctgtcgacgccaagctctccacctggctcgagcaagcggacaaggacgacgactctggtgctacggccactgccatgtttctcaggaacgatgtccttgttgtctcgcacattggggactcttgcttggtgatatcacgcggtggaagacctgaagctttgaccagctctcatcgaccatatgggaacaacaaaacgtcccttgaagaggtcaagaggatcagagcagcaggtggatggattgttgatgggcgcatatgtggagacatatctgtatctcgtgcttttggggacataagatttaagacgcgaaagaatgaaatgctggtgaaaggagttaaagagggaaggtggactgataagttcatctcacgaataaaatttaaagatgatctaataatctcgtcacctgatgtatctctggtagagcttggaccagatgtggaatttgttctattagcaactgatggtctttgggattacataaaaagctctgaagctgtagcttttgtcagagatcaactacgtcaacatggtgatgtccagttggcctgtgaggcacttggtcagaaagctctggatcaacggtcaaaagacaatattagcatagtcatagctgacttggggaggacaaattggaaggcgttgcccgatgaaagaccaaacatgttcttggaactaagtcaagcagtcgcgactgtaggggttgtctcaataggaatttggttttcgtcgttccttggattacagtag

SEQ ID NO: 8826 - protein, 388 aa, Sorghum bicolor
  misc_feature: Ceres ANNOT ID no. 6092363
  misc_feature (56)..(339): Pfam Id: PP2C Pfam Desc: Protein phosphatase 2C
  misc_feature (4)..(388): NCBI GI: 131054188 NCBI Desc: pp2c [hordeum vulgare subsp. vulgare]
  misc_feature (43)..(387): NCBI GI: 3643090 NCBI Desc: protein phosphatase-2c; pp2c [mesembryanthemum crystallinum]
  misc_feature (1)..(385): NCBI GI: 4972111 NCBI Desc: protein phosphatase homolog (pph1) [arabidopsis thaliana]
  misc_feature (27)..(355): NCBI GI: 995839 NCBI Desc: protein phosphatase homolog
  misc_feature (1)..(331): NCBI GI: 30687733 NCBI Desc: protein phosphatase 2c pph1 / pp2c pph1 (pph1) [arabidopsis thaliana]
  misc_feature (1)..(385): SWISSPROT Homolog: EC 3.1.3.16 Protein phosphatase 2C PPH1
  misc_feature: The sequence is a functional homolog of SEQ ID NO. 406 in the 11/188,298 US application
  misc_feature: The sequence is a functional homolog of SEQ ID NO. 386 in the 11/188,298 US application
  misc_feature: The sequence is a functional homolog of SEQ ID NO. 363 in the 11/188,298 US application
  misc_feature: The sequence is a functional homolog of SEQ ID NO. 448 in the 11/188,298 US application
MALLSPRVPRLPPSTFTFTFAAAAGAPCFGRAARCQATAAGGVAAAGPPSSELEAVQWGSAKLQGVRDEMEDEILLRPGSLLDGFSFAAVLDGHAGFSAVQFLRDELYKECAAALDGGAVLSTKNLDAITVSIQRAFAAVDAKLSTWLEQADKDDDSGATATAMFLRNDVLVVSHIGDSCLVISRGGRPEALTSSHRPYGNNKTSLEEVKRIRAAGGWIVDGRICGDISVSRAFGDIRFKTRKNEMLVKGVKEGRWTDKFISRIKFKDDLIISSPDVSLVELGPDVEFVLLATDGLWDYIKSSEAVAFVRDQLRQHGDVQLACEALGQKALDQRSKDNISIVIADLGRTNWKALPDERPNMFLELSQAVATVGVVSIGIWFSSFLGLQ

SEQ ID NO: 8827 - DNA, 981 bp, Sorghum bicolor
  misc_feature: Ceres ANNOT ID no. 6092403
  misc_feature: Encodes the peptide sequence at SEQ ID NO 8828
atggttcagatgtctttacagaggagcgtacccgtatatccccgttgctgcttatctgattcgctacatcgtgtgggtggttcacgaagaagatgggcctcttgtaggtcccagtcttcacgttttgtttataatgcaagaccatctccaattgttctcaagactgaccatgcaattgatccctctgaaccaaagaatttggatgcaagttcctcagcttcaagaagtggaccttacattgggacttgtcatccatcaggcgcagctggagtaatgggtgcgtcttcctcttcatccctcagatttttagagaaatttgtgagttggagcactagaggtggagaagaggcacctccattcatcatctgcaatgatcctcttgtcaagaaagagctgttgccatctggaacccaatccacttctggctgcagtattgctcttgggaagattaggcagaagaggctcttcttggagcaatctggagcatgctgtattgttatgccatgccagttcttacatgcctggcaccatgagatttcacagggttgctcggttccattcctccatgttggtgattgcgttgtaaaggaactcaaagcagctaacttgaaacctgttgagtatggaagtaatgtccgtgtaggagttctgtccactgacaatacattggctacaaactgttatctagacaagttggagagccagggttttgaggtactatgtccagataaagcttccatggagcgtacagtgttaccatcagtcgatgcattcaggaagggggacatggaaggcgcaagaaacctgttgcgagtatcgctgcaggttcttcttgtgagagctgtcaataagataatccttgcctccgatgaccttgtaggcattttgcctgatgatgaccctctgctcaagaaatgtatagacccattggatgccttggtccgagaggccatcgtatgcgcacgagcaccacgaccatga

SEQ ID NO: 8828 - protein, 326 aa, Sorghum bicolor
  misc_feature: Ceres ANNOT ID no. 6092403
  misc_feature (35)..(323): NCBI GI: 87162592 NCBI Desc: asp/glu racemase [medicago truncatula]
  misc_feature (22)..(318): NCBI GI: 92881975 NCBI Desc: asp/glu racemase [medicago truncatula]
  misc_feature (133)..(318): NCBI GI: 50120438 NCBI Desc: probable aspartate racemase [erwinia carotovora subsp. atroseptica scri1043]
  misc_feature (87)..(321): NCBI GI: 91790218 NCBI Desc: aspartate racemase [polaromonas sp. js666]
  misc_feature (87)..(321): NCBI GI: 14521575 NCBI Desc: aspartate racemase [pyrococcus abyssi ge5]
MVQMSLQRSVPVYPRCCLSDSLHRVGGSRRRWASCRSQSSRFVYNARPSPIVLKTDHAIDPSEPKNLDASSSASRSGPYIGTCHPSGAAGVMGASSSSSLRFLEKFVSWSTRGGEEAPPFIICNDPLVKKELLPSGTQSTSGCSIALGKIRQKRLFLEQSGACCIVMPCQFLHAWHHEISQGCSVPFLHVGDCVVKELKAANLKPVEYGSNVRVGVLSTDNTLATNCYLDKLESQGFEVLCPDKASMERTVLPSVDAFRKGDMEGARNLLRVSLQVLLVRAVNKIILASDDLVGILPDDDPLLKKCIDPLDALVREAIVCARAPRP

SEQ ID NO: 8829 - DNA, 1026 bp, Sorghum bicolor
  misc_feature: Ceres ANNOT ID no. 6092626
  misc_feature: Encodes the peptide sequence at SEQ ID NO 8830
atggggcgcgaggcggcggcaacgaggcccaagctgcggaggggtctttggtcgccggaggaggacgagaagctctacaatcacatcatccgatatggcgtcggctgctggagctcagtcccaaagctcgcaggcttggagagatgcggcaagagctgcaggctgagatggatcaactacctgaggcctgacctcaagaggggcagcttctcccagcaggaggaggatctcatcatcagcctccacaagatactaggcaacaggtggtcccagatcgcatcgcagctgccggggcggacggacaacgagattaaaaacttctggaactcgtgcatcaagaagaagctccggcagcggggcatcgacccggccacgcacaagccgctcaacgacgacgacgacgtcgtcgtcgccgcggacgacaacaccgtggcgccgcatcgtcatcaggacgacaagaagctcgcctcatcaaccgacgaccaatgtttcgccgctatgggcgccgccgccgccagcagcgacgaccctctcgcgccacactccccgaccgtcagcttcgacccactttccgtgaccaacgtcccgacaatgcagcagggctcctacggcgccgcgcactccttcggccggtccgacaaccacctctgcgactacggcggcgtggacgtggtctccgacgcagcgacgacgtatagcgcctacacaggcggcggcgacagctccagcaacagcaacggaacctggacctgcggcggcaacaatgttgtcggcggcgacccgatgccgccgcacatggacatgttcggccgcgatgccgaggcggtgtaccagcagttcgacccggccaagtacagcccctggcagcaccagcagcagcacccggcggcggcgaggttcgatggtcacaacgtcagcagcggcggcgctgctgcgggcttcctaatccggcgggacctgccggattcctgcttcgacctcgcccgtagcgcgctggaggacgagttcagcgtcgacttcctctag

SEQ ID NO: 8830 - protein, 341 aa, Sorghum bicolor
  misc_feature: Ceres ANNOT ID no. 6092626
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(265): NCBI GI: 89145381 NCBI Desc: myb-related protein [triticum aestivum]
  misc_feature (1)..(301): NCBI GI: 547958 NCBI Desc: myb-related protein hv33
  misc_feature (1)..(301): NCBI GI: 456214 NCBI Desc: mybhv33 [hordeum vulgare subsp. vulgare]
  misc_feature (1)..(301): NCBI GI: 19059 NCBI Desc: mybhv33 [hordeum vulgare subsp. vulgare]
  misc_feature (1)..(158): NCBI GI: 115439433 NCBI Desc: os01g0702700 [oryza sativa (japonica cultivar-group)]
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1002 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1010 in the 11/435,388 US patent application
  misc_feature: Useful for making plants with modulated nitrogen use efficiency
  misc_feature: Functional homolog of the protein sequence given in SEQ ID NO 13932
  misc_feature: Useful for making plants with altered alkaloid content
  misc_feature: Useful for making plants with altered lignin content
  misc_feature: Functional homolog of the protein sequence given in SEQ ID NO 13600
  misc_feature: Useful for making plants with altered carbohydrate content
  misc_feature: Functional homolog of the protein sequence given in SEQ ID NO 13924
  misc_feature: Useful for making plants with altered terpenoid content
  misc_feature: Functional homolog of the protein sequence given in SEQ ID NO 13688
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 36 in US patent 7193132
  misc_feature: Useful for making plants with enhanced nutritional value
  misc_feature: Useful for making plants with modulated heat sensitivity
  misc_feature: Functional homolog of the protein sequence given in SEQ ID NO 13689
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1564 in the 10/374,780 US patent application
  misc_feature: The sequence is a functional homolog of SEQ ID NO 126 in the 10/412,699 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1071 in the 11/479,226 US patent application
  misc_feature: The sequence is a functional homolog of SEQ ID NO 1408 in the 10/666,642 US patent application
  misc_feature: The sequence is a functional homolog of SEQ ID NO 148 in the 10/374,780 US patent application
  misc_feature: The sequence is a functional homolog of SEQ ID NO 1808 in the 10/412,699 US patent application
  misc_feature: The sequence is a functional homolog of SEQ ID NO 234 in the 10/714,887 US patent application
  misc_feature: The sequence is a functional homolog of SEQ ID NO 234 in the 11/435,388 US patent application
  misc_feature: The sequence is a functional homolog of SEQ ID NO 286 in the 10/714,887 US patent application
  misc_feature: The sequence is a functional homolog of SEQ ID NO 42 in the 10/225,068 US patent application
  misc_feature: The sequence is a functional homolog of SEQ ID NO 468 in the 10/412,699 US patent application
  misc_feature: The sequence is a functional homolog of SEQ ID NO 758 in the 10/225,066 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
  misc_feature: The sequence is a functional homolog of SEQ ID NO. 395 in the 11/188,298 US application
MGREAAATRPKLRRGLWSPEEDEKLYNHIIRYGVGCWSSVPKLAGLERCGKSCRLRWINYLRPDLKRGSFSQQEEDLIISLHKILGNRWSQIASQLPGRTDNEIKNFWNSCIKKKLRQRGIDPATHKPLNDDDDVVVAADDNTVAPHRHQDDKKLASSTDDQCFAAMGAAAASSDDPLAPHSPTVSFDPLSVTNVPTMQQGSYGAAHSFGRSDNHLCDYGGVDVVSDAATTYSAYTGGGDSSSNSNGTWTCGGNNVVGGDPMPPHMDMFGRDAEAVYQQFDPAKYSPWQHQQQHPAAARFDGHNVSSGGAAAGFLIRRDLPDSCFDLARSALEDEFSVDFL

SEQ ID NO: 8831 - DNA, 1017 bp, Sorghum bicolor
  misc_feature: Ceres ANNOT ID no. 6092674
  misc_feature: Encodes the peptide sequence at SEQ ID NO 8832
atgatggccttgttggtccctctggctgttgcgctcctcttgtcaggtccatcgtcgttggcaacggcggcatccggcggcggcggccctgtggagtgggggaagctggacccgcacttctacgaccagtcgtgccctcacgcgcagcacatcgtggcgtccatcgtggggaaggcgcattaccaggacccgcgcatggccgcctccctcctccgcctccacttccacgactgcttcgtcaagggctgcgacgcgtcgctgctgctggacagcagcgggtccatcgtgagcgagaagcggtccaaccccaacaaggactccgccaggggcttcgaggtcatcgacgagatcaaggccgctctcgaggctgcctgcccgggaaccgtctcctgcgccgacatcctcgcgcttgctgcccgcgactccacagtcatgactggcgggcctggttggatcgtgccgctggggcggagggactcccgtggcgccagcgtgcagggctccaacaacgacatcccggctcccaacaacactctgcccaccatcatcaccaagttcaagctccagggcctcgacatcgtcgacctcgtcgcactcctcggtagccacaccatcggcgactcccggtgcaccagcttccggcagcgcctgtacaaccagacgggcaacggcctcccagacttcaccctagacgcgtcctacgcggcgacgctacgcccacgctgcccgcgctcggggggtgaccagaacctcttcttcctcgaccccatcacgccctttaagtttgacaaccagtactacaagaacatcctcgcctaccatggcctcctcagctccgatgaggtgctcctcaccggcagccccgctactgccgaccttgtcaagctctatgctgccaaccaggatatcttcttccagcacttcgcgcagtccatggtcaagatgggcaacatctcgccgctcacgggggccaatggcgagatcagaaagaactgcaggagggttaaccacagctga

SEQ ID NO: 8832 - protein, 338 aa, Sorghum bicolor
  misc_feature: Ceres ANNOT ID no. 6092674
  misc_feature (52)..(300): Pfam Id: peroxidase Pfam Desc: Peroxidase
  misc_feature (1)..(338): NCBI GI: 115437360 NCBI Desc: os01g0543100 [oryza sativa (japonica cultivar-group)]
  misc_feature (9)..(338): NCBI GI: 30725302 NCBI Desc: at5g66390 [arabidopsis thaliana]
  misc_feature (9)..(338): NCBI GI: 1429215 NCBI Desc: peroxidase atp6a [arabidopsis thaliana]
  misc_feature (34)..(336): NCBI GI: 110007375 NCBI Desc: peroxidase [dimocarpus longan]
  misc_feature (36)..(336): NCBI GI: 92876748 NCBI Desc: haem peroxidase, plant/fungal/bacterial [medicago truncatula]
  misc_feature (9)..(338): SWISSPROT Homolog: EC 1.11.1.7 Peroxidase 72 precursor
  misc_feature: Useful for making plants with altered cell wall content and/or composition
  misc_feature: Functional homolog of the protein sequence encoded by LOCUS at1g49570
  misc_feature: Functional homolog of the protein sequence encoded by LOCUS at3g03670
  misc_feature: Functional homolog of the protein sequence encoded by LOCUS at3g50990
  misc_feature: GREAT-hit functional homolog of the protein sequence encoded by LOCUS at5g66390
  misc_feature: Useful for making plants with altered cell wall content and/or composition
  misc_feature: Functional homolog of the protein sequence given in SEQ ID NO 13819
  misc_feature: Useful for making plants with altered carbohydrate content
  misc_feature: Functional homolog of the protein sequence given in SEQ ID NO 13815
  misc_feature: Useful for making plants with modulated nitrogen use efficiency
  misc_feature: Functional homolog of the protein sequence given in SEQ ID NO 13820
  misc_feature: Useful for making plants with modulated light quality response
  misc_feature: Functional homolog of the protein sequence given in SEQ ID NO 13816
MMALLVPLAVALLLSGPSSLATAASGGGGPVEWGKLDPHFYDQSCPHAQHIVASIVGKAHYQDPRMAASLLRLHFHDCFVKGCDASLLLDSSGSIVSEKRSNPNKDSARGFEVIDEIKAALEAACPGTVSCADILALAARDSTVMTGGPGWIVPLGRRDSRGASVQGSNNDIPAPNNTLPTIITKFKLQGLDIVDLVALLGSHTIGDSRCTSFRQRLYNQTGNGLPDFTLDASYAATLRPRCPRSGGDQNLFFLDPITPFKFDNQYYKNILAYHGLLSSDEVLLTGSPATADLVKLYAANQDIFFQHFAQSMVKMGNISPLTGANGEIRKNCRRVNHS

SEQ ID NO: 8833 - DNA, 732 bp, Sorghum bicolor
  misc_feature: Ceres ANNOT ID no. 6092736
  misc_feature: Encodes the peptide sequence at SEQ ID NO 8834
atggattgggctgctccggcattgacgagcttcgtcgccgactcgtcctaccgccacctctgctgctacggcgccggaatcgcagggaacgtcttcgccttcgtgctcttcatctccccacttcccacattcaagaggatcgtccgcaacgggtccacggagcagttctcggccatgccgtacatctactcgctgctcaactgcctcatctgcatgtggtacggcctccccttcgtctcctacggcgtcgtcctcgtcgccaccgtcaactccatcggcgccgtcttccagctcgcctacaccgccgtcttcatcgccttcgccgacgccaagcagaggctcaaggtctctgctctcctggctgccgtctttgtggtgttcggactgattgtgtttgttagtttggccttgttggatcacccaacccggcagatgttcgtcggatatctcagcgtcgcatccctcatattcatgttcgcgtcccccttgtcaatcatcaatctggtcatcaggacgaagagcgtggaatatatgcccttctacttgtcattatctatgtttctgatgagtgcatccttcttcggatacggagtgctgctgaatgatttcttcatatatattccaaatggtattggaaccatactgggtatcatacagttggtgctgtatgcctatttcagaaaaggatcaagcgaggaagccaagctgccattactagtcacacatacatga

SEQ ID NO: 8834 - protein, 243 aa, Sorghum bicolor
  misc_feature: Ceres ANNOT ID no. 6092736
  misc_feature (26)..(112): Pfam Id: MtN3_slv Pfam Desc: MtN3/saliva family
  misc_feature (145)..(231): Pfam Id: MtN3_slv Pfam Desc: MtN3/saliva family
  misc_feature (20)..(242): NCBI GI: 11994587 NCBI Desc: mtn3-like protein [arabidopsis thaliana]
  misc_feature (14)..(240): NCBI GI: 56785283 NCBI Desc: mtn3-like [oryza sativa (japonica cultivar-group)]
  misc_feature (19)..(234): NCBI GI: 20161429 NCBI Desc: b1065e10.2 [oryza sativa (japonica cultivar-group)]
  misc_feature (26)..(241): NCBI GI: 34146818 NCBI Desc: at5g53190 [arabidopsis thaliana]
  misc_feature (19)..(236): NCBI GI: 21593422 NCBI Desc: senescence-associated protein (sag29) [arabidopsis thaliana]
  misc_feature: The sequence is a functional homolog of SEQ ID NO. 328 in the 11/188,298 US application
MDWAAPALTSFVADSSYRHLCCYGAGIAGNVFAFVLFISPLPTFKRIVRNGSTEQFSAMPYIYSLLNCLICMWYGLPFVSYGVVLVATVNSIGAVFQLAYTAVFIAFADAKQRLKVSALLAAVFVVFGLIVFVSLALLDHPTRQMFVGYLSVASLIFMFASPLSIINLVIRTKSVEYMPFYLSLSMFLMSASFFGYGVLLNDFFIYIPNGIGTILGIIQLVLYAYFRKGSSEEAKLPLLVTHT

SEQ ID NO: 8835 - DNA, 843 bp, Sorghum bicolor
  misc_feature: Ceres ANNOT ID no. 6092799
  misc_feature: Encodes the peptide sequence at SEQ ID NO 8836
atggcttggatggctgcggccaccctgtgctgccgcctcctccgccttccctccgcccgccgccctccctcgtcccggactcggtgttccgctgcgcagagccccgacgccgtggacaaggagtacgccgacctcaacctccggcctctgtaccccaacaggggccatcacatgcgcatacggcagcacgtgaacccgctcagctcatccttctcggagcccacggagccgccagagtggaaggaggtgttcgacgaccccctgctccccctcatggtcgacatcggctgcgggagtgggaggttcttgatttggcacgcgaagaattctgacaagaggcagaactaccttgggttagaaatccgcgaaaagttggtggagcgggcacaattctgggtgaatgaattggggcttatgaatgtctgttttatgtttgcaaatgcaacggtgtcttttcagaaaatcatatcgtcataccctggtcccttgtcacttgtttcaatactgtgtcctgatccacacttcaaaaagagacatcacaaaagaagagttctgcagcaaccattggtcgattcaatcacaaagaatctctgtttaggtggacgggttttcatacaatcagatgtactggaagtagctgtagacatgagagaaaggtttgatgggtactctgatattttggcacatgttaattatgtcgatcaagatcttcagtgtgaccatgaaggatggcttctggacaacccaatgggaatccggacagagcgagaaatccatgcagagcttgaaggagcaaccatatacaggaggatgtaccaaaaaattagagatgcttcttactaa

SEQ ID NO: 8836 - protein, 280 aa, Sorghum bicolor
  misc_feature: Ceres ANNOT ID no. 6092799
  misc_feature (60)..(275): Pfam Id: Methyltransf_4 Pfam Desc: Putative methyltransferase
  misc_feature (51)..(280): NCBI GI: 115437288 NCBI Desc: os01g0535900 [oryza sativa (japonica cultivar-group)]
  misc_feature (92)..(280): NCBI GI: 57899298 NCBI Desc: trna (guanine-n(7)-)-methyltransferase-like protein [oryza sativa (japonica cultivar-group)]
  misc_feature (49)..(269): NCBI GI: 86609613 NCBI Desc: trna (guanine-n(7)-)-methyltransferase [cyanobacteria bacterium yellowstone b-prime]
  misc_feature (54)..(269): NCBI GI: 86607283 NCBI Desc: trna (guanine-n(7)-)-methyltransferase [cyanobacteria bacterium yellowstone a-prime]
  misc_feature (58)..(274): NCBI GI: 119492442 NCBI Desc: trna (guanine-n(7)-)-methyltransferase [lyngbya sp. pcc 8106]
MAWMAAATLCCRLLRLPSARRPPSSRTRCSAAQSPDAVDKEYADLNLRPLYPNRGHHMRIRQHVNPLSSSFSEPTEPPEWKEVFDDPLLPLMVDIGCGSGRFLIWHAKNSDKRQNYLGLEIREKLVERAQFWVNELGLMNVCFMFANATVSFQKIISSYPGPLSLVSILCPDPHFKKRHHKRRVLQQPLVDSITKNLCLGGRVFIQSDVLEVAVDMRERFDGYSDILAHVNYVDQDLQCDHEGWLLDNPMGIRTEREIHAELEGATIYRRMYQKIRDASY

SEQ ID NO: 8837 - DNA, 1488 bp, Sorghum bicolor
  misc_feature: Ceres ANNOT ID no. 6092809
  misc_feature: Encodes the peptide sequence at SEQ ID NO 8838
atggcgccgccggtcgccggcgtcgtgcgtctcgccgcggcctcccgcgtgttagtcctctccctctacctgctcgcccgcctcctcttccgcccctacgacacctccgccactctcaacccaccctgcctctcctctccccccttgttcccggatcccaacacgcccgtctccaccgctatctcgtcgctggccgtgtgggacggcgtccacttcgcccgacccgcggagtgcggctacgagtacgagcagtccttcgccttccttccgctcctccccgcctccctcgcgctcctcgcacgatcgctgttcgcgccgctagtgccgatactagggtacagggccgtgctcgtgctctccggctatgtcctcaacaacgtcgcattcgttgctgccgcggcctacttctacagattgtctttgctgattttgaaggaccagaaagcagcttaccgagcatctgttctgttttgtttcaaccctgcttctgtgttctactcatcactgtattcagaaagtctttatgcacttttttctcttggaggcatgttctacctgttttcgggtgctaatactgttgcagtgataatgctcgctctgtctggttcagctaggtcaaatggagcacttaatgctggttatttctgttttcaggccttgctacaagcatatgatgccgctgtccaaaagaaaaggcccttgttggcgatgcaggcccttgtgattggagctttgcgctccattttcatatttgtacctttctttgctttccaagcatatggatatttgaacatatgtgtacatgggagctcagaggaattgaggccgtggtgcaaagcaaaagttcccttgttgtatggattcattcagagccactactggggagttggtttcttgaggtacttccaagtgaaacagctgccaaactttcttttggcttcaccagtactttctcttgcggtttattctattgtccattacacaaaattgcttcaccgacttttccaaacaagtagcatccacaagcagattatcactgctctcgaggaaaggtccgttgtgtcatatagaagatccgatgatgtgacaattttgagtgaactttctgctggactcactaagaaagcacaaggaaactctacggttaaacagagaaaatcggttgctgccgaaacagcttctgcaacgttccatgatacaatgtcagctaaacaaaatatggaagagaatcaagatgcatgctccatattactacttccatttgttctgcatctagtcttcatgacattcacagccttctttgtgatgcatgtccaggtgtccacacggtttctatccgctagtccgcccatttactgggctgctgcacatattttggcttctccgagccgatcctccaaaagatggggctacttgatctgtgtctatttcatcgcatacatacttctaggtagtctgctcttctccaatttctacccgttcacgtaa

SEQ ID NO: 8838 - protein, 495 aa, Sorghum bicolor
  misc_feature: Ceres ANNOT ID no. 6092809
  misc_feature (1)..(495): Pfam Id: Mannosyl_trans2 Pfam Desc: Mannosyltransferase (PIG-V))
  misc_feature (8)..(225): NCBI GI: 116116518 NCBI Desc: ensangp00000009757 [anopheles gambiae str. pest]
  misc_feature (3)..(274): NCBI GI: 57999787 NCBI Desc: gpi mannosyltransferase ii [rattus norvegicus]
  misc_feature (3)..(274): NCBI GI: 32822771 NCBI Desc: riken cdna d430024f16 gene [mus musculus]
  misc_feature (8)..(260): NCBI GI: 125808548 NCBI Desc: ga19757-pa [drosophila pseudoobscura]
  misc_feature (8)..(260): NCBI GI: 6672090 NCBI Desc: vegetable [drosophila melanogaster]
MAPPVAGVVRLAAASRVLVLSLYLLARLLFRPYDTSATLNPPCLSSPPLFPDPNTPVSTAISSLAVWDGVHFARPAECGYEYEQSFAFLPLLPASLALLARSLFAPLVPILGYRAVLVLSGYVLNNVAFVAAAAYFYRLSLLILKDQKAAYRASVLFCFNPASVFYSSLYSESLYALFSLGGMFYLFSGANTVAVIMLALSGSARSNGALNAGYFCFQALLQAYDAAVQKKRPLLAMQALVIGALRSIFIFVPFFAFQAYGYLNICVHGSSEELRPWCKAKVPLLYGFIQSHYWGVGFLRYFQVKQLPNFLLASPVLSLAVYSIVHYTKLLHRLFQTSSIHKQIITALEERSVVSYRRSDDVTILSELSAGLTKKAQGNSTVKQRKSVAAETASATFHDTMSAKQNMEENQDACSILLLPFVLHLVFMTFTAFFVMHVQVSTRFLSASPPIYWAAAHILASPSRSSKRWGYLICVYFIAYILLGSLLFSNFYPFT

SEQ ID NO: 8839 - DNA, 276 bp, Sorghum bicolor
  misc_feature: Ceres ANNOT ID no. 6093439
  misc_feature: Encodes the peptide sequence at SEQ ID NO 8840
atggtgaaagcggtggcaatagtagtggccttagccctggccatggtagtggcaatgagtgtaggcagggtgtcagcaaactgcaacatcgcgctgctagcagtttgcaagacagcggtcatcggaggtttaaaacccactgtgacgtgctgctccatcctgcgagcacaggaggcatgcttgtgcaaataccagaaagaccccaagtatggcatgtacattaaccctgcccgcaaaatgattacctcctgcggcatggccatccccaactgctag

SEQ ID NO: 8840 - protein, 91 aa, Sorghum bicolor
  misc_feature: Ceres ANNOT ID no. 6093439
  misc_feature (1)..(91): NCBI GI: 1041815 NCBI Desc: lipid transfer protein [oryza sativa]
  misc_feature (1)..(91): NCBI GI: 110832071 NCBI Desc: nonspecific lipid-transfer protein 2 precursor (nsltp2) (7 kda lipid transfer protein)
  misc_feature (7)..(91): NCBI GI: 84617209 NCBI Desc: type 2 non specific lipid transfer protein precursor [triticum aestivum]
  misc_feature (7)..(91): NCBI GI: 84617215 NCBI Desc: type 2 non specific lipid transfer protein precursor [triticum aestivum]
  misc_feature (7)..(91): NCBI GI: 10803445 NCBI Desc: lipid transfer protein [triticum turgidum subsp. durum]
  misc_feature: The plant is abnormally small.
  misc_feature: Useful for making plants with modulated biomass
  misc_feature: Functional homolog of the protein sequence given in SEQ ID NO 13146
  misc_feature: Functional homolog of the protein sequence given in SEQ ID NO 13190
  misc_feature: The sequence is a functional homolog of SEQ ID NO. 364 in the 11/188,298 US application
MVKAVAIVVALALAMVVAMSVGRVSANCNIALLAVCKTAVIGGLKPTVTCCSILRAQEACLCKYQKDPKYGMYINPARKMITSCGMAIPNC

SEQ ID NO: 8841 - DNA, 276 bp, Sorghum bicolor
  misc_feature: Ceres ANNOT ID no. 6093443
  misc_feature: Encodes the peptide sequence at SEQ ID NO 8842
atggtgaaagcggtggcaatagtagtggccttagccctggccatggtagtggcaatgagtgtaggcagggtgtcagcaaactgcaacatcgcgctgctagcagtttgcaagacggcggtcatcggaggtttaaaacccactgtgacgtgctgctccatcctgcgagcacaggaggcatgcttgtgcaaataccagaaagaccccaagtatggcatgtacattaaccctgcccgcaaaatgattacctcctgcggcatggccatccccaactgctag

SEQ ID NO: 8842 - protein, 91 aa, Sorghum bicolor; identical to SEQ ID NO: 8840
  misc_feature: Ceres ANNOT ID no. 6093443
  misc_feature (1)..(91): NCBI GI: 1041815 NCBI Desc: lipid transfer protein [oryza sativa]
  misc_feature (1)..(91): NCBI GI: 110832071 NCBI Desc: nonspecific lipid-transfer protein 2 precursor (nsltp2) (7 kda lipid transfer protein)
  misc_feature (7)..(91): NCBI GI: 84617209 NCBI Desc: type 2 non specific lipid transfer protein precursor [triticum aestivum]
  misc_feature (7)..(91): NCBI GI: 84617215 NCBI Desc: type 2 non specific lipid transfer protein precursor [triticum aestivum]
  misc_feature (7)..(91): NCBI GI: 10803445 NCBI Desc: lipid transfer protein [triticum turgidum subsp. durum]
  misc_feature: The plant is abnormally small.
  misc_feature: Useful for making plants with modulated biomass
  misc_feature: Functional homolog of the protein sequence given in SEQ ID NO 13146
  misc_feature: Functional homolog of the protein sequence given in SEQ ID NO 13190
  misc_feature: The sequence is a functional homolog of SEQ ID NO. 364 in the 11/188,298 US application

SEQ ID NO: 8843 - DNA, 276 bp, Sorghum bicolor; identical to SEQ ID NO: 8841
  misc_feature: Ceres ANNOT ID no. 6093445
  misc_feature: Encodes the peptide sequence at SEQ ID NO 8844

SEQ ID NO: 8844 - protein, 91 aa, Sorghum bicolor; identical to SEQ ID NO: 8840
  misc_feature: Ceres ANNOT ID no. 6093445
  misc_feature (1)..(91): NCBI GI: 1041815 NCBI Desc: lipid transfer protein [oryza sativa]
  misc_feature (1)..(91): NCBI GI: 110832071 NCBI Desc: nonspecific lipid-transfer protein 2 precursor (nsltp2) (7 kda lipid transfer protein)
  misc_feature (7)..(91): NCBI GI: 84617209 NCBI Desc: type 2 non specific lipid transfer protein precursor [triticum aestivum]
  misc_feature (7)..(91): NCBI GI: 84617215 NCBI Desc: type 2 non specific lipid transfer protein precursor [triticum aestivum]
  misc_feature (7)..(91): NCBI GI: 10803445 NCBI Desc: lipid transfer protein [triticum turgidum subsp. durum]
  misc_feature: The plant is abnormally small.
  misc_feature: Useful for making plants with modulated biomass
  misc_feature: Functional homolog of the protein sequence given in SEQ ID NO 13146
  misc_feature: Functional homolog of the protein sequence given in SEQ ID NO 13190
  misc_feature: The sequence is a functional homolog of SEQ ID NO. 364 in the 11/188,298 US application

SEQ ID NO: 8845 - DNA, 1341 bp, Sorghum bicolor
  misc_feature: Ceres ANNOT ID no. 6093715
  misc_feature: Encodes the peptide sequence at SEQ ID NO 8846
atggagctagcatggttcatcagatcctcaataatctcccttgctggattcttgtcagtggtttccgcatcgacatcgcagcagcaatgcggcggcattggaggacctgctggagtgagagctggctactggtcgccgtcctcaagccgctactccccggtcagtagcatcgacgcctccttgtacactcacctctactacagctcagtgtccatcgacgaggcaagctatgctgtcgcgccacagccgaccgaagaggagggctcgctgctcgctgccttctccggtaccgtcaagtccgggagcccgtctaccaagaccatgctgtccatcggcacaaatgagtacagggtggatgcgtcgaatgccgccttctccacaatggcttcggacaaggacctccggggagtgttcatcaactcctccgtggaactggctcgagccaaccgcttcgacggcctggatttgtcgtggattttcccagtcacacagatggacatggagaaccttggagccctgcttgcagagtggcgagcaaggatcatggaggaatccgccaccaactccttgtctggtcctcttctcctgacggcaacactctacttctccaaccacatgtttgacatgcctgacggcaacctcgactacccaatagatgacatctcagacaacctggactgggcgaatatcctcaccttcggcttccacggggacagcagcgtcaccacagctgacgcacctctctacgacaagtcgtcgcacttctcagtgagctacggggtgatctcatggctggatgcaggagttcctccatgtaagctggtgatggggatacctctgtttggaagatcatggttcctcaggaacaaggccaagaatgggctaggatcgccgactgccgctgccggaacaaagcagagcaaaagcaaccagactgggataattgcatatgcagagactgaagagtacctgaactctgaaagcaccgttgttgcctatgacaaccaatcagtggcagagtatttctacaacggtgacctctgggtcagtttcgatggcgcacaggtagtgcagcagaagctagagttcgcggcgagatctcagttgcttggctacttcctctggaccgtcggcttcgatgattcaaacagcacaatatccaagaaagcatcggaatcatggcaccaatatactcaaggtggatttggaatcatgcacgcaggaggttcaaaccaatatgttgcatttaattcatcttcagtatcacttggtagctggtattcaaaatctctcagctgtttgctgtcttcagtacttctgttggtgattctgtttcattaa

SEQ ID NO: 8846 - protein, 446 aa, Sorghum bicolor
  misc_feature: Ceres ANNOT ID no. 6093715
  misc_feature (38)..(380): Pfam Id: Glyco_hydro_18 Pfam Desc: Glycosyl hydrolases family 18
  misc_feature (10)..(396): NCBI GI: 115457962 NCBI Desc: os04g0376400 [oryza sativa (japonica cultivar-group)]
  misc_feature (10)..(389): NCBI GI: 38346117 NCBI Desc: osjnbb0006n15.12 [oryza sativa (japonica cultivar-group)]
  misc_feature (39)..(394): NCBI GI: 65736671 NCBI Desc: chitinase a [cycas revoluta]
  misc_feature (39)..(394): NCBI GI: 505267 NCBI Desc: chitinase, class v [nicotiana tabacum]
  misc_feature (39)..(394): NCBI GI: 899342 NCBI Desc: chitinase, class v [nicotiana tabacum]
  misc_feature: Useful for making plants with altered cell wall content and/or composition
  misc_feature: Functional homolog of the protein sequence encoded by LOCUS at4g19760
  misc_feature: GREAT-hit functional homolog of the protein sequence encoded by LOCUS at4g19810
  misc_feature: Useful for making plants with altered carbohydrate content
  misc_feature: Functional homolog of the protein sequence given in SEQ ID NO 14033
MELAWFIRSSIISLAGFLSVVSASTSQQQCGGIGGPAGVRAGYWSPSSSRYSPVSSIDASLYTHLYYSSVSIDEASYAVAPQPTEEEGSLLAAFSGTVKSGSPSTKTMLSIGTNEYRVDASNAAFSTMASDKDLRGVFINSSVELARANRFDGLDLSWIFPVTQMDMENLGALLAEWRARIMEESATNSLSGPLLLTATLYFSNHMFDMPDGNLDYPIDDISDNLDWANILTFGFHGDSSVTTADAPLYDKSSHFSVSYGVISWLDAGVPPCKLVMGIPLFGRSWFLRNKAKNGLGSPTAAAGTKQSKSNQTGIIAYAETEEYLNSESTVVAYDNQSVAEYFYNGDLWVSFDGAQVVQQKLEFAARSQLLGYFLWTVGFDDSNSTISKKASESWHQYTQGGFGIMHAGGSNQYVAFNSSSVSLGSWYSKSLSCLLSSVLLLVILFH

SEQ ID NO: 8847 - DNA, 141 bp, Sorghum bicolor
  misc_feature: Ceres ANNOT ID no. 6093773
  misc_feature: Encodes the peptide sequence at SEQ ID NO 8848
atgatctacgacgtgaactctcccctcttccgctccttcctcagccagaagggcggcgccgacaagaggaaaatggaggagcataaaccaaaggagcagaggcccaaggccagcgagaacaagcctgtgatgaacgaatga

SEQ ID NO: 8848 - protein, 46 aa, Sorghum bicolor
  misc_feature: Ceres ANNOT ID no. 6093773
  misc_feature (1)..(46): Pfam Id: Wound_ind Pfam Desc: Wound-inducible basic protein family
  misc_feature (1)..(46): NCBI GI: 115488282 NCBI Desc: os12g0405700 [oryza sativa (japonica cultivar-group)]
  misc_feature (1)..(46): NCBI GI: 217989 NCBI Desc: 5.8 kb basic protein [phaseolus vulgaris]
  misc_feature (1)..(46): NCBI GI: 115488282 NCBI Desc: os12g0405700 [oryza sativa (japonica cultivar-group)]
  misc_feature (1)..(46): NCBI GI: 217989 NCBI Desc: 5.8 kb basic protein [phaseolus vulgaris]
  misc_feature: The plant is abnormally small.
  misc_feature: Useful for making plants with modulated biomass
  misc_feature: GREAT-hit functional homolog of the protein sequence given in SEQ ID NO 13117
  misc_feature: Useful for making plants with modulated biomass
  misc_feature: Functional homolog of the protein sequence given in SEQ ID NO 13117
MIYDVNSPLFRSFLSQKGGADKRKMEEHKPKEQRPKASENKPVMNE

SEQ ID NO: 8849 - DNA, 954 bp, Sorghum bicolor
  misc_feature: Ceres ANNOT ID no. 6094223
  misc_feature: Encodes the peptide sequence at SEQ ID NO 8850
atggcggcgagcaacatcgggatgatggacggcgcctacttcgtcgggcgcaacgagatcctcgcgtggatcaacaccacgctgcagctcggcctctccaaggtggaggaggctgcgtcgggcgcggttgcgtgccaattgatggacgcggctcatcctggtgccgtgccgatgcataaggtgaacttcgacgccaagacggagtacgagatgatccagaactataaggtgctgcaggatgtgttcaacaaactcaagatcactaagcacattgaggtgaacaaacttatcaaagcaagaccccttgacaatctggagttcatgcaatggcttaaacgatactgtgattctgtgaatggtggcttcatgaccaactacaatgcttctgagagaagggaaagcagcaaagggggaaaggataccaacagaagggcatcggtgccctctcacaccccggccaagtctgcaaccacaggtcacaaggctcaaacttcacatggtgctaagcgggcaagtgggcagacggctagtgcaccaccaccacgcagtgctaagccgtcacctgccgccaactctggtggaccagcaccagcttatgatgaacaaataactgagctgaagctccttgttgatagcctggagaaggagagagatttctacttcaccaagctgcgggacattgagatgctgtcccagaaccctgaggttgagcacgtttcggtccaaactatccagaacatactctacgcatcagaggaggacgctcagcagctgcctccggccctgagccccatcatggaggcgtccgaggagaggccgaagcaagagatggcgaacaagaggaagagcatctcggacctggacgagtttggtatgtcatccagctcaaggcagaggctctccgacatctcggacgtgcagctgtgcggttcgccactgacgagtttcagctga

SEQ ID NO: 8850 - protein, 317 aa, Sorghum bicolor
  misc_feature: Ceres ANNOT ID no. 6094223
  misc_feature (212)..(258): Pfam Id: EB1 Pfam Desc: EB1-like C-terminal motif
  misc_feature (15)..(116): Pfam Id: CH Pfam Desc: Calponin homology (CH) domain
  misc_feature (3)..(277): NCBI GI: 92892433 NCBI Desc: microtubule-associated protein eb1-like protein [medicago truncatula]
  misc_feature (2)..(261): NCBI GI: 90399108 NCBI Desc: h0423h10.8 [oryza sativa (indica cultivar-group)]
  misc_feature (2)..(261): NCBI GI: 38347318 NCBI Desc: osjnba0063c18.9 [oryza sativa (japonica cultivar-group)]
  misc_feature (2)..(261): NCBI GI: 115460892 NCBI Desc: os04g0642100 [oryza sativa (japonica cultivar-group)]
  misc_feature (3)..(276): NCBI GI: 21536831 NCBI Desc: microtubule-associated protein eb1-like protein [arabidopsis thaliana]
MAASNIGMMDGAYFVGRNEILAWINTTLQLGLSKVEEAASGAVACQLMDAAHPGAVPMHKVNFDAKTEYEMIQNYKVLQDVFNKLKITKHIEVNKLIKARPLDNLEFMQWLKRYCDSVNGGFMTNYNASERRESSKGGKDTNRRASVPSHTPAKSATTGHKAQTSHGAKRASGQTASAPPPRSAKPSPAANSGGPAPAYDEQITELKLLVDSLEKERDFYFTKLRDIEMLSQNPEVEHVSVQTIQNILYASEEDAQQLPPALSPIMEASEERPKQEMANKRKSISDLDEFGMSSSSRQRLSDISDVQLCGSPLTSFS

SEQ ID NO: 8851 - DNA, 729 bp, Sorghum bicolor
  misc_feature: Ceres ANNOT ID no. 6094234
  misc_feature: Encodes the peptide sequence at SEQ ID NO 8852
atgcggaaggcgtacagggactccatcaaggtgctcgaagctgacatccagcacgccaacaccctggcctccgagtttccccgggactatgacggtgcgtgtctgcagatgcggctgtcgtacagtcccgcagctcatatattcctcttcctggtgcagtggacagactgcagcctcgccggggcgcttggtctgctgagaatcctcatatacaaggtttatgtggatggcacgacaaccatgtcgactcatgagaggaaagcaagtatcaaagaattctatgctgtgatatttccttctttgctgcaactgcaaagggggatcactgatgtggaggacaagaagcagaaggccgtgtgcatggagaggtacacaaagaaagatgaggacgaacggggctccttatctgatattgatgtcgagagggaagaggagtgtgggatttgcatggagatgaacagcaaagttgtgctgcccaactgcacccatgctatgtgcctcagatgttaccaagactggagttcaagatcgcagtcctgcccattctgccgcgacaacctgaagaagacctgtcctggtgacttgtggatctatgtcgaggaccaagatgtggttgacatggagacagtgtcaagcgagaacctcagacggctgttcatgtacataagcaagctgcctctgattgtcccagacgtcattttcagtgtttatgattcccacataaaatga

SEQ ID NO: 8852 - protein, 242 aa, Sorghum bicolor
  misc_feature: Ceres ANNOT ID no. 6094234
  misc_feature (1)..(242): NCBI GI: 124360609 NCBI Desc: zinc finger, ring-type [medicago truncatula]
  misc_feature (1)..(242): NCBI GI: 38175742 NCBI Desc: zinc finger protein family-like [oryza sativa (japonica cultivar-group)]
  misc_feature (4)..(242): NCBI GI: 21618121 NCBI Desc: rna-binding protein-like protein [arabidopsis thaliana]
  misc_feature (1)..(230): NCBI GI: 140051168 NCBI Desc: zinc finger, ring-type [medicago truncatula]
  misc_feature (2)..(238): NCBI GI: 9294812 NCBI Desc: mtd2 [medicago truncatula]
  misc_feature: Useful for making plants with altered Lignin content
  misc_feature: Functional homolog of the protein sequence given in SEQ ID NO 12952
  misc_feature: Functional homolog of the protein sequence given in SEQ ID NO 13283
  misc_feature: Useful for making plants with altered lignin content
  misc_feature: Functional homolog of the protein sequence given in SEQ ID NO 13283
  misc_feature: The sequence is a functional homolog of SEQ ID NO. 271 in the 11/188,298 US application
  misc_feature: The sequence is a functional homolog of SEQ ID NO. 329 in the 11/188,298 US application
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMERYTKKDEDERGSLSDIDVEREEECGICMEMNSKVVLPNCTHAMCLRCYQDWSSRSQSCPFCRDNLKKTCPGDLWIYVEDQDVVDMETVSSENLRRLFMYISKLPLIVPDVIFSVYDSHIK

SEQ ID NO: 8853 - DNA, 2532 bp, Sorghum bicolor
  misc_feature: Ceres ANNOT ID no. 6094244
  misc_feature: Encodes the peptide sequence at SEQ ID NO 8854
atgtctccactcctcacgctcacctcactcctcttcctcgtccactccgccgccgccgccgccggcggcggcgacaccaggcgggcgctgcacgagccgctcttccccatcgaatggaccccgccgccgtccaccacggcgccgccagcaccgggattcgccgccgatccctccacgcccgtcccacccgtcgacaacggcgggccggcgctgctcccggctccgccgccaccgaacaccgtcgccgcggacgcctcatcatcccgcacaggcccggctccgcgcgtccacggcggcggcggcggaggaggaacgcccaaggccgccattgtcgtcgcctccgccgccgcggcggccgtcctcgcgctgctcgccttcgccgccgcgtttctcctcacgggccgtctcgcgcggcggcaccccgcgtgggcgaacaaaccccccggcctcgccgccgcggcgcaccctgggcctgcctccgcggtcgtgctgcacgccgacgcggtgggcacctccgcagcggcggcggcctcgtcgtcgggtgccggtgccacaccgtaccggaaggcccgctcggagcgcgccaggcggggcatgtgccgcgacgtcgacaccgtcccgagcccggaactcaggccgctcccgccgcttcggcgcgcggggtcgtccgacgaggacgccgcgtactacacgccgggccagcgctcggcgggcggcgacggcgccgggacgtggagcgaggcgagcgcgtccagcccacggaccaccactccctcccgccgcagtctccccagcctcaccagcgatttcttcccacccacgccggccgccgccgttccagctgcaaccgtggcgcctcctccgcccgcgcctcctgcgccacgctcccgacgcactctgccgcggacccgtttctccgccggctccgcctcggatatgatcaagcaaatggtctcgccaccctccaacccacctcctcctcctccaccgccgccgccgccgccgccgccagcgccaagatgcaccaacgcaatcccaaaacctccgcagcctccaccgggaccatccgctgcaccattatcaacgcgccggcttcacaaaccagagcaaacagaggggccaagtgtcgctgcgccgagagcacccgtcatggcggtgaacaaagacaatgacggcatgtcgatccggacggacgatgatcctgccggtgacgaagcccgccccaagctgaagccgctgcactgggacaaggtccgggcgtgctccgaccgcgacatggtctgggaccggctcaagttggatgaggacatgatcgaggtgcttttcacgaacaatgctgcaaatgcaccttctagggacacgctgaaaaaacctggagcgccgcaatgtagtgcccaagagaaggtccttgatcctaagaaggcacagaacattgccatcctgctgcgcgcactgaatgtcactctggaagaggtctccgatgcactgttagatggcaatgctgaatgtctgggggcggatttgttggaaaccttagtaaagatggctcctacaaaagaggaagaactgaagcttcgaaactttactggggacttatcaaagcttggttcggcagagcgttttctcaaggcactgcttgatatccctttctccttcaaaagagttgatgctatgctatatcgagcaaattttgagagcgaaattaattacctcaggaaatctttcgagacattagagggagcttgtgatgatttaaaaggcagtagattgttcctgaagctacttgaagctgtcctgcaagctgggaaccgaatgaatgttggcacaaaccgtggtcaggcaaaagctttcaagctggacactctactcaaactcgcagacgtcaaaggcaccgatggcaaaaccaccttgctacactttgttgtccaagaaatcgtccggtctgaagacgcaaaatccgagaaagccgtaggagatgaagccagaaatatcgtgaaagacgaaatgttccgtaagcaaggattgaaagttgtatctgggctgagcaatgagctcgggaatgtcaagaaagcagccagcatggatttcgatgtgctgcacagctatgtatccaagcttcaggccggtcttggcaagatcaagtcggtcctcctgctcgagaagcagtgcacccaaggccagaatttcttcgcgaggatgcgtgattttctcaaggaagctgagatagagatcaaacaagtcaggtgcgatgaggagagggctctggggagagtgaaagagatcactgagtatttccatggcgattctgcaaaggaggaagcgcaccctctgaggatattcatggttgtgagggacttcctgtccatgctggaccatgtctgcaaggaggtcagccagcaggacaggtcggttgttggatctggaaggtccttccgtatgtcagcgaccacggcaatggcgaacctgaaaatgtacggccagcatgcaggagacgacgacgacgacgacgacgaagagagttggtcgctgtag

SEQ ID NO: 8854 - protein, 843 aa, Sorghum bicolor
  misc_feature: Ceres ANNOT ID no. 6094244
  misc_feature (401)..(791): Pfam Id: FH2 Pfam Desc: Formin Homology 2 Domain
  misc_feature (246)..(842): NCBI GI: 92866950 NCBI Desc: actin-binding fh2 [medicago truncatula]
  misc_feature (246)..(840): NCBI GI: 37694426 NCBI Desc: formin-like protein atfh6 [arabidopsis thaliana]
  misc_feature (260)..(819): NCBI GI: 110741802 NCBI Desc: formin-like protein ahf1 [arabidopsis thaliana]
  misc_feature (147)..(840): NCBI GI: 115473083 NCBI Desc: os07g0588200 [oryza sativa (japonica cultivar-group)]
  misc_feature (307)..(842): NCBI GI: 6691125 NCBI Desc: fh protein nfh2 [nicotiana tabacum]
MSPLLTLTSLLFLVHSAAAAAGGGDTRRALHEPLFPIEWTPPPSTTAPPAPGFAADPSTPVPPVDNGGPALLPAPPPPNTVAADASSSRTGPAPRVHGGGGGGGTPKAAIVVASAAAAAVLALLAFAAAFLLTGRLARRHPAWANKPPGLAAAAHPGPASAVVLHADAVGTSAAAAASSSGAGATPYRKARSERARRGMCRDVDTVPSPELRPLPPLRRAGSSDEDAAYYTPGQRSAGGDGAGTWSEASASSPRTTTPSRRSLPSLTSDFFPPTPAAAVPAATVAPPPPAPPAPRSRRTLPRTRFSAGSASDMIKQMVSPPSNPPPPPPPPPPPPPPAPRCTNAIPKPPQPPPGPSAAPLSTRRLHKPEQTEGPSVAAPRAPVMAVNKDNDGMSIRTDDDPAGDEARPKLKPLHWDKVRACSDRDMVWDRLKLDEDMIEVLFTNNAANAPSRDTLKKPGAPQCSAQEKVLDPKKAQNIAILLRALNVTLEEVSDALLDGNAECLGADLLETLVKMAPTKEEELKLRNFTGDLSKLGSAERFLKALLDIPFSFKRVDAMLYRANFESEINYLRKSFETLEGACDDLKGSRLFLKLLEAVLQAGNRMNVGTNRGQAKAFKLDTLLKLADVKGTDGKTTLLHFVVQEIVRSEDAKSEKAVGDEARNIVKDEMFRKQGLKVVSGLSNELGNVKKAASMDFDVLHSYVSKLQAGLGKIKSVLLLEKQCTQGQNFFARMRDFLKEAEIEIKQVRCDEERALGRVKEITEYFHGDSAKEEAHPLRIFMVVRDFLSMLDHVCKEVSQQDRSVVGSGRSFRMSATTAMANLKMYGQHAGDDDDDDDEESWSL

SEQ ID NO: 8855 - DNA, 2472 bp, Sorghum bicolor
  misc_feature: Ceres ANNOT ID no. 6094253
  misc_feature: Encodes the peptide sequence at SEQ ID NO 8856
atgacagcccctgtggctcttccaaatgatctagaaacagtctcccattctgcaagggttgacttattccgagacactagttgcaacatagaaaaggaggtgttggccagtttgggaaatggccaagattcaactgctgctggaacaaatcctggtttcagagttggggagatcaggtttgctaatggagatatttattccggcacattgttggggaacacaccagagggttcaggccagtatcgctggtcagatggttgcacctatgagggtgagtggaggagagggatgaggcatgggcaaggaaagacgcgatggccatctggagctacctatgagggtgagtattctggtggctacgtattcggtgaaggcacctatacgggtccagataaaatcatctataagggacggtggaagttgaatcgcaagcatgggcttggacatcagacatatccaaatggagacatatttgaaggttcgtggattcagggagaaatagtaggtcatgggaagtacacatgggcgaatggggacacttacgttggcaacatgaaaagtggcaagatgtcagggaaaggaactcttacatggaaaaatggggactcatatgagggtaactggatggatggcatgatgcatgggtatggaatctatacatggaatgaatgcgggtattatattggaacatggacaagaggactgaaggatgggaaaggtaaattctatccgaacggttgcagaattcctgttaacgatgagctgtatatcaataatctaagaaaccgcggtgtattgcctgatattagaaggcagaatcatggttcacgcatacttcactcttcctcggttgacatggggaacatgaaggttggtatgattaggcaatcttcagatgttttgtccaaaaggaattcaactgagcagcctcctttgaagaatgtgtctttggaaagacggtggagtcttgaggtggctattgaaaagtttattggccatgattcgagtgaaagttctggtctagaaagcttggaaaacttgagtgattctcgattgcccatactggaaagagaatacatgcaaggtgttctaatcagcgaggtggttcttgacaggagtttttcagactcctcaaagaagacaaaacgccgccagaagaaaatagtgagggatacaaaaaagcctggagagacaataattaagggacacaggagctatgatttaatgctcagcctgcagcttgggatcaggtacacagttggaaagattacaccaattcaaaaacgtgaagttcgtgcttcagattttggaccaagagcaagtttctggatgaacttcccaaaagaaggatctcggcttactccttcacattcagcggaggattttaaatggaaagactactgtcccatggttttcaggaatttgagagagatgttcaagattgatgctgcagactatatgatctccatatgcggaaattctgctcttagggaactatcttcccctggaaagagtggaagtgtctttttcttgtcacaagatgataggttcatgattaagactctccgaaaatctgaagtgcaggttcttttacgaatgcttccaaactattatgatcatgtccgtacctatgagaacaccctcataactaagttttttggcctccacagggtgaaaccttctagtggtcaaaagttccggtttgttgtaatgggaaacatgttttgcactgaattgagaattcaccggaggtttgatttgaaaggctcatctttaggccgctctactgacaaaattgaaattgatgagaacacaactctgaaggatctggatcttaactattccttttatcttgaaccttcctggcgtgaggctctacttaagcagattgaaacagacagtgattttttgagaacacagcggataatggattacagcctactgcttggtgttcattatagagctccacagcacttgcgaacacgtgcatcgtatcaccggagcatggcagcagataggttgactgttgtttcagaagaagatgctcaggaagatgatgcccttagctatccagaaggattagttttggttcaaagcagtggcgagaacagtgttgttgttggtcctcacataagaggcagccgtttgcgtgcatcagctgctggatttggtgaagtagacctactgctgcctggtacagccaggcttcagatccagctaggagttaacatgcctgcaagggcagagcaaatacctaaggaagatgaaagcaaaccatttcgtgaggtgtatgatgtcgtcctctacctgggcatcattgacatattgcaagagtacaacatgacaaagaaaatcgagcatgctgtcaagtccatgcaatatgactcggtctcgatctctgctgtggacccccagttctactcagagcgtttcttgaagttcatccagaccgtcttccctgagaattcatag

SEQ ID NO: 8856 - protein, 823 aa, Sorghum bicolor
  misc_feature: Ceres ANNOT ID no. 6094253
  misc_feature (488)..(819): Pfam Id: PIP5K Pfam Desc: Phosphatidylinositol-4-phosphate 5-Kinase
  misc_feature (89)..(111): Pfam Id: MORN Pfam Desc: MORN repeat
  misc_feature (135)..(157): Pfam Id: MORN Pfam Desc: MORN repeat
  misc_feature (158)..(180): Pfam Id: MORN Pfam Desc: MORN repeat
  misc_feature (181)..(203): Pfam Id: MORN Pfam Desc: MORN repeat
  misc_feature (204)..(226): Pfam Id: MORN Pfam Desc: MORN repeat
  misc_feature (227)..(248): Pfam Id: MORN Pfam Desc: MORN repeat
  misc_feature (335)..(821): NCBI GI: 73621405 NCBI Desc: phosphatidylinositol-4-phosphate 5-kinase 1 precursor (1-phosphatidylinositol-4-phosphate kinase) (pip5k) (ptdins(4)p-5-kinase) (diphosphoinositide kinase)
  misc_feature (335)..(821): NCBI GI: 45434044 NCBI Desc: phosphatidylinositol-4-phosphate 5-kinase [oryza sativa (japonica cultivar-group)]
  misc_feature (390)..(654): NCBI GI: 33354203 NCBI Desc: phosphatidylinositol-4-phosphate 5-kinase-like protein [oryza sativa (japonica cultivar-group)]
  misc_feature (66)..(821): NCBI GI: 1931652 NCBI Desc: phosphatidylinositol-4-phosphate 5-kinase isolog; 89655-95590 [arabidopsis thaliana]
  misc_feature (391)..(680): NCBI GI: 140065036 NCBI Desc: phosphatidylinositol-4-phosphate 5-kinase [medicago truncatula]
  misc_feature (31)..(823): SWISSPROT Homolog: EC 2.7.1.68 Phosphatidylinositol-4-phosphate 5-kinase 9
MTAPVALPNDLETVSHSARVDLFRDTSCNIEKEVLASLGNGQDSTAAGTNPGFRVGEIRFANGDIYSGTLLGNTPEGSGQYRWSDGCTYEGEWRRGMRHGQGKTRWPSGATYEGEYSGGYVFGEGTYTGPDKIIYKGRWKLNRKHGLGHQTYPNGDIFEGSWIQGEIVGHGKYTWANGDTYVGNMKSGKMSGKGTLTWKNGDSYEGNWMDGMMHGYGIYTWNECGYYIGTWTRGLKDGKGKFYPNGCRIPVNDELYINNLRNRGVLPDIRRQNHGSRILHSSSVDMGNMKVGMIRQSSDVLSKRNSTEQPPLKNVSLERRWSLEVAIEKFIGHDSSESSGLESLENLSDSRLPILEREYMQGVLISEVVLDRSFSDSSKKTKRRQKKIVRDTKKPGETIIKGHRSYDLMLSLQLGIRYTVGKITPIQKREVRASDFGPRASFWMNFPKEGSRLTPSHSAEDFKWKDYCPMVFRNLREMFKIDAADYMISICGNSALRELSSPGKSGSVFFLSQDDRFMIKTLRKSEVQVLLRMLPNYYDHVRTYENTLITKFFGLHRVKPSSGQKFRFVVMGNMFCTELRIHRRFDLKGSSLGRSTDKIEIDENTTLKDLDLNYSFYLEPSWREALLKQIETDSDFLRTQRIMDYSLLLGVHYRAPQHLRTRASYHRSMAADRLTVVSEEDAQEDDALSYPEGLVLVQSSGENSVVVGPHIRGSRLRASAAGFGEVDLLLPGTARLQIQLGVNMPARAEQIPKEDESKPFREVYDVVLYLGIIDILQEYNMTKKIEHAVKSMQYDSVSISAVDPQFYSERFLKFIQTVFPENS

SEQ ID NO: 8857 - DNA, 1605 bp, Sorghum bicolor
  misc_feature: Ceres ANNOT ID no. 6094266
  misc_feature: Encodes the peptide sequence at SEQ ID NO 8858
atgatggcgagcacggcgtcagcgaccgccgccgccgccgccgcggcattcggggctgccgccaagccgcggggatcgtcgtcggccccctgcgcaagggtggccgccggcggcaggcggcgctccggggtggtggtgcggtgcgacgccggcgtggaggcccaggtgcaggcggtggccaaggccgccagcatcgccgcgctcgagcagttcaagatctccgccgaccggtacatgaaggaaaggagtagcatagctgtgataggcctcagtgtgcacacagcacctgtggagatgcgtgaaaaacttgcggttgcagaggaactatggccccgtgctattcaagaacttacaagtctaaaccatattgaagaggctgctgttcttagtacctgtaatagaatggaaatttatgtggtggccctatcatggaaccgaggtatcagagaagtagtggactggatgtcaaagaaaagtggtattcctgcttctgagcttagggagcatctgttcatgctgcgtgacagtgatgctacacgccatctgtttgaggtatcggctgggctggactctttggttctgggtgaaggacaaatccttgctcaagttaaacaagttgtgagaagtggacaaaacagtggaggcctgggaaagaacattgatagaatgttcaaggatgcaattacagctggaaagcgtgtgcgttctgagactaacatatcatctggtgctgtttctgtcagttcagcggcagttgaattggccctgatgaagcttccaaagtctgaagccctgtcagctaggatgcttttgattggtgctggcaaaatgggaaaattagtgatcaaacatctgattgccaaaggatgcaagaaggtggttgtggtcaaccgttcagtggaaagggtggatgcaatccgtgaggagacgaaagatatcgagattgtgtacaggccgctctcagagatgtatgaagctgcagctgaagctgacgtggtgttcacgagcactgcatctgaaaccccattgttcacaaaagagcacgcagatgcacttcccactatttctgatgccatgggtggtgttcggcttttcatcgacatatctgtcccaaggaatgtcagtgcgtgtgtctctgaaattggctctgcacgagtatacaatgttgatgacctgaaagaggtggtggaagccaacaaggaagaccgtctcaggaaggcaatggaggcgcagacaatcatcactgaagagctgaaacggtttgaggcatggagggactctctggagaccgttccaaccatcaagaagctgaggtcatatgccgacaggatccgggcctcggagctcgagaagtgcctgcagaagatcggggatgatgttctcaccaaaaagatgaggagagctatcgaggagctaagcaccggcattgtgaacaagctcctccacggtccgctgcagcacctgaggtgcgatggcagtaacagccgcacccttgatgaaacgctcgagaacatgcacgctctcaaccggatgttcagcctcgacactgagaaggcgatcatcgagcagaagatcaaggctaaggtggagaagacccaaaattga

SEQ ID NO: 8858 - protein, 534 aa, Sorghum bicolor
  misc_feature: Ceres ANNOT ID no. 6094266
  misc_feature (88)..(239): Pfam Id: GlutR_N Pfam Desc: Glutamyl-tRNAGlu reductase, N-terminal domain
  misc_feature (243)..(395): Pfam Id: Shikimate_DH Pfam Desc: Shikimate / quinate 5-dehydrogenase
  misc_feature (408)..(515): Pfam Id: GlutR_dimer Pfam Desc: Glutamyl-tRNAGlu reductase, dimerisation domain
  misc_feature (1)..(534): NCBI GI: 94730388 NCBI Desc: glutamyl-trna reductase, chloroplast precursor (glutr)
  misc_feature (1)..(534): NCBI GI: 2920320 NCBI Desc: glutamyl-trna reductase [oryza sativa (indica cultivar-group)]
  misc_feature (1)..(534): NCBI GI: 7433720 NCBI Desc: probable glutamyl-trna reductase (ec 1.2.1.-) 1 precursor, chloroplast - barley
  misc_feature (1)..(534): NCBI GI: 1039332 NCBI Desc: glutamyl trna reductase [hordeum vulgare subsp. vulgare]
  misc_feature (6)..(534): NCBI GI: 1041425 NCBI Desc: glutamyl-trna reductase [hordeum vulgare subsp. vulgare]
  misc_feature (1)..(534): SWISSPROT Homolog: EC 1.2.1.70 Glutamyl-tRNA reductase, chloroplast precursor
MMASTASATAAAAAAAFGAAAKPRGSSSAPCARVAAGGRRRSGVVVRCDAGVEAQVQAVAKAASIAALEQFKISADRYMKERSSIAVIGLSVHTAPVEMREKLAVAEELWPRAIQELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRSETNISSGAVSVSSAAVELALMKLPKSEALSARMLLIGAGKMGKLVIKHLIAKGCKKVVVVNRSVERVDAIREETKDIEIVYRPLSEMYEAAAEADVVFTSTASETPLFTKEHADALPTISDAMGGVRLFIDISVPRNVSACVSEIGSARVYNVDDLKEVVEANKEDRLRKAMEAQTIITEELKRFEAWRDSLETVPTIKKLRSYADRIRASELEKCLQKIGDDVLTKKMRRAIEELSTGIVNKLLHGPLQHLRCDGSNSRTLDETLENMHALNRMFSLDTEKAIIEQKIKAKVEKTQN

SEQ ID NO: 8859 - DNA, 1647 bp, Sorghum bicolor
  misc_feature: Ceres ANNOT ID no. 6094277
  misc_feature: Encodes the peptide sequence at SEQ ID NO 8860
atgcccgcgccgcgcctcgcgcacctccgccacctcctcctctcacaacgctccgccccggcccgctcgctggcccccaacctaggccacccgctccccgggccgcttcacccgtcccttctcctcgcccgtgccatggctggcgtcgcgcacgcaggtctggcgacggggtcgacggaatacgaggaggtgctcgggtgcctctcgtcgctgataacgcagaaggtgcgcgcggacaccggcaaccgcggcaaccagtgggagctcatggccaagtacgtgcagatacttgaactggaggagtccatcgcacagttgaaagtggttcacgttgctgggaccaaaggaaagggttcaacatgcacatttgctgagtcaatccttcgatcatgtggcttccgcactgggctcttcacttcaccgcatttgatggatgtccgcgagcgatttcggcttgatgggctggacatttcggaagaaaagtttattaggtatttctggtggtgctggaacaaattgaaggacaggattggtgatgatgtaccaatgccagcctacttcaggttccttgcactgctagcattcaagatcttttcagatgagcaggtggatgttgcggtgctcgaggttggtttgggagggaagtatgatgcaacgaatgtggtcagagcacctgtagtttgtggagtatcatctcttgggtatgatcatatggaaattcttggaagcacacttggagaaattgctggagagaaggctgggatacttaagaaaggagtttcggcgtatacagttccacagccagaagaggcaatgtctgtactggtgcagcgagcttctgagttgggtgtttctcttcaagtagtccagcctttggacccacagaaattagaggatcaaccccttggactccatggtgaacaccaatacatgaatgcaggtcttgcagttgcattggctaatacctggcttgagagggaaggccatttgaacagaatacatgtcaaacattctggtaccttgccagatcagttcatcaaagggctgtcaagtgcttgtctgcaaggtcgagcacagattgttccagatccacaagtgaactcagaaaacaataaggatcgtgattcttcactggttttctatttggatggggcacatagcccagaaagcatggaaatgtgtgcaagatggtttgcccacattacaaataatgatggaacgcagacatgttctttggagcagcctcatactgacagggattctaggaagtttctccttttcaattgcatgactgtaagagatcctcagagattgctcccacatcttctggatacatgtgctcaaaatgggctccactttgagcaggccttatttgtgccaaaccaatcacagtacaacaagcttggttcccttgcatccccaccttcagagcgtgaacaaattgatttgtcatggcagttgtcactccaaaaggtgtgggaaaacctgcctaatggcaataaaggtctaaatgatgcaaactctggcagaactagctcagtttttgaatctcttccgttggcaattaaatggctaagggaaactgctcaacaaaaccaatcgattcgatttcagatgtatgtttcgatcgcattccccattggatga

SEQ ID NO: 8860 - protein, 548 aa, Sorghum bicolor
  misc_feature: Ceres ANNOT ID no. 6094277
  misc_feature (47)..(542): NCBI GI: 144583301 NCBI Desc: folylpolyglutamate synthetase [triticum aestivum]
  misc_feature (1)..(542): NCBI GI: 30681208 NCBI Desc: dihydrofolate synthetase/folylpolyglutamate synthetase (dhfs/fpgs2) [arabidopsis thaliana]
  misc_feature (1)..(542): NCBI GI: 17976705 NCBI Desc: dihydrofolate synthetase /folylpolyglutamate synthetase [arabidopsis thaliana]
  misc_feature (55)..(542): NCBI GI: 79327065 NCBI Desc: atdfb (a. thaliana dhfs-fpgs homolog b); tetrahydrofolylpolyglutamate synthase [arabidopsis thaliana]
  misc_feature (54)..(538): NCBI GI: 10177571 NCBI Desc: tetrahydrofolylpolyglutamate synthase-like protein [arabidopsis thaliana]
MPAPRLAHLRHLLLSQRSAPARSLAPNLGHPLPGPLHPSLLLARAMAGVAHAGLATGSTEYEEVLGCLSSLITQKVRADTGNRGNQWELMAKYVQILELEESIAQLKVVHVAGTKGKGSTCTFAESILRSCGFRTGLFTSPHLMDVRERFRLDGLDISEEKFIRYFWWCWNKLKDRIGDDVPMPAYFRFLALLAFKIFSDEQVDVAVLEVGLGGKYDATNVVRAPVVCGVSSLGYDHMEILGSTLGEIAGEKAGILKKGVSAYTVPQPEEAMSVLVQRASELGVSLQVVQPLDPQKLEDQPLGLHGEHQYMNAGLAVALANTWLEREGHLNRIHVKHSGTLPDQFIKGLSSACLQGRAQIVPDPQVNSENNKDRDSSLVFYLDGAHSPESMEMCARWFAHITNNDGTQTCSLEQPHTDRDSRKFLLFNCMTVRDPQRLLPHLLDTCAQNGLHFEQALFVPNQSQYNKLGSLASPPSEREQIDLSWQLSLQKVWENLPNGNKGLNDANSGRTSSVFESLPLAIKWLRETAQQNQSIRFQMYVSIAFPIG

SEQ ID NO: 8861 - DNA, 1524 bp, Sorghum bicolor
  misc_feature: Ceres ANNOT ID no. 6094284
  misc_feature: Encodes the peptide sequence at SEQ ID NO 8862
atgcaccagcccagagcccgctacccgcccggctatggctccggcggcggaggcggagccgggcgtggcggcggaggcggcaatggaggcggcggcggaggcggtggcggaaaccacaactactacggccggaacccgcagccacagcagcaacaccaccaccaacagcagcagcagcagcagcagcacgtgcataggaactcctcgcaccagcagcagtggctgcggcgagaccaggcccccgccgttgcgggggcagcgtccggaaacgctgcggctaagacggcgcctcagcttgacgccataggctcgagttctcatgattggaaggctcaactaaatataccagctccagatacacgctacaggacagaggatgtcactgcaacaaaaggcaatgagtttgaggattatttcttgaaacgtgaactgcttatgggaatctatgaaaagggatttgaaaggccatctcctattcaagaagaaagcattcctattgcgctgactggaagtgatattcttgcaagggcgaaaaatggcactggaaaaactgctgcattttgcattccagcacttgaaaaaattgatcctgaaaaaactgctattcaagttgttatactagtaccaacaagggaactggctctgcaaacttcacaagtctgtaaagagcttgggaagtacctgaacattcaagtcatggttagtactggaggaaccagcttgaaggatgacatcatgcgtttgtaccaacctgttcatttacttgttgggactcctggccgaatacttgatcttaccaggaagggcatttgtgtgctgaaagattgttcaatgcttgtcatggatgaggcagacaagctattagctccagagtttcagccttctgtggaggcacttattcatttccttccacctagtcggcaactgttgatgttttcagcaacttttcctgtaactgtcaaggaattcaaagagaaatatctgcctagaccttatgtgattaatctaatggatgaactgacactgaaaggaatcacacaatattatgcttttgttgaagaaaggcagaaagttcattgcctgaatacacttttctcaaagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacagatctgtttaccagaggaattgatatccaggctgttaatgtggtcattaattttgactttcctaagacatctgagacatatttacacagggttggccgttctggaagatatggacaccttggtttggcagtgaacttgatcacttatgaggaccgtttcaacttgtataggattgagcaagaacttggaacagaaattaagacaatacccccacagattgacctggccgtgtactgccaatga

SEQ ID NO: 8862 - protein, 507 aa, Sorghum bicolor
  misc_feature: Ceres ANNOT ID no. 6094284
  misc_feature (157)..(323): Pfam Id: DEAD Pfam Desc: DEAD/DEAH box helicase
  misc_feature (389)..(465): Pfam Id: Helicase_C Pfam Desc: Helicase conserved C-terminal domain
  misc_feature (5)..(507): NCBI GI: 92877736 NCBI Desc: helicase, c-terminal [medicago truncatula]
  misc_feature (5)..(507): NCBI GI: 92877733 NCBI Desc: helicase, c-terminal [medicago truncatula]
  misc_feature (5)..(507): NCBI GI: 92877732 NCBI Desc: helicase, c-terminal [medicago truncatula]
  misc_feature (5)..(507): NCBI GI: 3775993 NCBI Desc: rna helicase [arabidopsis thaliana]
  misc_feature (1)..(507): NCBI GI: 3776001 NCBI Desc: rna helicase [arabidopsis thaliana]
  misc_feature: Useful for making plants with altered Lignin content
  misc_feature: GREAT-hit functional homolog of the protein sequence given in SEQ ID NO 13202
  misc_feature: Useful for making plants with altered lignin content
  misc_feature: Functional homolog of the protein sequence given in SEQ ID NO 13202
MHQPRARYPPGYGSGGGGGAGRGGGGGNGGGGGGGGGNHNYYGRNPQPQQQHHHQQQQQQQQHVHRNSSHQQQWLRRDQAPAVAGAASGNAAAKTAPQLDAIGSSSHDWKAQLNIPAPDTRYRTEDVTATKGNEFEDYFLKRELLMGIYEKGFERPSPIQEESIPIALTGSDILARAKNGTGKTAAFCIPALEKIDPEKTAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 8863 - DNA, 1524 bp, Sorghum bicolor
  misc_feature: Ceres ANNOT ID no. 6094287
  misc_feature: Encodes the peptide sequence at SEQ ID NO 8864
atggaccagcccagagcccgctacccacccggctatggctcccgcggcggaggcggagccggacgtggcggcggaggcggcaatggaggcggcggcggaggcggtggcggaaaccacaactactacggccggaacccgcagccacagcagcaacaccactaccagcagcagcagcagcagcagcagcacgtgcataggaactcctcgcaccagcagcagtggctgcggcgagaccaggcccccgccgttgcgggggcagcgtccggaaacgctgcggctaagacggcgcctcagcttgacgccatagactcgagttctcaagattggaaggctcaattaaatataccagctccagatacacgctacaggacagaggatgtcactgcaacaaaaggcaatgagtttgaggattatttcttgaaacgtgaactgcttatgggaatctatgaaaagggatttgaaaggccatctcctattcaggaagaaagcattcctattgcgctgactggaagtgatattcttgcaagggcgaaaaatggcactggaaaaactgctgcattttgcattccagcacttgaaaaaattgatcctgaaaaaactgctattcaagttgttatactagtaccaacaagggaactggctctgcaaacttcacaagtctgtaaagagcttgggaagtacctgaacattcaagtcatggttagtactggaggaaccagcttgaaggatgacatcatgcgtttgtaccaacctgttcatttacttgttgggactcctggccgaatacttgatcttaccaggaagggcatttgtgtgctgaaagattgttcaatgcttgtcatggacgaggcagacaagcttttagctccagagtttcagccttctgtggaggcacttattcatttccttccacctagtcggcaactgttgatgttttcagcaacctttcctgtaactgtcaaggaattcaaagagaaatatctgcctagaccttatgtgattaatctaatggatgaactgacactgaaaggaatcacacaatattatgcttttgttgaagaaaggcagaaagttcattgcctgaatacacttttctcaaagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacagatctgtttaccagaggaattgatatccaggctgttaatgtggtcattaattttgactttcctaagacatctgagacatatttacacagggttggccgttctggaagatatggacacctcggtttggcagtgaacttgatcacatatgaggaccgtttcaacttgtataggattgagcaagaacttggaacagagattaagacaatacccccacagattgacctggccgtatactgccaatga

SEQ ID NO: 8864 - protein, 507 aa, Sorghum bicolor
  misc_feature: Ceres ANNOT ID no. 6094287
  misc_feature (157)..(323): Pfam Id: DEAD Pfam Desc: DEAD/DEAH box helicase
  misc_feature (389)..(465): Pfam Id: Helicase_C Pfam Desc: Helicase conserved C-terminal domain
  misc_feature (5)..(507): NCBI GI: 92877736 NCBI Desc: helicase, c-terminal [medicago truncatula]
  misc_feature (5)..(507): NCBI GI: 92877733 NCBI Desc: helicase, c-terminal [medicago truncatula]
  misc_feature (5)..(507): NCBI GI: 92877732 NCBI Desc: helicase, c-terminal [medicago truncatula]
  misc_feature (5)..(507): NCBI GI: 3775993 NCBI Desc: rna helicase [arabidopsis thaliana]
  misc_feature (43)..(507): NCBI GI: 27363412 NCBI Desc: at2g45810/f4i18.21 [arabidopsis thaliana]
  misc_feature: Useful for making plants with altered Lignin content
  misc_feature: GREAT-hit functional homolog of the protein sequence given in SEQ ID NO 13202
  misc_feature: Useful for making plants with altered lignin content
  misc_feature: Functional homolog of the protein sequence given in SEQ ID NO 13202
MDQPRARYPPGYGSRGGGGAGRGGGGGNGGGGGGGGGNHNYYGRNPQPQQQHHYQQQQQQQQHVHRNSSHQQQWLRRDQAPAVAGAASGNAAAKTAPQLDAIDSSSQDWKAQLNIPAPDTRYRTEDVTATKGNEFEDYFLKRELLMGIYEKGFERPSPIQEESIPIALTGSDILARAKNGTGKTAAFCIPALEKIDPEKTAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 8865 - DNA, 585 bp, Sorghum bicolor
  misc_feature: Ceres ANNOT ID no. 6094293
  misc_feature: Encodes the peptide sequence at SEQ ID NO 8866
atggccgaggaggccaagaacgcagcagggtcggaagcggaaccgaccaaggacattgccgaggagaagacgacctcccgacgccggaggagtccaagaccctcgtcatgttgcaacgtcttttgtctaattttctttgtttctctaccaaagctttttctggtggtgaaatttctattgcagtgtcacactaatatgagtaacttagatgcatttctcacccgggtcgtgaccgccaagaagacgtcgttcatcagagcatgggaggagagcgagaaggccaaagccgagaacaaggcggccaggaggctggcgagcgtcgcctcctgggagaactccaaggtcgcggagatagaggccgagctcaagaagatccacgagcagctggaaatgaagaatgcggcgcaagcagagaagcggaagaacagcacggcggcggtgcacagggttgccgaggagaagcgcgcggctgccgtggcgcggcgcggcgaggaggtcatcgccgcggaggaggctgccgccaagtaccgcgccagggggcaggaacccaccaggctcttcggcctcggccatcagcaggggtag

SEQ ID NO: 8866 - protein, 194 aa, Sorghum bicolor
  misc_feature: Ceres ANNOT ID no. 6094293
  misc_feature (78)..(187): Pfam Id: Remorin_C Pfam Desc: Remorin, C-terminal region
  misc_feature (68)..(188): NCBI GI: 42573455 NCBI Desc: remorin family protein [arabidopsis thaliana]
  misc_feature (68)..(188): NCBI GI: 21555669 NCBI Desc: remorin [arabidopsis thaliana]
  misc_feature (70)..(189): NCBI GI: 34925093 NCBI Desc: remorin (pp34)
  misc_feature (70)..(188): NCBI GI: 6522572 NCBI Desc: remorin-like protein [arabidopsis thaliana]
  misc_feature (70)..(189): NCBI GI: 4731573 NCBI Desc: remorin 1 [lycopersicon esculentum]
  misc_feature: The sequence is a functional homolog of SEQ ID NO 1773 in the 11/479,226US patent application
  misc_feature: The sequence is a functional homolog of SEQ ID NO 2 in the 10/286,264US patent application
  misc_feature: The sequence is a functional homolog of SEQ ID NO 20 in the 10/286,264US patent application
  misc_feature: The sequence is a functional homolog of SEQ ID NO 2658 in the 10/374,780US patent application
  misc_feature: The sequence is a functional homolog of SEQ ID NO 652 in the 10/225,066US patent application
  misc_feature: The sequence is a functional homolog of SEQ ID NO 876 in the 10/412,699US patent application
  misc_feature: The sequence is a functional homolog of SEQ ID NO 922 in the 10/412,699US patent application
  misc_feature: Useful for making plants with modulated growth and phenotype characteristics
  misc_feature: The sequence is a functional homolog of SEQ ID NO 2 in the 20030093837 US patent application
  misc_feature: The sequence is a functional homolog of SEQ ID NO 20 in the 20030093837 US patent application
MAEEAKNAAGSEAEPTKDIAEEKTTSRRRRSPRPSSCCNVFCLIFFVSLPKLFLVVKFLLQCHTNMSNLDAFLTRVVTAKKTSFIRAWEESEKAKAENKAARRLASVASWENSKVAEIEAELKKIHEQLEMKNAAQAEKRKNSTAAVHRVAEEKRAAAVARRGEEVIAAEEAAAKYRARGQEPTRLFGLGHQQG

SEQ ID NO: 8867 - DNA, 819 bp, Sorghum bicolor
  misc_feature: Ceres ANNOT ID no. 6094312
  misc_feature: Encodes the peptide sequence at SEQ ID NO 8868
atggccgcctcctgcgacctcctcgatgtcgaccctccggagctccagtttccgttcgtcctcgacaagcagatctcctgcccgctgcggctcgtcaacaggactgaccgtaccgtcgcctttaaggtcaagacgacgaaccccaggaaatactgcgtgcggcccaacaatggtgtcgtgccgccccgatcctcttccacggttgtagtcacgatgcaggcgcagaaggtggtgcctccggatttgcagtgcaaggacaagttcttggtgcagagcgtggtcgtcagtgatcgcttgtcagccaaggacataacctctcaaatgttcgtgaaagggggtggtaatgtggtcgaggaggtgaaattgaaggttgcttatgtgatgccacctgaaccgccatcagagattgcagaggagcacgatggtttagagagagttttagtgcctatgcagaggactgtggataatgggaggagtacttcagggctatcgagtggctccgtgtcattgaaatcagctgaggaggtcggatcacctgttggtcgaattgtgaagagtgaggagttcctgaagtctgcaggacctgctatggcaacaaaaacatatgcgggacctggtgaacaatctcatcagctgtcatctataattgcaaagttgactgaagaaaagaattctgcacttgagcaaaacagaaaacttcaagttgaattggaacttgtaaggtgcgaagccaggaaacagcaaggtgccttctcgttggttctcttattagcatttgggctccttggcattgttctaggttacattgtaaagaaatga

SEQ ID NO: 8868 - protein, 272 aa, Sorghum bicolor
  misc_feature: Ceres ANNOT ID no. 6094312
  misc_feature (7)..(114): Pfam Id: Motile_Sperm Pfam Desc: MSP (Major sperm protein) domain
  misc_feature (4)..(138): NCBI GI: 115459632 NCBI Desc: os04g0534400 [oryza sativa (japonica cultivar-group)]
  misc_feature (4)..(138): NCBI GI: 116310461 NCBI Desc: osigba0159i10.10 [oryza sativa (indica cultivar-group)]
  misc_feature (3)..(178): NCBI GI: 90738686 NCBI Desc: vap25 [solanum chacoense]
  misc_feature (1)..(174): NCBI GI: 92872094 NCBI Desc: major sperm protein [medicago truncatula]
  misc_feature (3)..(160): NCBI GI: 79315832 NCBI Desc: vap27-1 (vamp/synaptobrevin-associated protein 27-1); structural molecule [arabidopsis thaliana]
  misc_feature: The sequence is a functional homolog of SEQ ID NO. 356 in the 11/188,298 US application
MAASCDLLDVDPPELQFPFVLDKQISCPLRLVNRTDRTVAFKVKTTNPRKYCVRPNNGVVPPRSSSTVVVTMQAQKVVPPDLQCKDKFLVQSVVVSDRLSAKDITSQMFVKGGGNVVEEVKLKVAYVMPPEPPSEIAEEHDGLERVLVPMQRTVDNGRSTSGLSSGSVSLKSAEEVGSPVGRIVKSEEFLKSAGPAMATKTYAGPGEQSHQLSSIIAKLTEEKNSALEQNRKLQVELELVRCEARKQQGAFSLVLLLAFGLLGIVLGYIVKK

SEQ ID NO: 8869 - DNA, 1623 bp, Sorghum bicolor
  misc_feature: Ceres ANNOT ID no. 6094318
  misc_feature: Encodes the peptide sequence at SEQ ID NO 8870
atggcgtcggcgccggagcctgaggatgggagggagctctacgcgctgctccacctctccccggacgcctccggcgaggaaatccgcagggcgtaccgccagttcgcgcaaatctaccaccccgacaagtaccaagacacgcagatgaaggaagtagcaactgaaaacttccaacgaatacgtgatgcgtatgagatactatcggatgagaacaaaagacagatttatgacatctatggtatggaaggtttaaattctggcctggaacttggtcccaagctaactaaaccagaggaaatcaaagaacagttggaacgactgcggcgacgcaaggaggaagaaaaacttttcacacatgctctaccgaatggctcaatcattgctaatttttcagtgccacattatttaaatggtgggggcatcatgagaggaatggcgatgtctagtgaagttgagttgccagtgtccaagcaaaatactgtcgttgttggtgggaatttggctgtaaatggctcagctggatctggagcagcaagcactgtgctgcgacaccagctgtctcccgtttcctctatcgagtttatggccacagctggactacgttctgttattggcacacagatgtctcgtcaaatttcaccacattctacagcaacatctggacttgctgtttctttgagagatgggtctatcaacttgtcaaatgcctggactcgccaattatctgacaatgctgttggaaatatacagcttgtccttggtgatgaatcaagtatttctgttggatggcaaaagaaggatgaaaaaagtactgcaactggagaagtaaagtttggaactaatttttttggtgcatctgctcattacacgcatcgcttctcctccaaatctcatgcacgcgttgctggtagagttggaagcacggcccttgattttgaaattggaggagggaggcgaatatcagaatttagtactataaggatgatgtataacataggaattcagggtgtctcttggaggtttgagttacatcgtgctggtcaaaagttaattatcccagtcttgctttcggctgatttaaatgcattatttgttaccagtgcatttgctattccttcaacactgtattttctacttcagacatatgttgtaaagccttactaccttaagcgagaaaagcagaaaacactagaaaagatggaaggcttatctgcacagctaactgaagccagaaaggcagctgaaaaggctcaaaaattactggaacctgtctccaatcgtaagaagaatagacagctagagaacaatggattggtgataacaaaggctctgtatggcagttgcaaaaaaatcaaagagagcagtgaattgaatgagatacatagtgacatggcttcacaagtatttgatgtgaccatcccactgaacttcctcgttactgatgcaggccagctcaagcttcatgacgggataaagaagtctggaataatgggtttctacgatccttgtcctggagagccgaagctgttacttgtcgagtacacgtttcatggtcgtaaatacaaggtcatggtggatgactatgaggcgctgttgataccacaagatatccatcaattttga

SEQ ID NO: 8870 - protein, 540 aa, Sorghum bicolor
  misc_feature: Ceres ANNOT ID no. 6094318
  misc_feature (12)..(77): Pfam Id: DnaJ Pfam Desc: DnaJ domain
  misc_feature (3)..(536): NCBI GI: 928936 NCBI Desc: j-domain protein [arabidopsis thaliana]
  misc_feature (3)..(536): NCBI GI: 30686523 NCBI Desc: dnaj heat shock n-terminal domain-containing protein [arabidopsis thaliana]
  misc_feature (145)..(539): NCBI GI: 46255815 NCBI Desc: dnaj (hsp40) homolog, subfamily c, member 11 [homo sapiens]
  misc_feature (145)..(539): NCBI GI: 56202782 NCBI Desc: otthump00000044227 [homo sapiens]
  misc_feature (145)..(539): NCBI GI: 46255661 NCBI Desc: dnajc11 protein [homo sapiens]
MASAPEPEDGRELYALLHLSPDASGEEIRRAYRQFAQIYHPDKYQDTQMKEVATENFQRIRDAYEILSDENKRQIYDIYGMEGLNSGLELGPKLTKPEEIKEQLERLRRRKEEEKLFTHALPNGSIIANFSVPHYLNGGGIMRGMAMSSEVELPVSKQNTVVVGGNLAVNGSAGSGAASTVLRHQLSPVSSIEFMATAGLRSVIGTQMSRQISPHSTATSGLAVSLRDGSINLSNAWTRQLSDNAVGNIQLVLGDESSISVGWQKKDEKSTATGEVKFGTNFFGASAHYTHRFSSKSHARVAGRVGSTALDFEIGGGRRISEFSTIRMMYNIGIQGVSWRFELHRAGQKLIIPVLLSADLNALFVTSAFAIPSTLYFLLQTYVVKPYYLKREKQKTLEKMEGLSAQLTEARKAAEKAQKLLEPVSNRKKNRQLENNGLVITKALYGSCKKIKESSELNEIHSDMASQVFDVTIPLNFLVTDAGQLKLHDGIKKSGIMGFYDPCPGEPKLLLVEYTFHGRKYKVMVDDYEALLIPQDIHQF

SEQ ID NO: 8871 - DNA, 963 bp, Sorghum bicolor
  misc_feature: Ceres ANNOT ID no. 6094322
  misc_feature: Encodes the peptide sequence at SEQ ID NO 8872
atgtcgtcctcgtcctcgtcgtcctccgctgcctccgcggccacggtgttcccgccgtccccgcagctgccgccgtccccgctcctggtggagaacctcccgccgctgcatcagctcacgccggtagcggcggcggaggccgccgcgccggcctccgagcagctctgctacgtgcactgccacttctgcgacaccgtcctcgtcgtgagcgtgcctacgagcagcttgttcaagacggtgacggtacgatgcggccactgcagcagcttgctcactgtcaacatgaggggcctcctcttcccgggaacgccgacgaacacagccgcagcggccgcaccaccagctgctgtcaccgccagtaccaccaccaccaccaccaccaccatcaccacggcgccgccgccggccacctcggtcaacaacgggcagttccacttcccccagtcggtcgacctcgcgcccaaccctcaccaccaatccctcctgctggatgagatatccagcgcgaacccgaggctgcagttgctggagcagcacggcctcggcggcctgatcccgagcggcaggaacgcggccgcgccggccccgcccccgccgcctgcagcggccggtaaaggggccaaagagccgtcgccgcgcactaaccccgtcatcaacagacctccggagaagaggcagcgcgtgccgtcggcgtacaaccgcttcatcaaggacgaaatccaacgcatcaaggctggcaatcccgacatctcgcacagggaggccttcagcgcggccgccaagaactgggcgcactttccacacatccactttggactcatgccggatcaccaggggctcaagaagacaagcctgcttcctcaggatctccagagaaaggacgggcttctaaaggaagggctctacgcggcggcagccgccgccgccgctgcggcagccaatatgggggttgctccatactaa

SEQ ID NO: 8872 - protein, 320 aa, Sorghum bicolor
  misc_feature: Ceres ANNOT ID no. 6094322
  misc_feature (46)..(273): Pfam Id: YABBY Pfam Desc: YABBY protein
  misc_feature (3)..(320): NCBI GI: 32330679 NCBI Desc: yabby9 protein [zea mays]
  misc_feature (5)..(320): NCBI GI: 32330681 NCBI Desc: yabby10 protein [zea mays]
  misc_feature (4)..(320): NCBI GI: 37551421 NCBI Desc: fil-like protein [triticum aestivum]
  misc_feature (61)..(320): NCBI GI: 115482856 NCBI Desc: os10g0508300 [oryza sativa (japonica cultivar-group)]
  misc_feature (134)..(320): NCBI GI: 32330677 NCBI Desc: yabby15 protein [zea mays]
  misc_feature: The plant flowers significantly late compared to wild-type.
  misc_feature: The plant produces a reduced number of seeds.
  misc_feature: The plant senesces significantly late compared to wild-type.
  misc_feature: The sequence is a functional homolog of SEQ ID NO 1151 in the 10/666,642US patent application
  misc_feature: There is a problem with the ovules such that no fertilization is occurring
  misc_feature: Useful for biocontainment applications
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated time to senescence
  misc_feature: Functional homolog of the protein sequence given in SEQ ID NO 12923
  misc_feature: The sequence is a functional homolog of SEQ ID NO 1151 in the 20070033671 US patent application
MSSSSSSSSAASAATVFPPSPQLPPSPLLVENLPPLHQLTPVAAAEAAAPASEQLCYVHCHFCDTVLVVSVPTSSLFKTVTVRCGHCSSLLTVNMRGLLFPGTPTNTAAAAAPPAAVTASTTTTTTTTITTAPPPATSVNNGQFHFPQSVDLAPNPHHQSLLLDEISSANPRLQLLEQHGLGGLIPSGRNAAAPAPPPPPAAAGKGAKEPSPRTNPVINRPPEKRQRVPSAYNRFIKDEIQRIKAGNPDISHREAFSAAAKNWAHFPHIHFGLMPDHQGLKKTSLLPQDLQRKDGLLKEGLYAAAAAAAAAAANMGVAPY

SEQ ID NO: 8873 - DNA, 720 bp, Sorghum bicolor
  misc_feature: Ceres ANNOT ID no. 6094335
  misc_feature: Encodes the peptide sequence at SEQ ID NO 8874
atggcactggcacgtaccgcctcgtcctcgttgctgcttctcttggtgctctcgtgctggtgcggcgccacgacggcgcgcccggcgccgacctcggacgccgcgggcacgggcgcgggcgcgggcgcgggcttcgtcaagtcgtggtgcgcggggacggagtacccagcgctatgcgacgcgacgctggcctcgtacgcggcggaggtgggcaccagcgcggcgcgcctgtcgtgggccgcgctgacggtgacgctcgacggcgcgcgtgacgcgacggccgcgatgaaggggatggcggcggcgggccacctggcgcccgtggcggccgaggcggcgcgggactgcgtgagcatgctcggggacgccgtggacatgctgcgacagtcggtggaaaccatggcgcgcctcggcgaggaggaggaggagaagcagcaagggcagccggggagcagcagcaggaggaacgtgaggttccaggtggacagcgtgcagacgtgggcgagcgcggcgctgacggacgacgacatgtgcatggaagggttcaagggcgaggccgcggtggtgagggaggccgtgcgggggcacgtcgtcggcgtcgcgcacctcacggccgacgcgcttgccattgtcaacgccatgggcaagtccatgggagtcgatatatgccgcggttcttgcaaatccacaccgacgccgccgcctgctactgccccatag

SEQ ID NO: 8874 - protein, 239 aa, Sorghum bicolor
  misc_feature: Ceres ANNOT ID no. 6094335
  misc_feature (40)..(210): Pfam Id: PMEI Pfam Desc: Plant invertase/pectin methylesterase inhibitor
  misc_feature (13)..(217): NCBI GI: 21618088 NCBI Desc: ripening-related protein-like [arabidopsis thaliana]
  misc_feature (1)..(219): NCBI GI: 60459401 NCBI Desc: dc1.2-like [capsicum annuum]
  misc_feature (34)..(217): NCBI GI: 8809648 NCBI Desc: ripening-related protein-like; contains similarity to pectinesterase [arabidopsis thaliana]
  misc_feature (5)..(219): NCBI GI: 8096279 NCBI Desc: dc1.2 homologue [nicotiana tabacum]
  misc_feature (9)..(212): NCBI GI: 115469908 NCBI Desc: os06g0711800 [oryza sativa (japonica cultivar-group)]
MALARTASSSLLLLLVLSCWCGATTARPAPTSDAAGTGAGAGAGFVKSWCAGTEYPALCDATLASYAAEVGTSAARLSWAALTVTLDGARDATAAMKGMAAAGHLAPVAAEAARDCVSMLGDAVDMLRQSVETMARLGEEEEEKQQGQPGSSSRRNVRFQVDSVQTWASAALTDDDMCMEGFKGEAAVVREAVRGHVVGVAHLTADALAIVNAMGKSMGVDICRGSCKSTPTPPPATAP

SEQ ID NO: 8875 - DNA, 1242 bp, Sorghum bicolor
  misc_feature: Ceres ANNOT ID no. 6094339
  misc_feature: Encodes the peptide sequence at SEQ ID NO 8876
atggccacgcctcctccgccgccgaaactccagtgcggccgctcgctgctggatctacccgacgagctcatccctgagatcctcctccgcctcccgccgcacgaccctaggcgcctcgttcgctgctcggccgtctgcaagccctggcgccgcctcctcaccgaccccgccttccttcgccgctaccgcgcgttccacggggtgcctcccatgctgggcctcatcttctacctggaactcccccgcagtcgtttcctcgcgcggttcgtccgcaccacctccttccgccctcgcaccctcgaccacgccggctgctacgtgcgcgacgcccgccacggccgcgtcctcttcagcaacgccaccagcgaggagaatgaggatgagctcttcgtatggagccccgtcacgggtgagcggtgggggctggacatgccgtccccgttcgactgttggagcgtggcggtgctctgcgctgcggccgcgcgcgaagggggctgcgactgcgaccacctcgactgccacggcgggcccttcctcgtcacattcgtggacaccgacgacgatgggaggacgtacgcccgcgtctactcctcggagaccggagcctggagcgacgcgacctacgctcaacaccccaataacctcgccatggacatgaaggatcccagcgcgcttgtgggaaataggatctacttccccgctgcagggagcaagaccatcgtggagtacgacttgggtcgccggaaactcgcatttgtcgacccgccgttagcgcaccaaggtcacggtatcctcatgccggcaatgggcggtggcctggggttcgccagcgtgcgggggtcccgcctctacctgtggtcgagagagaccggttccgccagaactgcggcggcatggacgccgagcagggtcttggaactcaacacactgcccaatcgcaggactcgtgtccccttgaaccaaccaactgcgcttggcttcacggagatcttgatggaggaatatgtgactgtggttggctttgcggagggcctcggcgtcatcttcgtcaggacaagtgctggcgtcttcgcgattaacctggagtctggccaagtcaagaagatgtccagcagaaggcccggcgttgtcattccttacatgagcttctatactccagaaaaaactgtctatgactggaactggatactcaagagaatcgagctgagcataagcaatcaaagagtgatcatggtcaattag

SEQ ID NO: 8876 - protein, 413 aa, Sorghum bicolor
  misc_feature: Ceres ANNOT ID no. 6094339
  misc_feature (14)..(64): Pfam Id: F-box Pfam Desc: F-box domain
  misc_feature (18)..(329): NCBI GI: 115470391 NCBI Desc: os07g0122900 [oryza sativa (japonica cultivar-group)]
  misc_feature (18)..(386): NCBI GI: 115437584 NCBI Desc: os01g0557400 [oryza sativa (japonica cultivar-group)]
  misc_feature (32)..(386): NCBI GI: 115481210 NCBI Desc: os10g0158700 [oryza sativa (japonica cultivar-group)]
  misc_feature (4)..(183): NCBI GI: 38567955 NCBI Desc: osjnbb0115i21.11 [oryza sativa (japonica cultivar-group)]
  misc_feature (6)..(386): NCBI GI: 115475786 NCBI Desc: os08g0299900 [oryza sativa (japonica cultivar-group)]
MATPPPPPKLQCGRSLLDLPDELIPEILLRLPPHDPRRLVRCSAVCKPWRRLLTDPAFLRRYRAFHGVPPMLGLIFYLELPRSRFLARFVRTTSFRPRTLDHAGCYVRDARHGRVLFSNATSEENEDELFVWSPVTGERWGLDMPSPFDCWSVAVLCAAAAREGGCDCDHLDCHGGPFLVTFVDTDDDGRTYARVYSSETGAWSDATYAQHPNNLAMDMKDPSALVGNRIYFPAAGSKTIVEYDLGRRKLAFVDPPLAHQGHGILMPAMGGGLGFASVRGSRLYLWSRETGSARTAAAWTPSRVLELNTLPNRRTRVPLNQPTALGFTEILMEEYVTVVGFAEGLGVIFVRTSAGVFAINLESGQVKKMSSRRPGVVIPYMSFYTPEKTVYDWNWILKRIELSISNQRVIMVN

SEQ ID NO: 8877 - DNA, 1533 bp, Sorghum bicolor
  misc_feature: Ceres ANNOT ID no. 6094378
  misc_feature: Encodes the peptide sequence at SEQ ID NO 8878
atggggtccgcctccgccagcgtcgccaccgccaccgcgcacctcgtcgccgccaccgcgctcctcctcatgctcgcgcgaggcggcgagtccgtcagtttctggctcccgccgccgaccgccggaggaggagggggcttcctcggcggcgcggaccgatacctaactcgggaggagcactggatgaaccagaccctcgatcacttcaacccgacggaccatcggcaattcaaacagcgttactatgaatttcttgactactaccgagctccaaatggcccgatcttcctctacatctgtggagaatcctcatgcagtgggattggcaataactacttagctgtgatggcgaagaaatttggtgctgcattggtttctcctgagcatcgatactatggaaagagttctccttttaacagtttaacaacagaaaatctacagttcttgtcatcaaagcaggctttatttgatcttgccgttttccgccaatattatcaggaaaccttaaatgctaagtataatcgctctggggcagacagttcttggtttgtttttggaggatcatatgctggagcactcagtgcttggttcaggttgaagtttcctcacttgacatgtggaagcctagcaagttcaggagttgttcttgctgtatacaactttactgattttgacaaacagattgggatctctgctggtcctgagtgcaaggcagcacttcaagaaataacaggacttgttgatggacagcttcagtctggccgtaattcagttaaggagctgtttggagcaccaaagttagaaaatgatggtgacttcctctacttactggcggatgctgctgctattgcgttccaatatggtaatcctgatgtcttatgctccccactagctgaagcaaagaagaatgggacagacttggtggaaacatttgctagttacgtcaaagattattacattggaaaatttggcgcatcagtagcatcatatgatcaagaatatttgaagaacacaactcctgctgaatcctcatataggctatggtggtaccaagtttgcagtgaggttgcatatttccaggtggcaccaaaaaatgatagtgttcgctccccaaagattgacacaaggtaccatttggacttgtgcagaaatgtttttggtgaaggagtctaccctgatgtcttcatgacaaacttatactatggaggcacaggaattgcaggttctaaaattgtttttgcaaatggatctcaagacccatggcgacatgcttctaagcagaaatcctcagacgaattgccatcatacttaattgaatgcgaaaactgcggacattgcagtgatctctctggatgccctcaagctccttcaaacattgaaggcgattcatccaagtgctcacctcctgaatctctgaacaaagtaaggaaggagattgtcgatcacatcgacctgtggttatcagaatgccaagagcaaggacatgacaaggagccatcactgggaagcagatgggccatatctactatttga

SEQ ID NO: 8878 - protein, 510 aa, Sorghum bicolor
  misc_feature: Ceres ANNOT ID no. 6094378
  misc_feature (64)..(479): Pfam Id: Peptidase_S28 Pfam Desc: Serine carboxypeptidase S28
  misc_feature (15)..(491): NCBI GI: 51972041 NCBI Desc: prolyl carboxypeptidase like protein [arabidopsis thaliana]
  misc_feature (51)..(491): NCBI GI: 51968542 NCBI Desc: prolyl carboxypeptidase like protein [arabidopsis thaliana]
  misc_feature (15)..(491): NCBI GI: 51970574 NCBI Desc: prolyl carboxypeptidase like protein [arabidopsis thaliana]
  misc_feature (48)..(491): NCBI GI: 145651776 NCBI Desc: at4g36190 [arabidopsis thaliana]
  misc_feature (15)..(491): NCBI GI: 79326354 NCBI Desc: catalytic/ serine-type peptidase [arabidopsis thaliana]
MGSASASVATATAHLVAATALLLMLARGGESVSFWLPPPTAGGGGGFLGGADRYLTREEHWMNQTLDHFNPTDHRQFKQRYYEFLDYYRAPNGPIFLYICGESSCSGIGNNYLAVMAKKFGAALVSPEHRYYGKSSPFNSLTTENLQFLSSKQALFDLAVFRQYYQETLNAKYNRSGADSSWFVFGGSYAGALSAWFRLKFPHLTCGSLASSGVVLAVYNFTDFDKQIGISAGPECKAALQEITGLVDGQLQSGRNSVKELFGAPKLENDGDFLYLLADAAAIAFQYGNPDVLCSPLAEAKKNGTDLVETFASYVKDYYIGKFGASVASYDQEYLKNTTPAESSYRLWWYQVCSEVAYFQVAPKNDSVRSPKIDTRYHLDLCRNVFGEGVYPDVFMTNLYYGGTGIAGSKIVFANGSQDPWRHASKQKSSDELPSYLIECENCGHCSDLSGCPQAPSNIEGDSSKCSPPESLNKVRKEIVDHIDLWLSECQEQGHDKEPSLGSRWAISTI

SEQ ID NO: 8879 - DNA, 1179 bp, Sorghum bicolor
  misc_feature: Ceres ANNOT ID no. 6094391
  misc_feature: Encodes the peptide sequence at SEQ ID NO 8880
atggaggccatccggaagcaggcctcgaagctccgggagcaggtcgctcggcagcagcaggcggtgatgaagcagttcgggggcgggtacggcgcagacggcgtgttcgcggacgaggccgaggcgcaacagcactccaagctcgagaagctctacatctccacgcgcgccgccaagcacttccaaagggatatagttcggggcgtcgagggctacatcgtcacggggtcgaagcaagtcgagattgggaacaagttatgtgaggatggcaagaagtatggcactgagaacacttgtaccagtggaagcacactgtcgaaggcggcattaagttttgctaaggcacggtccatgatggaaaaggaaaggggtaacctgctgaaagcccttggcacacaggttgcagaaccattgagggctatggttatgggagcccctttggaggatgctcgccacctcgcccaaagatatgacaggatgcgtcaagaagctgaagcacaggctattgaagtttcaaaacgccaaatgaaactaagagaagcatctggaaatagtgatatggttgcaaggctagaagcagctgagtcaaagctgcaggagttgaaatcaaatatgggggttttgggcaaagaagctgttgcagcaatgactgctgttgaagcccaacagcaaaggctgacactgcagcgtcttattgcattggttgaatcagagagaaactaccaccaaaaggtcctacaagttcttgatcaacttgagagagagatggtatttgagcgccaaagaattgaaggagcacctcctccggttgttgagagttccatgcctccgccgcctgcatatgaagaagtcaatggtatattcatgaggaatacagttgcagaattggtcgagactgtggagtatttcttggctgaggcaatccagtcatatcgagcagagagtgataccgagctcaacctttcagctggtgactacatagtggtccgaaaggtgtcgaacaatggatgggccgaaggtgaatgcagggggaaagctggctggttcccctacgactacatcgagaaacgagagcgtgtgcttgcaaagaagatctgtaattttgctgaaagctgcctgttggatggctcgttcctgcctggccgtctgcattgttcaaattcatgtggcaggaactga

SEQ ID NO: 8880 - protein, 392 aa, Sorghum bicolor
  misc_feature: Ceres ANNOT ID no. 6094391
  misc_feature (304)..(357): Pfam Id: SH3_2 Pfam Desc: Variant SH3 domain
  misc_feature (303)..(357): Pfam Id: SH3_1 Pfam Desc: SH3 domain
  misc_feature (1)..(365): NCBI GI: 92887266 NCBI Desc: sh3 [medicago truncatula]
  misc_feature (1)..(387): NCBI GI: 115459676 NCBI Desc: os04g0539800 [oryza sativa (japonica cultivar-group)]
  misc_feature (1)..(365): NCBI GI: 38344978 NCBI Desc: osjnba0011l07.8 [oryza sativa (japonica cultivar-group)]
  misc_feature (1)..(365): NCBI GI: 116310379 NCBI Desc: h0115b09.2 [oryza sativa (indica cultivar-group)]
  misc_feature (1)..(316): NCBI GI: 21928139 NCBI Desc: at4g18060/f15j5_30 [arabidopsis thaliana]
MEAIRKQASKLREQVARQQQAVMKQFGGGYGADGVFADEAEAQQHSKLEKLYISTRAAKHFQRDIVRGVEGYIVTGSKQVEIGNKLCEDGKKYGTENTCTSGSTLSKAALSFAKARSMMEKERGNLLKALGTQVAEPLRAMVMGAPLEDARHLAQRYDRMRQEAEAQAIEVSKRQMKLREASGNSDMVARLEAAESKLQELKSNMGVLGKEAVAAMTAVEAQQQRLTLQRLIALVESERNYHQKVLQVLDQLEREMVFERQRIEGAPPPVVESSMPPPPAYEEVNGIFMRNTVAELVETVEYFLAEAIQSYRAESDTELNLSAGDYIVVRKVSNNGWAEGECRGKAGWFPYDYIEKRERVLAKKICNFAESCLLDGSFLPGRLHCSNSCGRN

SEQ ID NO: 8881 - DNA, 1719 bp, Sorghum bicolor
  misc_feature: Ceres ANNOT ID no. 6094416
  misc_feature: Encodes the peptide sequence at SEQ ID NO 8882
atgcaacgggccatccggaaagccgcggctgcggcaaggcgagcgctgtcggcggcggcggcgagggcatcgtccgctcctccccgcggcggacacctcgcgcctggctggggcgccacaactaggtggctctgcagcgggcgggaggcgctgagctacgacgtggtcatcgtgggcgccgggcccgcggggctcgccgccgcgatccggctgaagcagctctgccgcgccgctgacgccgacctctccgtctgcgtcctggagaagggctccgaagtcggggctcatgtgctgtccgggaatgtgtttgagccccgagccttggacgagctcattcccaactggaggcaagaggattctccaatcagagttcctgtctcatctgacaagttctggctgttaacaaagaaccaagcatggacactgccatctccatttgacaacaaaggaaactacgtgatcagcttgagccaattggtgcgatggatgggcacaaaagctgaagagttgggtgttgaagtatatccaggttttgctgctagtgagatactttatgatgaaaatcaaatagttacaggagtcgcaaccaatgatgttggtattgctaaggatgggcgaataacactctttgctgagggttgccgaggttcattatcagagaaaataataagaaatcacaagctcagagagagagggcaagggcaacatcagacatatgctcttggaattaaggaggtttgggagattgaagaaggaaagcacaagccaggttctgttattcatactgttggatggcctttggacactaaaacatatggaggatcattcctataccaccttgatgatagacagttagcgattggtctggttgttgctttgaattatcgaaatcctttccttagtccctatgatgaattccagaaatttaagcagcaccctgctgtcagagaacttttggaaggtggaacagctattcagtatggtgcgcgtactctcaatgaaggtggtttccagtcaataccatatccagttttccctggaggtgcaattattggatgctctgcaggatttctaaatgttcccaaaataaaaggaacccatacggctatgaaatcaggtatgcttgcggcggaagcaactttcaagtcccttgttgaaggatcttcgatggaactgtactgggagaacctcaagaagtcatggatatgggaagaacttcataaagctaggaactatagaccagcatttgaatatggatttattccgggcatggctttgtctgcactggaacgctacatattcaaagggaagtcaccttatacattgaagcacgggagacccgatcatgaagcaacagacacggccaatctgcatgtgcctattcaatatcctaaaccagatggacagataacatttgatgtcccaacatctttatacaggagcaatacaaaccatgagcatgatcagccacctcatctgcgcttgagggatcctacaataccggaacaagtaaatgttccactgtatgcggggccagaatcacgctattgcccagcccgggtttacgaatatgtctctgacgaaaaaggtgacccaaagcttcaaataaatgcacagaattgtcttcattgcaaggcttgcgacatcaaagatccaaagcagaacatcgagtggactgttccagaaggtggaggcggccctggttacacagtaatgtag

SEQ ID NO: 8882 - protein, 572 aa, Sorghum bicolor
  misc_feature: Ceres ANNOT ID no. 6094416
  misc_feature (419)..(528): Pfam Id: ETF_QO Pfam Desc: Electron transfer flavoprotein-ubiquinone oxidoreductase
  misc_feature (54)..(383): Pfam Id: DAO Pfam Desc: FAD dependent oxidoreductase
  misc_feature (205)..(572): NCBI GI: 115482938 NCBI Desc: os10g0516300 [oryza sativa (japonica cultivar-group)]
  misc_feature (48)..(572): NCBI GI: 82948377 NCBI Desc: dehydrogenase [magnetospirillum magneticum amb-1]
  misc_feature (48)..(572): NCBI GI: 46201652 NCBI Desc: cog0644: dehydrogenases (flavoproteins) [magnetospirillum magnetotacticum ms-1]
  misc_feature (48)..(572): NCBI GI: 71905870 NCBI Desc: fad dependent oxidoreductase:electron transfer flavoprotein-ubiquinone oxidoreductase [dechloromonas aromatica rcb]
  misc_feature (48)..(572): NCBI GI: 144900576 NCBI Desc: electron transfer flavoprotein-ubiquinone oxidoreductase [magnetospirillum gryphiswaldense msr-1]
  misc_feature (142)..(572): SWISSPROT Homolog: EC 1.5.5.1 Electron transfer flavoprotein-ubiquinone oxidoreductase, mitochondrialprecursor
MQRAIRKAAAAARRALSAAAARASSAPPRGGHLAPGWGATTRWLCSGREALSYDVVIVGAGPAGLAAAIRLKQLCRAADADLSVCVLEKGSEVGAHVLSGNVFEPRALDELIPNWRQEDSPIRVPVSSDKFWLLTKNQAWTLPSPFDNKGNYVISLSQLVRWMGTKAEELGVEVYPGFAASEILYDENQIVTGVATNDVGIAKDGRITLFAEGCRGSLSEKIIRNHKLRERGQGQHQTYALGIKEVWEIEEGKHKPGSVIHTVGWPLDTKTYGGSFLYHLDDRQLAIGLVVALNYRNPFLSPYDEFQKFKQHPAVRELLEGGTAIQYGARTLNEGGFQSIPYPVFPGGAIIGCSAGFLNVPKIKGTHTAMKSGMLAAEATFKSLVEGSSMELYWENLKKSWIWEELHKARNYRPAFEYGFIPGMALSALERYIFKGKSPYTLKHGRPDHEATDTANLHVPIQYPKPDGQITFDVPTSLYRSNTNHEHDQPPHLRLRDPTIPEQVNVPLYAGPESRYCPARVYEYVSDEKGDPKLQINAQNCLHCKACDIKDPKQNIEWTVPEGGGGPGYTVM

SEQ ID NO: 8883 - DNA, 705 bp, Sorghum bicolor
  misc_feature: Ceres ANNOT ID no. 6094417
  misc_feature: Encodes the peptide sequence at SEQ ID NO 8884
atggcttccgcggcgggcgcgggtccgatggggctggggctgcgcagcgggagcggggcgtggggcggaggaggaggaggacaagccgcggcgccggcgatgaacgacgcgcatcagcccggagtggacctcgccaggcacccgtccggcttcgtccccacactccagaacatcgtatcaacagtcaatttgggctgcaagttggatctgcaacaaatagccagcggtgctcgtaacgcagagtacaacccaaagcgtttcgctgcggttatcgtgaggataagggacccgaagacaacagcattggtatttgcttcagggaagatggtttgcactggagcgaaaagcgaagaacattcgaggcttgctgggaggaagtttgcgcgcattgtccacaagctcggtttccaatcagctcggttcaaggatttcaagatccagaatatagttgggtcatgtgatgtcaaatttcctattcgtctggagggcctcgctttggccagtggcacatttgccaattatgagccagagatcttccctggactgatctaccgtatggtggagcccaagatcgtgatcctcatcttcgtctctggaaagatcgtcctcactggagccaaggtgcgggaagagatatacaccgccttcgagaacatatacccgatgctcgtgcagttcaggaaacggcagcagtatattaggtaa

SEQ ID NO: 8884 - protein, 234 aa, Sorghum bicolor
  misc_feature: Ceres ANNOT ID no. 6094417
  misc_feature (50)..(135): Pfam Id: TBP Pfam Desc: Transcription factor TFIID (or TATA-binding protein, TBP)
  misc_feature (141)..(227): Pfam Id: TBP Pfam Desc: Transcription factor TFIID (or TATA-binding protein, TBP)
  misc_feature (3)..(231): NCBI GI: 21875 NCBI Desc: tata binding protein (tfiid) [triticum aestivum]
  misc_feature (30)..(232): NCBI GI: 974216 NCBI Desc: tata-box binding protein [zea mays]
  misc_feature (30)..(231): NCBI GI: 293904 NCBI Desc: tata-binding protein [zea mays]
  misc_feature (36)..(231): NCBI GI: 1498162 NCBI Desc: tata binding protein (tbp) [nicotiana tabacum]
  misc_feature (36)..(231): NCBI GI: 1220522 NCBI Desc: tata-box binding protein
  misc_feature: The sequence is a functional homolog of SEQ ID NO. 496 in the 11/188,298 US application
MASAAGAGPMGLGLRSGSGAWGGGGGGQAAAPAMNDAHQPGVDLARHPSGFVPTLQNIVSTVNLGCKLDLQQIASGARNAEYNPKRFAAVIVRIRDPKTTALVFASGKMVCTGAKSEEHSRLAGRKFARIVHKLGFQSARFKDFKIQNIVGSCDVKFPIRLEGLALASGTFANYEPEIFPGLIYRMVEPKIVILIFVSGKIVLTGAKVREEIYTAFENIYPMLVQFRKRQQYIR

SEQ ID NO: 8885 - DNA, 1551 bp, Sorghum bicolor
  misc_feature: Ceres ANNOT ID no. 6094429
  misc_feature: Encodes the peptide sequence at SEQ ID NO 8886
atgcccaagccccactacgccgcttcctcacctccgcatccgccgcctcagcagccgccgctcctcccgcttgcgctcgtcccgccgcggcagtgcccgcttgccgcggccctgctggcgctgctctcgctgctgctcgccaccgcgctctggctcctcctcgtgctctccccgtcccagggggcgccccccaccgccgcatccgagcactcggcgctgtcggatgcgcgcgccgcggctgccgcggccgcgggccccggcgctgcctcgcctctctcgctcggccacatcgtcttcggcatcgccgggtcggcgcatctctggccgcgccgccgcgagtacgtccgcctgtggtgggaccccgccgcgatgcgcggcaacgtctggctcgacgcgggcgcgcctgccgcgccggggcctagcgccccctgggagggcgccctcccgccgatccgggtgtccgaggacacctcgcggttcaggtacaccaaccccacgggccacccgtcggggctccggatcgcgcgcatcgccgctgaggccgtgcgcctcgtcggcggaggggcgggcgcgcggtggctcgtgcttgtcgacgacgacaccgtgctgtgcgccgacaacctggtcgccgtgctcagcaagtacgactggagggagatggtgtacgtcggggcgccgtccgagagccactccgccaacacctacttcagccatagcatggctttcgggggtggcggcgtcgcgctcagcttcccactcgccgctgcactcgcgcagacgctcgacgtgtgcatcgagaggtaccccaagctgtatggaagtgacgatcgcctccatgcctgcattacggagctcggcgtgcccctgtcccgcgagtacggattccaccagtgggatatcagaggcaatgctcatgggttattggcatctcatccaattgctcctttcatcagtatccatcatgtggagctcgtggaccccatataccctggattgaactctcttgagagtctggagctctttacgaaggctatgaaaatggaacccatgagcttcctgcagcgttcactttgttatgatcaaagccaaaagcttacatttgctatctcgttgggctatgttgttgaagtataccccaatgttcttcttcctcgtgatttggagcgatcacaacgcacttacattgcttataataggatgagtcagagaaatgaatttgattttgacactagagatgttcagaagtctttgtgcaagaagccaatcttatttttcttgaaggatgtctggaaggatggaaacataactaggggatcttacgcacgatcaagtgctagggatgacctcaaaagaaaggtgttttgcttccggtcaccccctttacctgacatagatgagatccaagtttcttcgtctccattaagcaagcgctggcatctggcaccaagaaggttgtgcagtgcactcaaaggatctattgatggtactctatttatgtttgttcggcaatgtggacgtgggacttttggctcagcttctgattccttatga

SEQ ID NO: 8886 - protein, 516 aa, Sorghum bicolor
  misc_feature: Ceres ANNOT ID no. 6094429
  misc_feature (94)..(507): NCBI GI: 25090374 NCBI Desc: at4g23490/f16g20_190 [arabidopsis thaliana]
  misc_feature (94)..(507): NCBI GI: 15529153 NCBI Desc: at4g23490/f16g20_190 [arabidopsis thaliana]
  misc_feature (84)..(507): NCBI GI: 79469221 NCBI Desc: transferase, transferring glycosyl groups [arabidopsis thaliana]
  misc_feature (34)..(492): NCBI GI: 116309693 NCBI Desc: h0404f02.17 [oryza sativa (indica cultivar-group)]
  misc_feature (94)..(504): NCBI GI: 15223433 NCBI Desc: fringe-related protein [arabidopsis thaliana]
MPKPHYAASSPPHPPPQQPPLLPLALVPPRQCPLAAALLALLSLLLATALWLLLVLSPSQGAPPTAASEHSALSDARAAAAAAAGPGAASPLSLGHIVFGIAGSAHLWPRRREYVRLWWDPAAMRGNVWLDAGAPAAPGPSAPWEGALPPIRVSEDTSRFRYTNPTGHPSGLRIARIAAEAVRLVGGGAGARWLVLVDDDTVLCADNLVAVLSKYDWREMVYVGAPSESHSANTYFSHSMAFGGGGVALSFPLAAALAQTLDVCIERYPKLYGSDDRLHACITELGVPLSREYGFHQWDIRGNAHGLLASHPIAPFISIHHVELVDPIYPGLNSLESLELFTKAMKMEPMSFLQRSLCYDQSQKLTFAISLGYVVEVYPNVLLPRDLERSQRTYIAYNRMSQRNEFDFDTRDVQKSLCKKPILFFLKDVWKDGNITRGSYARSSARDDLKRKVFCFRSPPLPDIDEIQVSSSPLSKRWHLAPRRLCSALKGSIDGTLFMFVRQCGRGTFGSASDSL

SEQ ID NO: 8887 - DNA, 2271 bp, Sorghum bicolor
  misc_feature: Ceres ANNOT ID no. 6094439
  misc_feature: Encodes the peptide sequence at SEQ ID NO 8888
atgcagaagtctgatcatcatgagcagaagctaacttcgccaagagggttaatccataagatacttcgtcgtacaaatagcaggcgttctcccactgcagctgatcaacaaccttctcctgtatctccagaaacaagcaactcatcaatattctcaaagcaaaaggatgctgatgatgccatcaaagattcagaaaagccgagcacacatactatcagaattgaagatgagaaatctgatttgctagggtatgaagtttattctgggaagcttacattagataacaaagcaaaaaattcatccagtgaacagtctggatctgggtctagtagcaattgctttgatgctaggctcagcactgaagcccttatatggggttctaacatccttaagcttgaggatattgtatctgtatcatataattctggtctccggtatttcaccgtgcatgcgtgtcctcttgaaaaaagatccagtggactctcctgctttatgaatcctagaagaacccaaaaggacttgaagttcgtatccacttctccgcacgaggcctttcggtgggttaatagttttgcggaccagcaatgctacataaacctgttgcctcaccccatggcatctagcaagaagcattcttctgaactcattcagtttgataccatgtttgatccttatcttaaaaaatgtcggtctccaccaaagatacttgtcatcttgaatcctcgatctggacatggtagatctagcaaagtttttcatggaaaagtggaacccatatttaagcttgcaggtttcaagatggaagtggtaaaaactacacatgctggtcatgcaaaatctcttgtatcaactattgattttagtacctgtcctgatggtattgtatgtgtgggtggtgatggaattgtaaacgaggttctcaatggtcttctatgcagagatgatcaaaatatggccgcctctgttccaataggtataatacctgctgggtctgataactcacttatttggacagtcttgggtgtcaaggatccaatttctgcagcattgtcaattgtcaggggaggtcttacaccaattgatgttttttctgttgaatggattcaaagtgggactatgcattatggcacaactgtatcatattttggtttcgttagtgatgttcttgagctctcagagaaatttcagaagcattttggtcctttacgatactttgtagctggttttctcaaattcctgtgtttgccaaagtacagttttgaattggaatatcttccagtgtcagatgtcaatgacgctgagcatacaattttggtaggacaagaaaaggtcgatgcatctgatctatatgatgatgttgttcggagatcaagagcagaatgtttaccacgcgcctcaagtttatctagcattgattcaataatgtctacaggcatgtctggggcagagctggaggtttgtagtcctcgtgcaaataatgaaccttctgaggttgttcgtgcacttgacccgaaatcaaagcgcttatcattagggagagcgagtacatttaaagaaccagaagaagtgcttcatccccactcccatggtacatctactcccaactggcgtagatctaagtcaaaatcaaggactgaaaaggcaaggccaggcttgtctgctacaaatgatgcaaaatcctctaaggttaacacagacaaagaggacacgtcgtccacaatttctgatcctggacctgtggctgtatgggattcaggaccaaagtgggacgatgaacctaaatgggacaatcaacctaactgggaacctgagacttcaattgagctccatagtcctcgtgaggacattgagcttggtctgactaaggagctggtacctagcttagatgaaagatggacagttaggaaagggcgctatcttggtgtactggtgtgcaaccattcatgcaagactgtgcagagtctgagctctcaggttgttgctcccaaggctgaatatgatgacaattgtttggacctgctgttagttggtggaagtggaagactgagattactgagatttttggtgcttttgcagtttggaaagcacatatctcttccaaatttagaatatgtaaaggtgaagtctgtgaggctcaaggcaggcccaaatacacatgatggatgtggtattgatggcgaactactccatgtcaaggggcaagttcgctgtagtttgttgcctcaacaatgccaattgatgggcaggccagtgaaaaaccttgtacaatag

SEQ ID NO: 8888 - protein, 756 aa, Sorghum bicolor
  misc_feature: Ceres ANNOT ID no. 6094439
  misc_feature (234)..(367): Pfam Id: DAGK_cat Pfam Desc: Diacylglycerol kinase catalytic domain
  misc_feature (15)..(749): NCBI GI: 38345938 NCBI Desc: osjnbb0103i08.5 [oryza sativa (japonica cultivar-group)]
  misc_feature (15)..(749): NCBI GI: 116310433 NCBI Desc: h0501d11.3 [oryza sativa (indica cultivar-group)]
  misc_feature (76)..(749): NCBI GI: 57281695 NCBI Desc: sphingosine kinase [lotus corniculatus var. japonicus]
  misc_feature (1)..(748): NCBI GI: 22654975 NCBI Desc: at5g23450/k19m13_8 [arabidopsis thaliana]
  misc_feature (1)..(706): NCBI GI: 79328532 NCBI Desc: atlcbk1 (a. thaliana long-chain base (lcb) kinase 1); diacylglycerol kinase [arabidopsis thaliana]
MQKSDHHEQKLTSPRGLIHKILRRTNSRRSPTAADQQPSPVSPETSNSSIFSKQKDADDAIKDSEKPSTHTIRIEDEKSDLLGYEVYSGKLTLDNKAKNSSSEQSGSGSSSNCFDARLSTEALIWGSNILKLEDIVSVSYNSGLRYFTVHACPLEKRSSGLSCFMNPRRTQKDLKFVSTSPHEAFRWVNSFADQQCYINLLPHPMASSKKHSSELIQFDTMFDPYLKKCRSPPKILVILNPRSGHGRSSKVFHGKVEPIFKLAGFKMEVVKTTHAGHAKSLVSTIDFSTCPDGIVCVGGDGIVNEVLNGLLCRDDQNMAASVPIGIIPAGSDNSLIWTVLGVKDPISAALSIVRGGLTPIDVFSVEWIQSGTMHYGTTVSYFGFVSDVLELSEKFQKHFGPLRYFVAGFLKFLCLPKYSFELEYLPVSDVNDAEHTILVGQEKVDASDLYDDVVRRSRAECLPRASSLSSIDSIMSTGMSGAELEVCSPRANNEPSEVVRALDPKSKRLSLGRASTFKEPEEVLHPHSHGTSTPNWRRSKSKSRTEKARPGLSATNDAKSSKVNTDKEDTSSTISDPGPVAVWDSGPKWDDEPKWDNQPNWEPETSIELHSPREDIELGLTKELVPSLDERWTVRKGRYLGVLVCNHSCKTVQSLSSQVVAPKAEYDDNCLDLLLVGGSGRLRLLRFLVLLQFGKHISLPNLEYVKVKSVRLKAGPNTHDGCGIDGELLHVKGQVRCSLLPQQCQLMGRPVKNLVQ

SEQ ID NO: 8889 - DNA, 1116 bp, Sorghum bicolor
  misc_feature: Ceres ANNOT ID no. 6094443
  misc_feature: Encodes the peptide sequence at SEQ ID NO 8890
atggctctgcttcccgccgcaggggcggcggcgccggcgacgccgtccgccgccaagccgtgcggcctcaggcggccgtctgctcctcctgccgcggccctgcggctcgggccgctcttctggccgtgggaaaaggtgaaaattggtcccctttctgtttcccccatgggttttggaacatgggcatggggaaaccagttactttggggctatgaagaaagcatggacaacgaacttcaggactgcttcaatctggctctaaggaatggcataaacctttttgacactgctgactcttatggaactggaaggctgaatggacaaagcgaacggctactcggtaaattcatccttgagtgtgaagggacgattaaatctccagatgatgtgatcattgcaactaagtttgctgcatatccttggcgacttacatcggggcagtttgtcagcgcctgcaagtcttctttggaaagattacaacttgatcggctcggaatagggcagctgcattggtctactgcaaactatgcgcccttgcaggagcgcgccctctgggatggactagttgaaatgtatgacaagggtctcgttagtgctgtcggcgtcagcaattatgggccaaagcagcttctgaagatccacagctatctagcttctaaaggagttccgttgagctcagctcaggttcagttctcactactgagcatgggtgacgatcagatggaactgaaaactgtgtgtgattcattgggcattcgtctcatcgcatatagtccgcttggactaggaatgctcactgggaaatatgatgcttctaacctcccaaaaggaccaaggtcagtgctgttccgacaaattcttcctgggctggagtctttgctgtcttgcctgagaaggattgctgaaaagaaggggaaaaccatgtctcaggtggccatcaactggtgcatctgcaaaggcacaattcctatcccaggcgttaaaatggtcaggcacgtcgaggagaacttgggtgcgctcggctggaggctgagttctgctgagatcgcagagcttgaggccgcggcgatggcagctccaaagaagatggtccagaatgtcttccagactgcctga

SEQ ID NO: 8890 - protein, 371 aa, Sorghum bicolor
  misc_feature: Ceres ANNOT ID no. 6094443
  misc_feature (46)..(357): Pfam Id: Aldo_ket_red Pfam Desc: Aldo/keto reductase family
  misc_feature (34)..(370): NCBI GI: 30696358 NCBI Desc: aldo/keto reductase family protein [arabidopsis thaliana]
  misc_feature (34)..(370): NCBI GI: 46931336 NCBI Desc: at5g53580 [arabidopsis thaliana]
  misc_feature (48)..(370): NCBI GI: 9759197 NCBI Desc: aldo/keto reductase-like protein [arabidopsis thaliana]
  misc_feature (51)..(370): NCBI GI: 119508846 NCBI Desc: aldo/keto reductase [nodularia spumigena ccy9414]
  misc_feature (56)..(370): NCBI GI: 75909269 NCBI Desc: aldo/keto reductase [anabaena variabilis atcc 29413]
MALLPAAGAAAPATPSAAKPCGLRRPSAPPAAALRLGPLFWPWEKVKIGPLSVSPMGFGTWAWGNQLLWGYEESMDNELQDCFNLALRNGINLFDTADSYGTGRLNGQSERLLGKFILECEGTIKSPDDVIIATKFAAYPWRLTSGQFVSACKSSLERLQLDRLGIGQLHWSTANYAPLQERALWDGLVEMYDKGLVSAVGVSNYGPKQLLKIHSYLASKGVPLSSAQVQFSLLSMGDDQMELKTVCDSLGIRLIAYSPLGLGMLTGKYDASNLPKGPRSVLFRQILPGLESLLSCLRRIAEKKGKTMSQVAINWCICKGTIPIPGVKMVRHVEENLGALGWRLSSAEIAELEAAAMAAPKKMVQNVFQTA

SEQ ID NO: 8891 - DNA, 1194 bp, Sorghum bicolor
  misc_feature: Ceres ANNOT ID no. 6094459
  misc_feature: Encodes the peptide sequence at SEQ ID NO 8892
atggacgggggaagagagcagcaggcgccgccggaggggcagcccggtaagaacctcatcaagatcccgtcctatcaggaggtcttcggcaccggcgcctcctcctcttcctcgaagccggcctcctacaaccctcctctcgccagctccggcggcaccgccgccgccgccgcttcatcctcctcgtcgtcctcgggatcgttctcgcaggctttctccttcctcaagtcctccgagttctactcccctccgccgccgccgcctccccagcccaccaccaccaccccgaggccgcctcaggctagcccctcagcgccgacgcgccagagcaagaacgccattctcgtcagtcataggcagagagggaaccctctgctgaagcacatcaggaatgccaggtggacgttcgccgatgtcgtgccggactatgtgcttgggcagtcgtcatgtgccttgtacttaagtatcaggtaccatcttctacatccagactacttgtactatcggataagagagctgcagaagaatttcaggctgcgtgtcatcttgtgccatgttgatgttgaagatgtaatcaagcctttgcatgaaattacaagaaccgcgctgcttcatgattgcaccctcttgtgcggttggagcctggaggaatgtggtcggtacttggagactattaaagtatatgaaaacaagccagctgacattattcgtgagcacatggataacgactatctatcacggttgtcgcactcgctcacatccattcggcatgttaataaaacagatgttgtcacacttggttcatcttttgggtcactctcacaaatcatgaatgcttctatggaggagctggctcgatgcccaggaattggtgagcggaaggtaaaaagactctatgataccttccatgagccattcaaacgggtttctgcccgaccaaaccttgtcgtacccgatacccctgaccgagaaaaagcaaaaggtcaaccttcatctacagatgacagtttgcaagatgcggtagaaaagccagatgcgccgaagaagaagaaaggctctgatgtaaggtcagcccttaccgctgcttttgctaagtattcggagaagatccgcagccagggccacgatgcagcaaacgaggccggtgaaagtactagcagctcaaccatggaagctgacagggcgagagactag

SEQ ID NO: 8892 - protein, 397 aa, Sorghum bicolor
  misc_feature: Ceres ANNOT ID no. 6094459
  misc_feature (112)..(179): Pfam Id: Rad10 Pfam Desc: DNA repair protein rad10
  misc_feature (272)..(301): Pfam Id: HHH Pfam Desc: Helix-hairpin-helix motif
  misc_feature (87)..(351): NCBI GI: 3297891 NCBI Desc: nucleotide repair protein [lilium longiflorum]
  misc_feature (1)..(309): NCBI GI: 60652851 NCBI Desc: excision repair cross-complementing rodent repair deficiency complementation group 1 [synthetic construct]
  misc_feature (1)..(309): NCBI GI: 61363050 NCBI Desc: excision repair cross-complementing rodent repair deficiency complementation group 1 [synthetic construct]
  misc_feature (1)..(309): NCBI GI: 119577752 NCBI Desc: excision repair cross-complementing rodent repair deficiency, complementation group 1 (includes overlapping antisense sequence), isoform cra_a [homo sapiens]
  misc_feature (1)..(309): NCBI GI: 123990970 NCBI Desc: excision repair cross-complementing rodent repair deficiency, complementation group 1 (includes overlapping antisense sequence) [synthetic construct]
MDGGREQQAPPEGQPGKNLIKIPSYQEVFGTGASSSSSKPASYNPPLASSGGTAAAAASSSSSSSGSFSQAFSFLKSSEFYSPPPPPPPQPTTTTPRPPQASPSAPTRQSKNAILVSHRQRGNPLLKHIRNARWTFADVVPDYVLGQSSCALYLSIRYHLLHPDYLYYRIRELQKNFRLRVILCHVDVEDVIKPLHEITRTALLHDCTLLCGWSLEECGRYLETIKVYENKPADIIREHMDNDYLSRLSHSLTSIRHVNKTDVVTLGSSFGSLSQIMNASMEELARCPGIGERKVKRLYDTFHEPFKRVSARPNLVVPDTPDREKAKGQPSSTDDSLQDAVEKPDAPKKKKGSDVRSALTAAFAKYSEKIRSQGHDAANEAGESTSSSTMEADRARD

SEQ ID NO: 8893 - DNA, 2784 bp, Sorghum bicolor
  misc_feature: Ceres ANNOT ID no. 6094477
  misc_feature: Encodes the peptide sequence at SEQ ID NO 8894
atgatgtccttctttctgaagggcacaaatattaaaagattgttcaagtggccattgagaagagaatcaacactttcgacacatcttcttgctgaaattctgcctgaagtagagttatcggactaccggagactaccaagctcttattgtgagagcccaacagggcttctccatggggagtacttcaaggctgagctgattcctgatttggatattttctttgagagactgtatgaatatttctgtgcaaagggtttaagatgcattatcatcaagtggataatcgagatccttaatgttacatttatggtatgtgctattggtttcttcttcttgtttgttgactgggatgcccttggccatttgaaatgtggagtggaagcacttgagataggggataaaccatgtgacctaatgagtgtcatcaagaacgacccattagttccgttcacatatgtgaagcttatcactattggatcaatggttatattgacgacatatggaattattaatttaatcaagttctttgtaaaattgagaagcatactcaatgttcgtgacttctactataacagtcttaaggtcacagatctggagattcagactatatcatggcccaaagtagttgagaaggttgtcctcctccagaagtcacaacaactttgcgttgttaaggacctttcagagcatgatattatcatgagattaatgcggaaacagaattacttaattgggatggttaataaaggcattattgcatttccggttgcctgttggctgcctggagtaggaccaactgtcagttcgcgtttccatggaaggaaaagctatctgatgcttccaaagacgctagagtgggcattaaattggtgcatatttcatagcatgtttgatagtaaattttgtgtcaggaaagactttctaacaggcccatctgttttgacaaagcgacttgtatttatgggcattgcaatgcttttgctgtcgccctgccttgtcatcttcccattggtatacatgtttctgagacatgctgaagaattctacaataatcccagtacagcatcatctcgaagatggtcaaatttgtcaaggtggattttgcgggagtacaacgaggttgagcatttcttcagacataggatggataattgcactcttcactctttaaattatttaaagcagtttccaactccattaatatctattgttgcaaaatttgtatcatttgtatctggcggcttggctggaattcttctcatccttggattcctgggggaatctattcttgagggacatgtttttggccgaaatcttttctggtatactgttgtttttggaaccatagcagctgtaagtcgtaaagttgtggcagatgagcttcaagtgattgatccagaaggagccatgacccttgttgtccaacatacgcattacatgccaaaaagatggcgtggtaaagagagcagtgaagttgtgcggaaagaatttgaaactctatttcagtataccataacgatgcttttggaagagatggcctcgattttcatcactccttacttgctaatatttgtgcttccaaagcgtgtcaatgatattttgtgcttcatttcggaatttacaatttatgtagatggagtgggagatgtttgcagcttaagcttgtttgacctccgaagacatggaaataggaactatggttcaccacttgattcagtaaaagatacgaggagctcccaggggaaaatggagaaatcattattaagtttccaaagcacatatacatcatggcaaccaaatccagatggcaagcagtttttgtgcaatctccagagattcaaggaaaagcaaatccgcaaatatacttttcaacaaacagtggaagattcacaactttggtcgagtagtagaggtcagagtggcaacattttgcatcggctgcgccccagtgatgtttttccaggcattgggattgtttacaacttaaatccattaggactgcttgacacagatcaaagagcttatccgtatatcctggactggtattacacatgccactctgaacgttcaggcagagatttggactcatattcccaccgcggtgaagcatcccctgaatcgggggaggatatatggctgccacctatgagcaagccactaactgagattgaagaggagcaaatctgggattctaatttgtatgaaagagctcgaagccacttggaagcatcagcaacgagtgcattctttcaacgtaccactttcaagcgccaggacagggaacataattctacaagctgcccttggtgggcccaggcctctgcacgccaaactgatccacgagacagattttctgagcctccttgcgacagtttcattgagcctccagactttgcaaatcactacacatctgcccattcttccaaccagcacagcgattgggcactgaattatgcacaccttactggttcacaggataatttccatgaaccaccgaactttggaaatcactatcattccagctatcacagcaacaatgggttagaggagggaaacagagagcgagatcaaagagataacagcccacagaccatgtccaagacaagtttcatggatgatgatcccgacctagaggagggccagagtttccatttcaccgatgtccctccgaacaatgatggaaatgaagatgaagatgatggcaacagagtaggcagtatctgtagctctatgctagccaaccttcatgtacggattgtacctaggagcagtgacccagtttag

SEQ ID NO: 8894 - protein, 927 aa, Sorghum bicolor
  misc_feature: Ceres ANNOT ID no. 6094477
  misc_feature (197)..(580): Pfam Id: APG9 Pfam Desc: Autophagy protein Apg9
  misc_feature (1)..(813): NCBI GI: 74831799 NCBI Desc: autophagy protein 9 [sorghum bicolor]
  misc_feature (1)..(812): NCBI GI: 74831819 NCBI Desc: autophagy protein 9 [zea mays]
  misc_feature (1)..(813): NCBI GI: 74831802 NCBI Desc: autophagy protein 9 [saccharum officinarum]
  misc_feature (1)..(813): NCBI GI: 74831808 NCBI Desc: autophagy protein 9 [triticum aestivum]
  misc_feature (1)..(851): NCBI GI: 74831778 NCBI Desc: autophagy protein 9 [hordeum vulgare]
MMSFFLKGTNIKRLFKWPLRRESTLSTHLLAEILPEVELSDYRRLPSSYCESPTGLLHGEYFKAELIPDLDIFFERLYEYFCAKGLRCIIIKWIIEILNVTFMVCAIGFFFLFVDWDALGHLKCGVEALEIGDKPCDLMSVIKNDPLVPFTYVKLITIGSMVILTTYGIINLIKFFVKLRSILNVRDFYYNSLKVTDLEIQTISWPKVVEKVVLLQKSQQLCVVKDLSEHDIIMRLMRKQNYLIGMVNKGIIAFPVACWLPGVGPTVSSRFHGRKSYLMLPKTLEWALNWCIFHSMFDSKFCVRKDFLTGPSVLTKRLVFMGIAMLLLSPCLVIFPLVYMFLRHAEEFYNNPSTASSRRWSNLSRWILREYNEVEHFFRHRMDNCTLHSLNYLKQFPTPLISIVAKFVSFVSGGLAGILLILGFLGESILEGHVFGRNLFWYTVVFGTIAAVSRKVVADELQVIDPEGAMTLVVQHTHYMPKRWRGKESSEVVRKEFETLFQYTITMLLEEMASIFITPYLLIFVLPKRVNDILCFISEFTIYVDGVGDVCSLSLFDLRRHGNRNYGSPLDSVKDTRSSQGKMEKSLLSFQSTYTSWQPNPDGKQFLCNLQRFKEKQIRKYTFQQTVEDSQLWSSSRGQSGNILHRLRPSDVFPGIGIVYNLNPLGLLDTDQRAYPYILDWYYTCHSERSGRDLDSYSHRGEASPESGEDIWLPPMSKPLTEIEEEQIWDSNLYERARSHLEASATSAFFQRTTFKRQDREHNSTSCPWWAQASARQTDPRDRFSEPPCDSFIEPPDFANHYTSAHSSNQHSDWALNYAHLTGSQDNFHEPPNFGNHYHSSYHSNNGLEEGNRERDQRDNSPQTMSKTSFMDDDPDLEEGQSFHFTDVPPNNDGNEDEDDGNRVGSICSSMLANLHVRIVPRSSDPV

SEQ ID NO: 8895 - DNA, 1248 bp, Sorghum bicolor
  misc_feature: Ceres ANNOT ID no. 6094484
  misc_feature: Encodes the peptide sequence at SEQ ID NO 8896
atgtggtgcgcgtcgtgcttggcgtccgcctgcgcgggctgcacctgcaacctctgcgcgtcggcggcatcggccgtgtcccgccgctccgcgcgcctcgcctactgcggcctcttcgccgcctcccttatcctctccttcttgctccgccagttcgccgcgccgctcctcaagcatatcccatggataaatgcatttgatcaaacaccaccagaagaatggtttcaaatgaatgctgttcttcgtgtaagcctggggaacttcttgttttttgcaacatttgctctcatgatgattggtgtgaaagaccagaatgatcggcgagatgcatggcaccatggtggctggattgcaaaggttgctgtatgggctgttctcattgttcttatgttctgtgtgccaaacattgttattactatttatgaggtactttcgaagtttggatctggcttctttctcctagtacaggttgtgatgcttttagacttcacaaataattggaatgactcatggattgagaaagaagagcgaaaatgggaaatagctttgctggtagtgactgtggtttgctatctctctacattcgccttctctggtgtgctcttcatgtggtttaatccctccggtcatgactgtggtctcaatgtgttctttattgtcatgacattcatccttgcttttgcatttgcaatagttgctttgcatccccaggtcaatggaagcgttatgcctgcttctgtcatttctgtttactgtgcatacctgtgctacacaagtctctcaagtgaaccggatgactatgagtgcaatgggcttcacaggcattctaagcaggtttcattgggtgctcttatactcgggatgctcacgacggtgctctctgttgtgtactctgcagttcgtgctggatcttcgactacattcctttcgccgccatcatctcctagatctggagccaaaaacccattactcggtgatgaggaggatggcaaaggcgatggcaaagaaagcgaaccgcgccccgtgagctattcctacaccttcttccacctcatcttcgcccttgcaagcatgtattcagccatgctcttgactggctggacgagcgctgcatcagagagatcagagctgatggatgttggatggacaaccgtctgggtgcgcatctgcacagagtgggtcaccgccgcgttgtacatctggaccctcatcgccccactgctcttcccagaccgtgatttctcctag

SEQ ID NO: 8896 - protein, 415 aa, Sorghum bicolor
  misc_feature: Ceres ANNOT ID no. 6094484
  misc_feature (8)..(414): Pfam Id: Serinc Pfam Desc: Serine incorporator (Serinc)
  misc_feature (4)..(304): NCBI GI: 123993433 NCBI Desc: serine incorporator 3 [synthetic construct]
  misc_feature (4)..(304): NCBI GI: 119596321 NCBI Desc: serine incorporator 3, isoform cra_a [homo sapiens]
  misc_feature (24)..(306): NCBI GI: 115459316 NCBI Desc: os04g0506300 [oryza sativa (japonica cultivar-group)]
  misc_feature (4)..(270): NCBI GI: 5853319 NCBI Desc: membrane protein tms-1 [mus musculus]
  misc_feature (4)..(270): NCBI GI: 57529361 NCBI Desc: similar to tde2 protein [gallus gallus]
MWCASCLASACAGCTCNLCASAASAVSRRSARLAYCGLFAASLILSFLLRQFAAPLLKHIPWINAFDQTPPEEWFQMNAVLRVSLGNFLFFATFALMMIGVKDQNDRRDAWHHGGWIAKVAVWAVLIVLMFCVPNIVITIYEVLSKFGSGFFLLVQVVMLLDFTNNWNDSWIEKEERKWEIALLVVTVVCYLSTFAFSGVLFMWFNPSGHDCGLNVFFIVMTFILAFAFAIVALHPQVNGSVMPASVISVYCAYLCYTSLSSEPDDYECNGLHRHSKQVSLGALILGMLTTVLSVVYSAVRAGSSTTFLSPPSSPRSGAKNPLLGDEEDGKGDGKESEPRPVSYSYTFFHLIFALASMYSAMLLTGWTSAASERSELMDVGWTTVWVRICTEWVTAALYIWTLIAPLLFPDRDFS

SEQ ID NO: 8897 - DNA, 1167 bp, Sorghum bicolor
  misc_feature: Ceres ANNOT ID no. 6094487
  misc_feature: Encodes the peptide sequence at SEQ ID NO 8898
atgcttctcctcagcccctcgccgccggctcccgccgccgcggtaaccgccccccgtcgtatcctacttgctccccacaggcgcctcaatgctacgtccaccccaccgcgcctcgcctgcctccgccttcgccccgccaccccgctccgcgcccgcggcattccgtcgaggaccgggtgccgcgcggccgccgatgccgatgcagcgccctcccaggctccaggcggcgatggaggcgtgcggggcgcggtggtgcgcgtcggggaggctctgtcgctggggttcccggtgtgggtggcgtcggcctgcgcgctggctctctggcggccgccggccttcctctgggtcggacccaccgcgcagatgctcggcctctccttcacaatgctcgggatgggaatgacattgactttggatgacctcaaaaccgcattattgatgccgagggagttagctgctggatttatactgcaatacacggtgatgccactgtcaggattttttgtgagcaagctgttgaaattgccatcccattatgctgctggactaattttagtggcctgttgccctggaggcacagcgagcaacattgtgacctatttagcaagggcaaatgttgctctttcagtcctgatgacagcattcatgacccctctcctgacatccaaacttgctgggcaatatgttgcagtagatccaatgggactgtttgtgtccacatctcaggttgtcctcgcacctgtccttttgggtgctctacttaatcagtattgcaatggtctggttcacttagtgtccccgttgatgcccttcattgctgtagcgacagtagctgttctctgtggcaatgctattgcacagaacgcttcagcaatcctagcatctgggtcgcaagtggttttatctgttggttgcttgcatgcatctggctttttcttcggctatgttctttcaagattacttggcattgatatctcttctgcaagaacaatctctattgaggttggcatgcagaactcagtgctgggccttgtccttgcaaccaagcatttcggcaaccctctcacggctgttccatgtgctgtttcgagcatctgccactcggtctacggtagcattttggctgggatctggaggtctatgcccaccaaggacaagggagaatga

SEQ ID NO: 8898 - protein, 388 aa, Sorghum bicolor
  misc_feature: Ceres ANNOT ID no. 6094487
  misc_feature (122)..(295): Pfam Id: SBF Pfam Desc: Sodium Bile acid symporter family
  misc_feature (1)..(388): NCBI GI: 38346633 NCBI Desc: osjnba0072d21.3 [oryza sativa (japonica cultivar-group)]
  misc_feature (1)..(388): NCBI GI: 116309284 NCBI Desc: osigba0092e09.1 [oryza sativa (indica cultivar-group)]
  misc_feature (55)..(388): NCBI GI: 55295966 NCBI Desc: na(+) dependent transporter-like [oryza sativa (japonica cultivar-group)]
  misc_feature (44)..(382): NCBI GI: 30683305 NCBI Desc: bile acid:sodium symporter family protein [arabidopsis thaliana]
  misc_feature (95)..(379): NCBI GI: 145348219 NCBI Desc: bass family transporter: sodium ion/bile acid [ostreococcus lucimarinus cce9901]
MLLLSPSPPAPAAAVTAPRRILLAPHRRLNATSTPPRLACLRLRPATPLRARGIPSRTGCRAAADADAAPSQAPGGDGGVRGAVVRVGEALSLGFPVWVASACALALWRPPAFLWVGPTAQMLGLSFTMLGMGMTLTLDDLKTALLMPRELAAGFILQYTVMPLSGFFVSKLLKLPSHYAAGLILVACCPGGTASNIVTYLARANVALSVLMTAFMTPLLTSKLAGQYVAVDPMGLFVSTSQVVLAPVLLGALLNQYCNGLVHLVSPLMPFIAVATVAVLCGNAIAQNASAILASGSQVVLSVGCLHASGFFFGYVLSRLLGIDISSARTISIEVGMQNSVLGLVLATKHFGNPLTAVPCAVSSICHSVYGSILAGIWRSMPTKDKGE

SEQ ID NO: 8899 - DNA, 366 bp, Sorghum bicolor
  misc_feature: Ceres ANNOT ID no. 6094488
  misc_feature: Encodes the peptide sequence at SEQ ID NO 8900
atgctggacaagctgtgggacgacgtggtggcggggcctcacccggagacgggcctcgagaagctccgcaaggccgccactgcccgccccatcctcatcgacaaagacgcggatgccggagccgcggggagctacaagcggacgcagtcgatgccgtcgaccccgacgacgccggtgacgccgtcgtcgtcgtcgacgacgacgacgccgcggggcgccagcaacgtgtggcgcagcgtgttccacccggggagcaacctggccaccaagggcatgggtgccaacctcttcgaccgcccgcagccaaactcccccaccgtctacgactggctctacagcgacgagaccaggagcaaccaccgttag

SEQ ID NO: 8900 - protein, 121 aa, Sorghum bicolor
  misc_feature: Ceres ANNOT ID no. 6094488
  misc_feature (5)..(121): Pfam Id: Auxin_repressed Pfam Desc: Dormancy/auxin associated protein
  misc_feature (1)..(121): NCBI GI: 62526583 NCBI Desc: auxin-repressed protein-like protein arp1 [manihot esculenta]
  misc_feature (1)..(121): NCBI GI: 11386111 NCBI Desc: auxin-repressed protein [robinia pseudoacacia]
  misc_feature (1)..(121): NCBI GI: 71040687 NCBI Desc: auxin-repressed protein [arachis hypogaea]
  misc_feature (1)..(121): NCBI GI: 92886939 NCBI Desc: dormancyauxin associated [medicago truncatula]
  misc_feature (1)..(121): NCBI GI: 2605887 NCBI Desc: dormancy-associated protein [pisum sativum]
MLDKLWDDVVAGPHPETGLEKLRKAATARPILIDKDADAGAAGSYKRTQSMPSTPTTPVTPSSSSTTTTPRGASNVWRSVFHPGSNLATKGMGANLFDRPQPNSPTVYDWLYSDETRSNHR

SEQ ID NO: 8901 - DNA, 1152 bp, Sorghum bicolor
  misc_feature: Ceres ANNOT ID no. 6094494
  misc_feature: Encodes the peptide sequence at SEQ ID NO 8902
atggattcctccgagaagagggccagagccgcaactgccgccgccggcctcaccgatgacctcatcgtcgacatactgtctcgcctgccggtcaaatcggtctgccgattcaagtgcgtctcccgtcactggcacggcctcatctctcacccggagcaccgcaagaacattccccagacagtatctggcttcttctaccctcactacctgttgaaccaagaggacgagataacagctattcccgaattcatccgcatcagggggaccgaagaacctccatttctggacccttcgttgcccttcttgcctggctacaggtggatccgtcctagggactgctgcggtggccttctcctcaacatgtgctggaaggtgaatcccagagatgaattcaattacgtggtgtgcaaccccgctgctgatacatgggtagtcctgcctgagccccttaacaacagcccagtgtctacagtgcgtttgggtttcgacccggctgtctcctcccacttccatgtgttccagctcctagaggaagatcagtacggatatatcactggcctggaaatttactcatcggaaactggagcgtggagtcacaaggaaaatggttggagtgatgaggttgtgccgatcggggaaagaggtgtctttatgaatggaatactccatttgatctcctctgagtccactatactgacagttgacaaggaagggaagacatggaggaccattcctttgctggaaagtatgagttttaaaaactttgctaacggccctgttgcttttattggtcaatcacaggggcgcttgtgctatataaatactaggagacatctcagttctaaaatatcagtctggattcttgaagattatagtgcgggtcaatggatgtttaagtataatgttagcacttcccagctttgcggaaaggtggatctcatgttcgagcgggattattctttaatcgcaatccacccagagtgcaacgtgattttcgttgtttggaaatgtgggaatctgctaatgtcatatgacatggatcatgggaaagtttgtgttatatgtagtctcacagagcctatgtatgatgcatttctaccatattttccatatgttccttttttctcagactcactggctgatcaaaactag

SEQ ID NO: 8902 - protein, 383 aa, Sorghum bicolor
  misc_feature: Ceres ANNOT ID no. 6094494
  misc_feature (12)..(59): Pfam Id: F-box Pfam Desc: F-box domain
  misc_feature (2)..(381): NCBI GI: 115462391 NCBI Desc: os05g0177100 [oryza sativa (japonica cultivar-group)]
  misc_feature (43)..(379): NCBI GI: 50508392 NCBI Desc: receptor-like kinase-like [oryza sativa (japonica cultivar-group)]
  misc_feature (2)..(300): NCBI GI: 115462393 NCBI Desc: os05g0177400 [oryza sativa (japonica cultivar-group)]
  misc_feature (2)..(300): NCBI GI: 115462373 NCBI Desc: os05g0175800 [oryza sativa (japonica cultivar-group)]
  misc_feature (17)..(182): NCBI GI: 117670145 NCBI Desc: f-box-like protein [hordeum vulgare]
  misc_feature: The sequence is a functional homolog of SEQ ID NO. 456 in the 11/188,298 US application
MDSSEKRARAATAAAGLTDDLIVDILSRLPVKSVCRFKCVSRHWHGLISHPEHRKNIPQTVSGFFYPHYLLNQEDEITAIPEFIRIRGTEEPPFLDPSLPFLPGYRWIRPRDCCGGLLLNMCWKVNPRDEFNYVVCNPAADTWVVLPEPLNNSPVSTVRLGFDPAVSSHFHVFQLLEEDQYGYITGLEIYSSETGAWSHKENGWSDEVVPIGERGVFMNGILHLISSESTILTVDKEGKTWRTIPLLESMSFKNFANGPVAFIGQSQGRLCYINTRRHLSSKISVWILEDYSAGQWMFKYNVSTSQLCGKVDLMFERDYSLIAIHPECNVIFVVWKCGNLLMSYDMDHGKVCVICSLTEPMYDAFLPYFPYVPFFSDSLADQN

SEQ ID NO: 8903 - DNA, 894 bp, Sorghum bicolor
  misc_feature: Ceres ANNOT ID no. 6094527
  misc_feature: Encodes the peptide sequence at SEQ ID NO 8904
atggcgatgccgccgagccgtccgtgggcggagctgcagcacgacctcctggtggcgatcgtggcccgcgtgggcgtgccggacctgctctccggcggcgcctcccgcgcctgctcttcgtggcgggccgcggcgcgggacccgctcgcgtggcgccgcgtcgacctccgcgattgggtcgccctcacctcgggccggcgcgccgcgagaccgggacactccagctctcgcgtacccgtacacgccgcgctcttcggcatcctggaggtcgccgccaagttggccgaagggcggatcgaggccgtgctgctccccgagtttgctgatgaggaccatctcttgttcctcgctgagaggtgtccaaacctgcagtatttcagccttcctagcacctgtatgacttacgatcagttctgtaaggcgataggtggacttcattcgcttaaaggcatggcagtggatgagactctgattaactatgatgtcctcctgcatgtgcaccagtgctgcccagactttgtggagctgaaggtgtctgcactgtatgtggatgaagagatggcctcagtcatctgtaactctcttcctcgtctgaagaagctggagataccaagcgctgacatgtcttctgccgcaataataaagttccttgattgcctagaggagctcgagcacctggacatctcaggttatgagacatcagccatctcaagcttggttcttgagaaagcttcgcggctcaagttcttcctctggaactcgaaattcgagcttggggagttcgtggactgctccaactgtggagagcacaacattaaccctcaagaaccctgcaagtgcatgatggagcacaaggtcatggactggctggctggaccttcacaggcttcctga

SEQ ID NO: 8904 - protein, 297 aa, Sorghum bicolor
  misc_feature: Ceres ANNOT ID no. 6094527
  misc_feature (9)..(291): NCBI GI: 3273101 NCBI Desc: n7 protein [medicago truncatula]
  misc_feature (1)..(228): NCBI GI: 21593361 NCBI Desc: f-box protein family, atfbl20 [arabidopsis thaliana]
  misc_feature (1)..(228): NCBI GI: 27765050 NCBI Desc: at4g05460 [arabidopsis thaliana]
  misc_feature (4)..(205): NCBI GI: 77552121 NCBI Desc: n7-like protein [oryza sativa (japonica cultivar-group)]
  misc_feature (1)..(186): NCBI GI: 40253668 NCBI Desc: glutamic acid-rich protein precursor-like protein [oryza sativa (japonica cultivar-group)]
MAMPPSRPWAELQHDLLVAIVARVGVPDLLSGGASRACSSWRAAARDPLAWRRVDLRDWVALTSGRRAARPGHSSSRVPVHAALFGILEVAAKLAEGRIEAVLLPEFADEDHLLFLAERCPNLQYFSLPSTCMTYDQFCKAIGGLHSLKGMAVDETLINYDVLLHVHQCCPDFVELKVSALYVDEEMASVICNSLPRLKKLEIPSADMSSAAIIKFLDCLEELEHLDISGYETSAISSLVLEKASRLKFFLWNSKFELGEFVDCSNCGEHNINPQEPCKCMMEHKVMDWLAGPSQAS

SEQ ID NO: 8905 - DNA, 1881 bp, Sorghum bicolor
  misc_feature: Ceres ANNOT ID no. 6094528
  misc_feature: Encodes the peptide sequence at SEQ ID NO 8906
atgggcacaacaacaactactccggtcgccggagctgtcgtcctcagcctcaaatacctcgacaccgttaagcgaagcatgctgccgctcgtcctcgccaccctcaccaccgtcctgctcctcggccccgtatccgaccgtggagccgccttcgccagcccgccgccggaccccgtgcagtgctcgtccggcggcggcacgtccgactgcaccgtgtccagcgcgtacggcgtgttcccggaccgctcgacgtgccgcgccgcgggcgcggcgttcccgacctcggaggacgagctggtgcgcgccgtggcgcgcggcgccgcgtcggggaccaagatgaaggccgccacccgctactcccacagcatcccgccgctggcgtgccccggggccggagatggccaggggctcgtcatcagcaccaggcgcctcgaccgcgtcgtgtccgtcgacgccgcgtccgggcacgtcacggtggagagcggcgtcacgctgcggcagctcgtcgcggaggcggccaaggccgggctcgccctgccctacgcgccgtactggtgggggctcaccgtcggcggcatgctcggcacgggcgcgcacggcagctcgctctggggtaatggaagcgccgtgcacgagtacgtcgtcgggatgcgcatcgtcacgcccgcgcccgccgccgaagggtacgccaaggtgcgcgtgctcaccgccggcgatccggagctcgacgccgccaaggtctctctcggcgtcctcggcgtcatctctcaggtgacgctggcgctgcaacctctgttcaagcgttcggtgacgttcacggagcgggacgacgacgacctggcggagcaggtggccaaattcgggtaccagcacgagttcgccgacatctcgtggttcccgggccaccggcgggcggtgtaccgcatcgacgaccgcctgccgctcaccgcgcccggcgacggcgccatggacttcatcggcttccgcgccaccccggcgctggtgatccaggccacccgtctcgccgaggacctcttcgagcgcgccggcaacggcagcggcaagtgcctgacgtcccgggtgacccacgcggcgctgtcggcggccgggtacgggctgcagcggcggagcggcgggctgttcacgttcacggggtaccccgtggtcggggcgcagcaccggatgcaggcctccggcgggtgcgtgacggggcccgaggacgcgctgctgacggcgtgcccctgggacccgcgcgtgcgcggcggcactttcttccaccagaccaccttcagcctgccgctgcgccgcgccgccgcgttcgtcgccgaggtgaagcggctccgggacatggcggaccccagggcgctgtgcggcgtggagctctacgacggcatcctcatgcggtacgtgaaggcgtccacggcgcacctcggcaagccgccgccgccgtcgtcgtcgtcgggggacatggtggacttcgacatcacctactaccggagccgagatccggcgagggcgcgcctgttcgaggacgtgctggaggagatcgagcagatgggcgtcttcaagtacggcggcctgccgcactggggcaagaaccgcaacctcgccttcgtcggagcagcgcgcaagtacccgggcctgccgcagttcctgcgcgtcaaggacgcctacgaccccgacgggctcttctccagcgactggagcgacatgatgctcggcatcggcgggaggtcgccgacgacggacgcgcccgggtgcgcgctggaggggatgtgcgtgtgctcgcgggacgagcactgcgcgccggagcagggctatgtctgccgccccggcaaggtgtacaaggacgccagagtctgcaccagggtggcgtcgtag

SEQ ID NO: 8906 - protein, 626 aa, Sorghum bicolor
  misc_feature: Ceres ANNOT ID no. 6094528
  misc_feature (87)..(236): Pfam Id: FAD_binding_4 Pfam Desc: FAD binding domain
  misc_feature (258)..(572): Pfam Id: ALO Pfam Desc: D-arabinono-1,4-lactone oxidase
  misc_feature (31)..(622): NCBI GI: 32487608 NCBI Desc: osjnba0034e24.8 [oryza sativa (japonica cultivar-group)]
  misc_feature (252)..(624): NCBI GI: 62733494 NCBI Desc: plant-specific fad-dependent oxidoreductase [oryza sativa (japonica cultivar-group)]
  misc_feature (50)..(624): NCBI GI: 37202006 NCBI Desc: at2g46750 [arabidopsis thaliana]
  misc_feature (25)..(404): NCBI GI: 32487620 NCBI Desc: osjnba0034e24.20 [oryza sativa (japonica cultivar-group)]
  misc_feature (25)..(404): NCBI GI: 115457902 NCBI Desc: os04g0361500 [oryza sativa (japonica cultivar-group)]
  misc_feature: Useful for making plants with modulated nitrogen use efficiency
  misc_feature: Functional homolog of the protein sequence given in SEQ ID NO 14034
MGTTTTTPVAGAVVLSLKYLDTVKRSMLPLVLATLTTVLLLGPVSDRGAAFASPPPDPVQCSSGGGTSDCTVSSAYGVFPDRSTCRAAGAAFPTSEDELVRAVARGAASGTKMKAATRYSHSIPPLACPGAGDGQGLVISTRRLDRVVSVDAASGHVTVESGVTLRQLVAEAAKAGLALPYAPYWWGLTVGGMLGTGAHGSSLWGNGSAVHEYVVGMRIVTPAPAAEGYAKVRVLTAGDPELDAAKVSLGVLGVISQVTLALQPLFKRSVTFTERDDDDLAEQVAKFGYQHEFADISWFPGHRRAVYRIDDRLPLTAPGDGAMDFIGFRATPALVIQATRLAEDLFERAGNGSGKCLTSRVTHAALSAAGYGLQRRSGGLFTFTGYPVVGAQHRMQASGGCVTGPEDALLTACPWDPRVRGGTFFHQTTFSLPLRRAAAFVAEVKRLRDMADPRALCGVELYDGILMRYVKASTAHLGKPPPPSSSSGDMVDFDITYYRSRDPARARLFEDVLEEIEQMGVFKYGGLPHWGKNRNLAFVGAARKYPGLPQFLRVKDAYDPDGLFSSDWSDMMLGIGGRSPTTDAPGCALEGMCVCSRDEHCAPEQGYVCRPGKVYKDARVCTRVAS

SEQ ID NO: 8907 - DNA, 1284 bp, Sorghum bicolor
  misc_feature: Ceres ANNOT ID no. 6094555
  misc_feature: Encodes the peptide sequence at SEQ ID NO 8908
atggcacaggacggctgcgagagctccagcaaggcgtcgtcgtcgttggcaggcagcagcggctgctccatgccgtcgttcaggctcaacgtgcacgcgcgggagttcgtgccggtgccacccgcggtggtggccagccctttgacggccgccgccggctactactctccgttcctgcagctgtccggcggcggcggtggtgggctggccgcggactggaacttctttgccgagccggaccccacgtcgtcgtccttcctgccggacttcggacatggtggcgagatcgccggagctgccggtatcagtggctaccccaaccccaagggcgcgagtccggccgacgtcgcgcagaagatcatcaagcaggttgagtaccagttcagtgacactaatttggttgcgaatgatttcttgacgaagatcatgaacaaggatcctgagggctatgttcctttgtctgtcatatcatcctggaagaagatcaaggctatgggggtaacaaaccaactgctggttacggctctccggacctcggaaaagcttgttgtcagcgatgacggcaagaaagtgcgacgggctcagccattcaccgagagacacaaagaagagctgcagtgtcggatggtcatcgccgagaatttgccgcatgattccacgaggaacagcctcgagaagatcttcggcatcattggcagtgtgaaaaacatcagaatctgccatccgcaagaacccagctctgcaagatcatccaagtccgacgcaaacacactagtcagtaacaagctgcatgctcttatagagtacgagacctcacaccaagccgacagagcagtggacaagttgaacgacgaaagaaactggaggaggggcctccgcgtgcgcccggtgctgcgacgatcgcccaaggcggcaacacggctgaagcggccggacttggaccacctcgccgcctccgacgaggagcgctcgccgcagtcgcagggctcgtcgtccgactccctgacggcggcgcactttcctgacaacagccaggaggaggaccagcaccagcacgtcggcgccaagaagccatggggcagagggcggggcaggccgccgcagacgctgcactcctccgcgcacgctgctggcgcgccggggcatctggacagcctcgcggcgagccccaggcacgcggcgcaggggccgaggatgcccgacggcacgcgagggttcaccatgggccgggggaggccggcggcgcctgccgtggcatcggctgctgtcgtccgggtcgtgtag

SEQ ID NO: 8908 - protein, 427 aa, Sorghum bicolor
  misc_feature: Ceres ANNOT ID no. 6094555
  misc_feature (120)..(179): Pfam Id: La Pfam Desc: La domain
  misc_feature (5)..(335): NCBI GI: 6449448 NCBI Desc: rna-binding protein homolog [brassica napus]
  misc_feature (38)..(365): NCBI GI: 62734646 NCBI Desc: at2g43970/f6e13.10 [oryza sativa (japonica cultivar-group)]
  misc_feature (128)..(365): NCBI GI: 115484947 NCBI Desc: os11g0248200 [oryza sativa (japonica cultivar-group)]
  misc_feature (101)..(365): NCBI GI: 30689565 NCBI Desc: la domain-containing protein [arabidopsis thaliana]
  misc_feature (145)..(365): NCBI GI: 15724224 NCBI Desc: at2g43970/f6e13.10 [arabidopsis thaliana]
MAQDGCESSSKASSSLAGSSGCSMPSFRLNVHAREFVPVPPAVVASPLTAAAGYYSPFLQLSGGGGGGLAADWNFFAEPDPTSSSFLPDFGHGGEIAGAAGISGYPNPKGASPADVAQKIIKQVEYQFSDTNLVANDFLTKIMNKDPEGYVPLSVISSWKKIKAMGVTNQLLVTALRTSEKLVVSDDGKKVRRAQPFTERHKEELQCRMVIAENLPHDSTRNSLEKIFGIIGSVKNIRICHPQEPSSARSSKSDANTLVSNKLHALIEYETSHQADRAVDKLNDERNWRRGLRVRPVLRRSPKAATRLKRPDLDHLAASDEERSPQSQGSSSDSLTAAHFPDNSQEEDQHQHVGAKKPWGRGRGRPPQTLHSSAHAAGAPGHLDSLAASPRHAAQGPRMPDGTRGFTMGRGRPAAPAVASAAVVRVV

SEQ ID NO: 8909 - DNA, 360 bp, Sorghum bicolor
  misc_feature: Ceres ANNOT ID no. 6094573
  misc_feature: Encodes the peptide sequence at SEQ ID NO 8910
atgcacgacttctgcttcaccatcccctacgggttcgccgtgctggccggcggcgtgatgggctacctccgccgcggcagcaccgcctccctcgcggggggagccggcgccggcgccatcctcctcctcgcgggcttcgtcagtctcaaggccttcgagaagcgccgcaactcctacgtcgccctcgcgctccagacgctttgtgcattagccttaacttacgttatggggcaaagataccttgagacctcgaagattatgccagctggtgttgttgctggtctcagtgccgtgatgtcagtgttttatctgttcaaaattgcaaccggcggcaaccacatccctccaaagaaagagtaa

SEQ ID NO: 8910 - protein, 119 aa, Sorghum bicolor
  misc_feature: Ceres ANNOT ID no. 6094573
  misc_feature (4)..(107): Pfam Id: TMEM14 Pfam Desc: Transmembrane proteins 14C
  misc_feature (1)..(119): NCBI GI: 38344745 NCBI Desc: osjnba0089k21.3 [oryza sativa (japonica cultivar-group)]
  misc_feature (1)..(119): NCBI GI: 116310019 NCBI Desc: osigba0124n08.6 [oryza sativa (indica cultivar-group)]
  misc_feature (10)..(115): NCBI GI: 114153248 NCBI Desc: transmembrane protein 14c [argas monolakensis]
  misc_feature (10)..(99): NCBI GI: 90103444 NCBI Desc: transmembrane protein 14c-like [ictalurus punctatus]
  misc_feature (8)..(99): NCBI GI: 21961355 NCBI Desc: tmem14a protein [mus musculus]
MHDFCFTIPYGFAVLAGGVMGYLRRGSTASLAGGAGAGAILLLAGFVSLKAFEKRRNSYVALALQTLCALALTYVMGQRYLETSKIMPAGVVAGLSAVMSVFYLFKIATGGNHIPPKKE

SEQ ID NO: 8911 - DNA, 1695 bp, Sorghum bicolor
  misc_feature: Ceres ANNOT ID no. 6094577
  misc_feature: Encodes the peptide sequence at SEQ ID NO 8912
  misc_feature: Up-regulated in root tissues in response to salicylic acid treatment
atggcgggcacggcgtcgccggccgcgggctacggctccgacggcgtgtaccgctcgccgcgcgcggcggcgcagatcgcctcggacccgggcctctccctcgcggacctcgtcctgcgccgcgccgcggcgtgcccctccgcgccggcgctcgtggacgccgcgaccggccgcgcgctcaccttcgggtccctccggtccgcggtgctcgtcgcggccgccgcgctctcctcccgcgctggcgtccgccgcggcgacgccgtgctgctcctcgcgcccaactgcgtgctctacccggtctgcttcctcgcggtcacctcgctcggcgccgtcgccaccacggctaacccgcgctacaccccgcgggagatcgccaagcaggcggccgacgcccgcgccaagctcgtcgtcactgtctccgacctcctgcccaagatcgccggcctccgcctccccaccgtcctcctcgacggcgacggcggcggcgcccccgtgcctagttcggactgccccagcagaagcagtaacgtcactctctactcggacctcgtcgccggggttcaggaggcggagtaccgccgcccgccggccgtggggcagggcgacacggcggcgctgttctactcgtcgggcacgaccggggagagcaagggcgtggtgctcacgcaccgcaacttcatcgcggcggcgacgatggtgacgtcggaccaggacgagctcggggaaggaggccgcaacgtgttcctctgcttcctgcccatgttccacatcttcggcatggccgtggtcaccctcggccagctgcagcgcggcaacgccgtcgtcgtcatggcccggttcgacgtcgacgccgtgctcgccgccgtcgagcgccaccgcgtcacgtacatcttcggcgcgccgccggcgatgatcgcgctcgccaagcacggcgggggccgcaggtacgacctcagctcgctcaggtgcatcggctctggcgccgcgccgctcggcaaggacgtcatggtggctatggctgacagattccccgcgccgacattgtccaggtgggaggtgctcctcttgcagggttatggtatgactgaaacctgcgggataatatctctagagtacgtgcaaaagggtcgtgcccgtcagtttggttcaactggagcacttgtcataggagttgaagcaaagattgttgatacaaagacaatgaagcatctgcctccgaaccagctaggagaaatctgtgttcgaggaccaaacataatggaaggttatttcaacaatgtgcaagccactgagtttacaatcaagcaagggtggttgcatactggtgatcttggatactttgatgaaagaggccagcttcatgttgtcgatagacttaaagagctgattaagtacaaaggcttccagattgctcctgctgagcttgaaggattgcttttgtctcatcctgaaattcttgatgctgctgttatcccgtatcctgatcccgaagcaggggaagttcctatcgcctatgttgtacggtcaccaaagagttcactggctgaagttgatgtccagaaatttatcgaaaagcaggtcgcgcactacaagagactgaggaaggtaaagtttgtggacagtgtaccaaaatctgctgcgggaaagattttgagaagagagctcatcgcccaagtcagatcatccaagctgtag

SEQ ID NO: 8912 - protein, 564 aa, Sorghum bicolor
  misc_feature: Ceres ANNOT ID no. 6094577
  misc_feature (61)..(490): Pfam Id: AMP-binding Pfam Desc: AMP-binding enzyme
  misc_feature (1)..(558): NCBI GI: 115450783 NCBI Desc: os03g0152400 [oryza sativa (japonica cultivar-group)]
  misc_feature (16)..(559): NCBI GI: 76789647 NCBI Desc: 4-coumarate--coa ligase 2 (4cl 2) (4-coumaroyl-coa synthase 2)
  misc_feature (16)..(559): NCBI GI: 41053213 NCBI Desc: 4-coumarate:coa ligase isoform 2 [oryza sativa (japonica cultivar-group)]
  misc_feature (16)..(559): NCBI GI: 893294 NCBI Desc: 4-coumarate:coa ligase isoform 2
  misc_feature (2)..(559): NCBI GI: 7188335 NCBI Desc: 4-coumarate--coa ligase 4cl1 [lolium perenne]
  misc_feature: Useful for making plants with altered cell wall content and/or composition
  misc_feature: Functional homolog of the protein sequence encoded by LOCUS at4g05160
  misc_feature: Useful for making plants with altered cell wall content and/or composition
  misc_feature: Functional homolog of the protein sequence given in SEQ ID NO 14036
  misc_feature: Up-regulated in root tissues in response to salicylic acid treatment
MAGTASPAAGYGSDGVYRSPRAAAQIASDPGLSLADLVLRRAAACPSAPALVDAATGRALTFGSLRSAVLVAAAALSSRAGVRRGDAVLLLAPNCVLYPVCFLAVTSLGAVATTANPRYTPREIAKQAADARAKLVVTVSDLLPKIAGLRLPTVLLDGDGGGAPVPSSDCPSRSSNVTLYSDLVAGVQEAEYRRPPAVGQGDTAALFYSSGTTGESKGVVLTHRNFIAAATMVTSDQDELGEGGRNVFLCFLPMFHIFGMAVVTLGQLQRGNAVVVMARFDVDAVLAAVERHRVTYIFGAPPAMIALAKHGGGRRYDLSSLRCIGSGAAPLGKDVMVAMADRFPAPTLSRWEVLLLQGYGMTETCGIISLEYVQKGRARQFGSTGALVIGVEAKIVDTKTMKHLPPNQLGEICVRGPNIMEGYFNNVQATEFTIKQGWLHTGDLGYFDERGQLHVVDRLKELIKYKGFQIAPAELEGLLLSHPEILDAAVIPYPDPEAGEVPIAYVVRSPKSSLAEVDVQKFIEKQVAHYKRLRKVKFVDSVPKSAAGKILRRELIAQVRSSKL

SEQ ID NO: 8913 - DNA, 1383 bp, Sorghum bicolor
  misc_feature: Ceres ANNOT ID no. 6094580
  misc_feature: Encodes the peptide sequence at SEQ ID NO 8914
atggccgcgcctccgctccccttccccctcctgatactcctgctcctactcgctgtatcctcctccaccgtcgccgccgccgcggcaatcggggctccggtgctaggggaggactacgtccgtccgccgccgtcgcggtcgcaccgcaaggcactccttagcctcttcccttggagcaagaagaaggagtcatcctccgcctccgatccgcagcaggtgcacatttcactagctggagaaaagcacatgagaataacatggattaccgatgataactctgtcccatctgtggtagactatggaaccaaagaaggtgcatacacaatgaaatctcaaggagaaagcacatcctacagttacttattgtatagctcaggaaaaattcatcatgttgtcgtcggacctcttgaagacaacactatttattactaccgatgtggagggcaaggtccagaattccaatttaagaccccgccctcccaatttccattgtcattggctgttgttggtgatcttggtcagactagttggacaacatctaccctgaatcacattaagcagtgtgagcatgatatgcttttactccctggtgatctctcttatgctgattatatgcaacatttgtgggattccttcggcacattggtggagccacttgctagcaaccggccttggatggtgacagaaggcaaccatgagaaggagaaaattccactttttaagtcaggatttcaatcttataatgcacgatggaaaatgccttatgaagagagtggatctagatcaaatttgtactactcttttgaagttgctggtgcacacatcataatgctaggttcatacacagattatgatgatagctcagatcagtatgcttggctaaaggctgatcttgccaaggttgatagagagaggacaccctggctcattgtgttgttgcatgtaccatggtacaatagcaattgggctcatcagggtgaaggtgacagtatgatggcttcaatggagactttgctgtatgctgctcgtgtggacatggtaatagcaggtcatgtccatgcttatgaacgtgcggagcgagtctacaatggcagacttgatccttgtggtgctgttcacataactatcggggatggtgggaaccgtgaaggcttggcccacaggtatcgtaatccgaagccagcttggtcagtcttcagggaagcgagctttgggcatggcgagctaaagatcgtgaactccacccatgcccactggacctggcacaggaacgacgacgaggagcccgtgagaactgatgacgtgtggatcaactctcttgctggttcagggtgcatcctggaaggcagccgtgagttgaggaagatcctaacgtctccttga

SEQ ID NO: 8914 - protein, 460 aa, Sorghum bicolor
  misc_feature: Ceres ANNOT ID no. 6094580
  misc_feature (164)..(355): Pfam Id: Metallophos Pfam Desc: Calcineurin-like phosphoesterase
  misc_feature (13)..(460): NCBI GI: 20259848 NCBI Desc: purple acid phosphatase-like protein [arabidopsis thaliana]
  misc_feature (66)..(451): NCBI GI: 20257495 NCBI Desc: purple acid phosphatase [arabidopsis thaliana]
  misc_feature (66)..(451): NCBI GI: 7669956 NCBI Desc: purple acid phosphatase-like protein [arabidopsis thaliana]
  misc_feature (11)..(450): NCBI GI: 116310141 NCBI Desc: h0717b12.3 [oryza sativa (indica cultivar-group)]
  misc_feature (14)..(441): NCBI GI: 115484215 NCBI Desc: os11g0151700 [oryza sativa (japonica cultivar-group)]
MAAPPLPFPLLILLLLLAVSSSTVAAAAAIGAPVLGEDYVRPPPSRSHRKALLSLFPWSKKKESSSASDPQQVHISLAGEKHMRITWITDDNSVPSVVDYGTKEGAYTMKSQGESTSYSYLLYSSGKIHHVVVGPLEDNTIYYYRCGGQGPEFQFKTPPSQFPLSLAVVGDLGQTSWTTSTLNHIKQCEHDMLLLPGDLSYADYMQHLWDSFGTLVEPLASNRPWMVTEGNHEKEKIPLFKSGFQSYNARWKMPYEESGSRSNLYYSFEVAGAHIIMLGSYTDYDDSSDQYAWLKADLAKVDRERTPWLIVLLHVPWYNSNWAHQGEGDSMMASMETLLYAARVDMVIAGHVHAYERAERVYNGRLDPCGAVHITIGDGGNREGLAHRYRNPKPAWSVFREASFGHGELKIVNSTHAHWTWHRNDDEEPVRTDDVWINSLAGSGCILEGSRELRKILTSP

SEQ ID NO: 8915 - DNA, 1425 bp, Sorghum bicolor
  misc_feature: Ceres ANNOT ID no. 6094656
  misc_feature: Encodes the peptide sequence at SEQ ID NO 8916
atggcccgtacagataaatccggtagggccgatctgggccgtccatcctacatcagacggctaaggcaacctcagccgccgcaacttttatccatccgtttggcccacgcgctccctccccagtctcctctctctcctcgcgtggctagggttttgactcctacaccagctccgccccacgccgccatgatgcagccgccgccgccacagcagcagcagcaatgggcaatggcgccgccgcccccgccgcagtactaccaggcgggacaccccccgccgccgcccccgcagttctaccaggcgggccctccgcctcctgctatgtggggccagccgccgccgcaagcggccccggccccggcgccggcaccgtccggcggtggggcgggggacgaggccaggaccctctggatcggggacctgcagtactggatggacgagaactacctctacagctgcttctcccaggccggcgaggttatttctgtgaagataattcgaaacaagcagactgggcaacctgagggttatggttttattgaattcggcaaccatgctttagctgaacaagttctgcagaattataatggtcaaatgatgcctaatgttaatcaacctttcaaattgaattgggctaccagtggggctggtgagaaacgtggagatgatggttcagattatactatatttgttggggacttggcctcggatgttacagatttcattctacaagatacattcaagagtcgttatccatcagttaagagtgcaaaagttgtcttcgacagaactacaggccgctcgaaaggctatggttttgttaagtttgcagatttggatgaacagacacgggcaatgactgaaatgaatggacaatactgttctagcaggcccatgcgccttggaccagcatccaacaagaagaatactggtggacaaccacagccatcgagtactatttaccagaatacccaaggaactgattctgatagtgatccaaacaatactactgtatttgttggtggtcttgatccgagtgtgactgatgagcttctcaagcaaaccttcagtccatacggagagcttctctatgtcaaaatacctgtaggaaagcgttgtggatttgtccaatattctaacagggcttcagctgaggaggccataaggatgctaaatggaagccagctgggaggtcagagcataaggctctcatggggtcgtagccctgcaaacaagcagcctcagcaagagcagaaccaatggagtggtggtggctattatgggtatccccaaggatatgatccatatggttatgctcgcccccctcaagatcctgccatgtacgcctacacaccatatccagggtatggaaattaccagcagcagccaccacagcagcccccaccacaacagtacaatttctaa

SEQ ID NO: 8916 - protein, 474 aa, Sorghum bicolor
  misc_feature: Ceres ANNOT ID no. 6094656
  misc_feature (136)..(207): Pfam Id: RRM_1 Pfam Desc: RNA recognition motif. (a.k.a. RRM, RBD, or RNP domain)
  misc_feature (229)..(301): Pfam Id: RRM_1 Pfam Desc: RNA recognition motif. (a.k.a. RRM, RBD, or RNP domain)
  misc_feature (338)..(403): Pfam Id: RRM_1 Pfam Desc: RNA recognition motif. (a.k.a. RRM, RBD, or RNP domain)
  misc_feature (27)..(470): NCBI GI: 115453831 NCBI Desc: os03g0569900 [oryza sativa (japonica cultivar-group)]
  misc_feature (39)..(471): NCBI GI: 115475137 NCBI Desc: os08g0190200 [oryza sativa (japonica cultivar-group)]
  misc_feature (56)..(471): NCBI GI: 115460682 NCBI Desc: os04g0625800 [oryza sativa (japonica cultivar-group)]
  misc_feature (66)..(471): NCBI GI: 39545835 NCBI Desc: osjnbb0060e08.6 [oryza sativa (japonica cultivar-group)]
  misc_feature (66)..(471): NCBI GI: 116309791 NCBI Desc: osigba0148a10.8 [oryza sativa (indica cultivar-group)]
  misc_feature: The sequence is a functional homolog of SEQ ID NO 1484 in the 10/666,642US patent application
  misc_feature: The sequence is a functional homolog of SEQ ID NO 252 in the 10/714,887US patent application
  misc_feature: The sequence is a functional homolog of SEQ ID NO 252 in the 11/435,388US patent application
  misc_feature: The sequence is a functional homolog of SEQ ID NO 278 in the 10/714,887US patent application
  misc_feature: The sequence is a functional homolog of SEQ ID NO 278 in the 11/435,388US patent application
  misc_feature: The sequence is a functional homolog of SEQ ID NO 568 in the 10/666,642US patent application
  misc_feature: Useful for making plants with modulated growth and phenotype characteristics
  misc_feature: The sequence is a functional homolog of SEQ ID NO 252 in the 20060015972 US patent application
  misc_feature: The sequence is a functional homolog of SEQ ID NO 278 in the 20060015972 US patent application
  misc_feature: The sequence is a functional homolog of SEQ ID NO 536 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: Useful for making plants with altered terpenoid content
  misc_feature: Functional homolog of the protein sequence given in SEQ ID NO 12954
  misc_feature: The sequence is a functional homolog of SEQ ID NO. 339 in the 11/188,298 US application
  misc_feature: The sequence is a functional homolog of SEQ ID NO. 458 in the 11/188,298 US application
MARTDKSGRADLGRPSYIRRLRQPQPPQLLSIRLAHALPPQSPLSPRVARVLTPTPAPPHAAMMQPPPPQQQQQWAMAPPPPPQYYQAGHPPPPPPQFYQAGPPPPAMWGQPPPQAAPAPAPAPSGGGAGDEARTLWIGDLQYWMDENYLYSCFSQAGEVISVKIIRNKQTGQPEGYGFIEFGNHALAEQVLQNYNGQMMPNVNQPFKLNWATSGAGEKRGDDGSDYTIFVGDLASDVTDFILQDTFKSRYPSVKSAKVVFDRTTGRSKGYGFVKFADLDEQTRAMTEMNGQYCSSRPMRLGPASNKKNTGGQPQPSSTIYQNTQGTDSDSDPNNTTVFVGGLDPSVTDELLKQTFSPYGELLYVKIPVGKRCGFVQYSNRASAEEAIRMLNGSQLGGQSIRLSWGRSPANKQPQQEQNQWSGGGYYGYPQGYDPYGYARPPQDPAMYAYTPYPGYGNYQQQPPQQPPPQQYNF

SEQ ID NO: 8917 - DNA, 1506 bp, Sorghum bicolor
  misc_feature: Ceres ANNOT ID no. 6094661
  misc_feature: Encodes the peptide sequence at SEQ ID NO 8918
atggccggcggcggcgatggtcgtcaaggcgggacgtcgtcgtcgtcctcccatgagctgagcgggcagctggagggcatcctcgccgaccgtgaggcgccatgggcgcgccgggcgtccaaggcagccatgatcgagctccggctgctggcgccaatcgcggcgccggcggtggtggtgtacgtgctcaacaacgtgctgtccatctcgacgcagatcttctcggggcacctcggcaacctcgagctcgctgcctcgtcgctcgggaacaacggcatccaggtcttcgcctacggcctcatgcttggcatggggagtgccgtggaaaccctgtgcggccaagcctacggcgcacacaggtacgaaatgctgggcatctacctgcagcgctcgaccatcctgctcgtcgccgtgggcgtgccgctcagtgtcatctacgccttctccgagcccatcctcgtcttcctcggcgagtcgccggagatcgccaaggccgcggccgtcttcgtctacggcctcatcccgcaggtcttcgcgtacgcggccaacttcccgatccagaagttccttcaggcgcagagcatcgtgtcgcccagcgcctacatctccgcggcgacgctggccgtgcacctggtgctggggtggctggtggtgtacaggttcggcatgggcctcctgggcgcgtcgctcgtgctgagcctgagctggtggatcatcgtcgccgcccagttcctgtacatcgtcaccagcgagcggtgccggcggacgtggacggggctctcctgccgtgccttctcgggcttgccggagttcctcaagctgtcgacggcgtcggctgtcatgctgtgccttgagacgtggtacttccaggtcctcgtcctcatcgccggcctcctcgacaaccctcagctcgccctcgattctctaacagtctgcatgacgctcgccggatgggtgttcatgatctccattgggttcaacgctgctgctagtgtgagagttgggaatgagctgggagccgggcacccgcgggcggcggcgttctctgtggtggtggtgacggctctgtcgttcgtgatcactctggccatggcggtggtgttcctcgtcttccgcgactacctcagctacatcttcacggagggggagacggtggcccgcgccgtctccgacctctgccctctgctcgccgccacgctcatcctcaacggcatccagcccgtcctctcaggtgtggctgtcgggtggcagaaactggtcgcgtatataaatgtcggttgctactacttcgtgggcatcccactcggaattcttctcggcttcaaattccatcttggagcaaagggaatatggactgggatgctcggtggtacatgcatgcagacgcttatcttgttctggatcacttttaggacagattgggacaaagaggttgaggaagccaggaagagactgaaccaatgggaggacaacaagcagcctcttctgctagttccctcggattaa

SEQ ID NO: 8918 - protein, 501 aa, Sorghum bicolor
  misc_feature: Ceres ANNOT ID no. 6094661
  misc_feature (56)..(216): Pfam Id: MatE Pfam Desc: MatE
  misc_feature (277)..(438): Pfam Id: MatE Pfam Desc: MatE
  misc_feature (2)..(496): NCBI GI: 115453843 NCBI Desc: os03g0571900 [oryza sativa (japonica cultivar-group)]
  misc_feature (15)..(495): NCBI GI: 126363776 NCBI Desc: multi antimicrobial extrusion family protein [nicotiana tabacum]
  misc_feature (16)..(495): NCBI GI: 126363774 NCBI Desc: multi antimicrobial extrusion family protein [nicotiana tabacum]
  misc_feature (18)..(497): NCBI GI: 115472373 NCBI Desc: os07g0516600 [oryza sativa (japonica cultivar-group)]
  misc_feature (15)..(496): NCBI GI: 15081773 NCBI Desc: at1g61890/f8k4_9 [arabidopsis thaliana]
MAGGGDGRQGGTSSSSSHELSGQLEGILADREAPWARRASKAAMIELRLLAPIAAPAVVVYVLNNVLSISTQIFSGHLGNLELAASSLGNNGIQVFAYGLMLGMGSAVETLCGQAYGAHRYEMLGIYLQRSTILLVAVGVPLSVIYAFSEPILVFLGESPEIAKAAAVFVYGLIPQVFAYAANFPIQKFLQAQSIVSPSAYISAATLAVHLVLGWLVVYRFGMGLLGASLVLSLSWWIIVAAQFLYIVTSERCRRTWTGLSCRAFSGLPEFLKLSTASAVMLCLETWYFQVLVLIAGLLDNPQLALDSLTVCMTLAGWVFMISIGFNAAASVRVGNELGAGHPRAAAFSVVVVTALSFVITLAMAVVFLVFRDYLSYIFTEGETVARAVSDLCPLLAATLILNGIQPVLSGVAVGWQKLVAYINVGCYYFVGIPLGILLGFKFHLGAKGIWTGMLGGTCMQTLILFWITFRTDWDKEVEEARKRLNQWEDNKQPLLLVPSD

SEQ ID NO: 8919 - DNA, 435 bp, Sorghum bicolor
  misc_feature: Ceres ANNOT ID no. 6094674
  misc_feature: Encodes the peptide sequence at SEQ ID NO 8920
atgatcatcagcgccaagaggattgctcatgtggccaagaattggcagaggatggctgcacaagggaggaagcgcctcacctgggccgcggcagcaaaggaagccgacgagtgctgcagctccgtggcgagcaagggccactgcacggtgtacacggccgacggcgcgcggttcgaggtgccgctggcgtgccttggcaccgcggtcttcggggagctcctgcaaatgtcacgggaagagttcggcttcacgtgcggcgatggcaggatcacgctcccctgcgacgcggcggtgatggagtacgccatgtgtttgctcaggagaggcgcctctgccgagctagagcgggctttgcttagcaccatggcgatggcgtgccactattccagccgtgtggcgccgtgtgtagaagccagccagcagattgctgtttaa

SEQ ID NO: 8920 - protein, 144 aa, Sorghum bicolor
  misc_feature: Ceres ANNOT ID no. 6094674
  misc_feature (1)..(107): Pfam Id: Auxin_inducible Pfam Desc: Auxin responsive protein
  misc_feature (2)..(144): NCBI GI: 32187718 NCBI Desc: auxin induced protein [zea mays]
  misc_feature (2)..(144): NCBI GI: 115480483 NCBI Desc: os09g0545300 [oryza sativa (japonica cultivar-group)]
  misc_feature (2)..(96): NCBI GI: 115480493 NCBI Desc: os09g0546200 [oryza sativa (japonica cultivar-group)]
  misc_feature (2)..(144): NCBI GI: 20149052 NCBI Desc: auxin-induced saur-like protein [capsicum annuum]
  misc_feature (1)..(144): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MIISAKRIAHVAKNWQRMAAQGRKRLTWAAAAKEADECCSSVASKGHCTVYTADGARFEVPLACLGTAVFGELLQMSREEFGFTCGDGRITLPCDAAVMEYAMCLLRRGASAELERALLSTMAMACHYSSRVAPCVEASQQIAV

SEQ ID NO: 8921 - DNA, 432 bp, Sorghum bicolor
  misc_feature: Ceres ANNOT ID no. 6094676
  misc_feature: Encodes the peptide sequence at SEQ ID NO 8922
atgatcagcaccaagaggatcgctcagctggccaagaagtggcagacggtggcagcgcttgggaggaagaagcgcctcacctgggggccggcaccggcaacaaaggatgtcgacaagtgctgcaccacctctgtggcgagcaagggccactgcgcggtgtacacagccgacggggcacggttcgaggtgccattggcatgcctcgggacgacagtcttcgcggagctcctgcagatgtccgaggaggagtttggcttcacgggcggcgacggcaggatcacactgccctgtgatgccatggtcatggagtacgccttgtgcttgctgaggaggggcgcctctgcggagctggagaaggcgttcctgagcaccatggcaatgccgtgccactctgcaaaccacgtggcgccgtatgtggcagcttgctgttag

SEQ ID NO: 8922 - protein, 143 aa, Sorghum bicolor
  misc_feature: Ceres ANNOT ID no. 6094676
  misc_feature (16)..(110): Pfam Id: Auxin_inducible Pfam Desc: Auxin responsive protein
  misc_feature (1)..(141): NCBI GI: 32187718 NCBI Desc: auxin induced protein [zea mays]
  misc_feature (1)..(130): NCBI GI: 115480483 NCBI Desc: os09g0545300 [oryza sativa (japonica cultivar-group)]
  misc_feature (1)..(99): NCBI GI: 115480493 NCBI Desc: os09g0546200 [oryza sativa (japonica cultivar-group)]
  misc_feature (1)..(133): NCBI GI: 20149052 NCBI Desc: auxin-induced saur-like protein [capsicum annuum]
  misc_feature (1)..(122): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 505 in the 11/188,298 US application
  misc_feature: The sequence is a functional homolog of SEQ ID NO. 402 in the 11/188,298 US application
MISTKRIAQLAKKWQTVAALGRKKRLTWGPAPATKDVDKCCTTSVASKGHCAVYTADGARFEVPLACLGTTVFAELLQMSEEEFGFTGGDGRITLPCDAMVMEYALCLLRRGASAELEKAFLSTMAMPCHSANHVAPYVAACC

SEQ ID NO: 8923 - DNA, 2445 bp, Sorghum bicolor
  misc_feature: Ceres ANNOT ID no. 6094679
  misc_feature: Encodes the peptide sequence at SEQ ID NO 8924
atggcgtcccaacaagcagctgactacagaggaagtagggaagagatcgtcatcgtggacctcgagagcgaagaggccgccgtcgacgacgtcgatctgccgccggcgacgatgcagcggcaggattccctgtacgtggccgcaacaagagccgccggcgcgaaccaccacggacaggatagctgggccaggacgctgcggctggcgttccagtgcgtggggatcctgtacggcgacattggcacgtcgccgctgttcgtgtactcgagcacgttccgcgacggcgtcggccacccggacgacctgctcggggcgctctccctcatcatctacagcttcctgctcttcaccgtcatcaagtacgtctacatcgccctacgagccaacgacgacggtgacggtggaactttcgcgctctacactctgatctcgcgccacgccagggtgagcctgatcccgaaccagcaggttgaagacgagctcgtctccaagtacaaccgcgacaaaccgccggcgacgctgcagagagcggagtggatgaaggagctgctcgagacgaacaagactgtaaagatctcgctcttcctcatcaccatgctcgccaccgccatggttatcagcgacgctattctgactcctgcaatttcagttctctctgctgttgatggcctaaaagaaaaggcgtcttttcttacaacagatgagatagtctggatcaccgtgggaattttggtggtgctgttcgcaatccagaggttcgggacagacagagtcggttacttgtttgcgccgatcatcctcctctggctgctcctcattgcaggcgttgggttatacaacctgataaagtatgataccggtgctctcagggcattcaatatgaaatacatcatcgactattttagaaggaacaagaaaaaaggatgggtttcccttggaggcatactcctttgtttcacaggcacagaagctctttttgctgatctaggatacttcagcatcaaatcaatccagctaagctttggtttcggtttagtcccgtcagtattacttgcttacattgggcaagcagcatacttgagagtacacccggaggatgtggctaacactttctacagatcaactccaatctcgttgttctggccaacgttcattcttgcactagcagcatcgatcattggaagtcaagccatgatctcctgtgcctttgcaacaatttcacattcccaaacacttggttgctttccaagggtaaagatactgcacacctcaaggcaatactcaggccaattgtatatccctgaagtaaactacttgctgtgcttgggtgcttgccttgtcacaattggcttcaggacaaccgtcatcattggggaagctcatggtatatgtgttgttcttgtgatgatcgtcacaaccctattgttgacaattgtgatgctcctagtatggaagatcagtatctggtggattgttgcattctttgttgtttttatgtcatctgagtcaatttatctatctgctatcctatatcgatttgcgcatggggcatatgtgcctgtggcaatgtcagcattcctgatggtggtgatggttgtatggcattatgtgcatgtgaagaaatacaactttgagctcgagcactctgtgccccgtgacaaagtgaaagaactccttgagcgccgtgacatacagagagtaccagggattggcctcttctatactgagttggttcaaggcataccccctgtgttccgtcatctcatcgagaagatcccttccatccattcagtgctcattttcgtctcaatgaagcacttaccaattccatctgtcgacatgtcagagcgctttctctttagacaggtagacagagaagactataaggtattccaatgtgtggcacggtatgggtaccgagacccctttgaggaggccaaggacttcgttgataaacttgtagagcatcttcagtactacatccgggatgtcaacctctatggtgtgggttgtgagccaatgatgaagcagtcctctagctaccgcagttcccgtgctgagagctttagcagccatgaaaaaaccaaagtaaaggcagtctatgctgaggagatgctcacaccagcagagtcattttcggagcacgcaaggcaagctagtggaaagagcaagcattttgcacaatttcagggagacaagatgaatatagtagagatgctgaagattcagcaggagcaacaagctgtccttgaagagatgagtaaaggtgtggtgtacatatttggagagagtgaggtggtggcaagaccccattcctcactcattaagaagatagctgtcaactacttatactcttttcttagaaagaactcaagaaatggtgagaagatgctgtcaatcccccgtcgccagatcctaaaggtcggaatctcatatgaaatctaa

SEQ ID NO: 8924 - protein, 814 aa, Sorghum bicolor
  misc_feature: Ceres ANNOT ID no. 6094679
  misc_feature (67)..(814): Pfam Id: K_trans Pfam Desc: K+ potassium transporter
  misc_feature (1)..(814): NCBI GI: 75327937 NCBI Desc: probable potassium transporter 16 (oshak16)
  misc_feature (37)..(717): NCBI GI: 12862380 NCBI Desc: high-affinity potassium transporter [phragmites australis]
  misc_feature (37)..(713): NCBI GI: 12862382 NCBI Desc: high-affinity potassium transporter [phragmites australis]
  misc_feature (37)..(711): NCBI GI: 12862378 NCBI Desc: high-affinity potassium transporter [phragmites australis]
  misc_feature (37)..(725): NCBI GI: 12862384 NCBI Desc: high-affinity potassium transporter [phragmites australis]
  misc_feature: The sequence is a functional homolog of SEQ ID NO. 279 in the 11/188,298 US application
MASQQAADYRGSREEIVIVDLESEEAAVDDVDLPPATMQRQDSLYVAATRAAGANHHGQDSWARTLRLAFQCVGILYGDIGTSPLFVYSSTFRDGVGHPDDLLGALSLIIYSFLLFTVIKYVYIALRANDDGDGGTFALYTLISRHARVSLIPNQQVEDELVSKYNRDKPPATLQRAEWMKELLETNKTVKISLFLITMLATAMVISDAILTPAISVLSAVDGLKEKASFLTTDEIVWITVGILVVLFAIQRFGTDRVGYLFAPIILLWLLLIAGVGLYNLIKYDTGALRAFNMKYIIDYFRRNKKKGWVSLGGILLCFTGTEALFADLGYFSIKSIQLSFGFGLVPSVLLAYIGQAAYLRVHPEDVANTFYRSTPISLFWPTFILALAASIIGSQAMISCAFATISHSQTLGCFPRVKILHTSRQYSGQLYIPEVNYLLCLGACLVTIGFRTTVIIGEAHGICVVLVMIVTTLLLTIVMLLVWKISIWWIVAFFVVFMSSESIYLSAILYRFAHGAYVPVAMSAFLMVVMVVWHYVHVKKYNFELEHSVPRDKVKELLERRDIQRVPGIGLFYTELVQGIPPVFRHLIEKIPSIHSVLIFVSMKHLPIPSVDMSERFLFRQVDREDYKVFQCVARYGYRDPFEEAKDFVDKLVEHLQYYIRDVNLYGVGCEPMMKQSSSYRSSRAESFSSHEKTKVKAVYAEEMLTPAESFSEHARQASGKSKHFAQFQGDKMNIVEMLKIQQEQQAVLEEMSKGVVYIFGESEVVARPHSSLIKKIAVNYLYSFLRKNSRNGEKMLSIPRRQILKVGISYEI

SEQ ID NO: 8925 - DNA, 2433 bp, Sorghum bicolor
  misc_feature: Ceres ANNOT ID no. 6094684
  misc_feature: Encodes the peptide sequence at SEQ ID NO 8926
atggcacaacaagccggtgccggaggtggaggtggcctagagatggtggcacacagcggcgacctggagctggagctgccgccggtgaactggccgctacggcaggactcgctctaccgcgacgccacgaagccagcccacgccgccggccatcaccatggacggcaggagagctgggctcggacgctgcggctggcattccagtgcgtgggcatcatgtacgccgacctcggcacgtcgccgctctacgtctacgccaacaccttcaagtatggcgtcaagcatgaggacgacgtcctcggcgtgctgtccatcgtcatctacagcttcgtcctcttcaccatgatcaagatcgtcttcatcgcgctctacgccaacgacgagggtgatggtggaacgtttgctctgtactcgttgatctcgcggtacgccaagatctgcctgatcccaaatcaacaggacgaggacgagctcgtgctaagatacaagaatcaagcaaagccgtcagcgacgcgaaggagagctcagtggatgaagaacctcctggagacgagcaaggcagcaaaggttttgctcttctcccttaccatccttgccactgcgctggccatcagcgactgcatgctaaaccctccaatctcagttctagcggcggtcaatggtctcaagttgaaagcacctcatcgtctcacaaaagatgctgaggtatggatcacagttgggatcctagtagctctcttttctgtccagcgctttgggacagacaaaattggctacacatttgcaccagtcgttaccgtgtggcttatcctcatcggaggtattgggatctacaacgtcatcatgtatgatattggtaccttgagggctttcaacccgaaatatatcgtcgactattttcagaggaataaaaagaaaggatgggtctcattgggtgaaattctactttgcgtcacaggcacagaagctctttttgctgatctcgggtacttcagcatcagatcgatccagctgagctccaccttcggcttattaccatcagtattgctcacctatattgggcaagcagcatacctgaggaaacacatggacatgcctgacatatctaatgttttcttcaattcggttccaagctctttgttttggccaactttcatcctcgcactcattgcgtcagtcattggaagtcaagctatgatctcgtgtgccttcgcaaccatgtcacatttacaagcacttaactgtttcccacgggtcaagatattgcgtacatcagggcattattggggccaaatgtatatccctgaagtaaacatcttcctatgcatatctgcttgcctagtgacaataagcttcaagacaactggtttcattgcaagggcacatgaaatttgtgtggtccttgtgatggtcatcacaacattcttgatgacaatagtgatgctccttgtatggaaggtaaacatttggtggattgtcatcttcttcatggtcttcatgtccacagaattggtctacacagctgcagttctatataagttcatccatgggccttacctgtcattagccatgtcagcagttcttatgacaattatgattgtgtggcactatgtgcatgtgaagcgttacaaatatgagcttgagcatactgtatcacgtgataaggtgaaggatatccttgagcatcaggatctaaagagggttccaggttttgggctcatctacactgagctagtgcaaggcataccaccaatatttcctcacctcatagagaaaatccctaccattcattcagtgattgtcttcatcactgtgaagcatttgccaattccacatgtcgatgtctctgagcgtttcctattccgacaagtagaacctaaagagctcatggtgttccgttgtgtggcccgatatgggtaccttgacacgcttgaaatggccactgaatttgtcaaaatcttagttgagtacctccaatactatatcagggacatcaacctctatgcattaggtgatccattgaggattagcaattatagcactcgaattgacagtttttctagggagaagccctctggacatgctatctatgccgaagaaatgcttacaccgattcagtccttttcagagctcacaatgcatccagttggtatgagcaatatcctaacacatctccagacaggaaaactaaatgtggaggagatgataaagattgaagaagaccaaaacatggtcgaacgtgaggtagacaatggtgtagtttatattcttggggagactgaagttgtagccaagccgcactcaaatctattaaagaagataatcgtgaactatatatatagcttcctaaggaaaaattcaaggaatggtgagaagatgctatcaattccacgcggccaactactaaaggttgggataacatatgagatatag

SEQ ID NO: 8926 - protein, 810 aa, Sorghum bicolor
  misc_feature: Ceres ANNOT ID no. 6094684
  misc_feature (64)..(810): Pfam Id: K_trans Pfam Desc: K+ potassium transporter
  misc_feature (1)..(810): NCBI GI: 75327937 NCBI Desc: probable potassium transporter 16 (oshak16)
  misc_feature (34)..(810): NCBI GI: 12862380 NCBI Desc: high-affinity potassium transporter [phragmites australis]
  misc_feature (34)..(810): NCBI GI: 12862378 NCBI Desc: high-affinity potassium transporter [phragmites australis]
  misc_feature (34)..(810): NCBI GI: 12862382 NCBI Desc: high-affinity potassium transporter [phragmites australis]
  misc_feature (34)..(810): NCBI GI: 12862384 NCBI Desc: high-affinity potassium transporter [phragmites australis]
  misc_feature: The sequence is a functional homolog of SEQ ID NO. 279 in the 11/188,298 US application
MAQQAGAGGGGGLEMVAHSGDLELELPPVNWPLRQDSLYRDATKPAHAAGHHHGRQESWARTLRLAFQCVGIMYADLGTSPLYVYANTFKYGVKHEDDVLGVLSIVIYSFVLFTMIKIVFIALYANDEGDGGTFALYSLISRYAKICLIPNQQDEDELVLRYKNQAKPSATRRRAQWMKNLLETSKAAKVLLFSLTILATALAISDCMLNPPISVLAAVNGLKLKAPHRLTKDAEVWITVGILVALFSVQRFGTDKIGYTFAPVVTVWLILIGGIGIYNVIMYDIGTLRAFNPKYIVDYFQRNKKKGWVSLGEILLCVTGTEALFADLGYFSIRSIQLSSTFGLLPSVLLTYIGQAAYLRKHMDMPDISNVFFNSVPSSLFWPTFILALIASVIGSQAMISCAFATMSHLQALNCFPRVKILRTSGHYWGQMYIPEVNIFLCISACLVTISFKTTGFIARAHEICVVLVMVITTFLMTIVMLLVWKVNIWWIVIFFMVFMSTELVYTAAVLYKFIHGPYLSLAMSAVLMTIMIVWHYVHVKRYKYELEHTVSRDKVKDILEHQDLKRVPGFGLIYTELVQGIPPIFPHLIEKIPTIHSVIVFITVKHLPIPHVDVSERFLFRQVEPKELMVFRCVARYGYLDTLEMATEFVKILVEYLQYYIRDINLYALGDPLRISNYSTRIDSFSREKPSGHAIYAEEMLTPIQSFSELTMHPVGMSNILTHLQTGKLNVEEMIKIEEDQNMVEREVDNGVVYILGETEVVAKPHSNLLKKIIVNYIYSFLRKNSRNGEKMLSIPRGQLLKVGITYEI

SEQ ID NO: 8927 - DNA, 2454 bp, Sorghum bicolor
  misc_feature: Ceres ANNOT ID no. 6094686
  misc_feature: Encodes the peptide sequence at SEQ ID NO 8928
atggcacatcagcatggttctgccgccggcggccggggtggtggtagcatggagatcgttccctacagcttcagcagcggccgcgacctggagctggagctgccgccgtttgacgtgaagcgccaggactcgctctaccgcgacgccaccatgccagcgcacgccgcccaccacggacaggagagctgggttcggacgctacggctggcgttccagtgcgtgggcatcctgtacgccgacctcggcacgtcgccgctctacgtgtacgccaacaccttcaaggacggcgtccaccacgaggacgacgtcctcggcgtgctgtccatcatcatctacagcttcatcctcttcaccatgatcaagatcgtcttcgtcgcgctctacgccaacgatgacggtgacggtggtacgtttgcgctctactcgttgatctcgcggtacgccaaggtgtgcctcatcccaaaccagcaggcagaagatgagctcgtgtcgaggtacaagcaccgcggcaagccgtcggcgacgctccggagagctcagtggatgaagaacctgctggagacgagcaaggcagcaaagatctcactcttcttcctcaccatccttgccacggcactggccatcagcgactccatgctaacccctccgatatcagtacttgcggctgtcaacggactcaagttgagagcacctcatctgactacagatgcaacggtgtggatcacggtggccattttggtggttttcttttcggtccagcgttttgggaccgacaaaattggttacacatttgcaccggtggtttttgtgtggctcctcctcatctccggcatcggcatctataacacagtaaagtacgacattagcacattaaaggctttcaatgccaaatatatcatcgactatttccgaaggaacaaaaagaaaggatgggtctcattgggtgaaattcttctttgtttcacaggcactgaagctctttttgctgatctgggatacttcagcatcagatctatacagctaagcttcagcttcggcttattaccttcagtgttcttcacatatattgggcaagcagcgtacctgaggaaacacatggacaggcctgagatcatacctaatgttttcttcgaatcgattccaacgtctttgttttggccaactttcatcctagctctcattacatcagtcattggaagccaggctatggtctcgtgtgcctttgcaaccatgtcccatttacaggcgctcaactgtttcccaagggttaagatactgcatacatctaggcgatattcaggccagctgtacagccctgaagtgaacatcttcctctgcattgcagcttgtattgtaaccataagcttcaggacaactggtttcatagccaaagcacatgaaatttgtgtggtccttgtgatggtgatcacaactctcttgatgacaatagtgatgctcctcgtgtggaaggtaaacatctggtggatagccatattcttcgttgtcttcatgtcaacggagtccatctacacagctgcagtcctatataagttcacccatggaccctatgtgccagtggccatgtcagcagttctcatgttcatcatgattgtgtggcactacgtgcatgtcaagcggtacaagtatgagcttgagcacaccgtgtcacgagacgaggcaaaagatctccttgagcgccgggacctaaagagagttccaggcctagggcttttctacacagaactagtgcagggaataccacctattttccctcacctcattgagaagatccctaccatccactcagtgattgtcttcatcacggtgaagaatttgccgatagcccatgttgatgtcacggagcgcttcctcttccgccaagtggagcccaaagagttcatggtgttccgttgtgtggcaagatatgggtaccgtgacacactcgaaacggctggtgattttgttaaaattcttgttgagtacctccagtactatgttagggacttaaatctctatggagttggtggtgatgagccattgaagattatcttccatagtgctcgggtggacagcttttcttgggagaggaagccctcaggacatgccgtctatgctgaagagatgcttacaccggcccaatccttctcggagctcacaatgcatccagtctccatgagcagtagattggcacatttccagacagggaaaatgaacctggaggagatgttgaagattgaggaggatcaaaagataatccaacgcgaggtggacaatggtgttgtttatataattggcgagagtgaagtagtagccaagcctcattcaaatttgttcaagaagattattgtcaactacgtctatagcttcctaaggaaaaactcaaggaatggagagaagatgctatccattccaagaggccaactactaaaggttggaataacatatgagatctag

SEQ ID NO: 8928 - protein, 817 aa, Sorghum bicolor
  misc_feature: Ceres ANNOT ID no. 6094686
  misc_feature (68)..(817): Pfam Id: K_trans Pfam Desc: K+ potassium transporter
  misc_feature (1)..(817): NCBI GI: 75327937 NCBI Desc: probable potassium transporter 16 (oshak16)
  misc_feature (39)..(714): NCBI GI: 12862380 NCBI Desc: high-affinity potassium transporter [phragmites australis]
  misc_feature (39)..(714): NCBI GI: 12862378 NCBI Desc: high-affinity potassium transporter [phragmites australis]
  misc_feature (39)..(716): NCBI GI: 12862382 NCBI Desc: high-affinity potassium transporter [phragmites australis]
  misc_feature (39)..(714): NCBI GI: 12862384 NCBI Desc: high-affinity potassium transporter [phragmites australis]
  misc_feature: The sequence is a functional homolog of SEQ ID NO. 279 in the 11/188,298 US application
MAHQHGSAAGGRGGGSMEIVPYSFSSGRDLELELPPFDVKRQDSLYRDATMPAHAAHHGQESWVRTLRLAFQCVGILYADLGTSPLYVYANTFKDGVHHEDDVLGVLSIIIYSFILFTMIKIVFVALYANDDGDGGTFALYSLISRYAKVCLIPNQQAEDELVSRYKHRGKPSATLRRAQWMKNLLETSKAAKISLFFLTILATALAISDSMLTPPISVLAAVNGLKLRAPHLTTDATVWITVAILVVFFSVQRFGTDKIGYTFAPVVFVWLLLISGIGIYNTVKYDISTLKAFNAKYIIDYFRRNKKKGWVSLGEILLCFTGTEALFADLGYFSIRSIQLSFSFGLLPSVFFTYIGQAAYLRKHMDRPEIIPNVFFESIPTSLFWPTFILALITSVIGSQAMVSCAFATMSHLQALNCFPRVKILHTSRRYSGQLYSPEVNIFLCIAACIVTISFRTTGFIAKAHEICVVLVMVITTLLMTIVMLLVWKVNIWWIAIFFVVFMSTESIYTAAVLYKFTHGPYVPVAMSAVLMFIMIVWHYVHVKRYKYELEHTVSRDEAKDLLERRDLKRVPGLGLFYTELVQGIPPIFPHLIEKIPTIHSVIVFITVKNLPIAHVDVTERFLFRQVEPKEFMVFRCVARYGYRDTLETAGDFVKILVEYLQYYVRDLNLYGVGGDEPLKIIFHSARVDSFSWERKPSGHAVYAEEMLTPAQSFSELTMHPVSMSSRLAHFQTGKMNLEEMLKIEEDQKIIQREVDNGVVYIIGESEVVAKPHSNLFKKIIVNYVYSFLRKNSRNGEKMLSIPRGQLLKVGITYEI

SEQ ID NO: 8929 - DNA, 1422 bp, Sorghum bicolor
  misc_feature: Ceres ANNOT ID no. 6094689
  misc_feature: Encodes the peptide sequence at SEQ ID NO 8930
atggaaccgcaggaggaggaccggacgcggctgctcccggacgacgtgctggcagacgtactgagccgcctcgcgccgcgcggcctggccacgtcccgctgcgtctgcgcggcgtggcgcgcggtcatcgacggccgcggcctgctgcgcgcggacctcctcccgccgagctcgctggccggcctcttcatcaactacggcggcgactgccggttttcatgcacggggatcctgttctcacgcccgtcgtccgcgacgacgtcgacggaggtcaccaccagctaccgcatgccttacacttacgtacaagaccactgcaacggcctcctcctcctacacggcgccgtggtcaacccggcgacggggcggcgcgcgccgctgcccgagtgcccgcctcttccgacggcgatggagcgtttttaccgagaaatgtaccttgtcttcgacccggcagcggccacgccatcggcggagcagtacgaggtggtgtcgatcccccgtcctcctgatcctgacagggacgacgacgacgagctcgaaaagaagatcatcatcagacctaggtggcccgtccgtggtcccacgaccaggcgcctggagagatccttgctgcgatcggagtggccgccgtcgccatacgttctggatgtcttctcgtccacaacggggagatgggagaagagatccttcacccgggacggcgaggctgctggaaccaccctcgctgacctgcagctggaatataggtgggtgccatgtcgccggagcgtgtattggcggggggcgctatacgttcattgcgaaaatgacttcgttatgaggatatctatgtcaaataatacgtaccatataatcaaaccgccaagggaagtatctgatagatgtggagagatttatcttcatctaggaaggtctgaaaaaggagtctactctgcactatatgattctgatgagagcaagcttcaggtctggatccttgaggagtcgtcgcgcggtgtgatggagtggatattgaggcacgaaagtagtccagggcttttgcaagcaagtttaaactgtagaagacagaagcacgggccatggattttacgtggcctttacaatcgtcaacgcaaggaaccagtacaacatagtacgttcgatgagtggaattctgatgacgacgacagtgttctcaacgttggagatggtagcaccaaccagtactgctctggatgtctagacatcctcggattccatccgtacaaagagattgtcttcttgcacacatcgcgattggacagaggattggcgtatcatttgaagacatccaaactcgaggatttgggtgacttgtaccctcctcgttcaaatgcttctaggatagattcgtgtgttccgtatacaccttgcttggcaggagaactgcctgaaagtttataa

SEQ ID NO: 8930 - protein, 473 aa, Sorghum bicolor
  misc_feature: Ceres ANNOT ID no. 6094689
  misc_feature (7)..(54): Pfam Id: F-box Pfam Desc: F-box domain
  misc_feature (182)..(442): NCBI GI: 53370641 NCBI Desc: f-box domain containing protein [oryza sativa (japonica cultivar-group)]
  misc_feature (198)..(447): NCBI GI: 115456876 NCBI Desc: os04g0113000 [oryza sativa (japonica cultivar-group)]
  misc_feature (198)..(447): NCBI GI: 116308824 NCBI Desc: osigba0112g01.1 [oryza sativa (indica cultivar-group)]
  misc_feature (206)..(439): NCBI GI: 50508587 NCBI Desc: protein with f-box domain-like [oryza sativa (japonica cultivar-group)]
  misc_feature (207)..(366): NCBI GI: 115440773 NCBI Desc: os01g0824700 [oryza sativa (japonica cultivar-group)]
  misc_feature: The sequence is a functional homolog of SEQ ID NO. 456 in the 11/188,298 US application
MEPQEEDRTRLLPDDVLADVLSRLAPRGLATSRCVCAAWRAVIDGRGLLRADLLPPSSLAGLFINYGGDCRFSCTGILFSRPSSATTSTEVTTSYRMPYTYVQDHCNGLLLLHGAVVNPATGRRAPLPECPPLPTAMERFYREMYLVFDPAAATPSAEQYEVVSIPRPPDPDRDDDDELEKKIIIRPRWPVRGPTTRRLERSLLRSEWPPSPYVLDVFSSTTGRWEKRSFTRDGEAAGTTLADLQLEYRWVPCRRSVYWRGALYVHCENDFVMRISMSNNTYHIIKPPREVSDRCGEIYLHLGRSEKGVYSALYDSDESKLQVWILEESSRGVMEWILRHESSPGLLQASLNCRRQKHGPWILRGLYNRQRKEPVQHSTFDEWNSDDDDSVLNVGDGSTNQYCSGCLDILGFHPYKEIVFLHTSRLDRGLAYHLKTSKLEDLGDLYPPRSNASRIDSCVPYTPCLAGELPESL

SEQ ID NO: 8931 - DNA, 2487 bp, Sorghum bicolor
  misc_feature: Ceres ANNOT ID no. 6094695
  misc_feature: Encodes the peptide sequence at SEQ ID NO 8932
atggttctcgctgccgagagctcgaggggtagagaatatggcggtgaccggccggcggaggtcgtcgtcgtcgacatcgagagcggcggcggcagcctggatggagcgtcgtcgtcgtccatcgtggataggcaggactcgctgttccgggaggcggtgacgggtcatcaccgccgtgctgccggcggcgcagggcactctgatcatgatagctgggggacgacgctgcggctggcgttccagtgcgtgggcatcctgtacggcgacgtcggcacgtcgccgctgtatgtctactccaccaccttcggccacggcggcgacggcggcggcgttggccaccctgacgacatcctcggggtgctctccctcatcatctacagcttcgtgctcttcaccgtcatcaagatcgtcgtggttgcgctccacgccaacgatgacggggatggaggaacgtttgcactctactctttgatttcgagatacgccaaggtgagtctgctcccaaaccatcaggctgaagatgagctggtctccagctacagcaccaaccttgggaagccgtcggccacactaaggagagctcattggctgaagcatttgcttgagacaagcaagtcggcgaagatctccctgtttctccttaccatccttgcaattgcgatggtcatcagcgatgctgttttaactcctcctatttcggtgctctcagctgtcagtggcctgaaggaaaaggtgcctgatttgaccacagatcaaatagtctggatcaccgtggcaattttggtagttctgtttgctatccaacgcttcggaaccgacaaagttggctacttgttcgcaccaatcatcctgctgtggttgcttctcattggaggagtcgggctctataacctgatcaaatatgatgtcggtgtattgaggtccttcaacccaaaatacatcattgactatttcaggagaaacaagaaggaaggatgggtctcacttggtgatattctccttgtttttacaggaacagaagctctttttgctaatctgggatacttcagcattagatccattcagttaagctttagccttggactactgccatctgtattgcttacttacatcggacaagcagcatacctaaggaagcaccccgaacattttgctaacactttctttagatcaactccaagcgctctgttctggccgacgtttatcttggcaattgcggcatccatcataggaagccaagcaatgatctcatgtgcgtttgcaactgtttcacatttacaaacactcagttgcttcccgagggttaggatactgcacacgtcaaagcggtttcatggacagctgtatgttcctgaagtcaatttactgctttgcatagctgcttgcgtcgtgactgtcagtttcaagacaacgaccattatcggaaaagcccatgaaatctgtgtcatccttgtgatgctcatcacgacactgctgatgacaatcgtgatgctcttggtgtggaaaatcaatatctggtggattgcgctcttcttcatcgtcttcgttccgaccgagtccatctacctatcatctgtgctatacaagttcactcatggaccatacatacccgtggccatgtcagcagttctaatggtggtgatgattgtttggcattacgtgcacgtcaaacggtacaaatatgagctgaagcacaccttatcccctgccaaggctgaaaagctgcttgagaagagcgatctgaagaggatcccaggagttgggctcttctacactgagctagtgcaaggcatcccacccatattccctcacctcatggagaaggtcccggcgattcactcggtcctgatcttcgtctccatcaagcacttacatgttccccatgtcgacgcctccgaacgcttcctcttccgacaagtagagcccaaggagtacaaagtatttcgatgcgtggcgcggtatgggtaccgggactccattggtgaggaggcagaagattttgtcctagcactggttgagagcctccagtactacatacgagatgtcaacctctactcagtggatgagatgcagaatgttagctacccgatttctcgagatcagagcttgtctcgggacaagccttctggaaggcatgccatctatgctgaggagatgattacgccgatccaatcgttctccgagctcacaacactgccaaatggttggagcaatcgtctaccacagtttcaggcatcaaagatgaatattgaggagttagccaagattgaggaggaacagaaggtgattcaaagagaagcagagaaaggtgtggtgtacattattggagaggctgaggtagtggcaaggcctcagtcctcgctccttaagaagattgtgatcaactacatatactccttcctaaggaaaaacttcatgcaaggagagaagatgttatcgattccacatggcaagctactgaaagttggaatctcatatgaaatctag

SEQ ID NO: 8932 - protein, 828 aa, Sorghum bicolor
  misc_feature: Ceres ANNOT ID no. 6094695
  misc_feature (77)..(828): Pfam Id: K_trans Pfam Desc: K+ potassium transporter
  misc_feature (20)..(828): NCBI GI: 75327937 NCBI Desc: probable potassium transporter 16 (oshak16)
  misc_feature (24)..(828): NCBI GI: 12862380 NCBI Desc: high-affinity potassium transporter [phragmites australis]
  misc_feature (24)..(828): NCBI GI: 12862378 NCBI Desc: high-affinity potassium transporter [phragmites australis]
  misc_feature (24)..(828): NCBI GI: 12862384 NCBI Desc: high-affinity potassium transporter [phragmites australis]
  misc_feature (24)..(828): NCBI GI: 115458178 NCBI Desc: os04g0401700 [oryza sativa (japonica cultivar-group)]
  misc_feature: The sequence is a functional homolog of SEQ ID NO. 279 in the 11/188,298 US application
MVLAAESSRGREYGGDRPAEVVVVDIESGGGSLDGASSSSIVDRQDSLFREAVTGHHRRAAGGAGHSDHDSWGTTLRLAFQCVGILYGDVGTSPLYVYSTTFGHGGDGGGVGHPDDILGVLSLIIYSFVLFTVIKIVVVALHANDDGDGGTFALYSLISRYAKVSLLPNHQAEDELVSSYSTNLGKPSATLRRAHWLKHLLETSKSAKISLFLLTILAIAMVISDAVLTPPISVLSAVSGLKEKVPDLTTDQIVWITVAILVVLFAIQRFGTDKVGYLFAPIILLWLLLIGGVGLYNLIKYDVGVLRSFNPKYIIDYFRRNKKEGWVSLGDILLVFTGTEALFANLGYFSIRSIQLSFSLGLLPSVLLTYIGQAAYLRKHPEHFANTFFRSTPSALFWPTFILAIAASIIGSQAMISCAFATVSHLQTLSCFPRVRILHTSKRFHGQLYVPEVNLLLCIAACVVTVSFKTTTIIGKAHEICVILVMLITTLLMTIVMLLVWKINIWWIALFFIVFVPTESIYLSSVLYKFTHGPYIPVAMSAVLMVVMIVWHYVHVKRYKYELKHTLSPAKAEKLLEKSDLKRIPGVGLFYTELVQGIPPIFPHLMEKVPAIHSVLIFVSIKHLHVPHVDASERFLFRQVEPKEYKVFRCVARYGYRDSIGEEAEDFVLALVESLQYYIRDVNLYSVDEMQNVSYPISRDQSLSRDKPSGRHAIYAEEMITPIQSFSELTTLPNGWSNRLPQFQASKMNIEELAKIEEEQKVIQREAEKGVVYIIGEAEVVARPQSSLLKKIVINYIYSFLRKNFMQGEKMLSIPHGKLLKVGISYEI

SEQ ID NO: 8933 - DNA, 1230 bp, Sorghum bicolor
  misc_feature: Ceres ANNOT ID no. 6094696
  misc_feature: Encodes the peptide sequence at SEQ ID NO 8934
atgagcttcaacaagagcagcaggggtggcggcggactcggaggcgcagcaggaggaggagacgagctggtgctgcgaggctccatctccaagaaatggaccttgctcctctgcctcggcagcttctgcatcggcctcctcttcaccaacaggatgtggacgatgccggagccgaaagagatcatcaggaggtcgacactcgaggtggaaaagatgagccttgttgagggcgattgtgctccgaaaagcatcggtgacgcaaaagatgttcctggagaggttccaagaactcaagatgttatacagacactggacaaaacgatatcaaacctcgaaatggagcttgcgtctgcaaaggcgtcacaggagtccatgctcaatggtgccccaatgtccgaatccacagggaaacggaaatacttcatggtcattggcatcaacactgccttcagcagccggaagagaagagactcagtccgtgctacatggatgcctcaaggtgagagaaggagaaagatggaggaagagaagggcattatcattcgcttcgtcatcggtcatagtgcgactcctggcggcatacttgatcgagcaattgatgcagaggacaggaaacatgaggacttcatgaggctggaccatgttgaagggtacctggaactggcagcaaagaccaaagcgtacttcgtcgcagctgtgtccatgtgggatgcagagtactacatcaaggtcgacgacgatgtacatgtaaatatagcaactcttggaaacgtgctagcaagacatcgctccaagcctcgagcttacattggctgcatgaagtctggcccagtgctagctcagaagggcgtgaggtaccacgagcctgaatactggaaattcggagaatggggaaacaagtacttccgacacgcgaccggtcagctgtacgccatctccaaagatctggcctcctacatagcactcaaccagcatgttctgcacaaatatgctaatgaggatgtatccctgggatcctggttcatcggattggacgtcgaacacgtcgatgaccgtcgtctctgctgcggcactacaccagattgcgaatggaaggcgcaggcggggaacgtctgcgctgcgtcgttcgactggagctgcagtggcatctgcaaatctgctgatcggatcaaggaagtccatcagcgttgcggtgagagtgagaatgcgatttggaatgcaaagttttaa

SEQ ID NO: 8934 - protein, 409 aa, Sorghum bicolor
  misc_feature: Ceres ANNOT ID no. 6094696
  misc_feature (154)..(352): Pfam Id: Galactosyl_T Pfam Desc: Galactosyltransferase
  misc_feature (26)..(409): NCBI GI: 21360399 NCBI Desc: at1g05170/yup8h12_22 [arabidopsis thaliana]
  misc_feature (26)..(409): NCBI GI: 145323746 NCBI Desc: galactosyltransferase family protein [arabidopsis thaliana]
  misc_feature (29)..(409): NCBI GI: 21553519 NCBI Desc: avr9 elicitor response-like protein [arabidopsis thaliana]
  misc_feature (29)..(409): NCBI GI: 7269547 NCBI Desc: avr9 elicitor response like protein [arabidopsis thaliana]
  misc_feature (30)..(398): NCBI GI: 115446789 NCBI Desc: os02g0566800 [oryza sativa (japonica cultivar-group)]
  misc_feature: Useful for making plants with altered carbohydrate content
  misc_feature: Functional homolog of the protein sequence given in SEQ ID NO 14035
MSFNKSSRGGGGLGGAAGGGDELVLRGSISKKWTLLLCLGSFCIGLLFTNRMWTMPEPKEIIRRSTLEVEKMSLVEGDCAPKSIGDAKDVPGEVPRTQDVIQTLDKTISNLEMELASAKASQESMLNGAPMSESTGKRKYFMVIGINTAFSSRKRRDSVRATWMPQGERRRKMEEEKGIIIRFVIGHSATPGGILDRAIDAEDRKHEDFMRLDHVEGYLELAAKTKAYFVAAVSMWDAEYYIKVDDDVHVNIATLGNVLARHRSKPRAYIGCMKSGPVLAQKGVRYHEPEYWKFGEWGNKYFRHATGQLYAISKDLASYIALNQHVLHKYANEDVSLGSWFIGLDVEHVDDRRLCCGTTPDCEWKAQAGNVCAASFDWSCSGICKSADRIKEVHQRCGESENAIWNAKF

SEQ ID NO: 8935 - DNA, 1107 bp, Sorghum bicolor
  misc_feature: Ceres ANNOT ID no. 6094728
  misc_feature: Encodes the peptide sequence at SEQ ID NO 8936
atggttcctcctaagcgcaccgcgatctggattggccttcttctctgcctatcttccctgtccgattccgtgcagggtggcagggtcccggggctgtacgtgctcggcgactcacagttggacgtcggtaacaacaactacttgcagacgacgatcagggcgaacttcccccacaacggcgtcgactacccggggcacctgcccaccggcaggttcagcaacggcaagaacttggccgacttcatcgctggaagtctcagtgtcgccacgcctcctgcatatcgctccatcggcaacttcacaggaaattcctcgatatttctcaacggcgtcaactttgcatccgggggtgcaggagtcttgaaacttacaagcaagggcctcaccatcagcttcgacgaacaaatcaagcgcgattactccatcgtaaatgcaggactggtgcagcagctcggcaagactcaggccttggcccacgcggagggatcgatcttcgccattggagtgggtggcaacgacatagccaatcgcatctccttagacgaccccgctgatgagcagaagctcctgacaagctccgactccaatcagcagttcatcgactcattggcgcattccttgaaacgccaacttcagaggctttacgagctgggaatgcgcaagttgttctttgtgggtacggggccacttgggtgctatccgttgctgcggcagggaagtgtcaccaaggaatgcaacgcggaggccaactctttgtcgatgcagtacaacaccggggttcagaaactcctgcgcgaaatgagcacgcggcaaccggactttcggtactccttcctggaccaatacgctgtgttgaagaagtacataaatgaaccacaagcaaatggctttgctgaagtggaagcggcgtgctgtgctctcggggacaaggatgccatgttgatatgcaccccggagagccaactctgctacagcaggacgaaccacatcttttgggacggcgcacatctcacggaggtcaccacgcagaagctcgtcgcggtcgccttcaacgggtctgcgccgctggttgctccagtaaatttgaggcagctcagcgctccatag

SEQ ID NO: 8936 - protein, 368 aa, Sorghum bicolor
  misc_feature: Ceres ANNOT ID no. 6094728
  misc_feature (32)..(349): Pfam Id: Lipase_GDSL Pfam Desc: GDSL-like Lipase/Acylhydrolase
  misc_feature (16)..(359): NCBI GI: 124360057 NCBI Desc: lipolytic enzyme, g-d-s-l [medicago truncatula]
  misc_feature (33)..(359): NCBI GI: 9757979 NCBI Desc: gdsl-motif lipase/hydrolase-like protein [arabidopsis thaliana]
  misc_feature (33)..(359): NCBI GI: 21537293 NCBI Desc: gdsl-motif lipase/hydrolase-like protein [arabidopsis thaliana]
  misc_feature (1)..(366): NCBI GI: 54291019 NCBI Desc: gdsl-lipase-like [oryza sativa (japonica cultivar-group)]
  misc_feature (29)..(365): NCBI GI: 144924855 NCBI Desc: lipolytic enzyme, g-d-s-l [medicago truncatula]
MVPPKRTAIWIGLLLCLSSLSDSVQGGRVPGLYVLGDSQLDVGNNNYLQTTIRANFPHNGVDYPGHLPTGRFSNGKNLADFIAGSLSVATPPAYRSIGNFTGNSSIFLNGVNFASGGAGVLKLTSKGLTISFDEQIKRDYSIVNAGLVQQLGKTQALAHAEGSIFAIGVGGNDIANRISLDDPADEQKLLTSSDSNQQFIDSLAHSLKRQLQRLYELGMRKLFFVGTGPLGCYPLLRQGSVTKECNAEANSLSMQYNTGVQKLLREMSTRQPDFRYSFLDQYAVLKKYINEPQANGFAEVEAACCALGDKDAMLICTPESQLCYSRTNHIFWDGAHLTEVTTQKLVAVAFNGSAPLVAPVNLRQLSAP

SEQ ID NO: 8937 - DNA, 954 bp, Sorghum bicolor
  misc_feature: Ceres ANNOT ID no. 6094742
  misc_feature: Encodes the peptide sequence at SEQ ID NO 8938
atggagcctcatcacgcaaacaagccaaagccaaagctgagcatgaagcattccaagttcatcttctgcaagctctacatttcagaaacccgcaatactatggctatggacacaatcgagcatgcaagcaagagtgatgctcaggttgttgtcgtcagccagttaggagatcatcactacaaccgcttccgctacacgcttgtctcctacatcgtcgatgacagctcaactggagaagtgatatatagcccaatcaggaaggtgttgctggcgatgattgaggctgcatttgcaaccataaaccttgaatcacagtcagggacgcatccaaggatcggtgtcgtcgatgacttgtccttccaccccgtgggtcaagccacaattgaggatgctgcttctttggctaagcaggtagcatctgacattggaaatggcttacaagtcccagtgttcctgtatgcagcagcccacccaacaggaaagtctgtgggtgcaattcggcgtgagcttggctactaccgtccaaattacaaggaaaaccagtggttaggtagcgtactccctgatgttctgccagttaagcctgatgtgggtccaactcatgtctcacataagagaggtgccacaacagttggcgttacgccttggattgagggctacaatatcccagtactgtctaaggatgtcccagctgtgaggaggattacccgcagggtgactggacggagtggagggcttccaacggtgcaagctcttgcactcttccatggagatgattgcacagagattgcatgcttgttggatccagatcatgtcagtgcctatcaagttcagaccgtggtggagcagattgcaggagagcaaggacttgaagttgagcaggggtactacactgacataaccaaggatgcagcgctcgataagtatttgaagattgcttgcactgatgattga

SEQ ID NO: 8938 - protein, 317 aa, Sorghum bicolor
  misc_feature: Ceres ANNOT ID no. 6094742
  misc_feature (19)..(215): Pfam Id: FTCD_N Pfam Desc: Formiminotransferase domain, N-terminal subdomain
  misc_feature (130)..(317): NCBI GI: 24413963 NCBI Desc: formiminotransferase-cyclodeaminase-like [oryza sativa (japonica cultivar-group)]
  misc_feature (28)..(307): NCBI GI: 113939467 NCBI Desc: formiminotransferase-like [herpetosiphon aurantiacus atcc 23779]
  misc_feature (18)..(312): NCBI GI: 20806959 NCBI Desc: glutamate formiminotransferase [thermoanaerobacter tengcongensis]
  misc_feature (28)..(254): NCBI GI: 51894327 NCBI Desc: glutamate formiminotransferase [symbiobacterium thermophilum iam 14863]
  misc_feature (19)..(312): NCBI GI: 76587594 NCBI Desc: formiminotransferase [thermoanaerobacter ethanolicus atcc 33223]
MEPHHANKPKPKLSMKHSKFIFCKLYISETRNTMAMDTIEHASKSDAQVVVVSQLGDHHYNRFRYTLVSYIVDDSSTGEVIYSPIRKVLLAMIEAAFATINLESQSGTHPRIGVVDDLSFHPVGQATIEDAASLAKQVASDIGNGLQVPVFLYAAAHPTGKSVGAIRRELGYYRPNYKENQWLGSVLPDVLPVKPDVGPTHVSHKRGATTVGVTPWIEGYNIPVLSKDVPAVRRITRRVTGRSGGLPTVQALALFHGDDCTEIACLLDPDHVSAYQVQTVVEQIAGEQGLEVEQGYYTDITKDAALDKYLKIACTDD

SEQ ID NO: 8939 - DNA, 1881 bp, Sorghum bicolor
  misc_feature: Ceres ANNOT ID no. 6094744
  misc_feature: Encodes the peptide sequence at SEQ ID NO 8940
atgggaagtcttgagtattgcgagataaactcaaatacaactcttgactacataaaccgactgttaatggaggagggcactgatgagaaggcaagcatataccaacgacatgatgcacttcaggccatggagaagccattttatgatattcttggacaagcatatccatcttcacctacggaggcaatgatcagtagagataaccaagtagattgtccccaagacaattatagtgaacagacatgcagtggtagttttttcactgagaatcttgggccacaaggtatgcacctggtagccaatgactgggcttctgaatgtgaccatttgtctttgcaatttgagagaggtgctgaggaagcaaataagtttgtccccattattgtgcaattggttgatctggacagtaatggccttcctgattccaatcaaatgacaaaggcaacaattggacaaaagggcaagcatgtaagcaaaatacagagtcatccacatgtggacttggagtttttggaagcaaggagcagtaagcatttggccatctcggttagcgaaacaacccgggatgaaatgtttgacagtgttctgctctgtgattggcagttccattgtgatgctgctcatcttagagaaattaaggcaaaagaagcaaacaacagttcacagaatgtttggagaaaaggttatggccaagggcagatgaagtcacaaggtaagaagaaagaggaggggattgacctcagggatcatctcatgcagtgtgcacaagcaatagtagtaaacaaccttccatttgccagtgagctactgaagaagataaggcgtcacgcttcaccatatggagatggctctcagaggctggcactttactttgcaaatggtcttgaggcacgcttggccgggacagggagtcagatgtatcaaaaactgatggagaaacgaacaagagccaccgacatgttaaaggcctaccgccttttcaatgcagtgtgccctttcgctagggtagcatactacttctccaaccaaacaattgctgacctattgaacgggcgaccaaaggtgcatatcattgattttggcatcacactcggctttcagtggccatcattaatccagcgttttgccaagcaagaaggtggccccccaaagcttcgtatcacaggaatagatgtacctcagccaggttttcgcccctgtgcaataattgaggcgacaggaaaacgcttggctgagtatgcagaaatgttcaatgtgccttttgaataccaagggatcgcctcacaatgggaagatatctgcatcgagaatctcaatattgacaatgatgaggtgcttatagtcaactgcatgtacagaacaaaatatcttggtgatgagacagaagacatagatagtgcaagggatagggtactgcgtaccatgaacaggatcaacccagaggttttcattcttggcattgcgaatgggatgtacaacaacccattcttcctgccacgattcagagaggttctgttccattattctgcgctgtttgacatgctcgatgcaactgctctccggagtgacgaagatagggtacagatagaaagggatctgttcggggcaagtgcacttaacgttgtagcgtgtgaaggtgcagaaaggattgagaggccagagacttacaaacagtggcaagtgagatgtctcaaggctgggttcaagcaacttcctgttgataaagcaatcctgaagagatcaatagatgaaaaagacaagcattatcatgaagactttgtcatcgatgaagatagcagatggctgctacaaggatggaaggggaggataatgcatgcagtgtcctcgtggaaaccgaaagaatcatacactaatcagtaa

SEQ ID NO: 8940 - protein, 626 aa, Sorghum bicolor
  misc_feature: Ceres ANNOT ID no. 6094744
  misc_feature (222)..(527): Pfam Id: GRAS Pfam Desc: GRAS family transcription factor
  misc_feature (73)..(619): NCBI GI: 32813435 NCBI Desc: scarecrow-like protein [lilium longiflorum]
  misc_feature (161)..(619): NCBI GI: 125743148 NCBI Desc: scarecrow-like protein 1 [castanea sativa]
  misc_feature (159)..(619): NCBI GI: 125743130 NCBI Desc: scarecrow-like protein 1 [pinus radiata]
  misc_feature (167)..(622): NCBI GI: 15222433 NCBI Desc: scarecrow-like transcription factor 14 (scl14) [arabidopsis thaliana]
  misc_feature (167)..(611): NCBI GI: 8778540 NCBI Desc: f22g5.9 [arabidopsis thaliana]
  misc_feature: The sequence is a functional homolog of SEQ ID NO 1327 in the 10/374,780US patent application
  misc_feature: Useful for making plants with modulated growth and phenotype characteristics
  misc_feature: The sequence is a functional homolog of SEQ ID NO 1327 in the 20060162006 US patent application
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
MGSLEYCEINSNTTLDYINRLLMEEGTDEKASIYQRHDALQAMEKPFYDILGQAYPSSPTEAMISRDNQVDCPQDNYSEQTCSGSFFTENLGPQGMHLVANDWASECDHLSLQFERGAEEANKFVPIIVQLVDLDSNGLPDSNQMTKATIGQKGKHVSKIQSHPHVDLEFLEARSSKHLAISVSETTRDEMFDSVLLCDWQFHCDAAHLREIKAKEANNSSQNVWRKGYGQGQMKSQGKKKEEGIDLRDHLMQCAQAIVVNNLPFASELLKKIRRHASPYGDGSQRLALYFANGLEARLAGTGSQMYQKLMEKRTRATDMLKAYRLFNAVCPFARVAYYFSNQTIADLLNGRPKVHIIDFGITLGFQWPSLIQRFAKQEGGPPKLRITGIDVPQPGFRPCAIIEATGKRLAEYAEMFNVPFEYQGIASQWEDICIENLNIDNDEVLIVNCMYRTKYLGDETEDIDSARDRVLRTMNRINPEVFILGIANGMYNNPFFLPRFREVLFHYSALFDMLDATALRSDEDRVQIERDLFGASALNVVACEGAERIERPETYKQWQVRCLKAGFKQLPVDKAILKRSIDEKDKHYHEDFVIDEDSRWLLQGWKGRIMHAVSSWKPKESYTNQ

SEQ ID NO: 8941 - DNA, 945 bp, Sorghum bicolor
  misc_feature: Ceres ANNOT ID no. 6094746
  misc_feature: Encodes the peptide sequence at SEQ ID NO 8942
atggcggggagatcgaagtacgacaaccccttcgaggagggcggcgccgacgaggtcaaccctttcgcggaccaagctaaaagaggaggatcaagtgctcagtccagctattctggtggcgcgttctacacgacgcagtcacaacgcccttctgctcctcctagcacacgcctttcgcctcttcctcctgaacctgctgacttctacaatgactttgctaccccagtggatatccccatggacacaaacaaggacatgaagacaagggagaaggagcttctggccaaggaggccgagttgaacaggcgtgagaaggaaataaaaaggcgagaagatgctgcagcacgagctggcattgtattggaagagaaaaattggccaccatttttccccatcattcataatgatattggcaacgagatacctgttcatctgcaaagaacactgtatgtcgcatttgcatcactcttagggttggtcttgtgcctgttttggaacataatctgtgttaccgctgcctgggcaaaagggtcaggtcctaagatatggtttcttgcaattatatacttcattcttggatgccccggtgcctactacctttggtaccggccactataccgtgcaatgaggaatgagagtgctcttaaatttggatggtttttcctcttctacttggttcatatcgccttctgcgtgtatgcagctgtttctccttcaattctctttgtggggaaatcattaaccgggattcttccagcaatcagcttgataggcgacagtgtcattgttgggatcttctacttcattggctttggattattctgcttggagtctttgttaagcatgtgggtcattcagcgtgtttacctgtacttccgaggaagcgggaaagaagcagagatgaggcgggaagcagcacgtggtgcagcgagggcagcattttga

SEQ ID NO: 8942 - protein, 314 aa, Sorghum bicolor
  misc_feature: Ceres ANNOT ID no. 6094746
  misc_feature (122)..(296): Pfam Id: SCAMP Pfam Desc: SCAMP family
  misc_feature (51)..(314): NCBI GI: 7109232 NCBI Desc: secretory carrier membrane protein [oryza sativa]
  misc_feature (55)..(313): NCBI GI: 3941289 NCBI Desc: similarity to scamp37 [pisum sativum]
  misc_feature (52)..(313): NCBI GI: 15220305 NCBI Desc: secretory carrier membrane protein (scamp) family protein [arabidopsis thaliana]
  misc_feature (62)..(295): NCBI GI: 115460268 NCBI Desc: os04g0595800 [oryza sativa (japonica cultivar-group)]
  misc_feature (106)..(286): NCBI GI: 32492338 NCBI Desc: osjnba0006a01.24 [oryza sativa (japonica cultivar-group)]
  misc_feature: Useful for biocontainment applications
  misc_feature: Functional homolog of the protein sequence given in SEQ ID NO 13043
MAGRSKYDNPFEEGGADEVNPFADQAKRGGSSAQSSYSGGAFYTTQSQRPSAPPSTRLSPLPPEPADFYNDFATPVDIPMDTNKDMKTREKELLAKEAELNRREKEIKRREDAAARAGIVLEEKNWPPFFPIIHNDIGNEIPVHLQRTLYVAFASLLGLVLCLFWNIICVTAAWAKGSGPKIWFLAIIYFILGCPGAYYLWYRPLYRAMRNESALKFGWFFLFYLVHIAFCVYAAVSPSILFVGKSLTGILPAISLIGDSVIVGIFYFIGFGLFCLESLLSMWVIQRVYLYFRGSGKEAEMRREAARGAARAAF

SEQ ID NO: 8943 - DNA, 849 bp, Sorghum bicolor
  misc_feature: Ceres ANNOT ID no. 6094747
  misc_feature: Encodes the peptide sequence at SEQ ID NO 8944
atggccggaaggtggaggcacgacgacaacccgttcgaggagagcgacggagacgtcgtcaaccccttctcgcatccacgtccaactccgctccctccagaaccagttggtttctacaatgacattggagcatctgtagatatcccacttgatgcaaaaaaggacctcaagaaaacggagagggaacttatggctaaagaggctgagctaaacaggagggaacaggaaataaaaagaagggaagaagctcttgcgagagctggagttataatagagcccaaaaactggccaccattcttccccatcattcatgttgacatttcaaatgatatacccgttcacttgcaacgagtacagtatgtttcttttgcatcactcctagggttggtcatatgcctcttctggaacattttatgtgtaactgctgcttgggttacagggcatgatcctaggatctggtttctggcagtcatatacttcattactggatgcccaggtgcctactttttatggtaccgacctctttatcgtgccatgagaaaggatagtgcgttcagctatggatggttcttcctattctacttttttcacattgccttctgcatatacgctgctgtttctccgccattcttttatgtgggaagatcattggctggaatttttcaatcgatcagcgagataggcgagaatgctggtgttgggataatgtacttcatgggcttcgcgatgtttgtgctggaggcactgctgagcatctgggttttccagaaagtgtactggttcttccgcgggaaaggaagcgaggcgcagatgaggcctgacaccgcgtctcgcgcgccaccgttctga

SEQ ID NO: 8944 - protein, 282 aa, Sorghum bicolor
  misc_feature: Ceres ANNOT ID no. 6094747
  misc_feature (92)..(266): Pfam Id: SCAMP Pfam Desc: SCAMP family
  misc_feature (1)..(279): NCBI GI: 7109232 NCBI Desc: secretory carrier membrane protein [oryza sativa]
  misc_feature (1)..(276): NCBI GI: 3941289 NCBI Desc: similarity to scamp37 [pisum sativum]
  misc_feature (6)..(279): NCBI GI: 15220305 NCBI Desc: secretory carrier membrane protein (scamp) family protein [arabidopsis thaliana]
  misc_feature (7)..(264): NCBI GI: 115460268 NCBI Desc: os04g0595800 [oryza sativa (japonica cultivar-group)]
  misc_feature (76)..(256): NCBI GI: 32492338 NCBI Desc: osjnba0006a01.24 [oryza sativa (japonica cultivar-group)]
  misc_feature: The plant produces a reduced number of seeds.
  misc_feature: Useful for biocontainment applications
  misc_feature: Functional homolog of the protein sequence given in SEQ ID NO 13043
  misc_feature: Useful for biocontainment applications
  misc_feature: Functional homolog of the protein sequence given in SEQ ID NO 13043
MAGRWRHDDNPFEESDGDVVNPFSHPRPTPLPPEPVGFYNDIGASVDIPLDAKKDLKKTERELMAKEAELNRREQEIKRREEALARAGVIIEPKNWPPFFPIIHVDISNDIPVHLQRVQYVSFASLLGLVICLFWNILCVTAAWVTGHDPRIWFLAVIYFITGCPGAYFLWYRPLYRAMRKDSAFSYGWFFLFYFFHIAFCIYAAVSPPFFYVGRSLAGIFQSISEIGENAGVGIMYFMGFAMFVLEALLSIWVFQKVYWFFRGKGSEAQMRPDTASRAPPF

SEQ ID NO: 8945 - DNA, 525 bp, Sorghum bicolor
  misc_feature: Ceres ANNOT ID no. 6094779
  misc_feature: Encodes the peptide sequence at SEQ ID NO 8946
atggcggacgaagattacaacgacgtcaacatggggttcgatctctccctcatccttcctcccctctctgttgcttgtctcgccagctacgaggacgagcccgaaccacctgagattgaggtgcagacacattactattgtttcatttgccttttatgctttatagaaggggatgaagaagagcttgagaacaacgaagatgcccctgatgaaatcataggtggagagggtgaagagaaagagcaggaaaagaccaagcgcgagcgcaaaacatcgaaatacatgacgaagtatgaacgtgcgcgcatcttgggtactcgagccttgcagataagcatgaatgctccagtcatggttgagcttgagggagaaactgaccctcttgagattgcgatgaaggagctgagagcacgcaagatacccttcacgatcagacggtacctacctgatggaagctatgaagactggggagtagacgagctcattgtggaggactcctggaaacgccaggttggtggagactga

SEQ ID NO: 8946 - protein, 174 aa, Sorghum bicolor
  misc_feature: Ceres ANNOT ID no. 6094779
  misc_feature (93)..(146): Pfam Id: RNA_pol_Rpb6 Pfam Desc: RNA polymerase Rpb6
  misc_feature (59)..(173): NCBI GI: 4960152 NCBI Desc: dna-directed rna polymerase iib [nicotiana tabacum]
  misc_feature (30)..(174): NCBI GI: 124360124 NCBI Desc: dna-directed rna polymerase, 14 to 18 kda subunit [medicago truncatula]
  misc_feature (55)..(165): NCBI GI: 50416676 NCBI Desc: polymerase (rna) ii (dna directed) polypeptide f [xenopus tropicalis]
  misc_feature (56)..(165): NCBI GI: 45382031 NCBI Desc: rna polymerase common subunit rpb6 [gallus gallus]
  misc_feature (58)..(165): NCBI GI: 53733956 NCBI Desc: polymerase ii [rattus norvegicus]
  misc_feature (58)..(165): SWISSPROT Homolog: EC 2.7.7.6 DNA-directed RNA polymerases I, II, and III 14.4 kDa polypeptide
MADEDYNDVNMGFDLSLILPPLSVACLASYEDEPEPPEIEVQTHYYCFICLLCFIEGDEEELENNEDAPDEIIGGEGEEKEQEKTKRERKTSKYMTKYERARILGTRALQISMNAPVMVELEGETDPLEIAMKELRARKIPFTIRRYLPDGSYEDWGVDELIVEDSWKRQVGGD

SEQ ID NO: 8947 - DNA, 1842 bp, Sorghum bicolor
  misc_feature: Ceres ANNOT ID no. 6094797
  misc_feature: Encodes the peptide sequence at SEQ ID NO 8948
atggcggacggcgcgggatcggcgtctggtctggaggagaagctcgcggggctctcaacgggcggcgacgcgcagaatcctccgccggcgggtgagggcggagaggagccgcagctctcgaagaacgcgaagaagagagaggagaagaggaagaagctggaagaggagcggaggctcaaggaggaagagaagaagaacaaggctgcggcagctgctgccagtggaaagcctcagaaggcatctgctgctgacgatgatgacatggatcccactcaatactatgagaataggctcaagactcttgattcgctcaaggccacaggtgtaaacccctatccccataagttcccagttggcatctctgtagccgaatacattgagaagttcaacaccttgagcaatggggagaagcttacagatgtgacagagtgtttagctgggaggatcatgaacaagagaacatcatcatctaagctattcttttatgatctttatggtgggggcatgaaggttcaagtgatggctgatgccaggacctcagagttggacgaagctgaattttctaagtatcactcaggtgtgaagcgaggtgatattgttggcatagctggctatccaggaaaaagcaacagaggggagcttagtgtattcccaaagaaatttgtcgtgctctctccatgtcttcatatgatgcctcggcagaaaggtgaaggaagtgcggtgcctgtaccgtggactccaggaatgggtaggaacatcgaaaattatgttttgagggatcaggaaactcggtatcgtcaaaggtatcttgatcttatggtaaaccatgaagtgaggcatatcttcaagacacgatctaaagttgtctcatttatccggaagttccttgatgaacgtgaatttttggaggtggagactccgatgatgaacatgattgctggtggagcagctgcgaggccttttgttacacaccacaatgaattaaacatgaggctttttatgcgtattgctcctgaattatatctgaaggaattggttgtcggtggattggaccgtgtctatgaaattggaaaacaattcaggaatgaaggaattgatttaacacacaatcctgaattcacaacttgtgaattttatatggcttatgccgattacaatgatttgatggagcttactgaaaccatgttgtcaggcatggttaaggagctgacaggtggctataagataaaatatcatgcaaatggagttatgaaccccccaatagaaattgatttcacgcctcccttcagaaggatagatatgattaaagatttggaggttgtggccaatctcaatataccaaaagatctatctagtgatgaagcaaatcgttacttgatagaagcatgtgcgaagtatgatgtgaaatgtccacctccccaaacgacatcacggttgcttgacaagttagttggccatttcttggaggagatgtgtgtgaatccaacatttatcatcaatcatccagagataatgagtccattggcaaagtggcataggtcccgacctggattgactgagaggttcgagctatttgttaacaagcatgaggtgtgcaatgcatacacagagttaaacgatcctgttgtgcagaggcaacggtttgaggaacaactaaaggatcgtcaatctggtgatgatgaagctatggccttggatgaaacattctgtactgcccttgagtatggtctaccaccaacaggcggttggggcttgggaattgatcgcctaacgatgttgctaacagattctcagaacattaaggaagttcttctattcccggctatgaagcctcaagagtag

SEQ ID NO: 8948 - protein, 613 aa, Sorghum bicolor
  misc_feature: Ceres ANNOT ID no. 6094797
  misc_feature (260)..(611): Pfam Id: tRNA-synt_2 Pfam Desc: tRNA synthetases class II (D, K and N)
  misc_feature (143)..(224): Pfam Id: tRNA_anti Pfam Desc: OB-fold nucleic acid binding domain
  misc_feature (1)..(613): NCBI GI: 55583785 NCBI Desc: lysyl-trna synthetase (lysine--trna ligase) (lysrs)
  misc_feature (26)..(613): NCBI GI: 124359384 NCBI Desc: lysyl-trna synthetase, class-2; aminoacyl-transfer rna synthetase, class ii [medicago truncatula]
  misc_feature (55)..(613): NCBI GI: 92882121 NCBI Desc: lysyl-trna synthetase, class-2; aminoacyl-transfer rna synthetase, class ii [medicago truncatula]
  misc_feature (55)..(613): NCBI GI: 92876634 NCBI Desc: lysyl-trna synthetase, class-2; aminoacyl-transfer rna synthetase, class ii [medicago truncatula]
  misc_feature (36)..(612): NCBI GI: 1147585 NCBI Desc: lysyl-trna synthetase [lycopersicon esculentum]
  misc_feature (1)..(613): SWISSPROT Homolog: EC 6.1.1.6 Lysyl-tRNA synthetase
MADGAGSASGLEEKLAGLSTGGDAQNPPPAGEGGEEPQLSKNAKKREEKRKKLEEERRLKEEEKKNKAAAAAASGKPQKASAADDDDMDPTQYYENRLKTLDSLKATGVNPYPHKFPVGISVAEYIEKFNTLSNGEKLTDVTECLAGRIMNKRTSSSKLFFYDLYGGGMKVQVMADARTSELDEAEFSKYHSGVKRGDIVGIAGYPGKSNRGELSVFPKKFVVLSPCLHMMPRQKGEGSAVPVPWTPGMGRNIENYVLRDQETRYRQRYLDLMVNHEVRHIFKTRSKVVSFIRKFLDEREFLEVETPMMNMIAGGAAARPFVTHHNELNMRLFMRIAPELYLKELVVGGLDRVYEIGKQFRNEGIDLTHNPEFTTCEFYMAYADYNDLMELTETMLSGMVKELTGGYKIKYHANGVMNPPIEIDFTPPFRRIDMIKDLEVVANLNIPKDLSSDEANRYLIEACAKYDVKCPPPQTTSRLLDKLVGHFLEEMCVNPTFIINHPEIMSPLAKWHRSRPGLTERFELFVNKHEVCNAYTELNDPVVQRQRFEEQLKDRQSGDDEAMALDETFCTALEYGLPPTGGWGLGIDRLTMLLTDSQNIKEVLLFPAMKPQE

SEQ ID NO: 8949 - DNA, 804 bp, Sorghum bicolor
  misc_feature: Ceres ANNOT ID no. 6094799
  misc_feature: Encodes the peptide sequence at SEQ ID NO 8950
atgtcggaggagcagttcctcaccgtggcggtggaagccgccaaaagcgccggcgaggttattcgcaagggattttaccagaccaagaacgtcgagcacaagggccaggtggatttggtgacggagacggacaaggcctgcgaggacctagtcttcgaccacctacggaagcacttcccggaccacaagttcatcggggaggagacgtccgcggcgctcggggccaccgccgacctcaccgacgaccccacctggatcgtcgaccccctcgacgggaccactaattttgtccatggtttcccatttgtatgcgtctcgattggcctcaccattgggaaaattcccactgtcggtgtcgtcttcaaccccatcatgaacgagcttttcacggcggtccgtggaaaaggggctttcctgaatggctctccaattaaagcatcatctcaagatgagttagtgaaggctcttctggtaacagaggttggaaccaaaagagacaaggccactttggatgatacaaccaacagaatcaacaagctactatacaagattcgatccatacggatgtgtggctcattggcgttaaacatgtgtggagttgcctgtggtagacttgatttgtgttatgagatgggatttggtggcccctgggatgttgctgctggagctgtaattcttcaggaagctgggggccttgtttttgacccaagcggtggagagtttgatttgatgtcgcgaagaatggcgggatcaaacagcttgctgaaggataagtttgtcaaggaactgggggacaccaattga

SEQ ID NO: 8950 - protein, 267 aa, Sorghum bicolor
  misc_feature: Ceres ANNOT ID no. 6094799
  misc_feature (2)..(268): Pfam Id: Inositol_P Pfam Desc: Inositol monophosphatase family
  misc_feature (2)..(266): NCBI GI: 55275406 NCBI Desc: l-galactose-1-phosphate phosphatase [actinidia deliciosa]
  misc_feature (5)..(266): NCBI GI: 140064513 NCBI Desc: inositol monophosphatase [medicago truncatula]
  misc_feature (2)..(265): NCBI GI: 1709205 NCBI Desc: inositol-1(or 4)-monophosphatase 3 (impase 3) (imp 3) (inositol monophosphatase 3)
  misc_feature (2)..(263): NCBI GI: 79312679 NCBI Desc: 3'(2'),5'-bisphosphate nucleotidase/ inositol or phosphatidylinositol phosphatase [arabidopsis thaliana]
  misc_feature (5)..(266): NCBI GI: 55275408 NCBI Desc: l-galactose-1-phosphate phosphatase [malus x domestica]
  misc_feature (2)..(265): SWISSPROT Homolog: EC 3.1.3.25 Inositol monophosphatase 3
MSEEQFLTVAVEAAKSAGEVIRKGFYQTKNVEHKGQVDLVTETDKACEDLVFDHLRKHFPDHKFIGEETSAALGATADLTDDPTWIVDPLDGTTNFVHGFPFVCVSIGLTIGKIPTVGVVFNPIMNELFTAVRGKGAFLNGSPIKASSQDELVKALLVTEVGTKRDKATLDDTTNRINKLLYKIRSIRMCGSLALNMCGVACGRLDLCYEMGFGGPWDVAAGAVILQEAGGLVFDPSGGEFDLMSRRMAGSNSLLKDKFVKELGDTN

SEQ ID NO: 8951 - DNA, 990 bp, Sorghum bicolor
  misc_feature: Ceres ANNOT ID no. 6094800
  misc_feature: Encodes the peptide sequence at SEQ ID NO 8952
atgtccatggaagcggcggcggcgagctcggttggggctgaattcggtcccgccctcgggttcaggaacatccaccgccgcacccttccttattgttggcgcccgcgttcgccccggccggcctcgcttagcctctgcggaggctggggagcccgtccccgcggcgccatcgccgcggcgtccggcgaccagcggcggcggcagctgggagagctcgaggcggaggcagaagctggctcggccttgggtcctacgaggagcagcccccgcgaggtgagggaggagatggcgcggtgcttcgacctcgtccgccgcctcggcaggggcgccgtctacctcggctcctccagggtcccgcccacgcacccgcacttcctccaaaccaccgagctcgccagagagatagctcggctgctcgactgcaccacatggaccggagctggccctgggctgatggatgctgccatccaaggcgcccttgaggcgggcaagccggtcggcggcttgaagattgcaaaggaggcaggtgaatggacaagctcaggcttccatccttacctgccaccagagacctacctcacatgcaggttcttctcagcgaggaagcatggccttgtggatgctgcggtgcggagcagccctaccgacagaaccgccgtggttgcactgccaggaggggtcgggacgctggacgagttgtttgagatcatggcgctgattcaactagagaggattggatcagcgctcccggtcccgttcttgctcctcaactacgattcttattactccaagctgctggactttctgaatgactgccaggagtggggcacggttgctccgggggaagtggagtcactttggaaggtctgtgatgggaatcatgaagctttggagtaccttgcagagttctacaatgttcctgctgaccaaagaaattaccaaatatcaccacagttgaagcagcacaggacttcgtacgctgcaagctga

SEQ ID NO: 8952 - protein, 329 aa, Sorghum bicolor
  misc_feature: Ceres ANNOT ID no. 6094800
  misc_feature (152)..(303): Pfam Id: Lysine_decarbox Pfam Desc: Possible lysine decarboxylase
  misc_feature (89)..(325): NCBI GI: 115453949 NCBI Desc: os03g0587100 [oryza sativa (japonica cultivar-group)]
  misc_feature (65)..(326): NCBI GI: 76819601 NCBI Desc: decarboxylase family protein [burkholderia pseudomallei 1710b]
  misc_feature (65)..(326): NCBI GI: 53716627 NCBI Desc: decarboxylase family protein [burkholderia mallei atcc 23344]
  misc_feature (43)..(304): NCBI GI: 133910239 NCBI Desc: lysine decarboxylase family protein [saccharopolyspora erythraea nrrl 2338]
  misc_feature (110)..(326): NCBI GI: 121596637 NCBI Desc: decarboxylase family protein [burkholderia mallei savp1]
MSMEAAAASSVGAEFGPALGFRNIHRRTLPYCWRPRSPRPASLSLCGGWGARPRGAIAAASGDQRRRQLGELEAEAEAGSALGPTRSSPREVREEMARCFDLVRRLGRGAVYLGSSRVPPTHPHFLQTTELAREIARLLDCTTWTGAGPGLMDAAIQGALEAGKPVGGLKIAKEAGEWTSSGFHPYLPPETYLTCRFFSARKHGLVDAAVRSSPTDRTAVVALPGGVGTLDELFEIMALIQLERIGSALPVPFLLLNYDSYYSKLLDFLNDCQEWGTVAPGEVESLWKVCDGNHEALEYLAEFYNVPADQRNYQISPQLKQHRTSYAAS

SEQ ID NO: 8953 - DNA, 3375 bp, Sorghum bicolor
  misc_feature: Ceres ANNOT ID no. 6094801
  misc_feature: Encodes the peptide sequence at SEQ ID NO 8954
atggagatgctgcggcggaacctgaagcggcaagcgtcgcgctcgctctccgccttcgccggcgccgcatccccgcgcgccgtcgaccaggagaacctccaccccaacctcgcctcctcgccgccggcgtcgcccgccaagggcgcatcctcgccgcgccccaagcaaccagcagctgcggctccgccggcggccaccgtcgtggaggatcactccacggctgctaccaccgcgccagccgacgacgagccctccgtcaaggtggtggtgagggtgcggccgacggtgacccgcccggtggacggcaaggatctgtggttcgtccgcaagaccgccccagactcagtcgctgtcggcgaccggttcttcccagtggatggcgtcctcgaagacagggcctctcaggccgatgcgttcgatctggtaggattgcccatgatcgagaacgctcttgccggattcaacacatccctcgtctgctatggccagagtggcacaggaaagacatacaccatgtggggccctctcggcgccatggttgacagtggctctgaccatgctgaccggggcgtcgttcctcgggttttccagaacctgttctctcgaatccaaagaatgcgagagagttctcctgacaagcagacgagctaccaatgccgttgctcgttcctcgaggtacataacgagcagatcaatgatctgttggaaccatctcagcgtgacctacagataaaagagaatgctggcaatggtatccatgttgagaacttgactgatgagtacgtgtcaacagtagaggatatcaatcagatcttgatgaagggattgtcaaacagaaaagtcggcaccaccagtatgaacttgaaaagttcccgctctcatgtgatattcacctgcattattgaagcatggagcaagggttcatcacatgggtttagcagttcaagaacaagcagaattacctttgttgaccttgctggtcctgacactgatgaacttgatggtgcagcaaagcattccacaaaggaggaaagacatcttaagaagtctctttcaaggcttgggaaactagtcaacgttctttcagaaactccagagtcccataaggttgatttaccatatgagcaatcccgtttgacacatgtgctgaaggatacactaggtggcaactccagggttatatttctgtgttcaatttcttcagagcacagatctggaaccttaagtacactaagatttggtgagcgagcaaagctaatgccaaacaaacctgtgataaatgagatatcagaagatgatgttaatggtttgagtgatcagatacgtcagttaaaggatgaactcataagaacgaagtctggggatactacaacttgcaaggctagatacttcagtgcacaaagtgcccgtgaaagcttgcatactttgcgagtgagcctcaaccgctctcttatcttgcctcacatagaagttgattcagaggaagaaatggatgttgatgaagaagatgtgcaagaactgcgtgatcaaattagcaagcttcactcttcatctgaagatacctttgatgacttcatggatgcggagagtggagatgaaaacactccttgttctatgggaagaagtggagaagatgatcaagttatcatagatgattttgatggtccacaacaggaagagcacaaagaagtatctaacaatacaaatgctaatgaagagctcggttctgacagaaaatctagtctatcaattagtgcctccccacggttgtcacctattcaggatcctacattgtgctcttctccaaagatccacaacaaggcaagaaaaagcatcacttcaccgggattatcaccaagcaagcttagagtatctgacagcccaggtgatagaaatgttgaagtgtgcagaaatagtgcagttcgttcctctctacaatcaagcaagcttagtcctactgactcactggctgcaagtctccaacgtggtttgcacattatagagtatcatcaacagaatccagccccacgaaaatcatttattggcctttcatttgaccattttgcggtgaatcctcgtcagtcaacagcaaaattcagtacagttgctcaggctctacctgaggaccaaggaagcaatctttgttcatcctgcaagaagccaatggacacaaatgaaaatcaggcagaaaatgtaaactcagacaaacagattgtgttagccttgggggccacatctaatgaatcagctagcgcttcaattaaggatggcagcataaccaaggaaattgcttccaagagagaaactgagcttgaagctttatgtgaagaacaagcagcaaagatcaaggagctgagcactttgattgaccaatataagaacaggtcagaagatggcccaggttcaaatggtatggcacctgcagaagaactaactagcgaaggcatggtttctgaacaatgtcatgatagtaaggtgtcacttggtgtgagtgagagggaggcacttcttgctgaaatcgagagtctgaaggagcaactcaaaaaccagactattgtatcaacaactggtagccttcttgaccagttaaggaacggcagcacagaccaggagtatgaacttgacaaagaaagacagaaatggatggagtctgagagcaagtggatctcactcaccgaggagctgagggtcgatctagaatcaaacaggatgcatgcagagaagaccgagatggagctctgcaatgagaagaagtgcacagcagagctagatgatgctcttcaacgggcgatgtacggccacgccaggatggttgagcattatgttgagctccaggagctgtataatgatcttctcgagaagcaccgccgagttatggaagcaatctctgaggtgaagagggcggctgccaaagcaggcaggaagggctgcgggacggcctttgctgcggcccttgccgcagagctttccacagtgcgaatcgaccgagaaaaggagaggggtcagctgaaagaacagaacagaaggctccgcattcagctgcgagacaccgctgaagctgttcatgctgctggagaactgctcgtcagattgagagaagctgaggaagcatctacactagaaaaggaaaggactgctgcgttgttgcaagagaacgagaagctgaagaagcagctggagaagcttaggaagaagcacgagatggagctggagacgatgaaggtgcaccttgcggagagccggctgccagagtcggctttgggtgccttctaccaccacgagaatgagaggacaccggagtactcgtgcgatgctccattgacgcacgacgacgatcagtcttggcgggcagcctttgcatctgcctacgagtga

SEQ ID NO: 8954 - protein, 1124 aa, Sorghum bicolor
  misc_feature: Ceres ANNOT ID no. 6094801
  misc_feature (495)..(1083): Pfam Id: Kinesin-related Pfam Desc: Kinesin-related
  misc_feature (91)..(421): Pfam Id: Kinesin Pfam Desc: Kinesin motor domain
  misc_feature (222)..(1054): NCBI GI: 15208465 NCBI Desc: kinesin heavy chain [zea mays]
  misc_feature (32)..(1100): NCBI GI: 42565046 NCBI Desc: kinesin motor family protein [arabidopsis thaliana]
  misc_feature (93)..(634): NCBI GI: 9294524 NCBI Desc: kinesin-like protein [arabidopsis thaliana]
  misc_feature (6)..(1095): NCBI GI: 27462172 NCBI Desc: kinesin related protein [lycopersicon esculentum]
  misc_feature (8)..(1064): NCBI GI: 140063085 NCBI Desc: kinesin, motor region; kinesin-related [medicago truncatula]
MEMLRRNLKRQASRSLSAFAGAASPRAVDQENLHPNLASSPPASPAKGASSPRPKQPAAAAPPAATVVEDHSTAATTAPADDEPSVKVVVRVRPTVTRPVDGKDLWFVRKTAPDSVAVGDRFFPVDGVLEDRASQADAFDLVGLPMIENALAGFNTSLVCYGQSGTGKTYTMWGPLGAMVDSGSDHADRGVVPRVFQNLFSRIQRMRESSPDKQTSYQCRCSFLEVHNEQINDLLEPSQRDLQIKENAGNGIHVENLTDEYVSTVEDINQILMKGLSNRKVGTTSMNLKSSRSHVIFTCIIEAWSKGSSHGFSSSRTSRITFVDLAGPDTDELDGAAKHSTKEERHLKKSLSRLGKLVNVLSETPESHKVDLPYEQSRLTHVLKDTLGGNSRVIFLCSISSEHRSGTLSTLRFGERAKLMPNKPVINEISEDDVNGLSDQIRQLKDELIRTKSGDTTTCKARYFSAQSARESLHTLRVSLNRSLILPHIEVDSEEEMDVDEEDVQELRDQISKLHSSSEDTFDDFMDAESGDENTPCSMGRSGEDDQVIIDDFDGPQQEEHKEVSNNTNANEELGSDRKSSLSISASPRLSPIQDPTLCSSPKIHNKARKSITSPGLSPSKLRVSDSPGDRNVEVCRNSAVRSSLQSSKLSPTDSLAASLQRGLHIIEYHQQNPAPRKSFIGLSFDHFAVNPRQSTAKFSTVAQALPEDQGSNLCSSCKKPMDTNENQAENVNSDKQIVLALGATSNESASASIKDGSITKEIASKRETELEALCEEQAAKIKELSTLIDQYKNRSEDGPGSNGMAPAEELTSEGMVSEQCHDSKVSLGVSEREALLAEIESLKEQLKNQTIVSTTGSLLDQLRNGSTDQEYELDKERQKWMESESKWISLTEELRVDLESNRMHAEKTEMELCNEKKCTAELDDALQRAMYGHARMVEHYVELQELYNDLLEKHRRVMEAISEVKRAAAKAGRKGCGTAFAAALAAELSTVRIDREKERGQLKEQNRRLRIQLRDTAEAVHAAGELLVRLREAEEASTLEKERTAALLQENEKLKKQLEKLRKKHEMELETMKVHLAESRLPESALGAFYHHENERTPEYSCDAPLTHDDDQSWRAAFASAYE

SEQ ID NO: 8955 - DNA, 1260 bp, Sorghum bicolor
  misc_feature: Ceres ANNOT ID no. 6094838
  misc_feature: Encodes the peptide sequence at SEQ ID NO 8956
atgtatcgtgggggccttgaccgcttcaagaaggcacagaccttggagcccttctcagtgaaggagtcaagcaccaagaacgcagctgcagctgcagggacagctaaagcaccaccggctccattgacactgccacagaattctaattttgtgccaggtcagaatcaccaaagtccacaaggtaccagctccagggtggctgggcaagatggtgttgctcctgggcatgttgggacacaggtcggtggagggcagtcgacgtggcaacctcccgactgggcgattgagccgtgtcctggtgtctactatcttgatgtggtgaaagatggggaggtcattgacaggatcaatctggacaacaggaggcatctattcgggaggcaggttcctgcttgtgacttcgtgttggaccatcaatctgtgtcgcgtcagcatgctgctgttattccacacaggaatggaagcatctatgttatcgacttgggatcagttcatggcacgtttgttgcgaatgagagattaacaaaagacagccctgttgaacttgaggttggacagtcacttcgctttgctgcatcaaccagaacctatatcctgcgaaaaaacacagctgctctatttccaactcctagccttccatcagatatcagtttgccatctcctccagatcccaatgatgaagatgctgttgtggcatacaatacagttcttaaccgctatggtattagtagatctgacatattatccagttctaaagattcttctagaggtgcctctggtgcaaataatgataaacatgcagttgaaaggcctttgaagagaagtaaaaagcgcagagtgtcatttagagatcaggttggaggagaacttatccaagtggttgggatttcagatggtgcagatgttggaactgaacccggccctgtaggtgtgaaggaaggcagtcttgttgggaagtatgaatctcttgtacaggttactgtcataccgaagggaaaggagcaagcatcaccaaaagaatatacctctacctcaacgagtggtgtaacggataagctacaagaggtgcttaaaaaagtaaagagcacaacaaaacctggaatttacgatgatctttatggggattctgttccagcaaaagtgggctcatcttgggcatacaaatcagatgacctgtcagataaagcccaacctgttgaggagaagacacatagcatgaattcagccgatgacagtgatgacttgtttggtgactcgtga

SEQ ID NO: 8956 - protein, 419 aa, Sorghum bicolor
  misc_feature: Ceres ANNOT ID no. 6094838
  misc_feature (123)..(191): Pfam Id: FHA Pfam Desc: FHA domain
  misc_feature (91)..(284): NCBI GI: 38174471 NCBI Desc: mgc69160 protein [xenopus laevis]
  misc_feature (91)..(265): NCBI GI: 108880943 NCBI Desc: nuclear inhibitor of protein phosphatase-1 [aedes aegypti]
  misc_feature (91)..(284): NCBI GI: 22122685 NCBI Desc: protein phosphatase 1, regulatory (inhibitor) subunit 8 [mus musculus]
  misc_feature (91)..(284): NCBI GI: 27807053 NCBI Desc: protein phosphatase 1, regulatory (inhibitor) subunit 8 [bos taurus]
  misc_feature (91)..(284): NCBI GI: 119628137 NCBI Desc: protein phosphatase 1, regulatory (inhibitor) subunit 8, isoform cra_b [homo sapiens]
MYRGGLDRFKKAQTLEPFSVKESSTKNAAAAAGTAKAPPAPLTLPQNSNFVPGQNHQSPQGTSSRVAGQDGVAPGHVGTQVGGGQSTWQPPDWAIEPCPGVYYLDVVKDGEVIDRINLDNRRHLFGRQVPACDFVLDHQSVSRQHAAVIPHRNGSIYVIDLGSVHGTFVANERLTKDSPVELEVGQSLRFAASTRTYILRKNTAALFPTPSLPSDISLPSPPDPNDEDAVVAYNTVLNRYGISRSDILSSSKDSSRGASGANNDKHAVERPLKRSKKRRVSFRDQVGGELIQVVGISDGADVGTEPGPVGVKEGSLVGKYESLVQVTVIPKGKEQASPKEYTSTSTSGVTDKLQEVLKKVKSTTKPGIYDDLYGDSVPAKVGSSWAYKSDDLSDKAQPVEEKTHSMNSADDSDDLFGDS

SEQ ID NO: 8957 - DNA, 429 bp, Sorghum bicolor
  misc_feature: Ceres ANNOT ID no. 6094848
  misc_feature: Encodes the peptide sequence at SEQ ID NO 8958
atgcagacggtacgaggtgtggtgctgcagcacctccggctccgcgcggcgcctgccatcgctgcacgtggaggcagcgggaggccggcgctgtacgggttcgctcgggggatgagcgcgccggcgggccaggaggacagtaagggaagcagcagccccgaccccgagagggacatcaggacgcgcgtcgttaacctggtcaagaagttcgacaagatcgacgccgacaaggtgactgagactgcagacttccaaaaggacctgagcttggacagtttagaccgggtggaacttgttatggcttttgaacaagagttctccattgagattcctgatgacaaggctgacaagctaacctgctgtgcggatgttgcaaaatacatcatatcggaatctcaaatcagcgataaaagtgccggtggctcctga

SEQ ID NO: 8958 - protein, 142 aa, Sorghum bicolor
  misc_feature: Ceres ANNOT ID no. 6094848
  misc_feature (61)..(128): Pfam Id: PP-binding Pfam Desc: Phosphopantetheine attachment site
  misc_feature (58)..(130): NCBI GI: 53801502 NCBI Desc: mitochondrial acyl carrier protein [helicosporidium sp. ex simulium jonesii]
  misc_feature (4)..(130): NCBI GI: 34485510 NCBI Desc: acyl carrier protein 1 [chlamydomonas reinhardtii]
  misc_feature (14)..(129): NCBI GI: 58613403 NCBI Desc: mitochondrial acyl carrier protein [isochrysis galbana]
  misc_feature (5)..(133): NCBI GI: 3335337 NCBI Desc: similar to acyl carrier protein, mitochondrial precursor (acp) nadh-ubiquinone oxidoreductase 9.6 kd subunit (myacp-1), gbl23574 from a. thaliana. ests gbz30712, gbz30713,
  misc_feature (5)..(133): NCBI GI: 3335337 (continued) gbz26204, gbn37975 and gbn96330 come from this gene. [arabidopsis thaliana]
  misc_feature (47)..(140): NCBI GI: 118137613 NCBI Desc: chain a, solution structure of rsgi ruh-059, an acp domain of acyl carrier protein, mitochondrial [precursor] from human cdna
MQTVRGVVLQHLRLRAAPAIAARGGSGRPALYGFARGMSAPAGQEDSKGSSSPDPERDIRTRVVNLVKKFDKIDADKVTETADFQKDLSLDSLDRVELVMAFEQEFSIEIPDDKADKLTCCADVAKYIISESQISDKSAGGS

SEQ ID NO: 8959 - DNA, 1275 bp, Sorghum bicolor
  misc_feature: Ceres ANNOT ID no. 6094857
  misc_feature: Encodes the peptide sequence at SEQ ID NO 8960
atggaattcaacaccgagaagcttcaaaatcttcatatcatctccaatgaggagctggagcctgttgtcgtcttcaatactgatgatgtcgatcctgaggatgacgagggcacagaaccacaagtaacagttggtttcgtagaggaaccagagggaccaaaggactcgcactatcttcttccacaacattttcccaataaagctggcgattatgtttctgctcatcaggcctggcttgatcctgtgaatttgccatctggcaagtcaagcagctgtgacttctgtggcaatccactgcgttttgttctccaggtttatgcaccaattcggtcaaaggaaactgcctaccatcgcacattgtttgtgttcatgtgcccatcaatggcatgcttactcctggaccagcatgaacaggagaaagacaggacagtaaatcctaaaaggagtgtcaaggttttccggtgccagctgcccaaggacaatgcattttatcaacttgaagaacctgaggggtgcggtgaaaccttcgaatcacagtgtgaaggaggaatgcgacctcaactatgccattggtgtggtatgtggaaaggtgaaaaatggtgtggccgttgtaggagagcatactattgttccaagaagcatcagatggtaggagaggccacatctggttgcctcatgaacttcctttgtgtgccaatatttccagtatttgctggcacttcatggcctgaatatatagtggtcgatgtacctgaaaaggcaccctgtttcaataattttgatggcaatacgtcagaattgtctgtggtgcatgggcaaaataaatcagatgacatgctttcattgatggacgagtttgaggctgatgccgacaacagatgctgggcatcttttctggatcgtatctcaagggacccggaacaagtgttgaggtacagtggggaggcaaatgcaaaacctctttgggccgtgtcatctggatctctgactaatgatgctgctatcccattgtgcatctactgtaatggtccactttgctatgaatttcaggtaatgtcacaaatgctccactacttccatgttgagaatgaaccagactcccttgattgggcgacaataattgtgtacacatgtcaagggtcatgtgactggaatgttagttataaggaagaatttgtgtgggttcagttaggtccagctacaagaacaacctatcatggtatgacaggtaaccaagacctttcgtctcgtaagattattcggtctgagctatag

SEQ ID NO: 8960 - protein, 424 aa, Sorghum bicolor
  misc_feature: Ceres ANNOT ID no. 6094857
  misc_feature (242)..(402): Pfam Id: PDCD2_C Pfam Desc: Programmed cell death protein 2, C-terminal putative domain
  misc_feature (1)..(142): NCBI GI: 13161342 NCBI Desc: programmed cell death 2-like [oryza sativa (japonica cultivar-group)]
  misc_feature (1)..(142): NCBI GI: 115437846 NCBI Desc: os01g0578200 [oryza sativa (japonica cultivar-group)]
  misc_feature (42)..(396): NCBI GI: 116126447 NCBI Desc: ensangp00000007243 [anopheles gambiae str. pest]
  misc_feature (42)..(396): NCBI GI: 38680349 NCBI Desc: programmed cell death 2 [gallus gallus]
  misc_feature (38)..(396): NCBI GI: 28838500 NCBI Desc: pdcd2-prov protein [xenopus laevis]
MEFNTEKLQNLHIISNEELEPVVVFNTDDVDPEDDEGTEPQVTVGFVEEPEGPKDSHYLLPQHFPNKAGDYVSAHQAWLDPVNLPSGKSSSCDFCGNPLRFVLQVYAPIRSKETAYHRTLFVFMCPSMACLLLDQHEQEKDRTVNPKRSVKVFRCQLPKDNAFYQLEEPEGCGETFESQCEGGMRPQLCHWCGMWKGEKWCGRCRRAYYCSKKHQMVGEATSGCLMNFLCVPIFPVFAGTSWPEYIVVDVPEKAPCFNNFDGNTSELSVVHGQNKSDDMLSLMDEFEADADNRCWASFLDRISRDPEQVLRYSGEANAKPLWAVSSGSLTNDAAIPLCIYCNGPLCYEFQVMSQMLHYFHVENEPDSLDWATIIVYTCQGSCDWNVSYKEEFVWVQLGPATRTTYHGMTGNQDLSSRKIIRSEL

SEQ ID NO: 8961 - DNA, 1335 bp, Sorghum bicolor
  misc_feature: Ceres ANNOT ID no. 6094865
  misc_feature: Encodes the peptide sequence at SEQ ID NO 8962
atgtccaccatggatgaaggctacggccctacttgggacagcgacgacgaatacgacaacttcatacgcaagatgaacccgccaaggatcgtcatcgataatgagtcctcagcagaggctacaattgtgagggtagatagtgcaaatgaatatgggatactgctggaagtgatccaggtcatgattgatctcaaccttgtcatcagcaaggcgtatataacctcggatggtggatggttcatggatgtattcaatgtgaccgataaggaagggaagaagatcaaagatgaggcaaccctcacacagattgaagattacatcagaaagtccttgggtgcagattcaagatacattccttcccgccggagatcagtagacgtggccgcagcagctgatcacaatgtcatcgagctgacagggacggacaggccaggcctgctctctgaagtcagcgcggtgctcgcgagcctcaagtgcaacgtggtcagcgccgagatctggacacacaacgcccgagctgcggccgtgatgcgagtcactgacgaggacaccaggctggcagtcacagacaccgagaggctggagaggattagggagaagctgtcgtacctgctccgcggaggcaacctctcccggggagccgccatggcggtgtcgtcggggactgccaccacgcacaccgagagaaggctgcaccagatgatgcttgatgactgcgactatgagcagctccagcagctagctccggggcagtctcagaggcctaatgtcaccgtgaggaactggaacgacaaggactactcggtggtgactatcagatgcaaggacaggcccaagcttctgttcgacacggtttgcactctgacggacctgcagtatgttgttttccatgcgaacattgatgccaaggacaatcaggcttaccaggaattctatgtaaggcatgtgaatggatcaccaatgaacactgaaactgagagattgcgagtcatccaatgccttgaaggtgtcaagcttgagctgtgcactaatgacaaggtcgggctactgtccgaggtcacccgcatcttccgtgagaacagcctgactgttacaagagcagaggtgaccacgaggggcaggatggctgtgaacacattctacgtccgtggttccacgggagaggatgttgatcagaaggcaatagactccatcaggcaagccataggccacagccttcaggtgaaaggccagcctgagccacaggaggcgcagaagaaagagtcccccacatggttcctctttgccaacttgtttcggccgaggtctctctacagtttcgggttcatgcgctga

SEQ ID NO: 8962 - protein, 444 aa, Sorghum bicolor
  misc_feature: Ceres ANNOT ID no. 6094865
  misc_feature (134)..(206): Pfam Id: ACT Pfam Desc: ACT domain
  misc_feature (337)..(403): Pfam Id: ACT Pfam Desc: ACT domain
  misc_feature (4)..(444): NCBI GI: 42572033 NCBI Desc: act domain containing protein (acr4) [arabidopsis thaliana]
  misc_feature (13)..(444): NCBI GI: 22138098 NCBI Desc: acr4 [arabidopsis thaliana]
  misc_feature (15)..(444): NCBI GI: 6730631 NCBI Desc: f4n2.2 [arabidopsis thaliana]
  misc_feature (15)..(444): NCBI GI: 22138100 NCBI Desc: acr5 [arabidopsis thaliana]
  misc_feature (15)..(412): NCBI GI: 38347211 NCBI Desc: osjnba0055c08.5 [oryza sativa (japonica cultivar-group)]
MSTMDEGYGPTWDSDDEYDNFIRKMNPPRIVIDNESSAEATIVRVDSANEYGILLEVIQVMIDLNLVISKAYITSDGGWFMDVFNVTDKEGKKIKDEATLTQIEDYIRKSLGADSRYIPSRRRSVDVAAAADHNVIELTGTDRPGLLSEVSAVLASLKCNVVSAEIWTHNARAAAVMRVTDEDTRLAVTDTERLERIREKLSYLLRGGNLSRGAAMAVSSGTATTHTERRLHQMMLDDCDYEQLQQLAPGQSQRPNVTVRNWNDKDYSVVTIRCKDRPKLLFDTVCTLTDLQYVVFHANIDAKDNQAYQEFYVRHVNGSPMNTETERLRVIQCLEGVKLELCTNDKVGLLSEVTRIFRENSLTVTRAEVTTRGRMAVNTFYVRGSTGEDVDQKAIDSIRQAIGHSLQVKGQPEPQEAQKKESPTWFLFANLFRPRSLYSFGFMR

SEQ ID NO: 8963 - DNA, 2754 bp, Sorghum bicolor
  misc_feature: Ceres ANNOT ID no. 6094867
  misc_feature: Encodes the peptide sequence at SEQ ID NO 8964
atggcgaagacgaagcccatggcggcggcggcggcgggcgagaagaagaagagcaaaggaaagaagaagggcaagaacggcccggccaaggtggccatgaaggctcgcggcgcggcggcggaggagcggagcaacccgttcgaggccatctggtcgcgccgcaagttcgacgtgctcggcaagaagcgcaagggcgaggagcggcgcgtatcgcgctcccgctccgaggccatccgcaagagggagaacacgctgctcaaggagttcatggagagcggcaagtcgtccgtgttccacgaccggcgtatcggcgagagggacgacgctctgcccgagttcgacaaggccatccttcgccagcaacgtgagcgcttggccaagttgaaacgagaaagcaagtacaatctatctgatgacgatgaagacgaaatcaatgttcataacatgctctcggaaaaggatgattttgatgaagaggtgcctctagatgatgggagcgacgaggaaggtaaaatggtcctttcaaagaagcgcttatctctccaaagtgatgaccatccttcagtgactgatctgccccaagaaacacatgggcagaagagcaagaaggaagttatgtcggagatcatttcaaagagtaaattttataaggcccaaagagccaaggagagggaagaggatgaacatcttgtggacaagttagacagtgattttgcatcattggcccagacacaggcgttattgtccttaactgattcagctaaggtcaaggtgaataaaaatgattcaagtgctggcttgacggggaaggagatttttaacaagttgaaggcagatacatatgaaaaactggtgaaagaaatggtgatggatcaacgtgctcggccttctgatagaactaaaaccccagaggaaatagcacaagaagagaaagaacgtcttgagaagttggaggaggaacgccaaaaaagaatgcttggaactgctgattcatctgatgaggacgatgacaacgaggacgataagcacatgaagctaggtaactcaaaacctatatctggagatgatcttggtgattccttctctttggatgagtcaataggaaagaaaaagggatgggttgatgaaatttatgaaagggaaggtagaaagattggtgatgatgcagcagcatccgatgatggagaaagcgatgatgaaaatgctagtgatgatggggctgatgatgaagaagattctgaagaagactccagtgacaatgactttggtaatatgtctgctagagattgggaacaaagtgatgatgatgaggttgatgtaggagatgatgaaatggaggatttcaaagagaaagaacaagagatcaatggcaaagtggtggaaaaagttgcacacaatttgaaaggagaatctgatgtgaaaccacaggtcaaggatggcagtattccttttgttattgatgcaccaaatgacctgaaagatctatcctctttgctagatggtcgttcagaagccgaaatagttgagattattagtcgtatacgcacttgcaattcaataaggcttgcagctgaaaaccgaaggaaaatgcaatactttgcaactttagctacccaaagtccagtgaagttcagaataattgacacacttgttaagcctttaattgagatgagtggagaaactccatattttgctgccatctgtgcaagagaacgacttattcatacacgtacccgtctatgcgaagatattaaggttccaggaaagagcagctggccaaatttgaagacattacttctgctgagattatggtctcttatttttccgtgctccgacttccgccatgttgttgcaactccattgcttctacttatgtgcgaatatctgatgcggtgccctatacaatctggtcgagatgttgctgttggttctttcttgtgttcaatggtgcttgtggttactaaagaatctaaaaagttctgtcctgaagcagttggctttctgcaatctcttttggtaacatctcttaaaggaaaagtgggaactcatctgcacaatcagattaatgatcaatttatggagctcaagactttaaaaccatggctcagtatccatgatcaagtgcatgaggtgaatccagtgaatatcctagaaatagttggcatggatcctgacgccccttatttctcatctgataactttaaggctggtgtacttttatctgtggtagaatgtttaagaggttttgttattatacatgaagggctatgctctttcccagaaatcttccttccaatatcctctttgctgcaagaaattttggagagatctgagttgcctgactcgttacaagacattttccatgaaatcattgacttggttaaaaagattagtgatgaacaccatgcttcaagagagcccctccgaatgcggaagaagaagcccgaaccaatcaagcaattgaatccaaagttcgaagagaactacatcaagggtcttgattatgatcctgaccgagaaagggcacaaatgaaaaaactgaggaagcgtgtcaagagtgagatgaagggggcgaagcgtgagctgcaaaaagataattatttcctgtctgctgtgaaggagaaagagaggatgaagcgagatgaagagagagctgagatgtatggaaaagccatggcgttccttcaagaacaggaaagtgctttcaaatctggacaactggggaaaggaaagggcaggaaaaggaggcgttga

SEQ ID NO: 8964 - protein, 917 aa, Sorghum bicolor
  misc_feature: Ceres ANNOT ID no. 6094867
  misc_feature (27)..(902): Pfam Id: Nop14 Pfam Desc: Nop14-like family
  misc_feature (308)..(917): NCBI GI: 115454017 NCBI Desc: os03g0598200 [oryza sativa (japonica cultivar-group)]
  misc_feature (127)..(915): NCBI GI: 140054345 NCBI Desc: nop14-like protein [medicago truncatula]
  misc_feature (15)..(655): NCBI GI: 6730652 NCBI Desc: f4n2.4 [arabidopsis thaliana]
  misc_feature (274)..(682): NCBI GI: 55249633 NCBI Desc: nop14-like [danio rerio]
  misc_feature (274)..(682): NCBI GI: 51467886 NCBI Desc: nop14-like [danio rerio]
MAKTKPMAAAAAGEKKKSKGKKKGKNGPAKVAMKARGAAAEERSNPFEAIWSRRKFDVLGKKRKGEERRVSRSRSEAIRKRENTLLKEFMESGKSSVFHDRRIGERDDALPEFDKAILRQQRERLAKLKRESKYNLSDDDEDEINVHNMLSEKDDFDEEVPLDDGSDEEGKMVLSKKRLSLQSDDHPSVTDLPQETHGQKSKKEVMSEIISKSKFYKAQRAKEREEDEHLVDKLDSDFASLAQTQALLSLTDSAKVKVNKNDSSAGLTGKEIFNKLKADTYEKLVKEMVMDQRARPSDRTKTPEEIAQEEKERLEKLEEERQKRMLGTADSSDEDDDNEDDKHMKLGNSKPISGDDLGDSFSLDESIGKKKGWVDEIYEREGRKIGDDAAASDDGESDDENASDDGADDEEDSEEDSSDNDFGNMSARDWEQSDDDEVDVGDDEMEDFKEKEQEINGKVVEKVAHNLKGESDVKPQVKDGSIPFVIDAPNDLKDLSSLLDGRSEAEIVEIISRIRTCNSIRLAAENRRKMQYFATLATQSPVKFRIIDTLVKPLIEMSGETPYFAAICARERLIHTRTRLCEDIKVPGKSSWPNLKTLLLLRLWSLIFPCSDFRHVVATPLLLLMCEYLMRCPIQSGRDVAVGSFLCSMVLVVTKESKKFCPEAVGFLQSLLVTSLKGKVGTHLHNQINDQFMELKTLKPWLSIHDQVHEVNPVNILEIVGMDPDAPYFSSDNFKAGVLLSVVECLRGFVIIHEGLCSFPEIFLPISSLLQEILERSELPDSLQDIFHEIIDLVKKISDEHHASREPLRMRKKKPEPIKQLNPKFEENYIKGLDYDPDRERAQMKKLRKRVKSEMKGAKRELQKDNYFLSAVKEKERMKRDEERAEMYGKAMAFLQEQESAFKSGQLGKGKGRKRRR

SEQ ID NO: 8965 - DNA, 636 bp, Sorghum bicolor
  misc_feature: Ceres ANNOT ID no. 6094875
  misc_feature: Encodes the peptide sequence at SEQ ID NO 8966
atggggtccctgctttgctgcctgcggtacccggaggacggctcggcgccgccgcccgtgtgctgcttctgcctaccgtggcctttcccttaccatggcgtcgactcgggctctgctgctcgtcacagaggtgatacacgtgtggcacctgaacgtggaaggattcctcttgcagcttgcacctctgctaatcaagtggactcattggatactttccggccccctccaaggcctttgccttacgatgatcctcaattcagcccttgcatgctgcagctcccagtagtgtcatcaggacatgacaaagcatcaacgcatattcagaaaccaggacaacctacagaaagtaagaatactgatgctggatcaacaacttgcacagctgctcataaggtttctgggacatcagcaaaacagcactcaggaggttcgagaattgatggaatacaattctgtgattcttctgacaatgaggatgactgtccgatatgcctagaagaatatgatgatgagaatccgaagattgtattgcaatgcaaccataatttccatcttagttgcatttatgagtggatggaaagaagtgaagcttgccctgtctgtgcaaagattatgttgttcaatgaggatgaatga

SEQ ID NO: 8966 - protein, 211 aa, Sorghum bicolor
  misc_feature: Ceres ANNOT ID no. 6094875
  misc_feature (161)..(201): Pfam Id: zf-C3HC4 Pfam Desc: Zinc finger, C3HC4 type (RING finger)
  misc_feature (1)..(209): NCBI GI: 92885424 NCBI Desc: zinc finger, ring-type; ringv [medicago truncatula]
  misc_feature (31)..(209): NCBI GI: 57900128 NCBI Desc: zinc finger (c3hc4-type ring finger) protein-like [oryza sativa (japonica cultivar-group)]
  misc_feature (65)..(208): NCBI GI: 23505815 NCBI Desc: at5g41350/myc6_6 [arabidopsis thaliana]
  misc_feature (159)..(209): NCBI GI: 20334768 NCBI Desc: at4g23450/f16g20_150 [arabidopsis thaliana]
  misc_feature (70)..(209): NCBI GI: 42572783 NCBI Desc: zinc finger (c3hc4-type ring finger) family protein [arabidopsis thaliana]
  misc_feature: The sequence is a functional homolog of SEQ ID NO 1553 in the 11/479,226US patent application
  misc_feature: Useful for making plants with modulated growth and phenotype characteristics
  misc_feature: The sequence is a functional homolog of SEQ ID NO 1553 in the 20070022495 US patent application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
  misc_feature: The sequence is a functional homolog of SEQ ID NO. 329 in the 11/188,298 US application
  misc_feature: The sequence is a functional homolog of SEQ ID NO. 468 in the 11/188,298 US application
MGSLLCCLRYPEDGSAPPPVCCFCLPWPFPYHGVDSGSAARHRGDTRVAPERGRIPLAACTSANQVDSLDTFRPPPRPLPYDDPQFSPCMLQLPVVSSGHDKASTHIQKPGQPTESKNTDAGSTTCTAAHKVSGTSAKQHSGGSRIDGIQFCDSSDNEDDCPICLEEYDDENPKIVLQCNHNFHLSCIYEWMERSEACPVCAKIMLFNEDE

SEQ ID NO: 8967 - DNA, 1695 bp, Sorghum bicolor
  misc_feature: Ceres ANNOT ID no. 6094887
  misc_feature: Encodes the peptide sequence at SEQ ID NO 8968
atggccgccagcaacaccacagctgctacacacacagacatactacaggcacatctgcagatggcggccaacaacaccactagtgccgaggtgaggactgttgacccctcagtgtggggtgacttcttcatcaactatgtccctcagccgatacagatgtctgagggaagcatgagggagagggtcaatcaattgaggaaggaggtgtgtggactgtttgaggcttgcagcgacagcaatgtggtgaaccaaatgagccttgtggacaccctccagcatctgagtattgatcatctcttccaggagcagattggtgccacactacatagcatccatggctctagaggattcagtaccctccatgaagctgccctgcgatttcgcctcctgaggacccatggtctttgggtttctccagacgaattgatcagcaagttcagaggtgatgatggaagcttccgtactgaaataatgaatgatcatagatgcttgttaagcttatataatgcagctcaccttttaacgcacggagaggtagaacttgaagaagcaattctatttgcaaggcaacatctggaactgggattattaacgagtagcctcagggccccattagctggtcaagtaacccgggcccttaagctaccattgccaaggacactgaagagattggaggccctagattatatgtccgaatacactcaagagcaaacatacaatccctccatactagagcttgcaaagctggattttaacctacttcaacgtcttcacttgaaagagctcaaagccatttgccaatggtggaaggatatttaccaagaagtggaactaaactacatgcgtgatcgcgtggttgagtgtttcttctggtcctacacagtatactacgagcaggatcacttgcgagctcgggcaatgcttaccaagatttttgcactcctaaccgtggtagatgacacatttgatgatcatgctactttagatgagtctcgtaagctcgctgaagctttacgaagatgggacaatagtgcagtttctatgttacccgagtacctgaggaagttctacctgaggctgttacagaactttgaagattttgaggatgaactgccaccaaatgagaggtaccgtgtggcttacaccagggaagcgtttcagatgacatctgaaagttatctccaggaaagtgaatggtttcatcatagctgcaagccaaagtttcaagaacaagtgaatgtgtctacagtatcgatcggacctcaaatagcagctaccgcgatgctaatgggcatgggtgatgaagcaaccagagatgcatttgagtgggcactgaggggagacactgctgttatgtccttcgggtggatagcccgtttcttgaatgacattgcttcatttaatagtgggaagagcaagaaagatgtggcaacttccgtggagtgttacatgaacgagtacaatgtaacaagtgaggtagccatgactgagataggctacctaattgaggatggatggaagacagcaaacagagctcgatttgagcatcctgagctacttccagcggtgcagcgaattatcaacctaacagtgtgcatgccgttcacgtaccgtggtaaaaaagatgcgcacacaggcagcaaggatatgaaggagacgattgagcgccttttcctcaatccaatgcccctctag

SEQ ID NO: 8968 - protein, 564 aa, Sorghum bicolor
  misc_feature: Ceres ANNOT ID no. 6094887
  misc_feature (242)..(510): Pfam Id: Terpene_synth_C Pfam Desc: Terpene synthase family, metal binding domain
  misc_feature (39)..(237): Pfam Id: Terpene_synth Pfam Desc: Terpene synthase, N-terminal domain
  misc_feature (21)..(564): NCBI GI: 46358535 NCBI Desc: terpene synthase 7 [zea mays]
  misc_feature (21)..(564): NCBI GI: 116309481 NCBI Desc: osigba0106g08.3 [oryza sativa (indica cultivar-group)]
  misc_feature (21)..(564): NCBI GI: 116309483 NCBI Desc: osigba0106g08.5 [oryza sativa (indica cultivar-group)]
  misc_feature (36)..(564): NCBI GI: 116309484 NCBI Desc: osigba0106g08.6 [oryza sativa (indica cultivar-group)]
  misc_feature (21)..(564): NCBI GI: 116309485 NCBI Desc: osigba0106g08.7 [oryza sativa (indica cultivar-group)]
MAASNTTAATHTDILQAHLQMAANNTTSAEVRTVDPSVWGDFFINYVPQPIQMSEGSMRERVNQLRKEVCGLFEACSDSNVVNQMSLVDTLQHLSIDHLFQEQIGATLHSIHGSRGFSTLHEAALRFRLLRTHGLWVSPDELISKFRGDDGSFRTEIMNDHRCLLSLYNAAHLLTHGEVELEEAILFARQHLELGLLTSSLRAPLAGQVTRALKLPLPRTLKRLEALDYMSEYTQEQTYNPSILELAKLDFNLLQRLHLKELKAICQWWKDIYQEVELNYMRDRVVECFFWSYTVYYEQDHLRARAMLTKIFALLTVVDDTFDDHATLDESRKLAEALRRWDNSAVSMLPEYLRKFYLRLLQNFEDFEDELPPNERYRVAYTREAFQMTSESYLQESEWFHHSCKPKFQEQVNVSTVSIGPQIAATAMLMGMGDEATRDAFEWALRGDTAVMSFGWIARFLNDIASFNSGKSKKDVATSVECYMNEYNVTSEVAMTEIGYLIEDGWKTANRARFEHPELLPAVQRIINLTVCMPFTYRGKKDAHTGSKDMKETIERLFLNPMPL

SEQ ID NO: 8969 - DNA, 1176 bp, Sorghum bicolor
  misc_feature: Ceres ANNOT ID no. 6094901
  misc_feature: Encodes the peptide sequence at SEQ ID NO 8970
  misc_feature: Down-regulated in root tissues in response to methyl jasmonate treatment
  misc_feature: Down-regulated in shoot tissues in response to salicylic acid treatment
atggcttccttctggcacgacgtctctctcattgtccttgtgctcctccttattggggtatccaattccaaagccagccacagccagctggatgtgaaccacaagaagccaatacagacgtttagaccttacaacattgcccaccgaggatcaaatggtgaattacccgaagagacagcggctgcctacctgagggctatcgaagaaggcgcagacttcatcgagaccgatatacttgcatcaaaggatggacacctcatctgtttccatgatgtaacgttagacgcaacaactaatgttgcgaaccatacggagtttgctgacaggaagaggacctatgaagtccaaggagaaaatgtcaccggatggttcattgtggatttcactcttaaagaacttaaatcactgagggtgaaacaacgactcagtttcagggaccaacgatacaatgggaagtatcagattattacttttgaggagtatatcttgattgcgctttacgctgacaggatagtcggaatataccctgagatcaagaatcccatcttcatcaaccagcatgtcaagtggtcgggtggaaagaattttgaggataagtttgtggagatgctactgaagtatggctacaaaggtgaatacatgtctgaaaattggctcaagcaaccgctgttcatacaatccttcgctccaacttcactgatttacatctccaacatgacaaactctcccaaactgttcctaatcgatgacacaacaattccaacacaagataccaatcagtcatactacgagataacttcaaattcttatctcacattcataagaaactatgttattgggattgggccgtggaaggacacaattgttcctccaaacccaaaagataactgtttaggacagcccactgatctcgtcgcacgagcacatgctctgaatcttcaggtgcatccatacactttcagaaatgagaaccaatacctgcacttcgatttccatcaagacccttattctgaatatgagtattggctcaacgagatcggcgtggacgggctgttcactgatttcaccggtagtctgcacaagtaccaacaatggactacaccataccagaaggaaaagaacccggaagcactcttgcgtgagatcgcgaacatgctgaagaatgatggctactga

SEQ ID NO: 8970 - protein, 391 aa, Sorghum bicolor
  misc_feature: Ceres ANNOT ID no. 6094901
  misc_feature (48)..(358): Pfam Id: GDPD Pfam Desc: Glycerophosphoryl diester phosphodiesterase family
  misc_feature (3)..(373): NCBI GI: 6562317 NCBI Desc: glycerophosphodiester phosphodiesterase-like protein [arabidopsis thaliana]
  misc_feature (8)..(280): NCBI GI: 56122686 NCBI Desc: glycerophosphodiester phosphodiesterase-like protein [manihot esculenta]
  misc_feature (43)..(354): NCBI GI: 103487690 NCBI Desc: glycerophosphoryl diester phosphodiesterase [sphingopyxis alaskensis rb2256]
  misc_feature (43)..(312): NCBI GI: 121595719 NCBI Desc: glycerophosphoryl diester phosphodiesterase [acidovorax sp. js42]
  misc_feature (42)..(355): NCBI GI: 126656105 NCBI Desc: glycerophosphoryl diester phosphodiesterase [cyanothece sp. ccy0110]
  misc_feature: Down-regulated in root tissues in response to methyl jasmonate treatment
  misc_feature: Down-regulated in shoot tissues in response to salicylic acid treatment
MASFWHDVSLIVLVLLLIGVSNSKASHSQLDVNHKKPIQTFRPYNIAHRGSNGELPEETAAAYLRAIEEGADFIETDILASKDGHLICFHDVTLDATTNVANHTEFADRKRTYEVQGENVTGWFIVDFTLKELKSLRVKQRLSFRDQRYNGKYQIITFEEYILIALYADRIVGIYPEIKNPIFINQHVKWSGGKNFEDKFVEMLLKYGYKGEYMSENWLKQPLFIQSFAPTSLIYISNMTNSPKLFLIDDTTIPTQDTNQSYYEITSNSYLTFIRNYVIGIGPWKDTIVPPNPKDNCLGQPTDLVARAHALNLQVHPYTFRNENQYLHFDFHQDPYSEYEYWLNEIGVDGLFTDFTGSLHKYQQWTTPYQKEKNPEALLREIANMLKNDGY

SEQ ID NO: 8971 - DNA, 1371 bp, Sorghum bicolor
  misc_feature: Ceres ANNOT ID no. 6094906
  misc_feature: Encodes the peptide sequence at SEQ ID NO 8972
atggccgacgccgcggcggcggccgccgtgcccggcgatgtccccgccagcaccaccgtgctggactcgctcggcgaggacatcacccgcatcgtctaccccgtctccgcctgcatgctcctcgtcgtcctcctggtctccctcctctcctcgccctcctccccctctcccctctccgcctccatcgcagccgccaccggcggcgtctccggaggaggggacggcgacgacatacccaccgcgctcatcaccgccctcaccttcgtcgttgccgtcaccgccgccactttcctgctcgcgctcctcttctacctccgctgcacgccctgcctccgcgcctacctcggcttctccgcgctcgccgtcctcctcgtcctcggcggccaggtcgcgctcctcctcctctcccgcctccgcttcccgctcgacgccgtctccttcgcgctcctcctgcccaacgccgcgggggcgctcgcgctcgccgcgctggcgccggcatccgtccccatcgcgctccaccaggccgcgctcgtcgccgtcgccgtgcttaccgccttctggttcacgatgctgcccgagtggaccacctgggcgctgctcgtcgccatggccatctacgacctcgcggccgtgctgctccccggtggccctttgagggtgctgcttgagctggccatacagaggaacgaggagataccggccttggtctatgaggccaggccggtggatccccgccatggccgaaattggcgcttgtggagggaagggaggcaacccggtgcggatttggatgaaagttccacggttgaggtgattggggaggtgttggggaggaatcttcaggccaaccctggaaacagttcatcatcccaagttcatgaagctgccactcttgctggtgatgttagtaattcaaggcccagggttacattgggggctgctttcagctcctctgattctactgttgcacaagctggggaggtttcagcattgccagagcatagagtggctgttgctgaaatgagtgtacctttgatccagccacgtccacagagatctggggaagaggtggaaggtgaagatggcattgggttgagctcatctggggcgatcaagcttgggttgggggatttcatattctacagcgttttggtcggtagggcagcaatgtatgactacatgacagtgtatgcctgctaccttgccatcattgcagggcttggcatcactctgctcctgctggcgttcttccgcaaggcattgcctgccctaccagtgtccatcgccctcggcgttgtgttttatgtgctcacaagaacactgcttgaggaatttgttgtgcagtgctccacaaatcttctgatgttttaa

SEQ ID NO: 8972 - protein, 456 aa, Sorghum bicolor
  misc_feature: Ceres ANNOT ID no. 6094906
  misc_feature (16)..(447): Pfam Id: Presenilin Pfam Desc: Presenilin
  misc_feature (1)..(417): NCBI GI: 115454059 NCBI Desc: os03g0603800 [oryza sativa (japonica cultivar-group)]
  misc_feature (18)..(456): NCBI GI: 16604521 NCBI Desc: at1g08700/f22o13_18 [arabidopsis thaliana]
  misc_feature (75)..(456): NCBI GI: 115435940 NCBI Desc: os01g0276400 [oryza sativa (japonica cultivar-group)]
  misc_feature (26)..(237): NCBI GI: 67476186 NCBI Desc: presenilin 1-related peptidase [entamoeba histolytica hm-1:imss]
  misc_feature (26)..(239): NCBI GI: 60463475 NCBI Desc: presenilin family protein [dictyostelium discoideum]
MADAAAAAAVPGDVPASTTVLDSLGEDITRIVYPVSACMLLVVLLVSLLSSPSSPSPLSASIAAATGGVSGGGDGDDIPTALITALTFVVAVTAATFLLALLFYLRCTPCLRAYLGFSALAVLLVLGGQVALLLLSRLRFPLDAVSFALLLPNAAGALALAALAPASVPIALHQAALVAVAVLTAFWFTMLPEWTTWALLVAMAIYDLAAVLLPGGPLRVLLELAIQRNEEIPALVYEARPVDPRHGRNWRLWREGRQPGADLDESSTVEVIGEVLGRNLQANPGNSSSSQVHEAATLAGDVSNSRPRVTLGAAFSSSDSTVAQAGEVSALPEHRVAVAEMSVPLIQPRPQRSGEEVEGEDGIGLSSSGAIKLGLGDFIFYSVLVGRAAMYDYMTVYACYLAIIAGLGITLLLLAFFRKALPALPVSIALGVVFYVLTRTLLEEFVVQCSTNLLMF

SEQ ID NO: 8973 - DNA, 1299 bp, Sorghum bicolor
  misc_feature: Ceres ANNOT ID no. 6094918
  misc_feature: Encodes the peptide sequence at SEQ ID NO 8974
atgctggccgacgttctcggccgcctcccgccgcgcagcctcgccgtgtcccgctgcgtctgcacggcgtggcgcgcggtgatcgacgcccgccgcctgctgcgaccagacctcctgccgctgtcgctcgatcgctgcagcagcagcagctgcagcagcttcccttactacccagcccacgttctcatcgaagatcactgcaacggcctcctcctcctccgcgacagcaactacgtcctcaacccggccacggggtggcggatggcgctgccgccggagtgcccgcggcctgcccacgcggggatggaggatttctggcaggacatgtaccttgtcttcgatcccaccgtgtcgtcgtcgcacttcgagttgtttctggtcccccgcgtccctttcgaccatagtatagaggagctggataagcacggagagcgtgtcttctatgccgagggtctgcagatagacacggctctgttgggatcacagtggccattgtcgccgtgcatcttgaacgtcttctcgtcggccacggggcgatgggaagagaggtcgtttcaccgtgacgatggcggcgagggagcaggaaccgtcgccgacatgcgaattgatgctggtgaacacttatttatgcggcgtcgcaacgctgtctacttccgaggagcactatatgttcattgcgaatacgatttcgttatgagaatatcattgtcaactaataagtaccatatgatcaagccaccacctacagttatctgtaactttccagagcttcatctaggaaagtctgagaatggaatttactttgccttgcttggtgatgaagcccaactttgggtttggatccttgctgaaacgaatggccaggcagagtggatactcaggcatggtactggtgctggtctttcgctgcaaagtctaaattgcactaaaagatttcatgcaccatggattttacatcatgtcacttcacatcatctcaccggtgctaaagatgaccagaatatcaatgcgctagcggaatataatgaatatgagtggaattctgataacgacgacgatgaggaggagattattcttcacagtgaagataataatggacaaacccactgcagcggatatctcgagatccttgcattccacccttacaaagagattctcttcttgcacagatcaatgagaagaggactggcgtatcatttgaattcatcaaaactagaggacttgggtgcattgtccccaaacatgcctttcatagaaaacataggaacatgttttccatttacgccttgttgggtatga

SEQ ID NO: 8974 - protein, 432 aa, Sorghum bicolor
  misc_feature: Ceres ANNOT ID no. 6094918
  misc_feature (1)..(432): NCBI GI: 115456876 NCBI Desc: os04g0113000 [oryza sativa (japonica cultivar-group)]
  misc_feature (1)..(432): NCBI GI: 116308824 NCBI Desc: osigba0112g01.1 [oryza sativa (indica cultivar-group)]
  misc_feature (149)..(427): NCBI GI: 53370641 NCBI Desc: f-box domain containing protein [oryza sativa (japonica cultivar-group)]
  misc_feature (161)..(297): NCBI GI: 50508587 NCBI Desc: protein with f-box domain-like [oryza sativa (japonica cultivar-group)]
  misc_feature (153)..(322): NCBI GI: 57900269 NCBI Desc: f-box domain containing protein-like [oryza sativa (japonica cultivar-group)]
MLADVLGRLPPRSLAVSRCVCTAWRAVIDARRLLRPDLLPLSLDRCSSSSCSSFPYYPAHVLIEDHCNGLLLLRDSNYVLNPATGWRMALPPECPRPAHAGMEDFWQDMYLVFDPTVSSSHFELFLVPRVPFDHSIEELDKHGERVFYAEGLQIDTALLGSQWPLSPCILNVFSSATGRWEERSFHRDDGGEGAGTVADMRIDAGEHLFMRRRNAVYFRGALYVHCEYDFVMRISLSTNKYHMIKPPPTVICNFPELHLGKSENGIYFALLGDEAQLWVWILAETNGQAEWILRHGTGAGLSLQSLNCTKRFHAPWILHHVTSHHLTGAKDDQNINALAEYNEYEWNSDNDDDEEEIILHSEDNNGQTHCSGYLEILAFHPYKEILFLHRSMRRGLAYHLNSSKLEDLGALSPNMPFIENIGTCFPFTPCWV

SEQ ID NO: 8975 - DNA, 1641 bp, Sorghum bicolor
  misc_feature: Ceres ANNOT ID no. 6094927
  misc_feature: Encodes the peptide sequence at SEQ ID NO 8976
atggccgccaaccacaatgttgatgtcgctagagagcctgccgcaagtgcctctccacccacctatgaagccgagcaccgcgctctccttcggtcgtcatcgttcatctctgccatctcagacaacaatgaaggatgcaaggaatgcgcatttgagccatctgaaaaggtcattgtttccgtctctggtgaccgcaaaggcgacgccaatgaagagggtgccttctatgcctcagggggttgcatgccacccttctcatggcgcaagttatggctattctcagggcctggcttcctgatgagcatcgcattcgtggacccaggaaacatcgagggtgacctacaggcgggggccacagcaggtggcacactattatgggtgctcctatgggccacaaccatgggcctactcgtgcagcttcacgctgcacgcctcggggtggccacggggaggcaccttgctgagttatgtcgtgatgagtacccagactgggcgcgtcacgcactttggttgatggctgagattgccttggttagtgccgacatccaagaggtcatcggaagcgccattgccatcaagatccttagccatggcctattgccgctctgggccggcgttgtcattaccgctttggattgctttatgtttctttccctggagaactatggggtgagaaagttggaaggtctatttgcggttctgattacaacaatggcgtgttccttcgcatggatgtttgtagagactgaacctagtggcaaagatctattcattggtattctggttccaaaattgagctcaggaacaataaaacaagccgttggccttgtcgggggtgttatcacacctcataatgtgttcctccattctgctcttgtgcaatcaagaaaaattgacccaaacaaggaatatgaagttcgtgaagcattgaggtactattccattgaatccaccctggcattggtagtgcccttcatgataaatttatttgtcacaacagtttttgcaaaaggatttcatggtaccaaggaagcagatagtatcggccttgagaatgctggaaaatatctacaagagaagtttggaggggactttttccctatcctttatatctggggtgttggattgttagccgctggcactagtagtaccataaccggaacttatgctggacaatttataatgggtggatttctaaattggcggttgaaaaaatggataagggcattgataactagaagctttgcgattgtgccaactataattgttgctttattcttcaacaaatctggctatgagctggatgttctcaatgagtggctcaatgtgctccagtcaattcagattcccttttctctcatcccactaataacactggtttccaaggaggaagtcatggggatgtacaagataggtccaagaatgaaaattgcaacctggatagttgcttctttaccgatcctaatcaatagctatatgttgttggacttcttctcttcagaaatggaaggcgtgttgtatagcttagctctatgtgtggttgtggcaacttattccgtgttcatactatatcttatttttcgaggaatggaatttccctactatcttgcaacaacattacacgagaatagttccatatag

SEQ ID NO: 8976 - protein, 546 aa, Sorghum bicolor
  misc_feature: Ceres ANNOT ID no. 6094927
  misc_feature (110)..(473): Pfam Id: Nramp Pfam Desc: Natural resistance-associated macrophage protein
  misc_feature (42)..(541): NCBI GI: 6468012 NCBI Desc: metal transporter nramp3 [arabidopsis thaliana]
  misc_feature (23)..(533): NCBI GI: 5231117 NCBI Desc: nramp2 [arabidopsis thaliana]
  misc_feature (47)..(532): NCBI GI: 57231016 NCBI Desc: nramp metal transporter-like protein [thlaspi caerulescens]
  misc_feature (47)..(542): NCBI GI: 6468014 NCBI Desc: metal transporter nramp4 [arabidopsis thaliana]
  misc_feature (47)..(542): NCBI GI: 22531257 NCBI Desc: natural resistance-associated macrophage protein [arabidopsis thaliana]
MAANHNVDVAREPAASASPPTYEAEHRALLRSSSFISAISDNNEGCKECAFEPSEKVIVSVSGDRKGDANEEGAFYASGGCMPPFSWRKLWLFSGPGFLMSIAFVDPGNIEGDLQAGATAGGTLLWVLLWATTMGLLVQLHAARLGVATGRHLAELCRDEYPDWARHALWLMAEIALVSADIQEVIGSAIAIKILSHGLLPLWAGVVITALDCFMFLSLENYGVRKLEGLFAVLITTMACSFAWMFVETEPSGKDLFIGILVPKLSSGTIKQAVGLVGGVITPHNVFLHSALVQSRKIDPNKEYEVREALRYYSIESTLALVVPFMINLFVTTVFAKGFHGTKEADSIGLENAGKYLQEKFGGDFFPILYIWGVGLLAAGTSSTITGTYAGQFIMGGFLNWRLKKWIRALITRSFAIVPTIIVALFFNKSGYELDVLNEWLNVLQSIQIPFSLIPLITLVSKEEVMGMYKIGPRMKIATWIVASLPILINSYMLLDFFSSEMEGVLYSLALCVVVATYSVFILYLIFRGMEFPYYLATTLHENSSI

SEQ ID NO: 8977 - DNA, 1362 bp, Sorghum bicolor
  misc_feature: Ceres ANNOT ID no. 6094950
  misc_feature: Encodes the peptide sequence at SEQ ID NO 8978
atggacttccaggtcgtcgtcctcgccggcggcacctccgactccgagaaactgtgccccctcgtttccaaggacgttcccaaggcgttgctcccggtcgccaaccgccccgtgctctcttacgcgctggaccttcttgaggccagcgacctcaaggacctcatcgtggtggttgaggggcaggaggcagcacagcttgtcgacgcttgggtatccagcgcgtacctggatcgccttcgagtggaggtagttgtggtttctgaagaccttggaagtgctggtgcattacgagctatttcaaagcgactgacagcaaatgatattttggtagttagcggtgacctggtaacagatgtgttgcctggagctgttgctgctactcatagaagaaatggtgcagctgttactgctttactatgttctgttcctgttagtggtccttcagacactgcttcttctagtgggaaagataaagctaaaaagccaactcgtttgaacatagtagggctggacaagagtaaacaattcttgttgcatatcgtgtcaggaactgatgttgaaaaagatgttcaagttcataaaagaaaaatacaggctgttggtcagatggaaattcgaagtgacctaatggatgcacatctttatgcttttaagaggacaatattacaggacgtactggaacagaaggaagcataccgtagcattagacttgaagtcctcccatatttagttaggagtcaattgagatcagctccatctggtggcagtggaacagcagttgatgaaactgggagtagtgctgttcagtccagtggtaatttgcagtgtttgtcacagcatcgtgtcattgcaccatctgctttcaagcaggatggtggtggacataggtgctgtgcttatattgctactaaaagcaaatactgtcaccggttgaactcaattcagtcgtattgtgatatcaatcgagacgttataggggaagctagccacttgtctggttattccttctctgcacaaaacaatatcatccacccatcctctgtgcttggatcaaagactacaataggaccacattgtattcttgctgagggttcacagctaggtgacaagtgtagtgtgaagcgatccgtgattggtcgtcactgccgaatcggttccaatgtgaagattgtcaactctgttgtgatgaatcacgttgttattgaagatggttgccacatccaaggttctgttgtatgtaataatgttcaactgcaagaacgggctgttctgaaagattgccaggttggagctggttatattgtgactggtggcagcgagcacaaagcagaatccctagcaagaaagtacagtgagctttga

SEQ ID NO: 8978 - protein, 453 aa, Sorghum bicolor
  misc_feature: Ceres ANNOT ID no. 6094950
  misc_feature (4)..(219): Pfam Id: NTP_transferase Pfam Desc: Nucleotidyl transferase
  misc_feature (1)..(449): NCBI GI: 92868692 NCBI Desc: glucose-1-phosphate adenylyltransferase, glgd subunit [medicago truncatula]
  misc_feature (1)..(444): NCBI GI: 30354582 NCBI Desc: similar to eukaryotic translation initiation factor 2b, subunit 3 gamma, 58kda [danio rerio]
  misc_feature (1)..(432): NCBI GI: 48675860 NCBI Desc: eukaryotic translation initiation factor 2b, subunit 3 (gamma, 58kd) [rattus norvegicus]
  misc_feature (1)..(435): NCBI GI: 110174985 NCBI Desc: eif2b-gamma protein [bombyx mori]
  misc_feature (1)..(432): NCBI GI: 119627418 NCBI Desc: eukaryotic translation initiation factor 2b, subunit 3 gamma, 58kda, isoform cra_c [homo sapiens]
MDFQVVVLAGGTSDSEKLCPLVSKDVPKALLPVANRPVLSYALDLLEASDLKDLIVVVEGQEAAQLVDAWVSSAYLDRLRVEVVVVSEDLGSAGALRAISKRLTANDILVVSGDLVTDVLPGAVAATHRRNGAAVTALLCSVPVSGPSDTASSSGKDKAKKPTRLNIVGLDKSKQFLLHIVSGTDVEKDVQVHKRKIQAVGQMEIRSDLMDAHLYAFKRTILQDVLEQKEAYRSIRLEVLPYLVRSQLRSAPSGGSGTAVDETGSSAVQSSGNLQCLSQHRVIAPSAFKQDGGGHRCCAYIATKSKYCHRLNSIQSYCDINRDVIGEASHLSGYSFSAQNNIIHPSSVLGSKTTIGPHCILAEGSQLGDKCSVKRSVIGRHCRIGSNVKIVNSVVMNHVVIEDGCHIQGSVVCNNVQLQERAVLKDCQVGAGYIVTGGSEHKAESLARKYSEL

SEQ ID NO: 8979 - DNA, 816 bp, Sorghum bicolor
  misc_feature: Ceres ANNOT ID no. 6094955
  misc_feature: Encodes the peptide sequence at SEQ ID NO 8980
atgctgcaaatgaccatgccatcgttcgccgtaacctccccttcatcgcatggcggtaccttatcggtgctccatgctcgtcattctcaaagattgcacaagagacacattcggagccaagtccgggcagtggcgcaaacacaactgcagtaccagaaactgggagattcagacctccttattagtgaggtcactcttggaacgatgacttttggagagcaaaacacagagaaggaagcgcatgatatgctctcttattcttttgataaaggggtcaatatcctagacacagcagaaatttacccgcttccattcaaaaaggaaactcaagggagaactgatctttacattggcaggtggatgcaactgaagccacgagacaagataattttggccaccaaagttgccggctattcagagaggtttacatttcttcgggaccatgcagaagtggtgcgtgttgatgcttccaatatcaaagaaagtgttgaaaagagccttaagcgcctatcaacagactacattgatttgctccagatacactggccagataggtatgtggcactatttggtgaatttagttataatccaaccaaatggaggccaagcttcccttttgaggaacaattgaaggctttccaggagctaattgatgaaggaaaggttcgctatattggtgtttccaatgagacctcatatggagtaatggagtttgtacatgctgcaaaggctcaaggccttccgaagatcgtgagcatccagaactgttatagtctgcttgtgagatgctgctttgaaggtgaaagcattgcttag

SEQ ID NO: 8980 - protein, 271 aa, Sorghum bicolor
  misc_feature: Ceres ANNOT ID no. 6094955
  misc_feature (54)..(272): Pfam Id: Aldo_ket_red Pfam Desc: Aldo/keto reductase family
  misc_feature (8)..(266): NCBI GI: 92893393 NCBI Desc: aldo/keto reductase [medicago truncatula]
  misc_feature (101)..(266): NCBI GI: 2341033 NCBI Desc: similar to babesia aldo-keto reductase (gbm93122). [arabidopsis thaliana]
  misc_feature (49)..(266): NCBI GI: 86605676 NCBI Desc: aldo/keto reductase tas [cyanobacteria bacterium yellowstone a-prime]
  misc_feature (49)..(267): NCBI GI: 75911206 NCBI Desc: aldo/keto reductase [anabaena variabilis atcc 29413]
  misc_feature (49)..(262): NCBI GI: 113476274 NCBI Desc: aldo/keto reductase [trichodesmium erythraeum ims101]
MLQMTMPSFAVTSPSSHGGTLSVLHARHSQRLHKRHIRSQVRAVAQTQLQYQKLGDSDLLISEVTLGTMTFGEQNTEKEAHDMLSYSFDKGVNILDTAEIYPLPFKKETQGRTDLYIGRWMQLKPRDKIILATKVAGYSERFTFLRDHAEVVRVDASNIKESVEKSLKRLSTDYIDLLQIHWPDRYVALFGEFSYNPTKWRPSFPFEEQLKAFQELIDEGKVRYIGVSNETSYGVMEFVHAAKAQGLPKIVSIQNCYSLLVRCCFEGESIA

SEQ ID NO: 8981 - DNA, 894 bp, Sorghum bicolor
  misc_feature: Ceres ANNOT ID no. 6094963
  misc_feature: Encodes the peptide sequence at SEQ ID NO 8982
atgtcgtcgtccaactcgccttgcgccgcgtgcaagctgctgcggcgcaagtgcacgcaggggtgcgtcttcgcgccctacttcccgcccgacaacccggccaagttctccagcgtgcaccgcatcttcggcgccagcaacgtctccaagctcctcaacgagctcccccaggcgcagcgggaggacgccgtcaactcgctcgcgtacgaggccgaggcgcgcctccgtgaccccgtctacggctgcgtctcctacatctccgtcctgcagctcaggatcaagcaggtccgcgaggagctcgccgccgcgcgcaaggagctggcggggtacattgggcccgcggccttcacgccgttcgtcgccacgccgcagtaccaccaccaccagtacgccgcgggcggcgtgcccctcgcggccgccgccggcatggggctcgccgtcggcgtcggcccgcagcacggtcaccacccgcaccaccagcagcagatcatggtgcatcagcaccagcaccagcacctccaccaccagcagatggcggctgccgaggcgcagcagcagctcgcggcggcagtggaggtcgcgcgagagcaggatctcatgatgcggcaggccgcggtctacgcgcacgccgtgcccgggagcagcggtggcggcggcggcggcggcggcgccacggtggccgttgtgccgcccgacgccgtgccgtacgagggcggcttcctcttccagcagcagccgccgccgtcgcaggcgcagacggccgtggcgctcacgtaccagatggagcagtccccgccgccgtcgtcctcgggccagtctcaccccgaggtgtcgcagcagcagaacacggatggcagcgacgagggcagcggcggtgtcgtgccgccggcctga

SEQ ID NO: 8982 - protein, 297 aa, Sorghum bicolor
  misc_feature: Ceres ANNOT ID no. 6094963
  misc_feature (4)..(110): NCBI GI: 84104907 NCBI Desc: ramosa 2 [sorghum bicolor]
  misc_feature (2)..(160): NCBI GI: 17227156 NCBI Desc: lob domain 6 [arabidopsis thaliana]
  misc_feature (4)..(160): NCBI GI: 60476771 NCBI Desc: as2 [triticum aestivum]
  misc_feature (4)..(115): NCBI GI: 62997483 NCBI Desc: asymmetric leaves2 [zea mays]
  misc_feature (4)..(115): NCBI GI: 20804970 NCBI Desc: b1099d03.24 [oryza sativa (japonica cultivar-group)]
MSSSNSPCAACKLLRRKCTQGCVFAPYFPPDNPAKFSSVHRIFGASNVSKLLNELPQAQREDAVNSLAYEAEARLRDPVYGCVSYISVLQLRIKQVREELAAARKELAGYIGPAAFTPFVATPQYHHHQYAAGGVPLAAAAGMGLAVGVGPQHGHHPHHQQQIMVHQHQHQHLHHQQMAAAEAQQQLAAAVEVAREQDLMMRQAAVYAHAVPGSSGGGGGGGGATVAVVPPDAVPYEGGFLFQQQPPPSQAQTAVALTYQMEQSPPPSSSGQSHPEVSQQQNTDGSDEGSGGVVPPA

SEQ ID NO: 8983 - DNA, 3573 bp, Sorghum bicolor
  misc_feature: Ceres ANNOT ID no. 6094969
  misc_feature: Encodes the peptide sequence at SEQ ID NO 8984
atgccgcccgcgcgccgccgcccgagccgtggcgcgaaccccgccggcggcggcggggacgacgactccgtcccctcctccgccgccgacctcctcgcgctcgccgccacgctcatcccggccgccgccaccgccgcgctcaaagccccgccccaactcaagcagctcgtgcactccctccccgtctcccacccgctcctcctctccctcccgcaggcgctcgccctcgccctcgctcccccttccgacgcgcccccgccccttcctccgcgctccgccgccgtcctcctccatctcctcgtcacgcaccccacccacccgccacgatgggacgacctcatctgcccgctcgcgctgctccacgcccgcctcgcgctcctcgccaacgccgacccgccgctcgcggccctcgccgcctcctgcttcgagctcgcctggcgcgccgacgcgccgggccgcgaggccctcgtcgcgcagacgctgccctacctcgtcgccctggcgctcacctccggctccagcgccaggcccgtcatccgccgcctcttcgcgctccgcgacgcgctgccgctgctcgactacgacgaccaccagagcatctacgacttcaagatgctcctgctgcgctgcttcgcctccccgctctttctcaaggccgaggaagggaggaagttcctcgcgctcgtgcttggtgtcagcgaggggatcgccagggaagggctggagctcatcagggcgcagctggtgatgacggggggcaagcgcgccgcggtggtggcctacggagaggtcatcttcagggcgtggaaggacgggggctgggtcaggggggaggtcggggaggcgttccttcaggggatggtcgagggcgccgtacacgccgggagcaaggaggtggccaaggcggccaggaagatcctgtcgtctttcgtcgagcagagggccgttgccggggttgaaaagttggtgttccggcttgccgaacctgtgctgttccgttccttgcaggttgctaactccaacgttcgccataatgctttgcatcttctattagatttgtttccccttgaagatccagatgtgacaaaggatgttaatgatcctcttctagagaagcagttcttcttgatagacaagctcctcatggatgaatatccagaaataagagcagttgcagttgaaggaatatgtcgtattcttaaccaatattgggaagttgtccctgcccccactatttcaaaatttctgagtaaaattgttgacgacatgtccaaggattcttgcaatgaagttcggctatcaacacttaatggtctcatatacttgcttgacaatccacaaagtcatgacatactgaaagttttacttccaagattaagcgatatgatctcagatactgctatgtctatcagagctgctgctgttgatcttcttttagctattcgtgatcttcgatcattccaatacaataaggtttggttgttggtctgggtactttattgtcttcacttgcaaatgatcatccccgcattgctcaaaaaattacaaagctcctcattccttcttattttcatcaagttgagcccaaaagaagcatgtgctcgctgcattgcactaatcaagaggtcaccaacagctggggcaagattttgtgaatctgctctgtctgaagggtcacccccaaggtctattgttgatctagtcaaatattcaattactcttgcattatcacaaacaggacttaactcagatcagattgatggtcttattattgcttcagtcaatcttataaaaagcttatccgatgagcgctctagtttggctgctttgcgagaattctttgcaaatgcgaagttaaggttggtccttaaaattgctgtttctgagggtgcccgggctgcccttcttagtatatctccagttgttttatctgatgatctatctgtgctgcatgaggaatgcatggatatagttatgaatgctgctaggatttcaaagcaagaagaatatcaggaaacagtgctggaggcacataagttgatagttttgggtaactggtctgatgagctgtttgaagcattgactaatactctgcaatctaaagcctctgattttgctaatatctatggagttgaacctcctccatgccctgttgcatcttcaaggaggaagaaaggcaaggcacttaagaaaataccgctacgtgacactgttgttggaaaggggtcatccaaatcaaaagtcagtaatgaagagcttgctgttgcggcgggggcagcatggcagatcaatgaaatagtaaaatctaaagacttgagagatgcctttcttcaatcttcttattcagagattgcattttcttccctgaaggtcatttctcaagtgtacgtcgagcagtgcctatattttgacactttagaccttgcacctatattggcctatttgagtctggctacatgtaatgaccttgcagatgttaatcaaactggaagctgctttgagtcctcaactgcaaatcagtcactggatcatctgctcaattgtttcgacaaacttctaaatggaactgttaacaatccaccatcaaaatcgaacaagaatggaaaagcttcacgatcaaaagaccagcagaaaggagcatctgaagtgaaaggcacgcttaatgcgattatgctgggtgcttcagttctcaaatttatcattgacacaactatgaagccagtcagtgatgataaaataaggtgcctcaaatttgcatcgtcctacataaaatatgcagtatcatccatcaaaaagcatcaggaacagagttcatctttcaagggggatgatctgaaggatgctttgttggttgtacggagctcctttacatacgcagccaagctacttcatttggttttatcaagctcacctgaggagtcaagccctccagaggaagccttcttccttgcaaatgatcttcttgatcttgtgcctattgtcgagtcctttgctggctcaagatttgcactccgcatagtttctgttctgaagcaatggctgcctgttctcttgttgggtcttgtatgccagtggctaactggaccacataatgaaatggcacccaacgtcttccactttgctgactctgtcttaccactgtgggtcactgctgtggcaaagaatgagcttgattccaaagagcctggccaggacgagcaaagcaattcagctgaagagggtgaggactcaccgttatgcagaaagctagcagaaatgatggcgatcctcctgaagaaaggaagccccagaatccttgattgcgtgagtggagtccttctgtccactttccagttgacgctgcaaagatcagagtatgacattgtcttgggcatgactcgtttcgtttgtgacaagttgctagggaacaactcccaagcattggaaaagctgcagcttacccaagactttcttcgtgagaatttccttgagattgataggtatgtcagagacgagcttgatgatgacgacgattcgaggcagcaactggagaaagcaaaagcgctgataagatcggttctcactgatgtctga

SEQ ID NO: 8984 - protein, 1190 aa, Sorghum bicolor
  misc_feature: Ceres ANNOT ID no. 6094969
  misc_feature (1)..(1190): NCBI GI: 108709844 NCBI Desc: heat repeat family protein [oryza sativa (japonica cultivar-group)]
  misc_feature (336)..(1153): NCBI GI: 115454123 NCBI Desc: os03g0616500 [oryza sativa (japonica cultivar-group)]
  misc_feature (146)..(653): NCBI GI: 49904652 NCBI Desc: 5830426i05rik protein [mus musculus]
  misc_feature (146)..(653): NCBI GI: 91208439 NCBI Desc: leucine zipper protein 5 [mus musculus]
  misc_feature (110)..(587): NCBI GI: 51262167 NCBI Desc: loc446284 protein [xenopus laevis]
MPPARRRPSRGANPAGGGGDDDSVPSSAADLLALAATLIPAAATAALKAPPQLKQLVHSLPVSHPLLLSLPQALALALAPPSDAPPPLPPRSAAVLLHLLVTHPTHPPRWDDLICPLALLHARLALLANADPPLAALAASCFELAWRADAPGREALVAQTLPYLVALALTSGSSARPVIRRLFALRDALPLLDYDDHQSIYDFKMLLLRCFASPLFLKAEEGRKFLALVLGVSEGIAREGLELIRAQLVMTGGKRAAVVAYGEVIFRAWKDGGWVRGEVGEAFLQGMVEGAVHAGSKEVAKAARKILSSFVEQRAVAGVEKLVFRLAEPVLFRSLQVANSNVRHNALHLLLDLFPLEDPDVTKDVNDPLLEKQFFLIDKLLMDEYPEIRAVAVEGICRILNQYWEVVPAPTISKFLSKIVDDMSKDSCNEVRLSTLNGLIYLLDNPQSHDILKVLLPRLSDMISDTAMSIRAAAVDLLLAIRDLRSFQYNKVWLLVWVLYCLHLQMIIPALLKKLQSSSFLLIFIKLSPKEACARCIALIKRSPTAGARFCESALSEGSPPRSIVDLVKYSITLALSQTGLNSDQIDGLIIASVNLIKSLSDERSSLAALREFFANAKLRLVLKIAVSEGARAALLSISPVVLSDDLSVLHEECMDIVMNAARISKQEEYQETVLEAHKLIVLGNWSDELFEALTNTLQSKASDFANIYGVEPPPCPVASSRRKKGKALKKIPLRDTVVGKGSSKSKVSNEELAVAAGAAWQINEIVKSKDLRDAFLQSSYSEIAFSSLKVISQVYVEQCLYFDTLDLAPILAYLSLATCNDLADVNQTGSCFESSTANQSLDHLLNCFDKLLNGTVNNPPSKSNKNGKASRSKDQQKGASEVKGTLNAIMLGASVLKFIIDTTMKPVSDDKIRCLKFASSYIKYAVSSIKKHQEQSSSFKGDDLKDALLVVRSSFTYAAKLLHLVLSSSPEESSPPEEAFFLANDLLDLVPIVESFAGSRFALRIVSVLKQWLPVLLLGLVCQWLTGPHNEMAPNVFHFADSVLPLWVTAVAKNELDSKEPGQDEQSNSAEEGEDSPLCRKLAEMMAILLKKGSPRILDCVSGVLLSTFQLTLQRSEYDIVLGMTRFVCDKLLGNNSQALEKLQLTQDFLRENFLEIDRYVRDELDDDDDSRQQLEKAKALIRSVLTDV

SEQ ID NO: 8985 - DNA, 903 bp, Sorghum bicolor
  misc_feature: Ceres ANNOT ID no. 6094974
  misc_feature: Encodes the peptide sequence at SEQ ID NO 8986
atggagtctggaggagtgattgcagagccaagctggagtttggttgatgtaccatttcaggctgaggagtcggagataatggaacagctgcttggtaccttcccctctaatggtgaggaagatcaccaagagtttccttggcctattcaagcttccaattcattttatttccattgcaatgctagtgcaagtacatatagctccacgagtagcaatggttctggtagtctcagccttattatgccatctgaacatgggggctactatttaagtgactcctgcactgcaccactgcacttaaacatggttcagaatcaaggtgcagctctgttcatggattccattcttaacccttcttacgggagctgtgattcaagctgtgatgatcttggggattcaagcatgaacctgctcgattccattggtacttctgacaagagaaagcacctggaacaaggcaaactggatggccacacaagaagtcgaaaatatgcaaagaagtctgattctaagagggccaagaagatcatgcaacgggaagatggacaaagcttgagttcctgcacctttgaaaatgactcaaatgcttctcaaggacggcctgtttctgataacctgggtggcaaggctaaagctgaccgccggtccgcaacagagtcccagagcctctacgcaaggaaaagaagagagaggatcaatgagaggctgaggatattgcagaaccttgtaccaaatggaaccaaagtagatatcagcactatgcttgaagaggcggtggagtatgtgaagttcttgcagcttcaaatcaagctcctcagctctgatgaaatgtggatgtatgctccgatcgcatacaacgggatgaatattggaattgatctgaacctctctcagcgtcgataa

SEQ ID NO: 8986 - protein, 300 aa, Sorghum bicolor
  misc_feature: Ceres ANNOT ID no. 6094974
  misc_feature (217)..(266): Pfam Id: HLH Pfam Desc: Helix-loop-helix DNA-binding domain
  misc_feature (160)..(297): NCBI GI: 92870215 NCBI Desc: helix-loop-helix dna-binding [medicago truncatula]
  misc_feature (180)..(297): NCBI GI: 108706746 NCBI Desc: helix-loop-helix dna-binding domain containing protein [oryza sativa (japonica cultivar-group)]
  misc_feature (9)..(288): NCBI GI: 102139852 NCBI Desc: basic helix-loop-helix (bhlh) family protein [musa acuminata]
  misc_feature (160)..(299): NCBI GI: 22327541 NCBI Desc: basic helix-loop-helix (bhlh) family protein [arabidopsis thaliana]
  misc_feature (181)..(271): NCBI GI: 6693022 NCBI Desc: t22c5.19 [arabidopsis thaliana]
  misc_feature: The sequence is a functional homolog of SEQ ID NO 198 in the 10/714,887US patent application
  misc_feature: The sequence is a functional homolog of SEQ ID NO 198 in the 11/435,388US patent application
  misc_feature: The sequence is a functional homolog of SEQ ID NO 2832 in the 10/374,780US patent application
  misc_feature: The sequence is a functional homolog of SEQ ID NO 42 in the 11/375,241US patent application
  misc_feature: The sequence is a functional homolog of SEQ ID NO 680 in the 11/435,388US patent application
  misc_feature: The sequence is a functional homolog of SEQ ID NO 932 in the 10/225,066US patent application
  misc_feature: The sequence is a functional homolog of SEQ ID NO 96 in the 10/374,780US patent application
  misc_feature: Useful for making plants with modulated growth and phenotype characteristics
  misc_feature: The sequence is a functional homolog of SEQ ID NO 932 in the 20050160493 US patent application
  misc_feature: The sequence is a functional homolog of SEQ ID NO 198 in the 20060015972 US patent application
  misc_feature: The sequence is a functional homolog of SEQ ID NO 96 in the 20060162006 US patent application
  misc_feature: The sequence is a functional homolog of SEQ ID NO 2832 in the 10/374,780 US patent application
  misc_feature: The sequence is a functional homolog of SEQ ID NO 680 in the 11/435,388 US patent application
  misc_feature: The sequence is a functional homolog of SEQ ID NO 932 in the 10/225,066 US patent application
MESGGVIAEPSWSLVDVPFQAEESEIMEQLLGTFPSNGEEDHQEFPWPIQASNSFYFHCNASASTYSSTSSNGSGSLSLIMPSEHGGYYLSDSCTAPLHLNMVQNQGAALFMDSILNPSYGSCDSSCDDLGDSSMNLLDSIGTSDKRKHLEQGKLDGHTRSRKYAKKSDSKRAKKIMQREDGQSLSSCTFENDSNASQGRPVSDNLGGKAKADRRSATESQSLYARKRRERINERLRILQNLVPNGTKVDISTMLEEAVEYVKFLQLQIKLLSSDEMWMYAPIAYNGMNIGIDLNLSQRR

SEQ ID NO: 8987 - DNA, 1629 bp, Sorghum bicolor
  misc_feature: Ceres ANNOT ID no. 6095033
  misc_feature: Encodes the peptide sequence at SEQ ID NO 8988
atggcgagcgacgaggagggggaggtgtgcgactacttctacgacgacgacgacgccgaggaggacgccgccgccggcctggaggaggactcttcgccgccgccgccgccgccgcacggcgcggactactgggctatcacacaagagaccgtttttgctgcacagaaacaagacctgtctacggtgatgaatttgctcaacataaaaaaatatcaagcacgggccctcctcatccaccaccggtggaggatcgatggcatctatgattccttagacaaggggcgagaatgcatgctcagaaatgcaggaatcgtgctacaggagaataatagcatggtggcagctggctcaacgacaccatggagaaccgtgacctgcaaagtgtgcttcgaggaattctccatggctgctgtttcgaccatggactgtgggcattgcttctgcaatgactgttggacagggcatttccacgctgcagtagagagtggaaaaaaacaaattcggtgcatggaggtcaagtgctcggctttctgtgatgagaacctcgtgctgtttctccttggccaaaagtatccagacatggccaagcgtttcaatcgcttcctgcttgagtcctacattgaggacaacgcctctgtgaagtggtgccccagcaccccaaactgtggccatgccatccgcgtgggcaccggcgagcgctactgcgaggtggaatgcccctgcggcctaagcttctgctttaactgtatggcgcatgcgcattcgccttgcccgtgccccatatgggagaaatggaatgccaagcgctccgagggagagaacatcaagtggatcctcgctaacaccaagagctgccccaaatgcttcaaggccatcgagaagaatggtggatgcaaccttgtccgctgcaagtgcggccagtgtatgtgttggctctgcggcggaggtactggcatggatcacacgtggaccagcattgccggtcacagctgcaaccggtacaaggaggagtcccgtggaaagacggcggacacgagcagggagcagatggagcggtacaagcactaccacgaccggttcaagatccacggcgactcgtacagcgtggagaagcagaagctgggggcgaccatcgcggagcaggtgcggctcctggagtcggacaaggaccgcccgctcgccatccgggacggcgactggctgacccgggcgcaccgccgtctgctggtgtcgcggcaggtgctgtcgcggtcgtacgtgttcgcctactacatgttcggcggcgggtgccagctgcggacgctcccagtcccggcggcgaggcgcgcgggcgcgagcctcctgggcgtggcgcggaacctgttcgaggaccagcaggagcagctggagcagcacgtggagcacctgtcgaggtcgctggcggaggcggccgtggtggcggggacccccgaggcggagatcgtgcggcagaagcaggcggccgtcacgctcgccaagaccgtggagcggctgtgcggggagatgtacaagtgcatccaggacgagctgctcacgctgctcgtcgagcccatgaccatcgcggcctacaggccggacggccccgaccgagccagggagctcgcggcctga

SEQ ID NO: 8988 - protein, 542 aa, Sorghum bicolor
  misc_feature: Ceres ANNOT ID no. 6095033
  misc_feature (196)..(259): Pfam Id: IBR Pfam Desc: IBR domain
  misc_feature (1)..(539): NCBI GI: 20855959 NCBI Desc: at2g16090/f7h1.11 [arabidopsis thaliana]
  misc_feature (1)..(539): NCBI GI: 29125020 NCBI Desc: ariadne-like protein ari2 [arabidopsis thaliana]
  misc_feature (193)..(542): NCBI GI: 15232252 NCBI Desc: zinc finger protein-related [arabidopsis thaliana]
  misc_feature (172)..(542): NCBI GI: 9294477 NCBI Desc: ring finger protein-like [arabidopsis thaliana]
  misc_feature (17)..(425): NCBI GI: 60465908 NCBI Desc: ariadne-like ubiquitin ligase [dictyostelium discoideum]
  misc_feature: The sequence is a functional homolog of SEQ ID NO 1727 in the 10/374,780US patent application
  misc_feature: The sequence is a functional homolog of SEQ ID NO 274 in the 10/666,642US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO 274 in the 20070033671 US patent application
  misc_feature: The sequence is a functional homolog of SEQ ID NO. 493 in the 11/188,298 US application
MASDEEGEVCDYFYDDDDAEEDAAAGLEEDSSPPPPPPHGADYWAITQETVFAAQKQDLSTVMNLLNIKKYQARALLIHHRWRIDGIYDSLDKGRECMLRNAGIVLQENNSMVAAGSTTPWRTVTCKVCFEEFSMAAVSTMDCGHCFCNDCWTGHFHAAVESGKKQIRCMEVKCSAFCDENLVLFLLGQKYPDMAKRFNRFLLESYIEDNASVKWCPSTPNCGHAIRVGTGERYCEVECPCGLSFCFNCMAHAHSPCPCPIWEKWNAKRSEGENIKWILANTKSCPKCFKAIEKNGGCNLVRCKCGQCMCWLCGGGTGMDHTWTSIAGHSCNRYKEESRGKTADTSREQMERYKHYHDRFKIHGDSYSVEKQKLGATIAEQVRLLESDKDRPLAIRDGDWLTRAHRRLLVSRQVLSRSYVFAYYMFGGGCQLRTLPVPAARRAGASLLGVARNLFEDQQEQLEQHVEHLSRSLAEAAVVAGTPEAEIVRQKQAAVTLAKTVERLCGEMYKCIQDELLTLLVEPMTIAAYRPDGPDRARELAA

SEQ ID NO: 8989 - DNA, 1608 bp, Sorghum bicolor
  misc_feature: Ceres ANNOT ID no. 6095038
  misc_feature: Encodes the peptide sequence at SEQ ID NO 8990
atgccgcaccatccgccgcgcatgtacaatactagcgacttctacggcagtgatgaagacgaggagctggtgacgggggacgacgatgaggatgaggggtggcaggaccaggaggaggatgacatgccgccgcggcggtccctgcagatttcggccattaagaaggactctctttcggtggcgcagcaacaagacctgtccatggtgatgggcctgttcaacataaagcagcaccacgcgcgtgctctcctcatccactgccggtggaacaccgattgcctcggtgaccacctggagaggaaagggcaagaacgcatgctcatggaggccggcgtcgtgctacagcaacaggagacgagcagcagcagcagcagcagcagggtgctgtgcgaggtgtgtttcgaggactcgtcgccgcgccacgtctccaccatggactgcggccactccttctgcaacgactgctggacgcagcacttcgtcgccgcgctcgacctgggcaagaaacagatccggtgcatggggttcaggtgccccgccatctgcgacgaggccgtggtgcagcggctcctgggccgccgggaccccgccgcggcacggcggctccacgacctgctcctccggtcgtacgtggacgacaacggcgccgtgaagtggtgccccagcgttccgcactgcggccgcgccatccgcgtggacgccgccgacgaggcggagccgctgtgcgaggtgtcgtgcccctgcggcgtcagcttctgcttccggtgcgccgcggccgcgcactcgccgtgcccgtgcgccatgtgggagcgctgggaggccaagagccagggcgaggccgagaacgtccggtggctcctcgccaacaccaagagctgccccaagtgcttcaggcccatcgacaagatcgacggctgcaaccttatgacctgccaatgcggccagcatttctgttggctgtgcggcggcgccacagggtttgcacacacatggactaggatcaacaaccacagctgcaaccgcttcgagaagggggaggagaagaggaaggtggacgacgccaagcggcaggtgcggcggtacgagcactactaccagcggttccacgcgcacgacttctcgtacagggcggagcacgacaagctggggccggcggtcgccgggcgcgcgctgacgctggagcggagcggcggcgtcctgaccagggacgcggcgtggctgggcgacgcgcacgggagcctgctgcggtgccggcaggtgctggcgcgctcctacgcgttcgcctactacatgttcgacgccgaggcgacggcgacgctgtccatggcgaagaagcaggcgctgttcgaggactaccaggagcaggtggagggcaacgtggagcggctgtccaagctgctggagacgacggacgtgcctgagctgccggagccggagatcctgcaggcgaagcaggacgtcaccaacctcgtccgggtcgtcgaggcgcactgcggcaagatgtacggatgcatccaggacgagctgctgccgatgctcgtcgagcccatgtccatcgtggcgtaccagcagggcggccccagcaaggcccacgagttgccggcttga

SEQ ID NO: 8990 - protein, 535 aa, Sorghum bicolor
  misc_feature: Ceres ANNOT ID no. 6095038
  misc_feature (200)..(266): Pfam Id: IBR Pfam Desc: IBR domain
  misc_feature (17)..(532): NCBI GI: 20855959 NCBI Desc: at2g16090/f7h1.11 [arabidopsis thaliana]
  misc_feature (17)..(532): NCBI GI: 29125020 NCBI Desc: ariadne-like protein ari2 [arabidopsis thaliana]
  misc_feature (212)..(535): NCBI GI: 9294477 NCBI Desc: ring finger protein-like [arabidopsis thaliana]
  misc_feature (199)..(535): NCBI GI: 15232252 NCBI Desc: zinc finger protein-related [arabidopsis thaliana]
  misc_feature (18)..(494): NCBI GI: 110617782 NCBI Desc: ring-5 [gibberella zeae]
  misc_feature: The sequence is a functional homolog of SEQ ID NO 1727 in the 10/374,780US patent application
  misc_feature: The sequence is a functional homolog of SEQ ID NO 330 in the 10/374,780US patent application
  misc_feature: The sequence is a functional homolog of SEQ ID NO 56 in the 11/375,241US patent application
  misc_feature: The sequence is a functional homolog of SEQ ID NO 854 in the 10/225,066US patent application
  misc_feature: Useful for making plants with modulated growth and phenotype characteristics
  misc_feature: The sequence is a functional homolog of SEQ ID NO 854 in the 20050160493 US patent application
  misc_feature: The sequence is a functional homolog of SEQ ID NO 1727 in the 20060162006 US patent application
  misc_feature: The sequence is a functional homolog of SEQ ID NO. 493 in the 11/188,298 US application
MPHHPPRMYNTSDFYGSDEDEELVTGDDDEDEGWQDQEEDDMPPRRSLQISAIKKDSLSVAQQQDLSMVMGLFNIKQHHARALLIHCRWNTDCLGDHLERKGQERMLMEAGVVLQQQETSSSSSSSRVLCEVCFEDSSPRHVSTMDCGHSFCNDCWTQHFVAALDLGKKQIRCMGFRCPAICDEAVVQRLLGRRDPAAARRLHDLLLRSYVDDNGAVKWCPSVPHCGRAIRVDAADEAEPLCEVSCPCGVSFCFRCAAAAHSPCPCAMWERWEAKSQGEAENVRWLLANTKSCPKCFRPIDKIDGCNLMTCQCGQHFCWLCGGATGFAHTWTRINNHSCNRFEKGEEKRKVDDAKRQVRRYEHYYQRFHAHDFSYRAEHDKLGPAVAGRALTLERSGGVLTRDAAWLGDAHGSLLRCRQVLARSYAFAYYMFDAEATATLSMAKKQALFEDYQEQVEGNVERLSKLLETTDVPELPEPEILQAKQDVTNLVRVVEAHCGKMYGCIQDELLPMLVEPMSIVAYQQGGPSKAHELPA

SEQ ID NO: 8991 - DNA, 1785 bp, Sorghum bicolor
  misc_feature: Ceres ANNOT ID no. 6095055
  misc_feature: Encodes the peptide sequence at SEQ ID NO 8992
atggcgtcgctgcccaagccgccgccgccgccgcgccccaagacgcggggcaactacaactgcggccgctgcggccagcccaagaagggccacgtctgcgtcggccccgtcgcccccggccccgccccgaccccgtcgccctcctcctcgtcgggggccgccagcgccaccgccagcgccagcgccggaggaggggagcagcagcacaggctccgccgcgccctctccttcgacgaggccggaaccacgccgtcgtcgccggagaagaagcccaaggtggaggacgacgcggacatggccgaggcggagctggacgacgaggaggagggcgccacggtggacgtgggcgcccgccgccccgtgcccacggaggtcatggcggaggtcctgcaccgcctcggcccccgcggggtcttggccgccgcgggcgtcagccgcggctggcgggactgcgcgggccgcgtctggcgggccgccgacgagctccgcctccgcgtcctcgccgcctctggcgtcgccctcctcgccgcgctgctcccgcgctgcaccgcgctctcccgcctgtacctccgaatggaaagtgatgttgacgccactaccttggattgtattgcattttcctgcccaagtttaagaactctcgagattaccatggctgctgatgcagtcaacaggattactggggaggatctaagtcgttttgtctcggagaagtctactctctcagttctcaaaattggtggttgctctaatttggatattcttaatctgtgctcttcaagcctttcaattctttggctgtcagatctttgttccctttcgaaatcggttatgaactgtcctaatatgaatgagctctcactatgcttcacacaacaaagtagtgattgtaccgatctggttactttgatggatggcctaggtcgtacatgccttaacttgaaaaaaatgcacatatcatcaagtcaattatccaatgaagctgtatgcgctctagagaatgctaatctcaggggactgtgcatgctatccttgattctaggttcaaaaataactgatgcagctgttgcatctattgttcggtcgtgtccgagcttggagttacttgatttaagtggatctagcattagtgataatggtgttgggatgatctgcaaagcgttccctcatactttatcaaggctgctccttgctctttgcccaaatgtgaccacacgtgggatccagctagccacagcacagttgccatgtctccaactcatggactgtggaatgagcctatgcactaacatgaagaatgaaaaagagggtccatattttggtgaactcaatggatgtattagaattataccaaaactatccaccttaaagaggcaacctattcaccaaaagcttattataaagcatgggaatttgaagaaactcagtctgtggggctgttctgcaatagatgctctatatgtaaattgtccagagttaaatgatctcaatcttaactcttgcacaaatctacatccagaacgtctgcttcttcagtgcccaaatttgaagaatgtccatgcatctggatgccaagatatgttgattggagcaatcagaaatcaggttctgaatgagttcgctgcagctgaaccatctcttccctgcaagcggctagcagatggcttgaaacgggttcaactcccccagttccaaaagcagcagccattggaggacgacaaattgattcaattgagccagacccagtgcatcttggttcataataacatcactagagccagttaa

SEQ ID NO: 8992 - protein, 594 aa, Sorghum bicolor
  misc_feature: Ceres ANNOT ID no. 6095055
  misc_feature (55)..(587): NCBI GI: 115454223 NCBI Desc: os03g0633400 [oryza sativa (japonica cultivar-group)]
  misc_feature (14)..(587): NCBI GI: 22655356 NCBI Desc: at3g54650/t5n23_10 [arabidopsis thaliana]
  misc_feature (164)..(527): NCBI GI: 19921840 NCBI Desc: cg8272-pa [drosophila melanogaster]
  misc_feature (152)..(505): NCBI GI: 124007179 NCBI Desc: f-box/lrr-repeat protein 15
  misc_feature (203)..(513): NCBI GI: 108876631 NCBI Desc: f-box/leucine rich repeat protein [aedes aegypti]
MASLPKPPPPPRPKTRGNYNCGRCGQPKKGHVCVGPVAPGPAPTPSPSSSSGAASATASASAGGGEQQHRLRRALSFDEAGTTPSSPEKKPKVEDDADMAEAELDDEEEGATVDVGARRPVPTEVMAEVLHRLGPRGVLAAAGVSRGWRDCAGRVWRAADELRLRVLAASGVALLAALLPRCTALSRLYLRMESDVDATTLDCIAFSCPSLRTLEITMAADAVNRITGEDLSRFVSEKSTLSVLKIGGCSNLDILNLCSSSLSILWLSDLCSLSKSVMNCPNMNELSLCFTQQSSDCTDLVTLMDGLGRTCLNLKKMHISSSQLSNEAVCALENANLRGLCMLSLILGSKITDAAVASIVRSCPSLELLDLSGSSISDNGVGMICKAFPHTLSRLLLALCPNVTTRGIQLATAQLPCLQLMDCGMSLCTNMKNEKEGPYFGELNGCIRIIPKLSTLKRQPIHQKLIIKHGNLKKLSLWGCSAIDALYVNCPELNDLNLNSCTNLHPERLLLQCPNLKNVHASGCQDMLIGAIRNQVLNEFAAAEPSLPCKRLADGLKRVQLPQFQKQQPLEDDKLIQLSQTQCILVHNNITRAS

SEQ ID NO: 8993 - DNA, 2205 bp, Sorghum bicolor
  misc_feature: Ceres ANNOT ID no. 6095056
  misc_feature: Encodes the peptide sequence at SEQ ID NO 8994
atggcgggaaggtactaccaggggcagggcggtggcggtggcgggggcgcgtccatggaggtagtcagcacgccgaaccaggagctggcgctcaccaactgcgcgtacatctcccccgcggacctccgtcgcttccccaacggcctcgccctcgtcgccgacgcctgggtcttcaccctacgatatccttttattgatggtctccgtcggcaggcgaaggtttcagctggggattctgttactgttagcagttttgtcccccctgatgatttcaagttggctttgctcactttagagctagagtatgccaaggcaagagccaaccgaaatgacgagctggatgctgttgtgcttgcccaacaactccgtaagaggtttctggatcaggtcatgacctcggggcaaagggtgccttttgaattttatgggacaaactatgtgttcactgtcaatcaagctttgttagagggtcaagagagttctacaccattggatagaggatacttgtcaagtgatacatacatcatatttgaggctgctcctaattcaggaattaaggtgatcaaccaaaaggaagctgctagcagcaaacttttcaaacataaagagtttaacctggaaaaattggggataggtgggttaagtgctgaattcactgacatatttcgtagggcatttgcttcaagagtgtttcctcctcacgttgtcagtaagttgggcatcaagcatgtaaagggcatattgctatatggacctccaggtactggcaagactcttatggcccggcaaattggaaagttattaaatggaaaagatcccaagattgtgaatggacctgaagttctgagcaagtttgttggagaaaccgagaagaatgtgagagatttgtttgctgatgctgaaaatgagcagaggacacgaggtgaccagagtgacctccatgttatcatatttgatgaaattgatgccatctgcaagtctagaggatctacccgtgatggtacaggtgtacatgatagcattgtaaaccagctccttacaaagatagatggtgttgaggcgctgaataacgtattgcttattggaatgaccaatcgtaaagatttgctcgatgaagctttattgagacctggacgattggaagttcacatcgagataaacctgcctgatgaaaatggtcgtttgcaaatccttcagattcatacaaataagatgaaagagaattctttcctatctccagatattaatcttcatgagctagccgcacggacaaagaactacagtggagcggagttggaaggtgttgtcaaaagtgctgtctcgtatgctttgaaccggcagataaccatggatgacctcactaaacctttagatgaggaaagcattaaggttactatggatgattttgtgaatgcacttcatgaaattactcctgcatttggtgcttccaccgatgatctcgaaagatgcagattgcgaggtattgttgattgtggcaaggcacataagcatatttaccagagagctatgctccttgtagagcaagttaaagttagcaaaggtagtccacttgtgacttgcctcttggaaggtcctgctggaagtggtaaaacagctatggcagcaagtgttggcattgacagtgattttgcatatgttaaaattatatcagcagaaacaatgattggtttcagtgagagcagcaagtgtgcacagatttgcaaggtttttgaggatgcatacaagtctcagttcagcatcataattcttgatgatatcgaaaggttactggagtatgtagccattggaccacgtttttcaaacttgatctctcaaactcttctggtcctcctcaagagggttcctcctaagggaaaaaacttgcttgtgattggaacaacaagcgaggttggcttcctagaatctgttggaatgtgtgatgtgttctctgtgacataccatgttcccaaactgaaaaaggaggatgccaaaaaggtattgcatcgtcttgatgtgttcgatgatggagatcttgatgcagcagcagaagcactggatgatatgccaatcaaaaagctgtacacacttgttgagatggctgcacaggggccaaccggaggaagtgcagaagcaatttataccggagaggacaagatagatatcaaccatttcttcagcatcttgagtgatattatccgttactaa

SEQ ID NO: 8994 - protein, 734 aa, Sorghum bicolor
  misc_feature: Ceres ANNOT ID no. 6095056
  misc_feature (246)..(445): Pfam Id: AAA Pfam Desc: ATPase family associated with various cellular activities(AAA)
  misc_feature (526)..(706): Pfam Id: AAA Pfam Desc: ATPase family associated with various cellular activities(AAA)
  misc_feature (1)..(734): NCBI GI: 1449179 NCBI Desc: n-ethylmaleimide sensitive fusion protein [nicotiana tabacum]
  misc_feature (1)..(734): NCBI GI: 20856713 NCBI Desc: at4g04910/t1j1_4 [arabidopsis thaliana]
  misc_feature (69)..(693): NCBI GI: 4325346 NCBI Desc: similar to n-ethylmaleimide sensitive fusion proteins; contains similarity to atpases (pfam: pf00004, score=307.7, e=1.4e-88n n=1) [arabidopsis thaliana]
  misc_feature (69)..(702): NCBI GI: 21040484 NCBI Desc: n-ethylmaleimide-sensitive factor [homo sapiens]
  misc_feature (69)..(702): NCBI GI: 10257494 NCBI Desc: n-ethylmaleimide-sensitive factor [homo sapiens]
  misc_feature (1)..(734): SWISSPROT Homolog: EC 3.6.4.6 Vesicle-fusing ATPase
  misc_feature: The sequence is a functional homolog of SEQ ID NO. 462 in the 11/188,298 US application
  misc_feature: The sequence is a functional homolog of SEQ ID NO. 471 in the 11/188,298 US application
MAGRYYQGQGGGGGGGASMEVVSTPNQELALTNCAYISPADLRRFPNGLALVADAWVFTLRYPFIDGLRRQAKVSAGDSVTVSSFVPPDDFKLALLTLELEYAKARANRNDELDAVVLAQQLRKRFLDQVMTSGQRVPFEFYGTNYVFTVNQALLEGQESSTPLDRGYLSSDTYIIFEAAPNSGIKVINQKEAASSKLFKHKEFNLEKLGIGGLSAEFTDIFRRAFASRVFPPHVVSKLGIKHVKGILLYGPPGTGKTLMARQIGKLLNGKDPKIVNGPEVLSKFVGETEKNVRDLFADAENEQRTRGDQSDLHVIIFDEIDAICKSRGSTRDGTGVHDSIVNQLLTKIDGVEALNNVLLIGMTNRKDLLDEALLRPGRLEVHIEINLPDENGRLQILQIHTNKMKENSFLSPDINLHELAARTKNYSGAELEGVVKSAVSYALNRQITMDDLTKPLDEESIKVTMDDFVNALHEITPAFGASTDDLERCRLRGIVDCGKAHKHIYQRAMLLVEQVKVSKGSPLVTCLLEGPAGSGKTAMAASVGIDSDFAYVKIISAETMIGFSESSKCAQICKVFEDAYKSQFSIIILDDIERLLEYVAIGPRFSNLISQTLLVLLKRVPPKGKNLLVIGTTSEVGFLESVGMCDVFSVTYHVPKLKKEDAKKVLHRLDVFDDGDLDAAAEALDDMPIKKLYTLVEMAAQGPTGGSAEAIYTGEDKIDINHFFSILSDIIRY

SEQ ID NO: 8995 - DNA, 795 bp, Sorghum bicolor
  misc_feature: Ceres ANNOT ID no. 6095057
  misc_feature: Encodes the peptide sequence at SEQ ID NO 8996
atggcgggcctcgggttcgaggagaccgagctccggctcggcctgcccggcggcaacgacgccggggatgccgcggcggcgaggaagcggggtttcgaggagaccatcgacctcaagctgaagctggagcagccggcggcgccgcacttggagaaggaggaggaggctggcgctggcgacgccgtcgcccccggcgcggtcccactgtcgtcgcctccagcagccagcaccgccggcgcaggtacggccatgaagaggtcgccgagccagagcagcgtggtcaccgccgacgcgccgccggaccccgaaaagcctcgcgcccccaaggcacaggcggtgggctggccgcccgtccggtcgttccgcaagagcatcctggccgtccaatcccagagaagtggaggcgacgacaaggtcaacggcggcaagacgtcaccggcgttcgtgaaggtgagcatggacggcgcgccgtacctgcgcaaggtggacctgaggacgtacgggagctaccaggagctgtccaaggcgctccagaagatgttcagctccttcaccatcggcagctgcgggccgcaggggatgatgaacgaggagacgaagctgcaggcggacctagtgagcggctccgacgactacttgcccacgtacgaggacaaggacggcgactggatgctcgtcggcgacgtcccctgggagatgttcgtggagtcgtgcaagcgcctccggatcatgaaaggatcggaagccgtcggcctcgcacccagggcgatggacaagtgcaacaacagctgctga

SEQ ID NO: 8996 - protein, 264 aa, Sorghum bicolor
  misc_feature: Ceres ANNOT ID no. 6095057
  misc_feature (4)..(256): Pfam Id: AUX_IAA Pfam Desc: AUX/IAA family
  misc_feature (2)..(262): NCBI GI: 88911337 NCBI Desc: auxin-responsive protein iaa30 (indoleacetic acid-induced protein 30)
  misc_feature (2)..(262): NCBI GI: 77556997 NCBI Desc: aux/iaa protein [oryza sativa (japonica cultivar-group)]
  misc_feature (87)..(262): NCBI GI: 6175173 NCBI Desc: auxin-induced protein [arabidopsis thaliana]
  misc_feature (85)..(262): NCBI GI: 53748471 NCBI Desc: auxin resistance protein [plantago major]
  misc_feature (98)..(262): NCBI GI: 4887020 NCBI Desc: nt-iaa28 deduced protein [nicotiana tabacum]
  misc_feature: The sequence is a functional homolog of SEQ ID NO 1149 in the 10/412,699US patent application
  misc_feature: The sequence is a functional homolog of SEQ ID NO 2006 in the 10/374,780US patent application
  misc_feature: The sequence is a functional homolog of SEQ ID NO 288 in the 10/412,699US patent application
  misc_feature: The sequence is a functional homolog of SEQ ID NO 664 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 288 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Useful for making plants with altered terpenoid content
  misc_feature: Functional homolog of the protein sequence given in SEQ ID NO 13610
  misc_feature: Useful for making plants with altered alkaloid content
  misc_feature: Functional homolog of the protein sequence given in SEQ ID NO 13611
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with modulated nitrogen use efficiency
  misc_feature: Functional homolog of the protein sequence given in SEQ ID NO 13612
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 739 in the 10/374,780 US patent application
  misc_feature: The sequence is a functional homolog of SEQ ID NO 890 in the 10/412,699 US patent application
  misc_feature: The sequence is a functional homolog of SEQ ID NO 737 in the 10/374,780 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 656 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 652 in the 11/479,226 US patent application
  misc_feature: Useful for making plants with altered lignin content
  misc_feature: Functional homolog of the protein sequence given in SEQ ID NO 13704
MAGLGFEETELRLGLPGGNDAGDAAAARKRGFEETIDLKLKLEQPAAPHLEKEEEAGAGDAVAPGAVPLSSPPAASTAGAGTAMKRSPSQSSVVTADAPPDPEKPRAPKAQAVGWPPVRSFRKSILAVQSQRSGGDDKVNGGKTSPAFVKVSMDGAPYLRKVDLRTYGSYQELSKALQKMFSSFTIGSCGPQGMMNEETKLQADLVSGSDDYLPTYEDKDGDWMLVGDVPWEMFVESCKRLRIMKGSEAVGLAPRAMDKCNNSC

SEQ ID NO: 8997 - DNA, 906 bp, Sorghum bicolor
  misc_feature: Ceres ANNOT ID no. 6095059
  misc_feature: Encodes the peptide sequence at SEQ ID NO 8998
atggctatcctcgccgtcgcctctccgctcaaaaccctaaaccctagccaggcggaccacagccgcatccgcctctcctcttccctcctccgccttccgctcccggtgccacgatggcgccgcctccggtgctccgcgcagtacagtgaggcggcggcggcgccgcccacgtcgacaacgacgccgcggccggcggagataccctggagcaaggagctctgcaactcggtgcgcctcattgggactgtgggcaccgaagtcgagctgcggcagctgcccagcggctccgctgttgcgaggggccgcctcgccgtatggaagtcggccaccgaaactacatgggtaactctacaattctgggatgatctggctattgttgcctctgagcacgttaagaagggtgaccggatatttgtttctggacggcttgtgtcagatactgttgatgaggggcctgagaagcggcatgtttattacaagcttgcagttcaacagttgaatttcatcgagtcccagccagttcgattatatgaaccagaggcaagccaggatgccccaggtggaaggcgtgctgattattttaactctacctctaattcaactgaggataagaatagggataatatgagctcttctcgatcaactgaagagctgtggcaagcgttctttgctaaccctcttgactggtgggataacaggacaaataagaagaacccaaggtatccagacttcaagcataagcacactggtgaagcactatgggttgacgggaggaacaaccccaactgggtcatctctcagctggctgttttggactcaagaatgagttctctgcaagacaatgggagaaaaccagtctcttatatgtatgctgatgagttcatgacattggacggcaatcggtag

SEQ ID NO: 8998 - protein, 301 aa, Sorghum bicolor
  misc_feature: Ceres ANNOT ID no. 6095059
  misc_feature (74)..(169): Pfam Id: SSB Pfam Desc: Single-strand binding protein family
  misc_feature (218)..(276): NCBI GI: 144924397 NCBI Desc: single-stranded dna binding [medicago truncatula]
  misc_feature (63)..(274): NCBI GI: 9802592 NCBI Desc: t2e6.21 [arabidopsis thaliana]
  misc_feature (219)..(277): NCBI GI: 60685032 NCBI Desc: mitochondrial sbp40 [solanum tuberosum]
  misc_feature (204)..(268): NCBI GI: 115442235 NCBI Desc: os01g0949200 [oryza sativa (japonica cultivar-group)]
  misc_feature (75)..(209): NCBI GI: 126646087 NCBI Desc: single-strand binding protein family [algoriphagus sp. pr1]
MAILAVASPLKTLNPSQADHSRIRLSSSLLRLPLPVPRWRRLRCSAQYSEAAAAPPTSTTTPRPAEIPWSKELCNSVRLIGTVGTEVELRQLPSGSAVARGRLAVWKSATETTWVTLQFWDDLAIVASEHVKKGDRIFVSGRLVSDTVDEGPEKRHVYYKLAVQQLNFIESQPVRLYEPEASQDAPGGRRADYFNSTSNSTEDKNRDNMSSSRSTEELWQAFFANPLDWWDNRTNKKNPRYPDFKHKHTGEALWVDGRNNPNWVISQLAVLDSRMSSLQDNGRKPVSYMYADEFMTLDGNR

SEQ ID NO: 8999 - DNA, 1416 bp, Sorghum bicolor
  misc_feature: Ceres ANNOT ID no. 6095079
  misc_feature: Encodes the peptide sequence at SEQ ID NO 9000
  misc_feature: Down-regulated in shoot tissues in response to aminocyclopropane carboxylic treatment
atgggcgatccccgggcgcgcacgtccgccgtggccgccggcgagctgcggccgccggagccgccgctggacccgctcgagttcctctcccgctcctggagcgcctcggcggggcgcgcgttcgcgccccacccgccgccgacgccgccgccggcggccagccccatcgccgaggacgccgcgtgcgagctcgacgacggcgccgtcgtctgcggggtctccgccgccgccgcgtccgggggcagctccttctccttcgcgtccgccgccacgtcgcagctcatcatggaacggatcctcgcgcaatcccaggaagtggcgccgctcacctccggccggctctcgcacagcagcggccccctcactggcggtggctccctctccgacagcccgccggtctcgccggagatcgatgacgcaaagtactgcagagcggtcagcacgccgaagccgcaggcataccgggccggcaacaagacggtcggccggtggctcaaggaccggaaggagaagaagaaagaggagacgcgggcgcacaatgcgcaggtccacgcagcagtgtctgttgcggccgttgcagctgcggtcgcggccgtggccgcggccactgctgccgcttcagggtccggcaaggacgaccgtgctgcccggacagatatggccgtggcgtcggctgcgaccctcgtggccgcgcagtgtgtcgaggtggccgagtccatgggcgccgagcgggagcacctcgaggccgtcgttgggtcggctgtgaacgtcaggactcccggagacatcgtcactgtcacggctgctgccgctactgcgttgagaggcgcggcgacattgaaggcgagggctctgaaggaggtgtggaacatcgcggcggtgatcccggtggagaagggcggtggcgttggcggcggcggaggtgggcaccaccagaagcacggcgcgcccaagcagcagcagcaccatcaccggaagctggagagcaacggcagcagcatcagcgacgtgtccctggaggaagagaacaacttcctcggcatctgcagccaggagctgcttgctcgcggcaccgagctcctcaaacgcacccggaaaggcgctctgcactggaaggtcgtatcggtgtacatcaaccggatgggcctggtgatggtgaagatgaagagccggcatgtggcagggacgatcacgaagaagaagaaaagtgtggtgatcgacgtgtgcagggacgtggcggcgtggcccgggcggcacctgctggaggacggcgagcaccggcggtacttcggcctgcggaccgccgagcaccgggtgatcgagttcgagtgcaccagccagcgggagtacgagatgtggaccaagggcgtggcgcggctgctgagcatcgccgccgagcggaagcgcctggcgtga

SEQ ID NO: 9000 - protein, 471 aa, Sorghum bicolor
  misc_feature: Ceres ANNOT ID no. 6095079
  misc_feature (358)..(468): Pfam Id: PH_2 Pfam Desc: Plant pleckstrin homology-like region
  misc_feature (141)..(471): NCBI GI: 115489460 NCBI Desc: os12g0604200 [oryza sativa (japonica cultivar-group)]
  misc_feature (133)..(321): NCBI GI: 38345392 NCBI Desc: osjnba0067k08.21 [oryza sativa (japonica cultivar-group)]
  misc_feature (133)..(283): NCBI GI: 116310721 NCBI Desc: osigba0092e01.13 [oryza sativa (indica cultivar-group)]
  misc_feature (159)..(274): NCBI GI: 79494795 NCBI Desc: ice binding [arabidopsis thaliana]
  misc_feature (169)..(284): NCBI GI: 115483542 NCBI Desc: os10g0568300 [oryza sativa (japonica cultivar-group)]
  misc_feature: The sequence is a functional homolog of SEQ ID NO 22 in the 10/225,066US patent application
  misc_feature: The sequence is a functional homolog of SEQ ID NO 224 in the 10/225,066US patent application
  misc_feature: The sequence is a functional homolog of SEQ ID NO 2372 in the 10/374,780US patent application
  misc_feature: The sequence is a functional homolog of SEQ ID NO 2870 in the 10/374,780US patent application
  misc_feature: The sequence is a functional homolog of SEQ ID NO 430 in the 10/666,642US patent application
  misc_feature: The sequence is a functional homolog of SEQ ID NO 886 in the 11/435,388US patent application
  misc_feature: The sequence is a functional homolog of SEQ ID NO 929 in the 11/479,226US patent application
  misc_feature: Useful for making plants with modulated growth and phenotype characteristics
  misc_feature: The sequence is a functional homolog of SEQ ID NO 22 in the 20050160493 US patent application
  misc_feature: The sequence is a functional homolog of SEQ ID NO 224 in the 20050160493 US patent application
  misc_feature: The sequence is a functional homolog of SEQ ID NO 430 in the 20070033671 US patent application
  misc_feature: Down-regulated in shoot tissues in response to aminocyclopropane carboxylic treatment
MGDPRARTSAVAAGELRPPEPPLDPLEFLSRSWSASAGRAFAPHPPPTPPPAASPIAEDAACELDDGAVVCGVSAAAASGGSSFSFASAATSQLIMERILAQSQEVAPLTSGRLSHSSGPLTGGGSLSDSPPVSPEIDDAKYCRAVSTPKPQAYRAGNKTVGRWLKDRKEKKKEETRAHNAQVHAAVSVAAVAAAVAAVAAATAAASGSGKDDRAARTDMAVASAATLVAAQCVEVAESMGAEREHLEAVVGSAVNVRTPGDIVTVTAAAATALRGAATLKARALKEVWNIAAVIPVEKGGGVGGGGGGHHQKHGAPKQQQHHHRKLESNGSSISDVSLEEENNFLGICSQELLARGTELLKRTRKGALHWKVVSVYINRMGLVMVKMKSRHVAGTITKKKKSVVIDVCRDVAAWPGRHLLEDGEHRRYFGLRTAEHRVIEFECTSQREYEMWTKGVARLLSIAAERKRLA

SEQ ID NO: 9001 - DNA, 4593 bp, Sorghum bicolor
  misc_feature: Ceres ANNOT ID no. 6095086
  misc_feature: Encodes the peptide sequence at SEQ ID NO 9002
atggcagcaacgtcgccaaacaatataaggcgcaaatactcatggtggtgggacagtcatatctccccaaagaactcgaaatggttgcaagaaaatctttcagatatggacagtaaaattaagctgatgatcaagatcattgaagaagatgctgaatcatttgcaaaaagagctgaaatgtactaccgaaggcggcctgagctgatgaccttacttgaggagctgtaccgtgcataccgagctttagcagaaagatatgaccatgcagcaggagaactccgacaagcacatcgaaagatagcagaagcatttcctgatcaggttctaatggacttggatgatgaccttccagcagaaacttcttccattggaactgacatggacaatccagacatggctccatatttcctctctttcatcaatgctagtgatttgaaaaggcatgctaaagatgaccaagattatgagaggctgcataaagaactagcaagcttatcacaggaaaaccaagacctcaaggacaggatctcgtccatgctagagcagggcaacaaggctgagtgtgagattcttcacctcaaggagtcccttgctcaacaagaagcagagaaggaggctgcagtttcactgtgccagcaatcaactgctagattacaaaacctgaagtctgaaattatgcatacccaggagaaattcaacaggctgaaagaggagatgcaaactgaaccgcaacccttgaggaaaggagatgaacatttctttttacttgaaagagctaatcaggacttgcacttggagctagataatctgaaacttctgttgaaacaaaagcatgatgaactaaatgaaaagcaagccgggttggaaaagcttcatatctctacagaagaagagcatctcaagcgcatgcaagcagaaatggcacagctttctttggaaaaacaattatcactggcacaagacaaactgaggcatttggctcttgagaagcaggttgaagtacacaagataaaggagatcgaaacaagcaaagttgtgcttcagaaagaactgcagaagattcttgaagagaaccaaaagttgaatgatcaaagtcactcttcttcggcagtgataattcgtctgcaggatgagataatttctatgaaaaatgtgcaacgaagactggaggaagagatttttcagcatgtggaggaaaagaagacacttcaacatgagctttctcatcttaaagaggataggagtgacttggagaggaaacactctacaatcaaggaacagatagaatctgtgaacttgaatgtagaatgtctacaagcacttgcacaagagctgagggatggcaatgttgagctgaaagagattgtcaagaaccatgagagcattgaacttgtgcatattgataatctgagaaagttggagaggatgtcagagacaaatgcacatttagagaagtctttgtcagctgccacagctgagcttgagggattgagggagaacaaagtggcattagaagaatcgtgcatgcacttcagatccaagattagcactcatcagtctgagcgagctgttcttcttgcgcagattgaggtagtttctcagaccatggaagagctactggagaagaatgtattcttggagaattcattatctgacgctaatgctgaacttgagagtttaaggatgaagttgaaagaactgaaagaatcttcagaggcactccaaaatcagaattctttgcttcaatctgagaagagaactcttgtccaccaggttgagggcatcactgtaactctgctgaatttggaaaggcaatacaaagaattaggaaggcgacactcagatctgcagaaggagaaggactcggtgcttgatgaagtgatcaagatacaggaacagataaggcttgagagaaaggagcatgaaaattgtacacagtcaagcaacactagattcgatgcactacagaaaaagattagcctattgctagaagagggtaggaacagagaggtgcagcttggagaggaggagctcaagattgtcaaagctcagatagagatatttgtcttgcagcagtgtttgaatgacatggtggaagtaaattctgaaattgcagcacaactgcaaaagaacaaagaaatatgcaaggtccaggaggggaaaatgtacagcttatcacagcataatcagaaactaactgaagggattgattcagtagtgagagtattgcatctggatcagaagtatgaatccttagaccaaatgaagcttgaaatcattgtacagctcatcttaaatgagataagctgcctgctgaataacatatccgatgcccaggatgtgaagcagaatgagcttgttgagaagtcacttgttgttacacttctggagcattttgggcaagaggtggctgacttaaggtcagagcggaatgtcttgaggcatgatcagcagataaagaatgaggaactgctccagctgcagagagaaaaggaggaacttatgaagataagtgatgaattcttggaagaggtggaggctcgtaatcacaaagtggatgagctaaaggctgaggcgaagttcttagttgtaaggctctcggaactgcaagagtctaggaggtcattgcaaagcgagatcaccaagctattacaatcgaactcttttctatcaaatgaactaaatgactccattgagaaacagaagatgtttgaacatgatttcagcaatcttgttactgaagctgtcagcaaagatattcttagtgtgatttttagaagccttcacgaagagaggacattgcagctgaagtctttgcataataactttggctgtctgcaatcagccggcagtgagctttatcaggagatcaagatgatgaacaagaggcttggagacatagaaattgagaacaagtaccttggcaaagaactaagtagaattatgagtgtttatggtggatctattgtgcaaactgcaacaggaaaaggaaatctagggcgaagagaccttctgaattctagcaggaaaacccaacaagattatcatgtaaatatggaagtggaacaacaagatgaagttagcagtgctgattttcaggaatcaaatgaaatgctacatgatgaggtgcgtaagttaaggggtgaagtagaaatgctcaggagcaaggagaaggctgcgttcaacatcaaatcttgtgatgaagagataatgaaattgctggctaacatgcaaatggctatcatgaatgcagctctgttcaaggagaaggtccttgagctcatcataacatgcgagagttttgagataagtgccatggtacagaaggaggttctgaaggaagaaatcatacaaagaaattcgtatgtagatgagctaaaggacaaactaaatgctgttgagattgagaacagaaggctgaaggtcgacctaaatggtgatttcacaatgttagggtcattgcagtctgaagtcaatgccttggaggaacaaaccttgtcccttgccaacgaacgcttgcaaacaaataagctcagtatggaggaaaatgcattatctcctcaccttgtgaagaccacaacacgatccagtggcgaagaaaatgcattgaggatggtgaagagcatggagctgcagaaattgcatggaacaatcaaagcccttcagaaggtggtcacagatactggtgtcctcctggaacaagagaggcttgatttcaatgccaatttgcaagaagcgaagaagcagattgaggtgctaaagctcaaggagatcttggatgatgatataattgaaatgaattacgagcagatgttaaaagacatacagcttgacctcattcaaacttcttcaggccggaaaactagtccatttggtcaggaaaagaaaaatgtagcacaactagatgacaagatggtaaactcacgtggcaccatcgggccaagccatggacatgtggctgatgacttcagaccgccgcaaagtgagtcatttgggagagagaacaatttaatggttgtgaaagagctcagcattgacaagcaagagctaccgaggccacttgccacggagccgcacgaggagtggagaaacaaggtcgtagaaaggctgtcttctgatgcccaaaggcttagcaccctccaatccagcatccaagaacttaaaacaaacgctgaaacatctgaagagctagaactcgagagcgtcaggtaccaaataagagaagctgagggtaccatcatgcagctgatcgataccaacagtaagctgtccaagaaggctgaggagtttacgtctcctgatggtctcgatgcggaaaacagtgacttgaggagcagacatcagcgtaagatcttggagcgtgcaaggaagatgtctgagaagattgggaggttggaggtggaaatgcagaaggtccagcaggctctgctgaaatacgaggaggagcagaatagcagaaagacctcaaaagccctgcagcggcggtccaaagtgcagctcgtagagtatctctatggtcgacggcgggacagtcgcaaacaacagcggaactcgccttgtggttgcatgagagcgaaaaccatcgatgactaa

SEQ ID NO: 9002 - protein, 1530 aa, Sorghum bicolor
  misc_feature: Ceres ANNOT ID no. 6095086
  misc_feature (14)..(87): Pfam Id: KIP1 Pfam Desc: KIP1-like protein
  misc_feature (1106)..(1530): NCBI GI: 115454253 NCBI Desc: os03g0637900 [oryza sativa (japonica cultivar-group)]
  misc_feature (526)..(1036): NCBI GI: 29367646 NCBI Desc: centromere protein-like protein [oryza sativa (japonica cultivar-group)]
  misc_feature (1153)..(1452): NCBI GI: 29370236 NCBI Desc: centromere protein-like protein [oryza sativa (japonica cultivar-group)]
  misc_feature (1)..(266): NCBI GI: 115489470 NCBI Desc: os12g0605200 [oryza sativa (japonica cultivar-group)]
  misc_feature (31)..(1473): NCBI GI: 4587570 NCBI Desc: strong similarity to gi2244833 centromere protein homolog from arabidopsis thaliana chromosome 4 contig gbz97337. ests gbt20765 and gbaa586277 come from this gene
MAATSPNNIRRKYSWWWDSHISPKNSKWLQENLSDMDSKIKLMIKIIEEDAESFAKRAEMYYRRRPELMTLLEELYRAYRALAERYDHAAGELRQAHRKIAEAFPDQVLMDLDDDLPAETSSIGTDMDNPDMAPYFLSFINASDLKRHAKDDQDYERLHKELASLSQENQDLKDRISSMLEQGNKAECEILHLKESLAQQEAEKEAAVSLCQQSTARLQNLKSEIMHTQEKFNRLKEEMQTEPQPLRKGDEHFFLLERANQDLHLELDNLKLLLKQKHDELNEKQAGLEKLHISTEEEHLKRMQAEMAQLSLEKQLSLAQDKLRHLALEKQVEVHKIKEIETSKVVLQKELQKILEENQKLNDQSHSSSAVIIRLQDEIISMKNVQRRLEEEIFQHVEEKKTLQHELSHLKEDRSDLERKHSTIKEQIESVNLNVECLQALAQELRDGNVELKEIVKNHESIELVHIDNLRKLERMSETNAHLEKSLSAATAELEGLRENKVALEESCMHFRSKISTHQSERAVLLAQIEVVSQTMEELLEKNVFLENSLSDANAELESLRMKLKELKESSEALQNQNSLLQSEKRTLVHQVEGITVTLLNLERQYKELGRRHSDLQKEKDSVLDEVIKIQEQIRLERKEHENCTQSSNTRFDALQKKISLLLEEGRNREVQLGEEELKIVKAQIEIFVLQQCLNDMVEVNSEIAAQLQKNKEICKVQEGKMYSLSQHNQKLTEGIDSVVRVLHLDQKYESLDQMKLEIIVQLILNEISCLLNNISDAQDVKQNELVEKSLVVTLLEHFGQEVADLRSERNVLRHDQQIKNEELLQLQREKEELMKISDEFLEEVEARNHKVDELKAEAKFLVVRLSELQESRRSLQSEITKLLQSNSFLSNELNDSIEKQKMFEHDFSNLVTEAVSKDILSVIFRSLHEERTLQLKSLHNNFGCLQSAGSELYQEIKMMNKRLGDIEIENKYLGKELSRIMSVYGGSIVQTATGKGNLGRRDLLNSSRKTQQDYHVNMEVEQQDEVSSADFQESNEMLHDEVRKLRGEVEMLRSKEKAAFNIKSCDEEIMKLLANMQMAIMNAALFKEKVLELIITCESFEISAMVQKEVLKEEIIQRNSYVDELKDKLNAVEIENRRLKVDLNGDFTMLGSLQSEVNALEEQTLSLANERLQTNKLSMEENALSPHLVKTTTRSSGEENALRMVKSMELQKLHGTIKALQKVVTDTGVLLEQERLDFNANLQEAKKQIEVLKLKEILDDDIIEMNYEQMLKDIQLDLIQTSSGRKTSPFGQEKKNVAQLDDKMVNSRGTIGPSHGHVADDFRPPQSESFGRENNLMVVKELSIDKQELPRPLATEPHEEWRNKVVERLSSDAQRLSTLQSSIQELKTNAETSEELELESVRYQIREAEGTIMQLIDTNSKLSKKAEEFTSPDGLDAENSDLRSRHQRKILERARKMSEKIGRLEVEMQKVQQALLKYEEEQNSRKTSKALQRRSKVQLVEYLYGRRRDSRKQQRNSPCGCMRAKTIDD

SEQ ID NO: 9003 - DNA, 1767 bp, Sorghum bicolor
  misc_feature: Ceres ANNOT ID no. 6095111
  misc_feature: Encodes the peptide sequence at SEQ ID NO 9004
atgctcccctcctccggcggcggccggtgccgcggccgccacctcctgctcggcttcggcctcgccgtcgctgccctgctcgcgctcgcctccgcctccgagtccgaccacaagtacaaaactgaagagccagttaagctttgggtgaataaagttggtccttacaataatcctcaagaaacttacaactattacagccttccattttgccaaccatctgagaaccctacacacaaatggggtggtcttggagaggtcctgggtggaaatgagctgattgatagtcagcttgaaattaagttcttaaaaaacgtggagaagggctccatttgtacacttgagctagatgctaaaaaggtccagcagtttgctgatgccattgaaagctcatattggttcgaattttttataggttttgttggggagactgacaagaacagtgaaaacaaacattatctttacacacacaagaacatccttgtcaaatacaatgataacaggataattcatgtaaatctcacccaagagtctcctaagcttcttgaagatggtaagaaattggaaatgacatattcagtgaaatgggtagcaacagatgtgtcatttgcacgccgttttgaagtgtacctggactatcctttctttgaacaccagattcactggttctccattttcaactctttcatgatggttattttcctaactggtttggtttcgatgatattgatgcggactttgagaaatgattatgccaaatatgctcgtgaagatgatgatctagagtccctggagagagatgttaatgaggaatcaggatggaagcttgtccatggtgatgtatttcggcctccccgaagtttgatgtttctttctgcacttgttggtatcggcacccaattggcagctcttatcctacttgtgattgttttggccatcgttggaatgctatacattgggcgaggggctatcatcacaacctttattgtgtgctatgctcttacatcgtttatttctggatatgttagtggtggtctttactcaaggaatggtggcaaaaactggattaaagcgatggttcttacagcatccctctttccgttcttatgtttttcaattggctttgcactgaatacaattgctatcttctaccgctcattagcagcaattccatttggcacaatggttgtcatgtttgtactttgggctttcatctcctttcccttggtgcttttgggaactgttgttggtaggaactggagtggtgctcctaacaacccctgccgagtaaagacaattccacggcctatccctgagaagaagtggtaccttacaccttctgtcatctcattgatgggtggcctgcttccatttggtagcatctttattgagatgtacttcgtgttcacatcattctggaactataaggtgtattatgtctatggtttcatgttgctggtcttcgtcatccttctaatagtcaccatctgcgtcactattgtgggtacttatttcttgctgaacgcggagaactatcactggcaatggacgtcattttcctctgcagcatcaaccgctttgtatgtgtatctgtactccatctactactaccatgtgaaaacaaagatgtcaggcttcttccagacaagtttctactttggctacacattgatgttctgtcttggtctaggcatactttgtggtgctattgggtatctagggtcaaccctttttgtaaggagaatctacagaaatatcaaatgtgattaa

SEQ ID NO: 9004 - protein, 588 aa, Sorghum bicolor
  misc_feature: Ceres ANNOT ID no. 6095111
  misc_feature (60)..(546): Pfam Id: EMP70 Pfam Desc: Endomembrane protein 70
  misc_feature (21)..(588): NCBI GI: 1931647 NCBI Desc: endomembrane protein emp70 precusor isolog; 68664-64364 [arabidopsis thaliana]
  misc_feature (15)..(588): NCBI GI: 92885243 NCBI Desc: nonaspanin (tm9sf) [medicago truncatula]
  misc_feature (19)..(588): NCBI GI: 92889078 NCBI Desc: nonaspanin (tm9sf) [medicago truncatula]
  misc_feature (18)..(588): NCBI GI: 60359970 NCBI Desc: mkiaa4036 protein [mus musculus]
  misc_feature (18)..(588): NCBI GI: 19111162 NCBI Desc: transmembrane protein 9 superfamily member 3 [mus musculus]
MLPSSGGGRCRGRHLLLGFGLAVAALLALASASESDHKYKTEEPVKLWVNKVGPYNNPQETYNYYSLPFCQPSENPTHKWGGLGEVLGGNELIDSQLEIKFLKNVEKGSICTLELDAKKVQQFADAIESSYWFEFFIGFVGETDKNSENKHYLYTHKNILVKYNDNRIIHVNLTQESPKLLEDGKKLEMTYSVKWVATDVSFARRFEVYLDYPFFEHQIHWFSIFNSFMMVIFLTGLVSMILMRTLRNDYAKYAREDDDLESLERDVNEESGWKLVHGDVFRPPRSLMFLSALVGIGTQLAALILLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFSSAASTALYVYLYSIYYYHVKTKMSGFFQTSFYFGYTLMFCLGLGILCGAIGYLGSTLFVRRIYRNIKCD

SEQ ID NO: 9005 - DNA, 684 bp, Sorghum bicolor
  misc_feature: Ceres ANNOT ID no. 6095117
  misc_feature: Encodes the peptide sequence at SEQ ID NO 9006
atggcgacgtcgacggcgccggcgtcggccgccgcggcgtgggctccggccgcttcctcctcgacgtcgtcgtcctcgtcgtccatggttgtgctaggcttcctctttttctcttctgttgcttggaattgggaatgtgatgacgctaactgggtgagatggatgttccggcgtggagcagttgcacgagctgttgccggcctgaatacaatggtccagttgccattaaccactggaaatgtggagtcggttctggatgaagtgcgcccgtatctgatagcagatggaggcgacgtcgccttgcacgagatcaacggcaatgttgtgaggttgaagctgcagggagcatgtggatcgtgtccgagctcagtgacgacgatgaagatgagaattcagcgacgcttgatggagaacataccagagatcagcgcggtcgaacgtgttgcagataaggagatgggacttaagctaaatgaagcaaatgttcaaaaggtactagctgagattagaccataccttgctggcaaaggaggtggcgagctcgagctcatcaagatcgttggccacgttgtcaaggtccgcctcacaggccgagctgcaggcgtgaagactgttcgagtggcgctaactcagaagctccgggagaagatcccatccatcgcagcaatccgtgtattgtcataa

SEQ ID NO: 9006 - protein, 227 aa, Sorghum bicolor
  misc_feature: Ceres ANNOT ID no. 6095117
  misc_feature (81)..(148): Pfam Id: NifU Pfam Desc: NifU-like domain
  misc_feature (162)..(228): Pfam Id: NifU Pfam Desc: NifU-like domain
  misc_feature (1)..(227): NCBI GI: 75147032 NCBI Desc: nifu-like protein 1, chloroplast precursor (osnifu1)
  misc_feature (74)..(226): NCBI GI: 124360086 NCBI Desc: nitrogen-fixing nifu, c-terminal [medicago truncatula]
  misc_feature (63)..(226): NCBI GI: 21554503 NCBI Desc: nitrogen fixation like protein [arabidopsis thaliana]
  misc_feature (63)..(226): NCBI GI: 4538920 NCBI Desc: nitrogen fixation like protein [arabidopsis thaliana]
  misc_feature (74)..(226): NCBI GI: 110738975 NCBI Desc: nitrogen fixation like protein [arabidopsis thaliana]
MATSTAPASAAAAWAPAASSSTSSSSSSMVVLGFLFFSSVAWNWECDDANWVRWMFRRGAVARAVAGLNTMVQLPLTTGNVESVLDEVRPYLIADGGDVALHEINGNVVRLKLQGACGSCPSSVTTMKMRIQRRLMENIPEISAVERVADKEMGLKLNEANVQKVLAEIRPYLAGKGGGELELIKIVGHVVKVRLTGRAAGVKTVRVALTQKLREKIPSIAAIRVLS

SEQ ID NO: 9007 - DNA, 1464 bp, Sorghum bicolor
  misc_feature: Ceres ANNOT ID no. 6095143
  misc_feature: Encodes the peptide sequence at SEQ ID NO 9008
  misc_feature: Up-regulated in root tissues in response to salicylic acid treatment
atggatgcggcggtggcggcggcggcggaggctcgggagcgggtgcgggcgagcttcgcgacggggaggacgcgggcggcggcgtggagggaggcgcagctgcggggcctgctgcggatggcggcggagatggaggacgacgtctgcgccgcgctccgcgccgacctcgccaagccccaaaccgaatcctacgtccacgagatatcgctggtcaccacctcctgcaagtttgctctcaagaatctcaagaaatggatgaagccccaaaaggtccccggcggggtgctgacgttcccgtcggcggcgagggtcacggcggagcccctcggcgtggtgctcgtcatctccgcctggaactaccccttcttgctggccatcgacccggtggtcggtgccatcgccgccggcaacgcggtggtgctgaagccgtcggaggtggcgccggcgacgtcgtcgctgctggccgagctcctcccgcggtacgtggacgcctcctgcgtcagggtcgtccagggcggcatcccggagaccaccgcgctcctcgaactcacctgggacaagatcttctacacaggtaacagcaaagtgggacgcattgtcatgtcctacgctgccaagcatctgactcccgtcgtcttggaactcggcggcaaatgccccgtcgttgtcgattccaacgtcaatatccacgttgccgccaagaggatcgccgccggcaagtggggctgcaacagcggccaagcctgcatctctccggattacatcgtcaccaccaaatcccttgcaccaaagctgctggagtccctgaagaaagtgctgcgcaagttctacggcgaggacccgctgcggtcgccggacctgtcgcgcatcgtcaactccaaccatttcaacaggctcaggacgctcatggacgacggcacggtcgccggcaagatcgccttcggtggccagagcgacgagcagcagctgaggatcgcccctacactgctgctggatgtcccgcttgattctgcgatcatgaaggaggagatcttcgggcctttgcttcccataatcacggttgacaagatcagcgagagcttcgccgtgatcaactccgtgagcaagccactggcagcttacctcttcaccaacgacagccggctcaaacagcagttcgagaggaacatctcgtcaggagggatgatattcaacgacaccgccatccacctgacaaatccacacctgccattcggaggagttggggagagcggcatgggcgcgtaccacggcgccttcagcttcgacgccttcacccacaggaaggccgtcctggaccgcagcagcttcctcggcgaggctagggcgaggtacccgccatacacgccggcgaagctcggcatcctcaggggagtgctcaagggcaatccactcgccatggttctggcggctgttgggtatacaggaggaagaagaagggcatga

SEQ ID NO: 9008 - protein, 487 aa, Sorghum bicolor
  misc_feature: Ceres ANNOT ID no. 6095143
  misc_feature (2)..(437): Pfam Id: Aldedh Pfam Desc: Aldehyde dehydrogenase family
  misc_feature (96)..(484): NCBI GI: 115487634 NCBI Desc: os12g0178000 [oryza sativa (japonica cultivar-group)]
  misc_feature (15)..(481): NCBI GI: 17065918 NCBI Desc: aldehyde dehydrogenase [craterostigma plantagineum]
  misc_feature (8)..(481): NCBI GI: 17065876 NCBI Desc: aldehyde dehydrogenase [arabidopsis thaliana]
  misc_feature (12)..(481): NCBI GI: 140069450 NCBI Desc: aldehyde dehydrogenase [medicago truncatula]
  misc_feature (68)..(469): NCBI GI: 145324174 NCBI Desc: aldh3h1 (aldehyde dehydrogenase 4) [arabidopsis thaliana]
  misc_feature (15)..(481): SWISSPROT Homolog: EC 1.2.1.3 Aldehyde dehydrogenase
  misc_feature: Up-regulated in root tissues in response to salicylic acid treatment
  misc_feature: The sequence is a functional homolog of SEQ ID NO. 442 in the 11/188,298 US application
  misc_feature: The sequence is a functional homolog of SEQ ID NO. 435 in the 11/188,298 US application
  misc_feature: The sequence is a functional homolog of SEQ ID NO. 428 in the 11/188,298 US application
  misc_feature: The sequence is a functional homolog of SEQ ID NO. 477 in the 11/188,298 US application
  misc_feature: The sequence is a functional homolog of SEQ ID NO. 537 in the 11/188,298 US application
  misc_feature: The sequence is a functional homolog of SEQ ID NO. 304 in the 11/188,298 US application
  misc_feature: The sequence is a functional homolog of SEQ ID NO. 437 in the 11/188,298 US application
  misc_feature: The sequence is a functional homolog of SEQ ID NO. 475 in the 11/188,298 US application
MDAAVAAAAEARERVRASFATGRTRAAAWREAQLRGLLRMAAEMEDDVCAALRADLAKPQTESYVHEISLVTTSCKFALKNLKKWMKPQKVPGGVLTFPSAARVTAEPLGVVLVISAWNYPFLLAIDPVVGAIAAGNAVVLKPSEVAPATSSLLAELLPRYVDASCVRVVQGGIPETTALLELTWDKIFYTGNSKVGRIVMSYAAKHLTPVVLELGGKCPVVVDSNVNIHVAAKRIAAGKWGCNSGQACISPDYIVTTKSLAPKLLESLKKVLRKFYGEDPLRSPDLSRIVNSNHFNRLRTLMDDGTVAGKIAFGGQSDEQQLRIAPTLLLDVPLDSAIMKEEIFGPLLPIITVDKISESFAVINSVSKPLAAYLFTNDSRLKQQFERNISSGGMIFNDTAIHLTNPHLPFGGVGESGMGAYHGAFSFDAFTHRKAVLDRSSFLGEARARYPPYTPAKLGILRGVLKGNPLAMVLAAVGYTGGRRRA

SEQ ID NO: 9009 - DNA, 942 bp, Sorghum bicolor
  misc_feature: Ceres ANNOT ID no. 6095150
  misc_feature: Encodes the peptide sequence at SEQ ID NO 9010
atggccgtccaccaccttctccgccgcggggtctccagcggctcaccgatccaccctctccgcggcctcttcctcgcctccaaggagcttgggcggcacccgttgagctcggcggcggcgggagacgcagcggccgagctgaggagcgcgcgggaggacgtcaggcagctgctcaaggcaacctcctgccatcccatcctggttcgattaggttggcatgatgctggtacctatgacaagaacattcctgagtggcccaagtgcggtggagctaatggtagcttgagatttgaagtcgagttaaaacatggggccaatgctggtcttgtgaatgctctgaagctgatccaatcgatcaaggacaagttttcaggtgttacgtatgcagatctgtttcagcttgccagcgccacagccattgaggaagcaggtggccccaaaattccgatgatctatggaagggttgacgttactgcccctgaacaatgcccaccagaggggaggcttcctgctgctggcccaccttcacctgcggaacatttgcgtgaagtattctacagaatgggcctgaatgacaaggaaattgttgcactgtcaggagctcatacacttggacgggcaagaccagagcgtagtggctggggtaaaccagaaacaaagtacactaaagatggacctggtgcacctggggggcaatcttggacatctcaatggctcaagtttgacaacagctatttcaaggctatcaaagaaaggcgagatgaggacctcctagttctgcctactgacgctgtgctgtttgaggattcctcattcaagatctatgctgagaaatacgccacggatcaggatgcatttttcgaggactatgctgaagctcatgccaaattaagcaatcttggggcaaaatttgacccgccaaagggcatctcacttgagtag

SEQ ID NO: 9010 - protein, 313 aa, Sorghum bicolor
  misc_feature: Ceres ANNOT ID no. 6095150
  misc_feature (50)..(282): Pfam Id: peroxidase Pfam Desc: Peroxidase
  misc_feature (3)..(313): NCBI GI: 88909670 NCBI Desc: probable l-ascorbate peroxidase 6, chloroplast precursor
  misc_feature (3)..(313): NCBI GI: 77553821 NCBI Desc: stromal ascorbate peroxidase [oryza sativa (japonica cultivar-group)]
  misc_feature (3)..(313): NCBI GI: 88909669 NCBI Desc: probable l-ascorbate peroxidase 5, chloroplast precursor
  misc_feature (3)..(313): NCBI GI: 77553822 NCBI Desc: stromal ascorbate peroxidase [oryza sativa (japonica cultivar-group)]
  misc_feature (26)..(313): NCBI GI: 3202024 NCBI Desc: thylakoid-bound l-ascorbate peroxidase precursor [mesembryanthemum crystallinum]
  misc_feature (46)..(310): SWISSPROT Homolog: EC 1.11.1.11 L-ascorbate peroxidase S, chloroplast/mitochondrial precursor
  misc_feature: Useful for making plants with modulated water use efficiency
  misc_feature: Functional homolog of the protein sequence given in SEQ ID NO 13794
MAVHHLLRRGVSSGSPIHPLRGLFLASKELGRHPLSSAAAGDAAAELRSAREDVRQLLKATSCHPILVRLGWHDAGTYDKNIPEWPKCGGANGSLRFEVELKHGANAGLVNALKLIQSIKDKFSGVTYADLFQLASATAIEEAGGPKIPMIYGRVDVTAPEQCPPEGRLPAAGPPSPAEHLREVFYRMGLNDKEIVALSGAHTLGRARPERSGWGKPETKYTKDGPGAPGGQSWTSQWLKFDNSYFKAIKERRDEDLLVLPTDAVLFEDSSFKIYAEKYATDQDAFFEDYAEAHAKLSNLGAKFDPPKGISLE

SEQ ID NO: 9011 - DNA, 2274 bp, Sorghum bicolor
  misc_feature: Ceres ANNOT ID no. 6095151
  misc_feature: Encodes the peptide sequence at SEQ ID NO 9012
atggcgacgccggtcccggcggaggcggacgcgggggaggcgcgggagctcctctacgaggcgtacaacgagctgcaggcgctggcgtccgagctgggcggtgcggcggtggcgccggcggtcgtggtcgtcggccaccagacggacggcaagagcgcgctggtcgaggccctcatgggtttccagttcaaccacgtcggcggcggcaccaagacgcgccgccccgtcgcgctgcacctccgcttcaacccgcgctgcgacgagccccagtgccgcctgctctctgcaacaggggacgccgacgagcatgatgaagccggggttgccgcgcgccccatgccgctcgccgacatccaggcatatattgaagctgaaaacttgaggttggagaatgatccatgccaattttcagagaaggaaatcataattaaggtagaatacaagcattcccccaatctcaccattattgacactccaggcctcatccttccagctcctggccgtaaaaacagagttttgcagagccaggcttctgctgttgagaggcttgttcgtgctaaaatccagcataaagagaccatcatactgtgccttgaagactgtagtgattggagtaatgcaactacacggagagtagtaatgcaggtcgaccctgatctcgccaggactgttctagtctctacaaaactggacactaaaataccacaatttgctcgcccctctgatgttgaagtgtttcttcacccaccaacatgtgtgctagatgtttccttattgggagattctccctttttcacatcagtaccctctggtagagttggttcttgccatgaagctgtgttcagatcaaatgaagagtttaagaaggccatcttatcaagagagatggaagatattgcatctattgaagataagttaggaaggtcacttacaaccaaggagagagatagaattggagtgggtaatttaagattatatttggaagagttgctgcagaagaggtatgttgagagtgttccattaatcattccacttcttgagaagcaacatcgaaatacaacaagtaaattgcgtgaagtcagtcatgaactcagtgatatgaacgaagccaaactgaaggagaaagctcagctattccatgactcatttttgaccaagttatctttgctattgaaaggcatggtggtggcaccccctgataaatttggagaaactttagttaatgagaggattaatggaggaacatttacaggaagtgagaatttccagctcccgaacaagatgatgccaaatggtggaatgcgtctttatggtggtgcacaataccatcgggcaatggctgaatttcgtctggtagttggtagtatcaggtgccctccaataactagggaggaaattgtcaatgcttgtggtgttgaggatattcatgatgggacaaactactccaggactgcttgtgtaattgctgtggcaaaggcacgtgacacatttgagccattccttcatcagctgggttttaggcttttatacatactgaagaggctgatcccaatctgtgtttatctgctggagaaagatggtgagggctttagtagccatgaagtgcttgtaaggcgtgtccaggaagctttcaagaggtttgctgaatccactgagcaatcatgtcgtcaaaggtgtatggaagatctggagagtaccactcgttatgtcacttggtcccttcacaacaagaaccgtgctggattgagacacttcctcgattcatttgttgcaccggagcaactatcagtgaatacactgaacgagcagttttctggcttgaatgacaacaaacaggacagggcaaagggtgactcgaagtcaaaccattcagacacaaattcgtccagtgctgtgccagagacaagactagttgatctattggatagcacactctggaacagacgtctggtgccctcatctgaaagacttgtttatgcgctggttcaccagatttttcttggaatcaaagagcattttcttgtcaccactgaactgaagttcaattgctttctcctcatgccgattgttgacaaattaccagcacttctaagacaagaccttgaatcagcttttgaagaggaacttgatagcatctttgatgtcactcagctgcgccagtcacttgggcagaagaagcgagagctggagatcgaactgaagcggatcaagcgcttaaaggataagtttggggagataaacaagaagctcaattctcttcaggttaggcagtag

SEQ ID NO: 9012 - protein, 757 aa, Sorghum bicolor
  misc_feature: Ceres ANNOT ID no. 6095151
  misc_feature (41)..(230): Pfam Id: Dynamin_N Pfam Desc: Dynamin family
  misc_feature (8)..(757): NCBI GI: 42565028 NCBI Desc: dynamin family protein [arabidopsis thaliana]
  misc_feature (8)..(593): NCBI GI: 42570477 NCBI Desc: dynamin family protein [arabidopsis thaliana]
  misc_feature (8)..(757): NCBI GI: 30349146 NCBI Desc: dynamin-like protein [arabidopsis thaliana]
  misc_feature (14)..(416): NCBI GI: 27544794 NCBI Desc: dynamin related protein involved in chloroplast division [cyanidioschyzon merolae]
  misc_feature (180)..(574): NCBI GI: 28829020 NCBI Desc: similar to arabidopsis thaliana (mouse-ear cress). f8l10.1 protein [dictyostelium discoideum]
MATPVPAEADAGEARELLYEAYNELQALASELGGAAVAPAVVVVGHQTDGKSALVEALMGFQFNHVGGGTKTRRPVALHLRFNPRCDEPQCRLLSATGDADEHDEAGVAARPMPLADIQAYIEAENLRLENDPCQFSEKEIIIKVEYKHSPNLTIIDTPGLILPAPGRKNRVLQSQASAVERLVRAKIQHKETIILCLEDCSDWSNATTRRVVMQVDPDLARTVLVSTKLDTKIPQFARPSDVEVFLHPPTCVLDVSLLGDSPFFTSVPSGRVGSCHEAVFRSNEEFKKAILSREMEDIASIEDKLGRSLTTKERDRIGVGNLRLYLEELLQKRYVESVPLIIPLLEKQHRNTTSKLREVSHELSDMNEAKLKEKAQLFHDSFLTKLSLLLKGMVVAPPDKFGETLVNERINGGTFTGSENFQLPNKMMPNGGMRLYGGAQYHRAMAEFRLVVGSIRCPPITREEIVNACGVEDIHDGTNYSRTACVIAVAKARDTFEPFLHQLGFRLLYILKRLIPICVYLLEKDGEGFSSHEVLVRRVQEAFKRFAESTEQSCRQRCMEDLESTTRYVTWSLHNKNRAGLRHFLDSFVAPEQLSVNTLNEQFSGLNDNKQDRAKGDSKSNHSDTNSSSAVPETRLVDLLDSTLWNRRLVPSSERLVYALVHQIFLGIKEHFLVTTELKFNCFLLMPIVDKLPALLRQDLESAFEEELDSIFDVTQLRQSLGQKKRELEIELKRIKRLKDKFGEINKKLNSLQVRQ

SEQ ID NO: 9013 - DNA, 1158 bp, Sorghum bicolor
  misc_feature: Ceres ANNOT ID no. 6095152
  misc_feature: Encodes the peptide sequence at SEQ ID NO 9014
atgcaaccgacttacacatgtaatgggactcagataattgcaggcctaactggtgctctgtgggcggcgtctagaaggtcatatgctcatttctgcaacttccaagcatcaggaaacaatgcgcttctttatggaagggaaaatcctctctccttgagatactcttttcgctttttgaaagcaagaaacaaccattcatcagccgttgcgcctaaggactattgtgaaacctacatccagtttttgagagataaacggatagttcctgattcagaccccccaagctctaaagacgtggacctattatatcaatttattgataagagtaaaaggctcatggtagtaactggagcaggaatgagcactgaatctgggattcctgattacaggagcacgggttttaaaccacttactcatcaggagtttgttcgctctattcaagcccggaggcggtactgggctaggagctatgctggatggagaaggtttaggagagcacaaccaaatgcagcccattatgctcttgcgtctctagaaaggattggtcgtgttcactcaatggttacccaaaatgtggataggttgcatcatcgtgctgggagtaatccacttgagctgcatgggagtgtatatgatgttatttgtttagaatgtggtacatccatcagccgggaatcattccaggaggaagtgaagaacctaaacccaaagtgggctcaagctatcgatagtttggaagtagggcaaccaggttcagacaaaagttttggaatgcagcaacgacctgatggtgatgttgagattgatgagaagttctgggagcaagattttgaaattcctagctgccatcaatgtggtggagtgctaaagcctgatgttgtgatgtttggtgataatgttcctcaagagagagctgaaagcgctaaggaggctgcaagaacctgcgatgcacttctggtggttggttcagcactaatgacaatgtctgcttttcggctggcaaggctggcacacgaagcacatgctccgatagctgcagttagcatcggggagaccagggctgatagcattttatcactgaaaatcaatgcgagatgtggggagatattacccagaatacttcagatgggaagtctggtggtaccaaacataagctga

SEQ ID NO: 9014 - protein, 385 aa, Sorghum bicolor
  misc_feature: Ceres ANNOT ID no. 6095152
  misc_feature (117)..(329): Pfam Id: SIR2 Pfam Desc: Sir2 family
  misc_feature (82)..(384): NCBI GI: 144923641 NCBI Desc: silent information regulator protein sir2 [medicago truncatula]
  misc_feature (80)..(382): NCBI GI: 42573313 NCBI Desc: transcriptional regulator sir2 family protein [arabidopsis thaliana]
  misc_feature (80)..(382): NCBI GI: 145334337 NCBI Desc: srt2 [arabidopsis thaliana]
  misc_feature (80)..(382): NCBI GI: 9955510 NCBI Desc: sir2-family protein [arabidopsis thaliana]
  misc_feature (80)..(335): NCBI GI: 42570509 NCBI Desc: transcriptional regulator sir2 family protein [arabidopsis thaliana]
MQPTYTCNGTQIIAGLTGALWAASRRSYAHFCNFQASGNNALLYGRENPLSLRYSFRFLKARNNHSSAVAPKDYCETYIQFLRDKRIVPDSDPPSSKDVDLLYQFIDKSKRLMVVTGAGMSTESGIPDYRSTGFKPLTHQEFVRSIQARRRYWARSYAGWRRFRRAQPNAAHYALASLERIGRVHSMVTQNVDRLHHRAGSNPLELHGSVYDVICLECGTSISRESFQEEVKNLNPKWAQAIDSLEVGQPGSDKSFGMQQRPDGDVEIDEKFWEQDFEIPSCHQCGGVLKPDVVMFGDNVPQERAESAKEAARTCDALLVVGSALMTMSAFRLARLAHEAHAPIAAVSIGETRADSILSLKINARCGEILPRILQMGSLVVPNIS

SEQ ID NO: 9015 - DNA, 1731 bp, Sorghum bicolor
  misc_feature: Ceres ANNOT ID no. 6095178
  misc_feature: Encodes the peptide sequence at SEQ ID NO 9016
atggacagaagatccggggcgatcctagcgtgcctgctcgtcgtcgtcgtcctggtccgggacgcggcggcggtcgccgagactgagcctggcagtgtccggctagtgcaggaggcgccccataggaaggtggtggaggatgggtccgccaaggcggggagggtgccggtgtcgaccgtcgcgtggtcgacgctcgccatggccgcggcgacggggctgggagctgtgcccttctttttcatggagctcgaagcgcagtgggcggggctctgcaatgggatggcggctggggtgatgctggcggccagctttgatcttgtgcaggaagggcaggtgtatggcagtgggagctgggttgtgtttggaatactcggtggaggtatatttatttggctttgtaagaagtttcttgagcaatacggagaagtaagcatgctggatataaaaggtgcagatgcaagtaaagttattcttgttgttggaataatgactcttcattcttttggagaaggctctggtgtgggtgtttcctttgctggctcaaaagggatctctcagggccttctagttactatagctatagcagtgcacaacataccagaaggcttagcagtaagcatggttcttgcatctaggggggtgtccccccaaaaggcaatgatatggagtatcattacatctttaccacagccaattgttgctgttcctgcattcctttgtgctgatgcattccagaaggtgcttcccttctgtactggtttcgcagcaggatgcatgatatggattgttatagctgaggttcttcctgatgcttttaaggaagcaactccatctcaagttgcttctgctggaacacttgctgttgctttcatggaaacattaagtacggtgcttctgggatttacagatggcaacaactcggaagatgcatcaggcttcttagtatcacttgtgtttggacttggtccactgatcggtggaattatactagtcacattctctcttggcttcagcatgccacaccctcttcttactggtgttgcatctggtattgctttccgtcttgcggcatggagacctgtgcagcttctaatgtcctcaaaaatgggtctctttaccaccctcttcctcctcattggaggttccctggtctatcatgctgctacatcaagcatccttagagtgtttaatcgcaaaagatcttccgcaaatgtgatcacgtcatcctctggcctctctcttagtgtcctcacaatacaatcactccttgcttgtggtgctgtattccttcacgcatatgcagaagggcttgcacttggtgtagcggctcgcaaggcttatggccttggccgttacatggttctcccagcctccctccatggtcttccgcggggtgctgctgctgcaagctgtgtgtatggtgctacagatagctggcgtggagcccttgcagctgctgctttgacagggtttgcagcaccaagcgctgccatcagcgcaatccttgcaaagattgactatgatggacttgactactggatggtaatagcatgtggggcactaatccccagctttggccgtgtcttcaggcgctcactgcggttggacatgcggaagagcattgttggcctgctgataggtattgcatttgcctccgtgtgcttgatgtcgactagattcatctgtttgcacactccttactgtaactcggctccagaagcagtcacataa

SEQ ID NO: 9016 - protein, 576 aa, Sorghum bicolor
  misc_feature: Ceres ANNOT ID no. 6095178
  misc_feature (57)..(292): Pfam Id: Zip Pfam Desc: ZIP Zinc transporter
  misc_feature (6)..(575): NCBI GI: 42572321 NCBI Desc: metal transporter family protein [arabidopsis thaliana]
  misc_feature (55)..(381): NCBI GI: 145340578 NCBI Desc: zip family transporter: zinc ion [ostreococcus lucimarinus cce9901]
  misc_feature (57)..(291): NCBI GI: 108805847 NCBI Desc: zinc/iron permease [rubrobacter xylanophilus dsm 9941]
  misc_feature (57)..(289): NCBI GI: 83756962 NCBI Desc: gufa protein [salinibacter ruber]
  misc_feature (60)..(271): NCBI GI: 15790064 NCBI Desc: gufa [halobacterium salinarum nrc-1]
MDRRSGAILACLLVVVVLVRDAAAVAETEPGSVRLVQEAPHRKVVEDGSAKAGRVPVSTVAWSTLAMAAATGLGAVPFFFMELEAQWAGLCNGMAAGVMLAASFDLVQEGQVYGSGSWVVFGILGGGIFIWLCKKFLEQYGEVSMLDIKGADASKVILVVGIMTLHSFGEGSGVGVSFAGSKGISQGLLVTIAIAVHNIPEGLAVSMVLASRGVSPQKAMIWSIITSLPQPIVAVPAFLCADAFQKVLPFCTGFAAGCMIWIVIAEVLPDAFKEATPSQVASAGTLAVAFMETLSTVLLGFTDGNNSEDASGFLVSLVFGLGPLIGGIILVTFSLGFSMPHPLLTGVASGIAFRLAAWRPVQLLMSSKMGLFTTLFLLIGGSLVYHAATSSILRVFNRKRSSANVITSSSGLSLSVLTIQSLLACGAVFLHAYAEGLALGVAARKAYGLGRYMVLPASLHGLPRGAAAASCVYGATDSWRGALAAAALTGFAAPSAAISAILAKIDYDGLDYWMVIACGALIPSFGRVFRRSLRLDMRKSIVGLLIGIAFASVCLMSTRFICLHTPYCNSAPEAVT

SEQ ID NO: 9017 - DNA, 1440 bp, Sorghum bicolor
  misc_feature: Ceres ANNOT ID no. 6095186
  misc_feature: Encodes the peptide sequence at SEQ ID NO 9018
atggcagtgcacagcggagtgaacaagcacgcggtggcgccgatggaggtctcggtggaggccggcaacgccggggacgccgcgtggctggacgacgacggccgcccacgccgcaccggcacgttctggacggccagctcccacatcatcaccgccgtcatcggctccggcgtgctgtccctggcctgggcgatcgcgcagctcggctgggtcgccggccccgccgccatgctcctcttcgccttcgtcacctactacaccgccacgctgctcgccgagtgctaccgcacgggcgacccggagacgggcaagcgaaactacacctacatggacgccgtccgctccaacctcggcggcgccaacgtcgtgttctgcggcgtcatacagtatgccaacctcgtcggcgttgcaatcgggtacaccatcgcgtcgtcgatcagcatgaaggcgatcaggagagcagggtgcttccacacccatggacacgctgatccctgcaagagctccagcaccccgtacatgatcctcttcggcgtcgtgcagattctcttctcccagataccagacttcgatcagatttggtggctatccattgtcgccgcagtcatgtccttcacctactcttccatcggactctccctcggcatcgcacaaaccatttctaatggtgggttcatgggcagcctcaccggcatcagcatcggcgccggcgtcacctccacgcagaaaatctggcacaccctgcaggccttcggggacatcgccttcgcctactccttctctaacatcctcatcgaaatccaagacacgatcaaggcgccgccaccatcggagtcgaaggtgatgcagaaggcaacgcgtctcagcgtggcgacgaccaccatcttctacatgctgtgcggatgcatggggtacgccgcgttcggcgacgccgcgccggacaacctcctgacaggtttcggcttctacgagccattctggctgctcgacgtcgccaacgtcgccatcgtcgtgcacctcgtcggcgcgtaccaggtgttctgccagcccatcttcgccttcgtggagcgccgcgccgccgcggcgtggccggacagcgccttcatcgcccgggagctccgcgtgggccccttcgcgctcagcgtgttccgcctgacatggcggtcggcgttcgtgtgcgtcaccaccgtggtcgccatgctgctgccgttcttcggcaacgtggtggggttcctcggcgccgtctcgttctggccgctcaccgtctacttccccgtcgagatgtacatcaagcagcgccgcgtggcacgcggcagcaccaagtggatttgcctgcagacgctcagcatcagctgtctccttgtttccattgccgctgcagcaggctccatagctgacgtcatcgacgccctcaaggtctaccggccgttcagcggttaa

SEQ ID NO: 9018 - protein, 479 aa, Sorghum bicolor
  misc_feature: Ceres ANNOT ID no. 6095186
  misc_feature (38)..(469): Pfam Id: Aa_trans Pfam Desc: Transmembrane amino acid transporter protein
  misc_feature (12)..(479): NCBI GI: 77553159 NCBI Desc: transmembrane amino acid transporter protein [oryza sativa (japonica cultivar-group)]
  misc_feature (13)..(479): NCBI GI: 62733942 NCBI Desc: transmembrane amino acid transporter protein [oryza sativa (japonica cultivar-group)]
  misc_feature (12)..(479): NCBI GI: 77553833 NCBI Desc: amino acid transport protein aap1 - castor bean [oryza sativa (japonica cultivar-group)]
  misc_feature (10)..(477): NCBI GI: 3293031 NCBI Desc: amino acid carrier [ricinus communis]
  misc_feature (25)..(477): NCBI GI: 27447657 NCBI Desc: amino acid transporter [lycopersicon esculentum]
  misc_feature: The sequence is a functional homolog of SEQ ID NO. 313 in the 11/188,298 US application
  misc_feature: The sequence is a functional homolog of SEQ ID NO. 438 in the 11/188,298 US application
MAVHSGVNKHAVAPMEVSVEAGNAGDAAWLDDDGRPRRTGTFWTASSHIITAVIGSGVLSLAWAIAQLGWVAGPAAMLLFAFVTYYTATLLAECYRTGDPETGKRNYTYMDAVRSNLGGANVVFCGVIQYANLVGVAIGYTIASSISMKAIRRAGCFHTHGHADPCKSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDAAPDNLLTGFGFYEPFWLLDVANVAIVVHLVGAYQVFCQPIFAFVERRAAAAWPDSAFIARELRVGPFALSVFRLTWRSAFVCVTTVVAMLLPFFGNVVGFLGAVSFWPLTVYFPVEMYIKQRRVARGSTKWICLQTLSISCLLVSIAAAAGSIADVIDALKVYRPFSG

SEQ ID NO: 9019 - DNA, 1398 bp, Sorghum bicolor
  misc_feature: Ceres ANNOT ID no. 6095204
  misc_feature: Encodes the peptide sequence at SEQ ID NO 9020
atggaggtgtcggcggaggccgggaacgccggtgctgccgagtggctggacgacgacggccgccctcgccgcaagggcacgttctggacagccagcgcacacatcatcaccgccgtcatcggctccggcgtgctctccctcgcctgggccattgcgcagctcggctgggttgccggccctaccgccatgctcctcttcgccttcgtcacctactacaccgccaccctactcgccgagtgctaccggaccggcgaccccgacaccggcaagcgcaactacacgtacatggacgccgtgcgctccaacctcggcggcaaaaaggtcgtgttctgcggcgtcatccagtacgccaacctcgtcggcgtcgccattggctacaccatcgcgtcgtccatcagcatgaaggccatcaggagagctgggtgcttccacacccacggtcatggggatccctgcaagagctccagcaccccgtacatgatcctcttcggcgttgtgcagatcctcttctcgcagataccggacttcgatgagatttggtggctctccattgtcgctgcagtcatgtccttcacctattcttctatcggactgtccctcggaatcgcacagaccgtctccaacggtgggttcaagggcactctcaccagcatcggcttcggcgccggcgtcacctcgacgcagaagatctggcacaccctgcaggcattcggcgacatcgccttcgcctactccttctccaacatcctcatcgagatccaagacacgatcaaggcgccaccaccgtcggagtcgaaggtgatgcagaaggcgacgcgtctcagcgtggcgacgacgaccatcttctacatgctgtgcggctgcatggggtacgcggctttcggtgacaacgcgccggataacctgctcaccggcttcggcttctacgagcccttctggctgctcgacgtcgccaacgtcgccatcgtcgtgcacctcgtcggcgcgtaccaggtgttctgccagcccatcttcgccttcgtcgagcgccgcgccgccgcggcgtggccggacagcgccttcatctcccgggagctccgtgtcggtcccttcgccctgagccttttccgcctgacatggcggtcggcgttcgtgtgcgtcaccaccgtcgtggccatgctgctgccgttcttcggcgacgtggcggggctcctcggcgccgtctcgttctggccgctcaccgtctacttccccgtcgagatgtacatcaagcaacgtcgtgtgcctcgtggaagccccaggtggatcagcctccagacgctcagcttcacctgcctcctcgtctccattgccgccgccgccggttccatcgccgacgtcgtggatgcgctcaaggtgtaccagccgttcagtggctaa

SEQ ID NO: 9020 - protein, 465 aa, Sorghum bicolor
  misc_feature: Ceres ANNOT ID no. 6095204
  misc_feature (24)..(455): Pfam Id: Aa_trans Pfam Desc: Transmembrane amino acid transporter protein
  misc_feature (1)..(465): NCBI GI: 77553159 NCBI Desc: transmembrane amino acid transporter protein [oryza sativa (japonica cultivar-group)]
  misc_feature (1)..(465): NCBI GI: 62733942 NCBI Desc: transmembrane amino acid transporter protein [oryza sativa (japonica cultivar-group)]
  misc_feature (1)..(465): NCBI GI: 77553833 NCBI Desc: amino acid transport protein aap1 - castor bean [oryza sativa (japonica cultivar-group)]
  misc_feature (13)..(463): NCBI GI: 3293031 NCBI Desc: amino acid carrier [ricinus communis]
  misc_feature (11)..(463): NCBI GI: 27447657 NCBI Desc: amino acid transporter [lycopersicon esculentum]
  misc_feature: The sequence is a functional homolog of SEQ ID NO. 313 in the 11/188,298 US application
  misc_feature: The sequence is a functional homolog of SEQ ID NO. 438 in the 11/188,298 US application
MEVSAEAGNAGAAEWLDDDGRPRRKGTFWTASAHIITAVIGSGVLSLAWAIAQLGWVAGPTAMLLFAFVTYYTATLLAECYRTGDPDTGKRNYTYMDAVRSNLGGKKVVFCGVIQYANLVGVAIGYTIASSISMKAIRRAGCFHTHGHGDPCKSSSTPYMILFGVVQILFSQIPDFDEIWWLSIVAAVMSFTYSSIGLSLGIAQTVSNGGFKGTLTSIGFGAGVTSTQKIWHTLQAFGDIAFAYSFSNILIEIQDTIKAPPPSESKVMQKATRLSVATTTIFYMLCGCMGYAAFGDNAPDNLLTGFGFYEPFWLLDVANVAIVVHLVGAYQVFCQPIFAFVERRAAAAWPDSAFISRELRVGPFALSLFRLTWRSAFVCVTTVVAMLLPFFGDVAGLLGAVSFWPLTVYFPVEMYIKQRRVPRGSPRWISLQTLSFTCLLVSIAAAAGSIADVVDALKVYQPFSG

SEQ ID NO: 9021 - DNA, 1263 bp, Sorghum bicolor
  misc_feature: Ceres ANNOT ID no. 6095246
  misc_feature: Encodes the peptide sequence at SEQ ID NO 9022
atgccgcgggtgacgccgctcggcgcgagcctcatcctggagcacgtcctggccgacccctcggtccccgccgccgtggtcaccaagctcctcgtcgcgctccccttcccctcccacccgaccccgcgcctccgccgcgcggtcctcctccaccacctcgccgccgacccggtctccgaatcctccctcgacacgctccagctcctggccgcgctccccgcccccgcctccccaatcgccgccgcccacatcgccgtcgcggcctacctcgcggtctccgcgtccgacttcgacgtcgccgtgggggcgctcttcgcgcgccccaacggccgcgcgcgcctcgcggtcgacgagggagggtcctccgcgctcgcctccgatgaggtcatgaccacagtggaccagttcgaggccgccgtcgggaactccttctctcaggccgtcctcaggggcctgtggggcgaccggtccgccacggaggagcgggtcagggacctcctcgccgccgagtgggctgccattgggccgtcgctgctcgtgcaggcggctgagcggatcgtcggggatggggccgtcgagacatggcgtgctgcggatgaggccacccgtgccaagctccgcattttggctggggaagaaagaacacatgagattctcagaaaacttgaagaacccacctccagtgcaaatccaatttcaacaccagctgttgagaaggtgattaactcgctcaaaacaagctgtgctgagcttcacagtgttgtggaggatccgcttccagctgcgaaggcagttgcagatgaggtattggctgcaaggatggagaaaagcgttagtttggatgctgaagaagcaagaggtcaaccaacaacttgtggcactgcaggcccgagcgctcctaatgataaaggcaagggtccaagtacaggtaaaccttacagccttatggattggaacccaacagcacgcacctttcagtgggaggaatcacctggtcctgagagttcagaaccgtcattacgcagaccacacttgcctagcccaaggagagcaccagtttctcctttgccaccgggagaaaacaaaaataggcgtagaagggcaaggaagtggtgcttattagaagaagaaacactaagacagggtgttgaacagtatggtagtggcaattggaaggacattttaaataacaaccctgacgtttttatcggcagaacaccggtggacttgaaggataagtggaggaatatgatcaaccgttag

SEQ ID NO: 9022 - protein, 420 aa, Sorghum bicolor
  misc_feature: Ceres ANNOT ID no. 6095246
  misc_feature (368)..(418): Pfam Id: Myb_DNA-binding Pfam Desc: Myb-like DNA-binding domain
  misc_feature (1)..(420): NCBI GI: 54111435 NCBI Desc: terminal acidic sant 1 [zea mays]
  misc_feature (1)..(418): NCBI GI: 40388419 NCBI Desc: anther indehiscence1 [oryza sativa (japonica cultivar-group)]
  misc_feature (365)..(420): NCBI GI: 56404263 NCBI Desc: terminal acidic sant 1 [zea mays]
  misc_feature (302)..(352): NCBI GI: 56404262 NCBI Desc: terminal acidic sant 1 [zea mays]
  misc_feature (257)..(420): NCBI GI: 22329375 NCBI Desc: myb family transcription factor [arabidopsis thaliana]
MPRVTPLGASLILEHVLADPSVPAAVVTKLLVALPFPSHPTPRLRRAVLLHHLAADPVSESSLDTLQLLAALPAPASPIAAAHIAVAAYLAVSASDFDVAVGALFARPNGRARLAVDEGGSSALASDEVMTTVDQFEAAVGNSFSQAVLRGLWGDRSATEERVRDLLAAEWAAIGPSLLVQAAERIVGDGAVETWRAADEATRAKLRILAGEERTHEILRKLEEPTSSANPISTPAVEKVINSLKTSCAELHSVVEDPLPAAKAVADEVLAARMEKSVSLDAEEARGQPTTCGTAGPSAPNDKGKGPSTGKPYSLMDWNPTARTFQWEESPGPESSEPSLRRPHLPSPRRAPVSPLPPGENKNRRRRARKWCLLEEETLRQGVEQYGSGNWKDILNNNPDVFIGRTPVDLKDKWRNMINR

SEQ ID NO: 9023 - DNA, 1458 bp, Sorghum bicolor
  misc_feature: Ceres ANNOT ID no. 6095254
  misc_feature: Encodes the peptide sequence at SEQ ID NO 9024
atggcagcgctatggctatcgagggcgtcgacccagctggcgcgccgtgcagcgaggaggcttcctgccggccgcggctccggcgaacccaccaccagtccatggttcttgggagcggtgccgccgccggctcttggatcgacggcggcggtggagacaagccggcgccggggcttctgctccgtacgaagattcgcaggggagagcagcgctgctgccgccactgtcgtcgacgaggagccggagaacggattcgtcgccagcgatcagcaggcagttcacttccctggaggcaaagtttctttcgtggctgaaatgaacttccttccagactcgatgaaggaaaggataaactgctaccgtgtgcttgatgatgacggcagaactatatcaggcagtagattccaagaggtcagtaaggagttggctgtgaaaatgtacagcgagatggtcacactccagatcatggataccattttctatgaggctcagaggcagggtagaatctcgttttatctcacttccaatggcgaggaagcaatcaacatagcctctgctgctgcgctcagtatggatgacattgtgctgcctcagtacagggaaccaggtgttcttctatggcgtggcttcactctgcaggaatttgcaaaccagtgctttgggaacaagctggactatggtaaagggaggcagatgcccattcattatgggtcaaaccgtctgaattatttcactgtctcatcgcctattgcaactcagcttcctcatgctgttggagctgcctactctctgaagatggacaaaaaggacgcatgtgccatcacatactttggcgacggtggaacaagtgagggagacttccatgcagcgctcaactttgcagctgttatggaagcaccagtgatcttcttctgccgtaacaatggctgggcaatcagcaccccaactactgaacaattcagaagtgatggagttgtaatccgtggccaggcttatgggatccgtggtatccgagtagatggcaatgatgctcttgctgtgtacagcgcagtccatgcagcccgagaaatggctataactgaaggaagacctattttagttgaggcacttacatatcgagttggtcatcactcgacgtccgatgattcaaccaagtacaggccagttgatgagattgagcactggcgaacagcaagggatccaatttccagatacagaaaatgggttcagggtaatgactggtggtctgatgctgaagaatctgagctcaggagcagagtgagaaaagagcttcttcaagccatccaggttgcagaaagaatgccaaaaccaccagttgctgaccttttcactgatgtttacgataagattccttctaacctatgtgaacaagagcaattgctgcgggatacaatcatgaagcaccctgcagactacccaactgatgtacccgtttag

SEQ ID NO: 9024 - protein, 485 aa, Sorghum bicolor
  misc_feature: Ceres ANNOT ID no. 6095254
  misc_feature (147)..(447): Pfam Id: E1_dh Pfam Desc: Dehydrogenase E1 component
  misc_feature (80)..(485): NCBI GI: 9955517 NCBI Desc: branched-chain alpha keto-acid dehydrogenase e1 alpha subunit-like protein [arabidopsis thaliana]
  misc_feature (89)..(480): NCBI GI: 3822223 NCBI Desc: branched-chain alpha keto-acid dehydrogenase e1 alpha subunit [arabidopsis thaliana]
  misc_feature (78)..(482): NCBI GI: 1945277 NCBI Desc: branched chain alpha-keto acid dehydrogenase e1-alpha subunit [lycopersicon esculentum]
  misc_feature (64)..(480): NCBI GI: 108875637 NCBI Desc: pyruvate dehydrogenase [aedes aegypti]
  misc_feature (113)..(480): NCBI GI: 60466281 NCBI Desc: 3-methyl-2-oxobutanoate dehydrogenase (lipoamide) [dictyostelium discoideum]
  misc_feature: The sequence is a functional homolog of SEQ ID NO. 531 in the 11/188,298 US application
  misc_feature: The sequence is a functional homolog of SEQ ID NO. 476 in the 11/188,298 US application
MAALWLSRASTQLARRAARRLPAGRGSGEPTTSPWFLGAVPPPALGSTAAVETSRRRGFCSVRRFAGESSAAAATVVDEEPENGFVASDQQAVHFPGGKVSFVAEMNFLPDSMKERINCYRVLDDDGRTISGSRFQEVSKELAVKMYSEMVTLQIMDTIFYEAQRQGRISFYLTSNGEEAINIASAAALSMDDIVLPQYREPGVLLWRGFTLQEFANQCFGNKLDYGKGRQMPIHYGSNRLNYFTVSSPIATQLPHAVGAAYSLKMDKKDACAITYFGDGGTSEGDFHAALNFAAVMEAPVIFFCRNNGWAISTPTTEQFRSDGVVIRGQAYGIRGIRVDGNDALAVYSAVHAAREMAITEGRPILVEALTYRVGHHSTSDDSTKYRPVDEIEHWRTARDPISRYRKWVQGNDWWSDAEESELRSRVRKELLQAIQVAERMPKPPVADLFTDVYDKIPSNLCEQEQLLRDTIMKHPADYPTDVPV

SEQ ID NO: 9025 - DNA, 1065 bp, Sorghum bicolor
  misc_feature: Ceres ANNOT ID no. 6095255
  misc_feature: Encodes the peptide sequence at SEQ ID NO 9026
atgtcgcaggctccgggggtcgccggaagcccgtacgccgccgagctcgccgcagccaagaaggccgtcgcccttgcggcccgcctctgccagagagtgcagcggggcatcttgcaatctgacattcaatcgaaggcagacaagactcctgttacagtcgcggattatggatcacaagtattggtatgtctggtcctgaagaaggaattgccttctcactctttctcaatcgtagctgaagaggattcaaaagacttgagagaagatggtgcccaagaaattctagaacacattactacccttgtaaatgaaaccattgtaaatgatggttcgtacaacatgtcgttatctaaggaagacgtgcttgctgcaattgatggtggtaaatctgagggaggtccatctgggcgacattggatattggacccaatagatggcactaaaggtttcataaggggagatcagtatgcagttgcacttggactgcttgatgagggcaaagttgttctgggtgtgttgggatgtccaaatcttccattaaaatcaacaaacaagaacaatagcagcttttctggggatcaaataggttccctcttttttgccacaattggttgtggagcgcaagttgaggccttagaaggatctgagccacaaaagattagtgtttgctccatcaataatccagtcgacgcctcattctttgaatcctttgaagcatcacactccaagcgtgatttaactagctccattgcagagaaacttggtgtccaagctcctcctgttagaatggatagccaagcaaaatatggtgccctagcacgtggtgatggtgacatttttctgcgcattccgcacaaaagttacatagaaacagtttgggatcatgcagctggatcaattgttgtcacagaagctggtggcatggtaaaagatgcctcaggaaacgatttggatttttccaaaggtagatatcttgatcgtgacagaggaattattgcaacaaataaacatttaatgccacttgttctaaaggcggttcaagaggctatgaaggaggaacagtag

SEQ ID NO: 9026 - protein, 354 aa, Sorghum bicolor
  misc_feature: Ceres ANNOT ID no. 6095255
  misc_feature (8)..(351): Pfam Id: Inositol_P Pfam Desc: Inositol monophosphatase family
  misc_feature (2)..(353): NCBI GI: 77553176 NCBI Desc: 3'(2'),5'-bisphosphate nucleotidase [oryza sativa (japonica cultivar-group)]
  misc_feature (1)..(353): NCBI GI: 85681936 NCBI Desc: 3'(2'),5'-bisphosphate nucleotidase (3'(2'),5-bisphosphonucleoside 3'(2')-phosphohydrolase) (dpnpase)
  misc_feature (1)..(353): NCBI GI: 77553177 NCBI Desc: 3'(2'),5'-bisphosphate nucleotidase [oryza sativa (japonica cultivar-group)]
  misc_feature (1)..(353): NCBI GI: 1109672 NCBI Desc: 3'(2'),5-diphosphonucleoside 3'(2') phosphohydrolase
  misc_feature (8)..(352): NCBI GI: 14268820 NCBI Desc: diphosphonucleotide phosphatase 1 [zea mays]
  misc_feature (1)..(353): SWISSPROT Homolog: EC 3.1.3.7 3'(2'),5'-bisphosphate nucleotidase
  misc_feature: Useful for making plants with modulated biomass
  misc_feature: Useful for making plants with modulated drought sensitivity
  misc_feature: Functional homolog of the protein sequence given in SEQ ID NO 13368
  misc_feature: Functional homolog of the protein sequence given in SEQ ID NO 13369
  misc_feature: Useful for making plants with modulated drought sensitivity
  misc_feature: Functional homolog of the protein sequence given in SEQ ID NO 13369
MSQAPGVAGSPYAAELAAAKKAVALAARLCQRVQRGILQSDIQSKADKTPVTVADYGSQVLVCLVLKKELPSHSFSIVAEEDSKDLREDGAQEILEHITTLVNETIVNDGSYNMSLSKEDVLAAIDGGKSEGGPSGRHWILDPIDGTKGFIRGDQYAVALGLLDEGKVVLGVLGCPNLPLKSTNKNNSSFSGDQIGSLFFATIGCGAQVEALEGSEPQKISVCSINNPVDASFFESFEASHSKRDLTSSIAEKLGVQAPPVRMDSQAKYGALARGDGDIFLRIPHKSYIETVWDHAAGSIVVTEAGGMVKDASGNDLDFSKGRYLDRDRGIIATNKHLMPLVLKAVQEAMKEEQ

SEQ ID NO: 9027 - DNA, 1068 bp, Sorghum bicolor
  misc_feature: Ceres ANNOT ID no. 6095257
  misc_feature: Encodes the peptide sequence at SEQ ID NO 9028
atggcgtcggggaacccctacgccgccgagctggccgccgccaagaaggccgtcaccctcgccgcccgcctctgcaagacagtgcaacaggacattgtgcattctggtgttcaggccaaggcagacaaaagtcctgtcacggtggctgattatggatctcaaatattggtcagtcttgccttaaagatggatgtagcatctggaccattttctttggttgctgaagaggactcggaagaattgagaaaagaaggtgctgaagaaattttggaagaaattactgatcttgtgaatgaaaccatcgttgatgatggttcatataacatttcatttacaaaggaaggtatactctctgcaattgatgatgggaagtctgagggaggtccatctggacgacactgggtgcttgatccgattgatggtactaaaggtttcttgaggggagaccaatatgccattgcattggctctgcttgatgaaggtaaagtcgttttgggtgtattggcttgtccaaatcttccattgtcatcagtaaacaacctcaatggtaactcttcgggagatcaagtcggtgccctgttttctgctacaattggttgtgggactgaagtggagtccctatatggctctccaccacaaaagattagtgtttgctccattgacgatcctgtcaatgcgtcattttttgaatcctatgaaagtgcacactccatgcatgatttgactggttccattgcgaagaaacttggtgtccaagctcctccagttagaattgacagccaagcaaaatatggtgctctggcccgaggcgatggtgccatttacttgcgctttccgcacaaaggttatagagagaaaatatgggaccatgcagcaggctcaattgtcgtgacagaagctggaggcatagtaacagatgccgccggaaatgacttggatttctccaaagggagatttctcgatctcgacacaggcatcatagcaacgaacaagaacttgatgccatcgctcctgaaggctgtccaagaggctattaaagagacgaaccaggcttcctccctcttgtag

SEQ ID NO: 9028 - protein, 355 aa, Sorghum bicolor
  misc_feature: Ceres ANNOT ID no. 6095257
  misc_feature (42)..(346): Pfam Id: Inositol_P Pfam Desc: Inositol monophosphatase family
  misc_feature (1)..(355): NCBI GI: 14268820 NCBI Desc: diphosphonucleotide phosphatase 1 [zea mays]
  misc_feature (2)..(355): NCBI GI: 85681936 NCBI Desc: 3'(2'),5'-bisphosphate nucleotidase (3'(2'),5-bisphosphonucleoside 3'(2')-phosphohydrolase) (dpnpase)
  misc_feature (2)..(355): NCBI GI: 77553177 NCBI Desc: 3'(2'),5'-bisphosphate nucleotidase [oryza sativa (japonica cultivar-group)]
  misc_feature (2)..(355): NCBI GI: 1109672 NCBI Desc: 3'(2'),5-diphosphonucleoside 3'(2') phosphohydrolase
  misc_feature (2)..(347): NCBI GI: 77553176 NCBI Desc: 3'(2'),5'-bisphosphate nucleotidase [oryza sativa (japonica cultivar-group)]
  misc_feature (2)..(355): SWISSPROT Homolog: EC 3.1.3.7 3'(2'),5'-bisphosphate nucleotidase
  misc_feature: Useful for making plants with modulated biomass
  misc_feature: Useful for making plants with modulated drought sensitivity
  misc_feature: GREAT-hit functional homolog of the protein sequence given in SEQ ID NO 13368
  misc_feature: GREAT-hit functional homolog of the protein sequence given in SEQ ID NO 13369
  misc_feature: Useful for making plants with modulated drought sensitivity
  misc_feature: Functional homolog of the protein sequence given in SEQ ID NO 13369
MASGNPYAAELAAAKKAVTLAARLCKTVQQDIVHSGVQAKADKSPVTVADYGSQILVSLALKMDVASGPFSLVAEEDSEELRKEGAEEILEEITDLVNETIVDDGSYNISFTKEGILSAIDDGKSEGGPSGRHWVLDPIDGTKGFLRGDQYAIALALLDEGKVVLGVLACPNLPLSSVNNLNGNSSGDQVGALFSATIGCGTEVESLYGSPPQKISVCSIDDPVNASFFESYESAHSMHDLTGSIAKKLGVQAPPVRIDSQAKYGALARGDGAIYLRFPHKGYREKIWDHAAGSIVVTEAGGIVTDAAGNDLDFSKGRFLDLDTGIIATNKNLMPSLLKAVQEAIKETNQASSLL

SEQ ID NO: 9029 - DNA, 324 bp, Sorghum bicolor
  misc_feature: Ceres ANNOT ID no. 6095326
  misc_feature: Encodes the peptide sequence at SEQ ID NO 9030
atggcaaaactactcttgggtttgctccttgtccttgtcattatagggacaacgtcggccgataactgtgctaaagatgcggaagccatgaagcaagagtgcaagaagttcgaggtgttccccgtgaacccaaagttgcaaccgtcgccggcatgttgcgctgtgtggcagagggcagacatcccatgcctatgcaaaagggtcaccccggaagtagagaaggtgtggtgcatggagaaggtcgtgtatgtcgccaattactgcaagaagccctttacacccggctacaagtgcgggagttatacggttcctaaaagcctctaa

SEQ ID NO: 9030 - protein, 107 aa, Sorghum bicolor
  misc_feature: Ceres ANNOT ID no. 6095326
  misc_feature (19)..(104): NCBI GI: 66840998 NCBI Desc: 5a2 protein [triticum aestivum]
  misc_feature (2)..(104): NCBI GI: 32395579 NCBI Desc: seed specific protein bn15d18b [brassica napus]
  misc_feature (2)..(104): NCBI GI: 42567284 NCBI Desc: protease inhibitor/seed storage/lipid transfer protein (ltp) family protein [arabidopsis thaliana]
  misc_feature (1)..(100): NCBI GI: 79495992 NCBI Desc: lipid binding [arabidopsis thaliana]
  misc_feature (78)..(104): NCBI GI: 115440511 NCBI Desc: os01g0800700 [oryza sativa (japonica cultivar-group)]
  misc_feature: The sequence is a functional homolog of SEQ ID NO. 364 in the 11/188,298 US application
MAKLLLGLLLVLVIIGTTSADNCAKDAEAMKQECKKFEVFPVNPKLQPSPACCAVWQRADIPCLCKRVTPEVEKVWCMEKVVYVANYCKKPFTPGYKCGSYTVPKSL

SEQ ID NO: 9031 - DNA, 987 bp, Sorghum bicolor
  misc_feature: Ceres ANNOT ID no. 6095417
  misc_feature: Encodes the peptide sequence at SEQ ID NO 9032
atggcggccagccgcggtgccgtggtgtcgtctagagccggtggggcggcggcggcggcggcggcgttcttgctgttgttgcttgttggagttggagttggcagtgcccagctccaggtggggttctactccgactcctgcccggacgccgaggacacggtcaccgccgccgtccaggacgccgccggcaacgaccccaccatcctccccgcgctcctccgcctccagttccacgactgcttcgtcaaggggtgcgacgcgtcggtgctgatccggagcgcgaccaacgacgccgaggtggacaacgccaagaaccagggcctccgcggccaggatgtggtggacgccgccaaggcgcagctcgaggaccagtgccccggcgtcgtctcctgcgccgacatcctcgcgctcgccgcgcgcgacgccgtcgccatgacgggcgggccgtcgttcgacgtgcccacggggcggcgcgacgggctgacctccaacctccgcgacgccgacgtgcttcccgacgccggcgactccatcagcgtgctccgatcacggttcgccgccagcggcctcgacgaccgcgacctcgtcctcctcacaggtgaccggctgtacagctacccgctgccgggcggcgggacgggcgccgacccgtcgatcccggcgccgttcgtggcggagctcaaggcccggtgcccgccgggggatttcaacacgcgcctgccgctggaccgcggcagcgagaccgacttcgacgactccatcctccggaacatccgctccggcttcgccgtcatcgcctccgacgccgcgctcgccaacagcaacgccacccgcgcgctcgtcgacgcgtacctgggcgcctcggcgcgcagcttccagcgggacttcgccgccgccatggtcaagatgggcaccgtcggcgccattaccggcgacgacgacgccggcgaggtcagggacgtctgctctgcgttcaacagcaattga

SEQ ID NO: 9032 - protein, 328 aa, Sorghum bicolor
  misc_feature: Ceres ANNOT ID no. 6095417
  misc_feature (54)..(287): Pfam Id: peroxidase Pfam Desc: Peroxidase
  misc_feature (12)..(326): NCBI GI: 55701131 NCBI Desc: tpa: class iii peroxidase 132 precursor [oryza sativa (japonica cultivar-group)]
  misc_feature (12)..(326): NCBI GI: 55701133 NCBI Desc: tpa: class iii peroxidase 133 precursor [oryza sativa (japonica cultivar-group)]
  misc_feature (11)..(326): NCBI GI: 115484677 NCBI Desc: os11g0210100 [oryza sativa (japonica cultivar-group)]
  misc_feature (17)..(326): NCBI GI: 57282623 NCBI Desc: peroxidase [gossypium hirsutum]
  misc_feature (23)..(326): NCBI GI: 19698450 NCBI Desc: class iii peroxidase [gossypium hirsutum]
  misc_feature: Useful for making plants with altered cell wall content and/or composition
  misc_feature: Functional homolog of the protein sequence encoded by LOCUS at4g25980
  misc_feature: Useful for making plants with altered carbohydrate content
  misc_feature: Functional homolog of the protein sequence given in SEQ ID NO 13631
MAASRGAVVSSRAGGAAAAAAAFLLLLLVGVGVGSAQLQVGFYSDSCPDAEDTVTAAVQDAAGNDPTILPALLRLQFHDCFVKGCDASVLIRSATNDAEVDNAKNQGLRGQDVVDAAKAQLEDQCPGVVSCADILALAARDAVAMTGGPSFDVPTGRRDGLTSNLRDADVLPDAGDSISVLRSRFAASGLDDRDLVLLTGDRLYSYPLPGGGTGADPSIPAPFVAELKARCPPGDFNTRLPLDRGSETDFDDSILRNIRSGFAVIASDAALANSNATRALVDAYLGASARSFQRDFAAAMVKMGTVGAITGDDDAGEVRDVCSAFNSN

SEQ ID NO: 9033 - DNA, 885 bp, Sorghum bicolor
  misc_feature: Ceres ANNOT ID no. 6095420
  misc_feature: Encodes the peptide sequence at SEQ ID NO 9034
atgaacgacctcatgaccgactccttcgtcgccgccgcggccaaggcgcaacagggcggcgcggccgcggctgcccccgcccccgccggcggcgacggcccggagctcggcgcgttcctggccgaggcggacgcggcaaagaccgagatgtccgcgctgcgcgacgagctgtcccacctccgatccgcgcacgaggcgtccaagaacgccgtggtgggatccggcgaaaaaagcgccgccacgcaggcggcgctggtccgcctcctgggttccgcgcggcggctccgcgcgcgcctcgcctccatggaccggcgtgccccggcccccgtggcgcagtccgaggcgggccctccggcggcaggtctccgcggagcgccggagcgacgtggcccgccggtacctcgccgtggccgggacgcgccgaccgaggagcagctggaccgcctcctcgccagcagcaccgaggatccctccgacgcggcgatgcgggcggcgctgctgtccgcctcaggggcggaggagcaggaggagaccgcgaaggaggtggcggaggtggagcgcggcctgctggagctccagcagctgttcctggacatggccgccctcgtggacgcccagggcgcgccgctggacgacatcgagcggcaggtgggcgcggccgcgggcgacgtggccgcggccgaggcggagtttagcgaggcccggaggctgcagggcgccgcgcggcggaggcgggtctgcctggccggcggaatcgtagcgctactgctcgtcggcgttgccgtcgcggtcgtggtggccatggtgctggtgcgcagaggcggcggcggcggcgccgcgaagcttgtgctgcagctcgccgccgcggccttgcccgcgcggtga

SEQ ID NO: 9034 - protein, 294 aa, Sorghum bicolor
  misc_feature: Ceres ANNOT ID no. 6095420
  misc_feature (177)..(239): Pfam Id: SNARE Pfam Desc: SNARE domain
  misc_feature (1)..(290): NCBI GI: 77553251 NCBI Desc: knolle [oryza sativa (japonica cultivar-group)]
  misc_feature (139)..(266): NCBI GI: 32308088 NCBI Desc: syntaxin-like protein 2 [hordeum vulgare subsp. vulgare]
  misc_feature (139)..(267): NCBI GI: 5912543 NCBI Desc: knolle [capsicum annuum]
  misc_feature (141)..(267): NCBI GI: 28974542 NCBI Desc: knolle [antirrhinum majus]
  misc_feature (174)..(270): NCBI GI: 8346545 NCBI Desc: syntaxin-like protein [arabidopsis thaliana]
MNDLMTDSFVAAAAKAQQGGAAAAAPAPAGGDGPELGAFLAEADAAKTEMSALRDELSHLRSAHEASKNAVVGSGEKSAATQAALVRLLGSARRLRARLASMDRRAPAPVAQSEAGPPAAGLRGAPERRGPPVPRRGRDAPTEEQLDRLLASSTEDPSDAAMRAALLSASGAEEQEETAKEVAEVERGLLELQQLFLDMAALVDAQGAPLDDIERQVGAAAGDVAAAEAEFSEARRLQGAARRRRVCLAGGIVALLLVGVAVAVVVAMVLVRRGGGGGAAKLVLQLAAAALPAR

SEQ ID NO: 9035 - DNA, 1164 bp, Sorghum bicolor
  misc_feature: Ceres ANNOT ID no. 6095464
  misc_feature: Encodes the peptide sequence at SEQ ID NO 9036
atgagcgacagcaaccccgccgccgccgcctcaagcaagcgaccctgtgacccctccctcgacgaccccacgccgtcggccaagctgcagcggtcctccgagccgtcagacccaacgccggcggtgaaaccgaacggcggcgcggagacgggagaggagagcgaggtgatggccggcgcacggaaccctagggcgcagaggtacctggtcgccgtggagtacattggcacccgcttctccggctcccagcagcagcccaaccagcgcaccgtcgtcggcgtcctcgaggaggcatttcacagatttattgggcagccagtttcgatattctgttctagccgaacggatgcaggtgttcatgctttatcaaatgtttgtcatgttgatgtggagcggataagtaaaaggaagcctggtgaagttttaacacctcatgagcctggagttgtaaaacgtgctgtgaaccactttctactgaagaatgaaggtgacataatggtgactgatgttcgctgtgttgcaccagattttcatgctagatacaaagctctagaacgcacatatcactatcgcttgctttctggacctgaatcaacatctgtctttgagacaaactctgcttggcatatatctgaagatttggatattcaggcaatgaagaaagcatgcagcatacttgttggccatcatgatttcagttcatttcgagcagctggatgtcaggcaaactctccgatgcgaactctggatgaacttagcgttacagaagtattccctttcatgttttttccttcaagtgtagaaagatcacagttggaatcatcaaatggttctcttgtttattcaaggacaccagacatagaatcttctgggaaaggatctgatctttgctgtaccagcagtgtgaaatcagaactcgagaatggagaagactttggaaagagatcaaggcaccgctgctttgttgttactgcaagggcacggtcttttctttaccatcaggtaaggttgatggtcggtcttctaaaatctgttggaacgggagatctaacaactgcagatgttgagagaattcttgatgcaaagacggtgactgctgcaccccgtatggcacctgcttatggtctgtaccttgctaacgtgaaatatgatctgaatgcttga

SEQ ID NO: 9036 - protein, 387 aa, Sorghum bicolor
  misc_feature: Ceres ANNOT ID no. 6095464
  misc_feature (70)..(182): Pfam Id: PseudoU_synth_1 Pfam Desc: tRNA pseudouridine synthase
  misc_feature (222)..(384): Pfam Id: PseudoU_synth_1 Pfam Desc: tRNA pseudouridine synthase
  misc_feature (62)..(384): NCBI GI: 42561874 NCBI Desc: trna pseudouridine synthase family protein [arabidopsis thaliana]
  misc_feature (62)..(384): NCBI GI: 46931324 NCBI Desc: at1g09800 [arabidopsis thaliana]
  misc_feature (53)..(385): NCBI GI: 140053519 NCBI Desc: trna pseudouridine synthase [medicago truncatula]
  misc_feature (67)..(280): NCBI GI: 52699494 NCBI Desc: cog0101: pseudouridylate synthase [rickettsia akari str. hartford]
  misc_feature (67)..(257): NCBI GI: 82944181 NCBI Desc: pseudouridylate synthase [magnetospirillum magneticum amb-1]
MSDSNPAAAASSKRPCDPSLDDPTPSAKLQRSSEPSDPTPAVKPNGGAETGEESEVMAGARNPRAQRYLVAVEYIGTRFSGSQQQPNQRTVVGVLEEAFHRFIGQPVSIFCSSRTDAGVHALSNVCHVDVERISKRKPGEVLTPHEPGVVKRAVNHFLLKNEGDIMVTDVRCVAPDFHARYKALERTYHYRLLSGPESTSVFETNSAWHISEDLDIQAMKKACSILVGHHDFSSFRAAGCQANSPMRTLDELSVTEVFPFMFFPSSVERSQLESSNGSLVYSRTPDIESSGKGSDLCCTSSVKSELENGEDFGKRSRHRCFVVTARARSFLYHQVRLMVGLLKSVGTGDLTTADVERILDAKTVTAAPRMAPAYGLYLANVKYDLNA

SEQ ID NO: 9037 - DNA, 1398 bp, Sorghum bicolor
  misc_feature: Ceres ANNOT ID no. 6095474
  misc_feature: Encodes the peptide sequence at SEQ ID NO 9038
atggccgccgacaggagaaccgtagtagtgtacgatgctgaagccggcgatgaccatgagaggcaagggactgtgtggacggcgacgtcgcacatcgtggcggcggtggtgggctccggcgtgctggcgctggcgtggacggtggcgcagctggggtgggtggtgggtcccctcgtcctcgtgggcttctcctgcgtcacctactacacctcggcgctgctcgccgactgctaccgctacccggaccccgtcgacggcgccgtcaaccgcgagtacatcgacgccgtccgatgctacctcgaccggaagaacgtggtgctgtgtgggtgcgcccagtacgtcaacctcgcggtgaaacgcgtcaactgcttccaccgagacgggtacggcgcggcgggttgcaacccatcagggagcacctacatggtggtcttcggcgtcttccagctcctgctctcgcagctccccagcctccacaacatcgcctggctctccgtcgtcgccgtcgccacctccttcggctactccttcatcagcctgggtctctgcgccgccaaatgggcctcccacgacggcggccacgacatccgcggcacgctggcgggcgccgccgtcgacgtgccccgcgacaaggccttcaacgtgctcctcgcgctgggcaacatcgccttctcctacacgttcgccgacgtgctcatcgagatccaggacacgctcagggcgccgccggcggagaacacgacgatgaagaaggcctccttctacggcctcggcatgaccaccgtcttctacctcgcgctcggctgcactgggtacgccgccttcggggacgacgcgccggggaacatcttgactgggttcgccttctacgagcccttctggctcgtcgacgtcgccaacgtctgcgtcatcgtgcacctcatcggcgcctaccaggtgttcgcgcagccaatcttcgccaggctcgagtcctgcgtcgcgtgccggtggcccgacgcaaagttcatcaacgccacctactacgtgcgcgtgccgccgtgcctccgctcgtcgtcgagctcggcgccggcgtcgtcgacgacagtggccgtggcgccgctcaagctggtgctgcgaaccatcgtcatcatgttcacgacgctggtggcgatgctgctgccattcttcaacgccgtgctggggctcatcggagcgctcgggttctggccgctctccgtctacttccccgtcagcatgcacatggccaggctcaagatccggcgaggggagctccggtggtggttgctgcaggccatgagcttcgtctgcctgctcatctccatcgccgccagcatcggctccgtgcaggacatcgtgcacaacctcaaggccgccgcgccattcaagcccggaaactga

SEQ ID NO: 9038 - protein, 465 aa, Sorghum bicolor
  misc_feature: Ceres ANNOT ID no. 6095474
  misc_feature (21)..(453): Pfam Id: Aa_trans Pfam Desc: Transmembrane amino acid transporter protein
  misc_feature (12)..(462): NCBI GI: 27447655 NCBI Desc: amino acid transporter [lycopersicon esculentum]
  misc_feature (20)..(462): NCBI GI: 3293031 NCBI Desc: amino acid carrier [ricinus communis]
  misc_feature (20)..(462): NCBI GI: 31455391 NCBI Desc: amino acid permease 1 [brassica napus]
  misc_feature (17)..(461): NCBI GI: 61967946 NCBI Desc: amino acid transporter [pisum sativum]
  misc_feature (20)..(462): NCBI GI: 18181930 NCBI Desc: amino acid permease i [arabidopsis thaliana]
  misc_feature: The sequence is a functional homolog of SEQ ID NO. 313 in the 11/188,298 US application
MAADRRTVVVYDAEAGDDHERQGTVWTATSHIVAAVVGSGVLALAWTVAQLGWVVGPLVLVGFSCVTYYTSALLADCYRYPDPVDGAVNREYIDAVRCYLDRKNVVLCGCAQYVNLAVKRVNCFHRDGYGAAGCNPSGSTYMVVFGVFQLLLSQLPSLHNIAWLSVVAVATSFGYSFISLGLCAAKWASHDGGHDIRGTLAGAAVDVPRDKAFNVLLALGNIAFSYTFADVLIEIQDTLRAPPAENTTMKKASFYGLGMTTVFYLALGCTGYAAFGDDAPGNILTGFAFYEPFWLVDVANVCVIVHLIGAYQVFAQPIFARLESCVACRWPDAKFINATYYVRVPPCLRSSSSSAPASSTTVAVAPLKLVLRTIVIMFTTLVAMLLPFFNAVLGLIGALGFWPLSVYFPVSMHMARLKIRRGELRWWLLQAMSFVCLLISIAASIGSVQDIVHNLKAAAPFKPGN

SEQ ID NO: 9039 - DNA, 1773 bp, Sorghum bicolor
  misc_feature: Ceres ANNOT ID no. 6095710
  misc_feature: Encodes the peptide sequence at SEQ ID NO 9040
atgtcgggctccggcgatcgtcgcggcggcgggcctcctggacccgatggtggctggaaaaccaaggggaagaactcgaagaaacacgggcaagtaggcgggagccaatggacaccggggagttccacaaatgcgacacctagtacagcaaggccagcatggggtggcaatggctcctcgcacccttctggaaggacttgggctcaagcttcagatcgtggtgctggcaacagatgcaatcctagaccgccaccaccaacactgcgccctgttgtgactccacctctggcaaatggttggcagtggcaatccaggcctcgtccatctggttctgaagtcgagaaggatgatgcttctccatctggttctgaccctgaggtggagaatgttgatggcaacaatgcatcagatgatgatgatgatttgagtgatgatatcagtgatgaatatgattctgatgcaagtgagaaaagttttgagactctaaaaacaaacaagtggttcaaaaaattctttgaaaaattgaatacattgagtgtggaacagataaatgaaccggctagggagtggcattgcccagcatgcaaaaatggacctggggcaattgactggtacagagggctgcaacctttaatgactcatgctagaacaaagggttctaaaagggttaggcttcacagagaattagctgcattgctgggagaggagctctctcgcaggggaacttcagtggtaccagcgggtgaacaatttgggaaatggaaaggactgcaagaaagcactgatcgggagatagtgtggccaccaatggttattgttatgaacaccttattggaaaaagatgacgatgataagtggaagggcatggggaaccaagagctccttgattattttggagaatatgcagcaactaaagcacgtcatgcatatggtccctctgggcaccgtggtatgagcgtgttaatatttgaaagctcagctgtgggctacatggaagctgaacgtctgcataggcactttgttaatcaaggtacagacaggaatgcatggcagctcaacaaggctcgattcgcacctggtgggaaaaggctgctatttggtttcttagcgagcaaagaggatatggaggcttttaacaagcattgccatggtaaaagccgtatgaagtatgagatgaagtcttacaatgagatggtcgtgatgcaaatgaaacagatgagtgaagacaaccagcaactgaattacctgaagaacaaggtggttaagacagagcagcactctaaagcagtagaagaatcattgggtgttgttagccagaagctacgtgagactatggaagagaatatatttatcaggagtaaagcaaaagagaagcacttggagtatgagcaagagatgaagtaccaggaggaattttttcatagtcaaattgaggatattcacaaggccacggaggacaaagaaaagctgtttgagaagttgctgcaggaggagcgctcaaaggctagacgatttgatgtagattctggaactaccgaagatcgcaagctaaggaaggaacatgtacagaagttcattgattgccaggtcaaggatgtggaaaagtttgaagctgagcgggatgagttgatcaaagtccacgatgagacgaagatgaggctcaagaaagagtacatggagaaggagctggagctggagaaggagctcgacgcagccctgacgggcctgatggagaagcacaagccagatagctttgaggcctccagctcgtaa

SEQ ID NO: 9040 - protein, 590 aa, Sorghum bicolor
  misc_feature: Ceres ANNOT ID no. 6095710
  misc_feature (192)..(230): Pfam Id: zf-XS Pfam Desc: XS zinc finger domain
  misc_feature (261)..(381): Pfam Id: XS Pfam Desc: XS domain
  misc_feature (1)..(590): NCBI GI: 111559385 NCBI Desc: leafbladeless1 [zea mays]
  misc_feature (1)..(590): NCBI GI: 77553859 NCBI Desc: emr1 [oryza sativa (japonica cultivar-group)]
  misc_feature (34)..(589): NCBI GI: 77553860 NCBI Desc: emr1 [oryza sativa (japonica cultivar-group)]
  misc_feature (289)..(590): NCBI GI: 32401386 NCBI Desc: emr1 [triticum aestivum]
  misc_feature (106)..(541): NCBI GI: 124360436 NCBI Desc: emr1, related [medicago truncatula]
MSGSGDRRGGGPPGPDGGWKTKGKNSKKHGQVGGSQWTPGSSTNATPSTARPAWGGNGSSHPSGRTWAQASDRGAGNRCNPRPPPPTLRPVVTPPLANGWQWQSRPRPSGSEVEKDDASPSGSDPEVENVDGNNASDDDDDLSDDISDEYDSDASEKSFETLKTNKWFKKFFEKLNTLSVEQINEPAREWHCPACKNGPGAIDWYRGLQPLMTHARTKGSKRVRLHRELAALLGEELSRRGTSVVPAGEQFGKWKGLQESTDREIVWPPMVIVMNTLLEKDDDDKWKGMGNQELLDYFGEYAATKARHAYGPSGHRGMSVLIFESSAVGYMEAERLHRHFVNQGTDRNAWQLNKARFAPGGKRLLFGFLASKEDMEAFNKHCHGKSRMKYEMKSYNEMVVMQMKQMSEDNQQLNYLKNKVVKTEQHSKAVEESLGVVSQKLRETMEENIFIRSKAKEKHLEYEQEMKYQEEFFHSQIEDIHKATEDKEKLFEKLLQEERSKARRFDVDSGTTEDRKLRKEHVQKFIDCQVKDVEKFEAERDELIKVHDETKMRLKKEYMEKELELEKELDAALTGLMEKHKPDSFEASSS

SEQ ID NO: 9041 - DNA, 951 bp, Sorghum bicolor
  misc_feature: Ceres ANNOT ID no. 6096336
  misc_feature: Encodes the peptide sequence at SEQ ID NO 9042
  misc_feature: Down-regulated in shoot tissues in response to methyl jasmonate treatment
  misc_feature: Down-regulated in root tissues in response to methyl jasmonate treatment
atggcgaccggcgacgaggcggagacggcggcgccggcatcggaggaggcgagggactggtccgacatgacgccggtgtgcctcgccgaagcgttctcgcggctggcgctggaggacctgtggcgcggcgccatggcgtgctgccgctcctggcgggacgccgcccgctcacgcccggggctcttcgctgtgctcaacctcgagcccgggtttgctgagtccacacccggggccgaggcggcagcgtggtggacgcccgccttccagcgccgcgccgacgcgatgctacgctccgccgccacgctcgccgcgggggagctgtgtgagatccgtgtccgccactgctccgacgacgcgctcgaattcgccgctgagaggtctctaaaacttagtatcctttccatcaaaactagcccggcaataactgatcgatcaatgctcactgtcggagcgtgctgccccatgcttacagaattggacatcagcaactgctatgacgtttcatacaagtcactggaggtgattggccagagctgccagaacctcagggtcctcaagcgcaacatattcaactggattgatccatcagagcatgttggaatagttcctgaggactacttaagagaatgccccgaagatggtgacagggaagccattacaatatccaagttcatgccaaagctgaaacatcttgaactgaggttctcaaagttgaccgccgtcggcctcaactctatccctgaaggatgcaaggatctggaggttctggacctgtttggctgcgcaaatcttacaagccgtggaatagatcaggctgctgctaatctgaagaatctcgtgacgctagtgaagcccaacttctacatacctcgttcctccttccacatggggaggtacggccactggcagttatatgacgagagattccagacaaatgtatttcagatatga

SEQ ID NO: 9042 - protein, 316 aa, Sorghum bicolor
  misc_feature: Ceres ANNOT ID no. 6096336
  misc_feature (15)..(316): NCBI GI: 92868841 NCBI Desc: cyclin-like f-box [medicago truncatula]
  misc_feature (126)..(316): NCBI GI: 115475640 NCBI Desc: os08g0269800 [oryza sativa (japonica cultivar-group)]
  misc_feature (91)..(268): NCBI GI: 116310189 NCBI Desc: osigba0152k17.13 [oryza sativa (indica cultivar-group)]
  misc_feature (91)..(268): NCBI GI: 116310066 NCBI Desc: h0818e04.4 [oryza sativa (indica cultivar-group)]
  misc_feature (93)..(286): NCBI GI: 18412949 NCBI Desc: f-box family protein (fbl21) [arabidopsis thaliana]
  misc_feature: Down-regulated in shoot tissues in response to methyl jasmonate treatment
  misc_feature: Down-regulated in root tissues in response to methyl jasmonate treatment
MATGDEAETAAPASEEARDWSDMTPVCLAEAFSRLALEDLWRGAMACCRSWRDAARSRPGLFAVLNLEPGFAESTPGAEAAAWWTPAFQRRADAMLRSAATLAAGELCEIRVRHCSDDALEFAAERSLKLSILSIKTSPAITDRSMLTVGACCPMLTELDISNCYDVSYKSLEVIGQSCQNLRVLKRNIFNWIDPSEHVGIVPEDYLRECPEDGDREAITISKFMPKLKHLELRFSKLTAVGLNSIPEGCKDLEVLDLFGCANLTSRGIDQAAANLKNLVTLVKPNFYIPRSSFHMGRYGHWQLYDERFQTNVFQI

SEQ ID NO: 9043 - DNA, 2058 bp, Sorghum bicolor
  misc_feature: Ceres ANNOT ID no. 6096531
  misc_feature: Encodes the peptide sequence at SEQ ID NO 9044
atggggtttgacgggctggtcgtggtgtccgatccctacctgcagcgccgcttcacgcaggccgaccttcgcgtgctccagacccagtatgcggcgctgcgggacgcgtcgcctaacgggaggctgcggatacgggacctccccgccgccatctctagcgtccgcggccgcggtgcggtcaggggcagggacgccgagaaggagaatagcgcgccggagccaggccccggcctgggcctcactgacgaggagtgggcctccgtgcttaaggccgtcgcgcgcgccgacgagaagccgcatcaggacgccagcttcgagctcttcctccgcgtttacgccgagatgcagctgcgcctcaaggcagccagcggcggtggcgccggccgcgccggaggaatcgcgcgctcctcgtcctcctctgctgttgccttcctcacggcggccacaaccacgctgctgcacaccatcagcgagtccgagaaggcgtcctacgtcggccacatcaacgcctacctcgccgaggatccattcctaaagaccgccctccccatcgatccggcgaccgatcacatcttccacgtcaccaaggacggcgtgctcctatgcaaactcatcaacttggcggtacctggcaccatcgacgagcgagccatcaacaccaagagggtgctcaatctgtgggagaagaacgagaaccacacgctttgcctcaactccgccaaggcgatcggctgcactgtcgtcaacatcggcacacaggacctcgccgaagggaggatacaactgttggcagatgttaatcttaaaagcacacctcaattagttgaattggttgaggacagtaaggagatggaggagcttatgagcttgtctcctgaaaagattctactaaggtggatgaactttcaactcaagaaaggaggtttccagaaaacagtaacaaatttttcatcagatataaaagatagtgaagcgtatgcttgtctactgaatgtcctggcacctgaatgcagtgcgaaaccatctgcgatgtctgtaaaagatctacttcatagagcaaggttaatccttgagcatgcagataggatgggctgcaaaagatacctgactccaaaagacatagttgatggtttacccaatctaaatcttgcctttgtggctcatattttccaaaaaagaaatgggttgtccaaacaaatgaaacaagtttcctttgtggatggactctctgatgatgctcaagtttccagggaagaaaggtcattccggctgtggattaacagccttggaatttctacttacatcaacaatgtgtttgaggaccttagaaatggatgggttctccttgaggtaattgacaagattgctccaggctcagttaattggaagatggcaaatcgcccaccaataaaattaccattcaggaaagtcgaaaattgcaatcaagttttgaagattggaaaagaactaaaattttctttggtgaatatcgctggaaatgatattgtgcaagggaacaaaaaactgatattagcttttctgtggcaattgatgcggtacaatattcttcaattgctgaagaatcttagatttcactcaaatggaaaagagatcacagataatgacatattggcatgggccaataaaaaagtaaaagattctggaaagcaccactctcatatgcaaagtttcaaggataaaagcctttcaagtggtacctttttccttgacttactaagtgctgtggagcctcgagttgtgaattggagccttgtgaccaaaggagaaaaagatgaagagaagcaaatgaacgcgtcatacatcatttcggtggctaggaagcttggttgctccattttcttgttgccagaagatatattggaggtgaaccagaagatgatgctaactctgacagcaagcatcatgtactggtatttgaaaaggccaacatcacattcattggactctgaaaatgggagttcatgtgagacaacctccatcacaacttcagatgattctgcatctgaatcatcgattgatgacaatacaaccagataa

SEQ ID NO: 9044 - protein, 685 aa, Sorghum bicolor
  misc_feature: Ceres ANNOT ID no. 6096531
  misc_feature (159)..(268): Pfam Id: CH Pfam Desc: Calponin homology (CH) domain
  misc_feature (291)..(394): Pfam Id: CH Pfam Desc: Calponin homology (CH) domain
  misc_feature (417)..(522): Pfam Id: CH Pfam Desc: Calponin homology (CH) domain
  misc_feature (538)..(646): Pfam Id: CH Pfam Desc: Calponin homology (CH) domain
  misc_feature (41)..(680): NCBI GI: 51971889 NCBI Desc: fimbrin 2 [arabidopsis thaliana]
  misc_feature (102)..(681): NCBI GI: 59797940 NCBI Desc: fimbrin 1 (atfim1)
  misc_feature (102)..(681): NCBI GI: 2905893 NCBI Desc: fimbrin-like protein [arabidopsis thaliana]
  misc_feature (143)..(628): NCBI GI: 2811230 NCBI Desc: fimbrin 1 [arabidopsis thaliana]
  misc_feature (158)..(648): NCBI GI: 50513334 NCBI Desc: chain b, crystal structure of the actin-crosslinking core of arabidopsis fimbrin
MGFDGLVVVSDPYLQRRFTQADLRVLQTQYAALRDASPNGRLRIRDLPAAISSVRGRGAVRGRDAEKENSAPEPGPGLGLTDEEWASVLKAVARADEKPHQDASFELFLRVYAEMQLRLKAASGGGAGRAGGIARSSSSSAVAFLTAATTTLLHTISESEKASYVGHINAYLAEDPFLKTALPIDPATDHIFHVTKDGVLLCKLINLAVPGTIDERAINTKRVLNLWEKNENHTLCLNSAKAIGCTVVNIGTQDLAEGRIQLLADVNLKSTPQLVELVEDSKEMEELMSLSPEKILLRWMNFQLKKGGFQKTVTNFSSDIKDSEAYACLLNVLAPECSAKPSAMSVKDLLHRARLILEHADRMGCKRYLTPKDIVDGLPNLNLAFVAHIFQKRNGLSKQMKQVSFVDGLSDDAQVSREERSFRLWINSLGISTYINNVFEDLRNGWVLLEVIDKIAPGSVNWKMANRPPIKLPFRKVENCNQVLKIGKELKFSLVNIAGNDIVQGNKKLILAFLWQLMRYNILQLLKNLRFHSNGKEITDNDILAWANKKVKDSGKHHSHMQSFKDKSLSSGTFFLDLLSAVEPRVVNWSLVTKGEKDEEKQMNASYIISVARKLGCSIFLLPEDILEVNQKMMLTLTASIMYWYLKRPTSHSLDSENGSSCETTSITTSDDSASESSIDDNTTR

SEQ ID NO: 9045 - DNA, 2454 bp, Sorghum bicolor
  misc_feature: Ceres ANNOT ID no. 6096579
  misc_feature: Encodes the peptide sequence at SEQ ID NO 9046
atggcatcgtcggcggggtacgccggtggcgacacgggaggtctgggcgacggggagcccccgcccccggtgccgccgcagatgaggaagcagccgtcgcggatcgcgtcggggatgcgtcggctggcgtcgaaggtgtcgtcggcggtgccagagatgcggggccacaagcatacacactcgggcgcgcagtcgggcttgcgcgggctgcgcttcctcgacaagacctctgccggcaaggacggctggaagaccgtcgagaagcggttcgacgagatgagcaccgacggccggctgcagagggagaacttcgccaagtgcatcggtatggctgattcaaaggagtttgcaagcgaggtatttgtggcattgtctaggagaagacacatcaatccggacgacggtgtaacaaaagaacaactaaaggagttctgggaggagatgacagaccagaactttgattcccggtgtgacaagaacggtgatggtaagctgacagaagatgaggtcaaggagatcatggtgctaagtgcctcagcaaacaagcttgccaaactgaagaaacatgctggaacctacgcctctctgatcatggaggagctggaccctgatcaccgcggctacattgagctggagaccctgcttcgggggatggtgtcggcctcagggccgccggacaagatgaacatggcgtcccaatctctgacgaggacgatggtgccttccagccaccggagcccactgcagcggcgcatgaacatggctgtggacttcgtccatgagaactggaagaggatatgggtgatctccctctggggcgccctcaacatcgccctcttcgtattcaagttcatccagtaccggaggcgcgcggtgttcgaggtgatgggctactgcgtctgcatcgccaagggcgccgccgagaccctcaagctcaacatggcgctcatactgctgccggtgtgccggaacacgctcacaaggctgcggtccaccgcgctcagcaaggtcgtgccgttcgacgacaacataaacttccacaaggtcatcgcgcttacaatcgccataggagctgcaacccatacgctttcacacgtcctctgcgacttccccaggctggtgtcgtgccccaaggacaagttcatggagaagctggggcccttcttcaactacgttcagccaacatggccgattctgctgacgagcatcccgggatggaccgggatcctcctcatcctcataatgtccttctccttcacgctcgccacgcactccttccggaggagcgtcgtgaagctgccgtcaccgctgcaccacctggccggcttcaacgccttctggtatgcccaccacctgctggtgatcgcctatgtcctcctggtgatgcactcatacttcatattcctcaccaagcagtggtacaagagaacgacatggatgtacttggcagtccctgtcatcttctatgcctctgagagaagtatcagaaaaattcgtgagagaagctatcgcgtgagcatcataaaggcagcaatttaccctggaaacgtgctctcaatttacatgaagaagccaccaagcttcaagtacaaaagtgggatgtacctgtttgtaaaatgcccagacgtttcaccttttgaatggcaccccttctctatcacttcggctcctggagatgactacttgagcgttcatatccgtacattaggtgattggacatcagaactcaggaatctatttgggaaggcttgtgaagcagaagtaacttctaagaaggctacactagctagacttgaaacaactgttgtggcacatggtctggcagaggacactaggtttcctaaagtcttcatagacggcccttatggtgcaccggctcaaaactaccggaaatatgacattcttttgcttatcgggctcgggattggtgcaactcctttcatcagcatactgaaggatctcctcaacaacataaagtccaaccaggagatggagagcacgcatgacacggagttaggttgcagcttcaagacgaatgggccaggaagagcctacttctactgggttaccagagagcaaggctccttcgagtggttcaaaagtgtcatgaacgaagttgccgagagtgatcgtgatgatgtgatagagatgcacaattacctgaccagcgtgtacgaagaaggcgacgcgaggtcagccctgattgccatggtccagtcacttcaacatgccaagaacggcgtggatattgtctcaggcagcaagattcgaacgcattttgcaaggccaaactggagaaaagtcttctctgatctggccagtgctcacaagaactcacggataggtgtcttctactgtggatctccaacacttacgaagaccctaagagatctttcaatagagttcagcagtaccacgacgacccgattccatttccacaaagagaatttctaa

SEQ ID NO: 9046 - protein, 817 aa, Sorghum bicolor
  misc_feature: Ceres ANNOT ID no. 6096579
  misc_feature (632)..(800): Pfam Id: NAD_binding_6 Pfam Desc: Ferric reductase NAD binding domain
  misc_feature (59)..(155): Pfam Id: NADPH_Ox Pfam Desc: Respiratory burst NADPH oxidase
  misc_feature (502)..(626): Pfam Id: FAD_binding_8 Pfam Desc: FAD-binding domain
  misc_feature (304)..(461): Pfam Id: Ferric_reduct Pfam Desc: Ferric reductase like transmembrane component
  misc_feature (5)..(817): NCBI GI: 115464367 NCBI Desc: os05g0465800 [oryza sativa (japonica cultivar-group)]
  misc_feature (2)..(817): NCBI GI: 112012438 NCBI Desc: respiratory burst oxidase protein a [zea mays]
  misc_feature (61)..(817): NCBI GI: 109631188 NCBI Desc: nox1 [striga asiatica]
  misc_feature (57)..(659): NCBI GI: 42565600 NCBI Desc: ferric reductase-like transmembrane component family protein [arabidopsis thaliana]
  misc_feature (16)..(817): NCBI GI: 58532641 NCBI Desc: respiratory burst oxidase 2 [medicago truncatula]
MASSAGYAGGDTGGLGDGEPPPPVPPQMRKQPSRIASGMRRLASKVSSAVPEMRGHKHTHSGAQSGLRGLRFLDKTSAGKDGWKTVEKRFDEMSTDGRLQRENFAKCIGMADSKEFASEVFVALSRRRHINPDDGVTKEQLKEFWEEMTDQNFDSRCDKNGDGKLTEDEVKEIMVLSASANKLAKLKKHAGTYASLIMEELDPDHRGYIELETLLRGMVSASGPPDKMNMASQSLTRTMVPSSHRSPLQRRMNMAVDFVHENWKRIWVISLWGALNIALFVFKFIQYRRRAVFEVMGYCVCIAKGAAETLKLNMALILLPVCRNTLTRLRSTALSKVVPFDDNINFHKVIALTIAIGAATHTLSHVLCDFPRLVSCPKDKFMEKLGPFFNYVQPTWPILLTSIPGWTGILLILIMSFSFTLATHSFRRSVVKLPSPLHHLAGFNAFWYAHHLLVIAYVLLVMHSYFIFLTKQWYKRTTWMYLAVPVIFYASERSIRKIRERSYRVSIIKAAIYPGNVLSIYMKKPPSFKYKSGMYLFVKCPDVSPFEWHPFSITSAPGDDYLSVHIRTLGDWTSELRNLFGKACEAEVTSKKATLARLETTVVAHGLAEDTRFPKVFIDGPYGAPAQNYRKYDILLLIGLGIGATPFISILKDLLNNIKSNQEMESTHDTELGCSFKTNGPGRAYFYWVTREQGSFEWFKSVMNEVAESDRDDVIEMHNYLTSVYEEGDARSALIAMVQSLQHAKNGVDIVSGSKIRTHFARPNWRKVFSDLASAHKNSRIGVFYCGSPTLTKTLRDLSIEFSSTTTTRFHFHKENF

SEQ ID NO: 9047 - DNA, 801 bp, Sorghum bicolor
  misc_feature: Ceres ANNOT ID no. 6096730
  misc_feature: Encodes the peptide sequence at SEQ ID NO 9048
atggcgtcgactagctccgccggggacgtgggaggctcagggtcaaaaggtgcggctgcagataaaacacttcctgcttctgcaaataccagtagctcaaatcaagagtctcatgatgctgatgcaaaatcacgtgtggaggacatttggaagaaaatgaacagtggtttgcctaataagatgcccaaacctgcaatgacgaagctcagtacagcagcaaaagaaaagaaaattaaatcaacaaataattggatgactgttctaggcctttcaccaagtaagtcatgcactgtcgatcaaggatcgaaaaatgggcaacaacagacacaacatgaaatgagcgaggatgccaaaaaacttgcagcaaaggcccttgcagctgccaaaaatgccgctgctatggcatctggacgagggaaagtggagatcactgaggtaagggactttgctggcaaggacatcgaaatcaagaaattggtcgatgctaattcaaaggaggcaattgagaaggccaaggcagctggtgccgccccatcagctgttgataacattctagagcaaatacggaagaagcagaagctgagcgtcctggacaagacgaagaaagactggggagagtacaaggaagagaaccgaggcctggaggaagagctggacgcctacaagaagagctcgaaccagtacctcgacaagcaatcgttcctgcagcgaactgattaccgcgagtttgagcgcgagcgggatgcccggctgtcattgatgtccaagcggaagacagatatgcgggaggacgatgtgtag

SEQ ID NO: 9048 - protein, 266 aa, Sorghum bicolor
  misc_feature: Ceres ANNOT ID no. 6096730
  misc_feature (175)..(254): Pfam Id: BCNT Pfam Desc: Bucentaur or craniofacial development
  misc_feature (1)..(264): NCBI GI: 115436316 NCBI Desc: os01g0328500 [oryza sativa (japonica cultivar-group)]
  misc_feature (33)..(260): NCBI GI: 21618133 NCBI Desc: bcnt-like protein [arabidopsis thaliana]
  misc_feature (140)..(266): NCBI GI: 47027075 NCBI Desc: bcnt [hyacinthus orientalis]
  misc_feature (98)..(254): NCBI GI: 47575702 NCBI Desc: craniofacial development protein 1 [gallus gallus]
  misc_feature (98)..(254): NCBI GI: 22775404 NCBI Desc: bcnt [gallus gallus]
MASTSSAGDVGGSGSKGAAADKTLPASANTSSSNQESHDADAKSRVEDIWKKMNSGLPNKMPKPAMTKLSTAAKEKKIKSTNNWMTVLGLSPSKSCTVDQGSKNGQQQTQHEMSEDAKKLAAKALAAAKNAAAMASGRGKVEITEVRDFAGKDIEIKKLVDANSKEAIEKAKAAGAAPSAVDNILEQIRKKQKLSVLDKTKKDWGEYKEENRGLEEELDAYKKSSNQYLDKQSFLQRTDYREFERERDARLSLMSKRKTDMREDDV

SEQ ID NO: 9049 - DNA, 1515 bp, Sorghum bicolor
  misc_feature: Ceres ANNOT ID no. 6096732
  misc_feature: Encodes the peptide sequence at SEQ ID NO 9050
atggcgctcgctatcctggcgaggcggcgggcggcggaggccgtgctgcggcggccgcaggcggcggcggcgggggcggccgtgtccgcctggagggcgtacgcggcggcgggcgaggagagcgacgtggtcgtggtgggcggcgggcccggagggtacgtggcggcgatcaaggccgcgcagctcgggctcaagaccacctgcatcgagaagaggggcaccctcggcgggacctgcctcaacgtcggatgcatcccatccaaggctcttttgcattcatcacatatgtaccatgaagcaatgagttcttttgcacaccatggagttaagttttcaaatctggaagtggacctcccagccatgatggctcagaaagacaaagctgtggcagggctaacaaaaggaattgaagggctctttaaaaagaacaaggtgacttatgttaagggctttgggaaattgtcatccccctcagaagtgtcagtcgatttgattgatggtggtagcactgttgtcaaaggcaaaaacataataattgcaactgggtctgatgtaaaatcacttccaggaataacaattgatgagaagaaagtggtttcatctactggtgcactgtgcttgtcagagatcccgaagaaactggtggtaattggagcaggttatattggccttgagatgggttcagtctggaaccgccttggttcagaggtcactgttgttgaatttgcaccagatatagtaccatcaatggatggcgaggtcaggaggcagttccaacgcatgctagaaaaacagaagttcaagttcatgctcaagacaaaggttgttgggtgtgataccagtggagatggcgtaaagctgacacttgagcctgcagctggtggtgagcagaccatccttgaagcagatgttgtccttgtctctgctggcagaaccccatttacttctgggattgggcttgaaactcttggtgttgagacagacaaggctggcaggatccttgttgataagcgcttcatgaccaatgtgaagggagtctatgcaattggggatgccatccctggtcccatgcttgcccataaagctgaagaggatggtgtcgcatgcgtagagttcattgctggaaaggaaggccatgttgactatgacacagttcctggtgtggtctatacgcatccagaagttgcatctgttggcaagactgaggagcaggtgaaggatctaggaattgcctatcaagtgggcaagtttccacttttggctaacagccgtgcgaaggccattgatgacgctgaaggggtagttaaggtgatcgcagagaaggaaactgacaagattctgggtgtgcacataatggcacccaatgctggtgaaatcatccatgaagccgtcctcgccttgcagtatggagcatccagtgaggacgttgctcgaacatgccacgcacaccctacagtgagcgaagccctcaaggaggcttgcttgcaaaccttcgataaagcaatccacatatga

SEQ ID NO: 9050 - protein, 504 aa, Sorghum bicolor
  misc_feature: Ceres ANNOT ID no. 6096732
  misc_feature (42)..(356): Pfam Id: Pyr_redox_2 Pfam Desc: Pyridine nucleotide-disulphide oxidoreductase
  misc_feature (385)..(494): Pfam Id: Pyr_redox_dim Pfam Desc: Pyridine nucleotide-disulphide oxidoreductase, dimerisationdomain
  misc_feature (213)..(310): Pfam Id: Pyr_redox Pfam Desc: Pyridine nucleotide-disulphide oxidoreductase
  misc_feature (1)..(504): NCBI GI: 10444388 NCBI Desc: dihydrolipoamide dehydrogenase precursor [solanum tuberosum]
  misc_feature (1)..(504): NCBI GI: 44662784 NCBI Desc: lipoamide dehydrogenase [capsicum annuum]
  misc_feature (1)..(504): NCBI GI: 23321340 NCBI Desc: dihydrolipoamide dehydrogenase precursor [lycopersicon esculentum]
  misc_feature (1)..(504): NCBI GI: 3309269 NCBI Desc: ferric leghemoglobin reductase-2 precursor [glycine max]
  misc_feature (1)..(504): NCBI GI: 13873336 NCBI Desc: dihydrolipoamide dehydrogenase precursor [bruguiera gymnorrhiza]
  misc_feature (1)..(504): SWISSPROT Homolog: EC 1.8.1.4 Dihydrolipoyl dehydrogenase 1, mitochondrial precursor
MALAILARRRAAEAVLRRPQAAAAGAAVSAWRAYAAAGEESDVVVVGGGPGGYVAAIKAAQLGLKTTCIEKRGTLGGTCLNVGCIPSKALLHSSHMYHEAMSSFAHHGVKFSNLEVDLPAMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRRQFQRMLEKQKFKFMLKTKVVGCDTSGDGVKLTLEPAAGGEQTILEADVVLVSAGRTPFTSGIGLETLGVETDKAGRILVDKRFMTNVKGVYAIGDAIPGPMLAHKAEEDGVACVEFIAGKEGHVDYDTVPGVVYTHPEVASVGKTEEQVKDLGIAYQVGKFPLLANSRAKAIDDAEGVVKVIAEKETDKILGVHIMAPNAGEIIHEAVLALQYGASSEDVARTCHAHPTVSEALKEACLQTFDKAIHI

SEQ ID NO: 9051 - DNA, 1023 bp, Sorghum bicolor
  misc_feature: Ceres ANNOT ID no. 6096760
  misc_feature: Encodes the peptide sequence at SEQ ID NO 9052
atggcggcggcggcggcggatacctcggaggcgtccgcggccgggatcgcgctcgcggaggccaacatcaactgggagaggttggacaagacgaggtttcatgtgattggagctatcctgtttacggcccagcaaggtgctctgcacccaacagctgttgtgaagactaggatgcaggttgctgaaggggggcttgcacatatgtccgggtttgctgtttttaggaggatattgagaagcgatggcatccctggcattttcagaggatttggtacctctgctgttggagctctgcctgggcgagtgctagctctaacatcactggagatctctaaagaaatgatgtttaagtattgtgaacattttgatatgtcagaggcgtcacgaattgctgtagcaaatggggttgcaggcctgatgtcgagtatctgttcatgctcatattttgttcctctagatgtgatttgccaaaggctcatggttcaaggattgccggggatggcaacatacaggggaccatttgatgtgataaataaggttgtcagaacagaagggatccgggggctttaccgaggttttggaatcactatgttaactcagtcgccagcttcagccctttggtggagtgcatatggtggtgctcaacatgctatttggaggagtttgggttatggaaatgactcaccaacaaaaccatctcaatcagaacttgttgctgtccaagctacagcaggaacaattgctggtgcttgctcgtcgattatcaccactccaatagatacaatcaagactcggcttcaggttatggacaactatggtaagggtaggccttctgtcatgaaaactaccaggctgctgcttgatgaagatgggtggagggggttttatagaggttttggaccgaggtttcttaacatgtctctctggggcacatcaatgatcgtgacatatgagctcataagtaggtcatttttcagtattattatctattacctatatatttcagtcgggaaggatcattaa

SEQ ID NO: 9052 - protein, 340 aa, Sorghum bicolor
  misc_feature: Ceres ANNOT ID no. 6096760
  misc_feature (34)..(119): Pfam Id: Mito_carr Pfam Desc: Mitochondrial carrier protein
  misc_feature (130)..(222): Pfam Id: Mito_carr Pfam Desc: Mitochondrial carrier protein
  misc_feature (237)..(328): Pfam Id: Mito_carr Pfam Desc: Mitochondrial carrier protein
  misc_feature (17)..(338): NCBI GI: 38194914 NCBI Desc: mitochondrial carrier protein [phaseolus vulgaris]
  misc_feature (11)..(322): NCBI GI: 115451065 NCBI Desc: os03g0175200 [oryza sativa (japonica cultivar-group)]
  misc_feature (8)..(322): NCBI GI: 21594326 NCBI Desc: mitochondrial carrier-like protein [arabidopsis thaliana]
  misc_feature (8)..(322): NCBI GI: 23308179 NCBI Desc: at5g26200/t19g15_50 [arabidopsis thaliana]
  misc_feature (8)..(322): NCBI GI: 3319342 NCBI Desc: similar to mitochondrial carrier proteins (pfam: mit_carr.hmm, score: 79.74 and 42.50) [arabidopsis thaliana]
  misc_feature: The sequence is a functional homolog of SEQ ID NO. 517 in the 11/188,298 US application
  misc_feature: The sequence is a functional homolog of SEQ ID NO. 385 in the 11/188,298 US application
  misc_feature: The sequence is a functional homolog of SEQ ID NO. 398 in the 11/188,298 US application
MAAAAADTSEASAAGIALAEANINWERLDKTRFHVIGAILFTAQQGALHPTAVVKTRMQVAEGGLAHMSGFAVFRRILRSDGIPGIFRGFGTSAVGALPGRVLALTSLEISKEMMFKYCEHFDMSEASRIAVANGVAGLMSSICSCSYFVPLDVICQRLMVQGLPGMATYRGPFDVINKVVRTEGIRGLYRGFGITMLTQSPASALWWSAYGGAQHAIWRSLGYGNDSPTKPSQSELVAVQATAGTIAGACSSIITTPIDTIKTRLQVMDNYGKGRPSVMKTTRLLLDEDGWRGFYRGFGPRFLNMSLWGTSMIVTYELISRSFFSIIIYYLYISVGKDH

SEQ ID NO: 9053 - DNA, 1884 bp, Sorghum bicolor
  misc_feature: Ceres ANNOT ID no. 6096803
  misc_feature: Encodes the peptide sequence at SEQ ID NO 9054
atgagtggtcaaaccccgatggggctcgccgccgcagcagccgcagcagtgaggccgtgccgccgacgcctcctctcgtccgcctccgcagcctcggcgtcaaagacggcggcgggcaccgcgacccggctcttccccaggttgccccacccgcaccacccgccgtacggccggcgcctccccttcctcgtctccgcggcgtcgcagtcgcaggcctcgcagaccggcccggccacccctgtaccggtccccgtcgcctccgacccccgcgccgccgtttccggcaacctccctttcttcgaccgcgtcctcttcccggactcgttcccgcttgataccccgcctgccaaggaggaggacgacgcggcggcggtgcaggccgatgaggcggtggagccgcccgcgcccttgagggaggagacggagacggagagggaggcgtggaggctgctacggcgggcggtcgtcagctactgcggcgagcctgtggggacggttgcggcggaggaccccgagtgcacggagacgctcaactacgaccaggtcttcatcagggacttcgtgccctccgctctcgccttcctcatgcgcggcgagaccgagatcgtccgcaacttcctcctccacaccctccagcttcagagctgggagaaaactgttgattgttacagccctgggcaaggattgatgccagctagcttcaagattaggaccgtaccacttgatgagaacaatgaaggatttgaggaggtcttggaccctgacttcggtgaggcagccattggccgtgtagctccggtggattctggactgtggtggattattttgttgagagcttactgcaagattacaggagacaatgctttgctagaaagagttgatgtgcagacaggaattcaattgatactgagtttgtgtttggctgatgggtttgacatgttcccaacgttactagttacagatggatcatgcatgatagacaggaggatgggaatacatgggcatcctcttgaaatccaagctttgttctactctgctttacgatgctcacgagaaatgcttgttatgaacaatggatcgaaaaacctcattcgtgccattaacaacaggctcagtgcattgtcctttcacatcagagaatattactgggttgacatgaagaagataaatgagatatacagatacaagacagaagaatactcccatgatgccactaacaaattcaacatttaccctgagcaaatcccttcctggcttgttgactggattcctgagaaaggaggttaccttatagggaatctgcagccagctcacatggattttaggttcttctctcttggcaacctttgggccatagcttcgtctctaactactccaaaacaagctgagggaattcttagccttattgatgaaaaatgggatgatcttgtagcaaacatgcccctcaagatatgctatcctgcaatggaagatgatgaatggcgcattattactggcagtgatcctaagaataccccatggtcatatcataatggtggatcttggccaaccctattgtggcagttcacgttggcgtgcataaaaatgggtagaccagaattggcccggagagccattgcagtggccgaggagagactctcagatgacaagtggccagaatactacgacacccgatctgggaggttcattgggaagcaatcccgatcttaccagacatggactattgctggttttctgacctcaaaaatgttgctggagaacccagagctggcttcaattctgacctgtgatgaggaccttgagctgctcgaaggctgcgcttgctgcctgtccacgaagaggaccaggtgctcacgccgggcagccaagtcacatattgggtga

SEQ ID NO: 9054 - protein, 627 aa, Sorghum bicolor
  misc_feature: Ceres ANNOT ID no. 6096803
  misc_feature (135)..(607): Pfam Id: Invertase_neut Pfam Desc: Plant neutral invertase
  misc_feature (1)..(626): NCBI GI: 27948558 NCBI Desc: invertase [oryza sativa (indica cultivar-group)]
  misc_feature (135)..(626): NCBI GI: 4200165 NCBI Desc: neutral invertase [daucus carota]
  misc_feature (104)..(626): NCBI GI: 21322510 NCBI Desc: neutral invertase [beta vulgaris]
  misc_feature (144)..(603): NCBI GI: 92899277 NCBI Desc: plant neutral invertase; glycoside transferase, six-hairpin [medicago truncatula]
  misc_feature (138)..(626): NCBI GI: 2832717 NCBI Desc: alkaline/neutral invertase [lolium temulentum]
  misc_feature: Useful for making plants with altered carbohydrate content
  misc_feature: Functional homolog of the protein sequence given in SEQ ID NO 13652
  misc_feature: Useful for making plants with modulated oxidative stress sensitivity
  misc_feature: Functional homolog of the protein sequence given in SEQ ID NO 13231
MSGQTPMGLAAAAAAAVRPCRRRLLSSASAASASKTAAGTATRLFPRLPHPHHPPYGRRLPFLVSAASQSQASQTGPATPVPVPVASDPRAAVSGNLPFFDRVLFPDSFPLDTPPAKEEDDAAAVQADEAVEPPAPLREETETEREAWRLLRRAVVSYCGEPVGTVAAEDPECTETLNYDQVFIRDFVPSALAFLMRGETEIVRNFLLHTLQLQSWEKTVDCYSPGQGLMPASFKIRTVPLDENNEGFEEVLDPDFGEAAIGRVAPVDSGLWWIILLRAYCKITGDNALLERVDVQTGIQLILSLCLADGFDMFPTLLVTDGSCMIDRRMGIHGHPLEIQALFYSALRCSREMLVMNNGSKNLIRAINNRLSALSFHIREYYWVDMKKINEIYRYKTEEYSHDATNKFNIYPEQIPSWLVDWIPEKGGYLIGNLQPAHMDFRFFSLGNLWAIASSLTTPKQAEGILSLIDEKWDDLVANMPLKICYPAMEDDEWRIITGSDPKNTPWSYHNGGSWPTLLWQFTLACIKMGRPELARRAIAVAEERLSDDKWPEYYDTRSGRFIGKQSRSYQTWTIAGFLTSKMLLENPELASILTCDEDLELLEGCACCLSTKRTRCSRRAAKSHIG

SEQ ID NO: 9055 - DNA, 1677 bp, Sorghum bicolor
  misc_feature: Ceres ANNOT ID no. 6096864
  misc_feature: Encodes the peptide sequence at SEQ ID NO 9056
atgtccctctcggcggcttcggcggcggtcgccagtagcgccgccgccgcctacaggtacgacacgatccggccggtttctaggctccgcttctgcggcctcaggcgcgaggccctccggctacaatcgccccggtccacgccgcagttggtggctgctaggcggagcgttgtgtatgcggcaacggctggcaatggcgcggctgcgagcagcgagttcgactacgacctcgtgatcatcggagccggcgtcggcggtcatggcgccgccctcaacgcagtcgagaagggtttaaaaactgccataattgagggagacgtcgtgggtggaacttgtgtgaacagaggctgtgttccgtcaaaggctctccttgcagtaagtggtaggatgcgagaacttcaagatgaacatcacatgaaatcactgggcctacaggtctcatcaccaggatatgacaggcaggctgttgctgaccatgcaaataatcttgcatctaaaatccgcagcaacttgactaattcaatgaaagctctgggtgtggatatactcactggtattggcaccattgtggggaagcaaaaagtgagatatgggaaagttggtttcccagacaatgaaatcactgctagaaacatcataattgccactggatctgttccttttgtccccaagggcattgaaatagatggtaaaactgtatttactagtgatcatgcactaaaacttgagtcagtccctgagtggatagctattgttggaagtggttacattggacttgaattcagtgatgtatacacggctctgggaagtgaggttacttttgttgaagctcttgatcaattaatgcctgggtttgatcccgagattgcgaaattggcgcagaggatccttattaatcctcgtaaaattgactatcacactggtgtttttgcaagcaagattaccccagcaaaggatggcaatcctgttttgattgagctgattgatgctaagacaaaagaacacaaggagacacttgaggtggatgcagcacttatagctactggaagggcacccttcaccaaaggacttggcttggaaaatatcaatgtcgttacacaacgaggttttgttcctgttgatgagcggatgcaagttatggatgcaactggcaatgtggttcctaatttatattgcattggagatgccaatggtaagctcatgcttgctcatgcagccagcgcacaaggaatctcagttgtggagcaaatcagtgggagggacaacatcttaaatcacctaagcatcccagctgcctgtttcactcaccctgagatcagtatggttggcttgacagagccacaggctagggagaaggctgacaaggaaggatttgaaataagtgttgtaaagaccagttttaaggctaacacaaaggctctggcggagaatgaaggagatggacttgctaagatgatttatcgccctgacactggagaaattctcggagttcatattttgggcttgcatgctgctgatctcatccatgaggcatcaaatgccattgcccttggaacccatgtgcaagacatcaagtttgctgttcatgcacacccaacgttgtctgaagttctggatgaactcttcaaggctgccaagaggacatgggattctccaggagaaatgctccaaacctaa

SEQ ID NO: 9056 - protein, 558 aa, Sorghum bicolor
  misc_feature: Ceres ANNOT ID no. 6096864
  misc_feature (429)..(542): Pfam Id: Pyr_redox_dim Pfam Desc: Pyridine nucleotide-disulphide oxidoreductase, dimerisationdomain
  misc_feature (76)..(400): Pfam Id: Pyr_redox_2 Pfam Desc: Pyridine nucleotide-disulphide oxidoreductase
  misc_feature (248)..(349): Pfam Id: Pyr_redox Pfam Desc: Pyridine nucleotide-disulphide oxidoreductase
  misc_feature (76)..(421): Pfam Id: GIDA Pfam Desc: Glucose inhibited division protein A
  misc_feature (29)..(546): NCBI GI: 21464567 NCBI Desc: at3g16950/k14a17_7 [arabidopsis thaliana]
  misc_feature (29)..(546): NCBI GI: 145332599 NCBI Desc: lpd1 (lipoamide dehydrogenase 1) [arabidopsis thaliana]
  misc_feature (1)..(546): NCBI GI: 87240458 NCBI Desc: pyridine nucleotide-disulphide oxidoreductase, class i [medicago truncatula]
  misc_feature (188)..(546): NCBI GI: 140041513 NCBI Desc: pyridine nucleotide-disulphide oxidoreductase, class i [medicago truncatula]
  misc_feature (70)..(545): NCBI GI: 23130019 NCBI Desc: cog1249: pyruvate/2-oxoglutarate dehydrogenase complex, dihydrolipoamide dehydrogenase (e3) component, and related enzymes [nostoc punctiforme pcc 73102]
  misc_feature (70)..(545): SWISSPROT Homolog: EC 1.8.1.4 Dihydrolipoyl dehydrogenase
MSLSAASAAVASSAAAAYRYDTIRPVSRLRFCGLRREALRLQSPRSTPQLVAARRSVVYAATAGNGAAASSEFDYDLVIIGAGVGGHGAALNAVEKGLKTAIIEGDVVGGTCVNRGCVPSKALLAVSGRMRELQDEHHMKSLGLQVSSPGYDRQAVADHANNLASKIRSNLTNSMKALGVDILTGIGTIVGKQKVRYGKVGFPDNEITARNIIIATGSVPFVPKGIEIDGKTVFTSDHALKLESVPEWIAIVGSGYIGLEFSDVYTALGSEVTFVEALDQLMPGFDPEIAKLAQRILINPRKIDYHTGVFASKITPAKDGNPVLIELIDAKTKEHKETLEVDAALIATGRAPFTKGLGLENINVVTQRGFVPVDERMQVMDATGNVVPNLYCIGDANGKLMLAHAASAQGISVVEQISGRDNILNHLSIPAACFTHPEISMVGLTEPQAREKADKEGFEISVVKTSFKANTKALAENEGDGLAKMIYRPDTGEILGVHILGLHAADLIHEASNAIALGTHVQDIKFAVHAHPTLSEVLDELFKAAKRTWDSPGEMLQT

SEQ ID NO: 9057 - DNA, 564 bp, Sorghum bicolor
  misc_feature: Ceres ANNOT ID no. 6096891
  misc_feature: Encodes the peptide sequence at SEQ ID NO 9058
atgcagaaccctagcggccaccaccccgcgacggccgccccgtcgtcggcgccgtccaagggcaagtcgtcggcgccgaaccctagcggccaccacgccgcgacgccggcgccgtcggggacgccgtcgaagggcaaatcagcggcggcgcaggccgcggcttcgggccagggctcctcttcccaccaccacactgccggcggtggcggtggtggcggcggcgccgacgcgtccgccaccaccctcaagcgcaagcgcggcgtcttccagaaagacctgcagcacatgatgtatggctttggggatgatccaaatccacttccagaaaccgttgcacttgtggaggacattgttgtcgaatatgtcactgacctggtgcacaaggcgcagaatgttgcctcaaagagagggaagctactgacggaggattttctttatcttatacgcaaggatttacgaaaactgcaccgtgctactgagctactgtccatgaatgaagagctcaagcaagcaaggaaagcttttgacgtggatgaagagacgctggctacgactaacatatga

SEQ ID NO: 9058 - protein, 187 aa, Sorghum bicolor
  misc_feature: Ceres ANNOT ID no. 6096891
  misc_feature (87)..(177): Pfam Id: TFIID-18kDa Pfam Desc: Transcription initiation factor IID, 18kD subunit
  misc_feature (72)..(176): NCBI GI: 58569313 NCBI Desc: gekbs181p [gekko japonicus]
  misc_feature (72)..(176): NCBI GI: 55666204 NCBI Desc: taf13 rna polymerase ii, tata box binding protein (tbp)-associated factor, 18kda [homo sapiens]
  misc_feature (72)..(176): NCBI GI: 75054990 NCBI Desc: transcription initiation factor tfiid subunit 13 (transcription initiation factor tfiid 18 kda subunit) (taf(ii)18) (tafii-18) (tafii18)
  misc_feature (72)..(176): NCBI GI: 119367384 NCBI Desc: transcription initiation factor tfiid subunit 13 (transcription initiation factor tfiid 18 kda subunit) (taf(ii)18) (tafii-18) (tafii18)
  misc_feature (72)..(176): NCBI GI: 122889901 NCBI Desc: taf13 rna polymerase ii, tata box binding protein (tbp)-associated factor [mus musculus]
MQNPSGHHPATAAPSSAPSKGKSSAPNPSGHHAATPAPSGTPSKGKSAAAQAAASGQGSSSHHHTAGGGGGGGGADASATTLKRKRGVFQKDLQHMMYGFGDDPNPLPETVALVEDIVVEYVTDLVHKAQNVASKRGKLLTEDFLYLIRKDLRKLHRATELLSMNEELKQARKAFDVDEETLATTNI

SEQ ID NO: 9059 - DNA, 1524 bp, Sorghum bicolor
  misc_feature: Ceres ANNOT ID no. 6096897
  misc_feature: Encodes the peptide sequence at SEQ ID NO 9060
atggggccaccgcagccagccagggtcggcgccatcaacatcgaggcgtgcgcgcggccgatcgccgtcgaccaccgcatcaggctcccctactacttccgcatcgcgggcagcctcctccgacaggctaatatatatcggaacgagagtaacttcctcgacctgtatgtcatccttctgagatactcgagcttgctgtgtgagacgattccgaagcatcgtgattaccatgccttcaagttaaaagaaaaggcattttttgataaacttaatgatgttatgaaagagcttgagacattgaagccagttgtgcagcggcaggttgccgagcataacagaggaggtactgtggaatcgaatactaatagtctaaatggaaactatggtataactcgtaggatagagcagcgcactccaacctcttatactccacagccatttgtaggcagcactaatggagcattgcaaaaaaccttccatgctgggagacaagtggcattattaccaagcgtccagaaacaatttatgaatctaccatatccaaaagaagaaacactagctagacactccatattaggacctaatggtcttaatggccgatggaatgggcctgttactgaaattaaggttcagtatccaagcaattttgaattaacacaaaatgatataacaagtttagtgccatccatcttgaaccaagatgattcgcatggtcccagtactgcacctgcacctccacctccagatagctcctcaaatgacaatgacgatatgaaatctgttctctctcttgatgatggtcgatggtctgtgccagcagaacgcactccacttccttctgctagcttggaagaagagttgtttcaattggatatcaaacaaccttctcctccaccagttctggcagaggtgcaaagaccaatttctccatctagagttgctgatccaacacccggacttccgacctcaggaactgcccgttttcagaacttgcatgttccgatcaagttgatggagtgttttctaagggttgctgagtcaaacaccaaaagaagcttagaaacctgtggggttcttgctggtaccttgaaaaagagaactttttgcgtgacaaccttaattattccaaagcagaaatcgacatctaatacgtgtgaagctataaatgaagaagagctatttgaagttcaggacacaggctcactgttcactcttggttggattcatacacatccaacacagtcctgcttcctttcttccattgacctccacaatcattattcttatcaggtcatgctacctgaagcaattgcgatagttatggcacctactgacacaacaagaaaacatggtatatttcatctcacggatccaggtggtatgggcgtgatccatgattgtcaagagagaggtttccatcctcataaggcacctcttgatggttcgccaatctatgagcagtgctcccatgtgtacatggacaacgatataaagtttgatatgattgatctccgagaacgatga

SEQ ID NO: 9060 - protein, 507 aa, Sorghum bicolor
  misc_feature: Ceres ANNOT ID no. 6096897
  misc_feature (326)..(435): Pfam Id: Mov34 Pfam Desc: Mov34/MPN/PAD-1 family
  misc_feature (1)..(505): NCBI GI: 15623925 NCBI Desc: stam binding protein(associated molecule with the sh3 domain of stam)-like [oryza sativa (japonica cultivar-group)]
  misc_feature (3)..(506): NCBI GI: 56202279 NCBI Desc: stam binding protein-like protein [oryza sativa (japonica cultivar-group)]
  misc_feature (12)..(505): NCBI GI: 56381981 NCBI Desc: at4g16144 [arabidopsis thaliana]
  misc_feature (323)..(505): NCBI GI: 24651395 NCBI Desc: cg2224-pa [drosophila melanogaster]
  misc_feature (323)..(505): NCBI GI: 18447170 NCBI Desc: at31826p [drosophila melanogaster]
MGPPQPARVGAINIEACARPIAVDHRIRLPYYFRIAGSLLRQANIYRNESNFLDLYVILLRYSSLLCETIPKHRDYHAFKLKEKAFFDKLNDVMKELETLKPVVQRQVAEHNRGGTVESNTNSLNGNYGITRRIEQRTPTSYTPQPFVGSTNGALQKTFHAGRQVALLPSVQKQFMNLPYPKEETLARHSILGPNGLNGRWNGPVTEIKVQYPSNFELTQNDITSLVPSILNQDDSHGPSTAPAPPPPDSSSNDNDDMKSVLSLDDGRWSVPAERTPLPSASLEEELFQLDIKQPSPPPVLAEVQRPISPSRVADPTPGLPTSGTARFQNLHVPIKLMECFLRVAESNTKRSLETCGVLAGTLKKRTFCVTTLIIPKQKSTSNTCEAINEEELFEVQDTGSLFTLGWIHTHPTQSCFLSSIDLHNHYSYQVMLPEAIAIVMAPTDTTRKHGIFHLTDPGGMGVIHDCQERGFHPHKAPLDGSPIYEQCSHVYMDNDIKFDMIDLRER

SEQ ID NO: 9061 - DNA, 1272 bp, Sorghum bicolor
  misc_feature: Ceres ANNOT ID no. 6096902
  misc_feature: Encodes the peptide sequence at SEQ ID NO 9062
atggctcagcctcccaatcccaagagaaggtcgtccctacctctccctgactggagatccggcctgccagaggaactcctccagtccatcgcgcaacgtctcgcgtcgggccacgacgcggcgtccttccgatccgcttgctccccgtggcgcgccgccgtcccgttcgcgaccttcgggccgctcctgctgctgccgttcgaccccgactcggaccgcgtcgacttctactgcgcctcggaggagaaggtcttctccaagacgctgcccgacgtgcgcggcaaggtggcgtgcggctcgtcgtgcgggtggctggcgctcatggacgaggcggcgtccgtgacgctgctaaatccgttcgccggtgcccgtgcccgtgcccgtgcgcaacgcgttgagctcccgccggcaggcgaacacgtcgcggcggcgtcctcgtcggaacccgtgtctaaggtccacggccggtgggtcgtccatcccaccaacaacggctacgggaacgcggatgctgcgggcagaggcatcaagctagaagacatgagggacgtgttcttccgtgagatcgtgctctccgcgccgcctgacgccgacggcggcagcgagtgcgtggccatggccatgcttgggtgctccacggaggtcgcgttctgccgggttggagtcgacagcgcatggacgctgctcgacaccaaactggactgctccgtggcctccgtcgtccactgccaggacaagttcttggcgatcgactacactggagaaatctccatctgcagcatcagcaacgccgccgccggtgcaacaccaaccgcgacgctgctgccgtcgctgtcgccacctgcggggctctgccaccgcagctacctggaatcaaacggtgagctgcacattgtgggtgccatggtgagcacgttccacgagacacagagcttcgcctacagcagcgcgatctacaagtgcaacctccacgaccgtacgccggagtggtccagggtgagggacatcggtgatcggacactgttcgtgtctaaacatttcaagggaggcttcagtggaacaagtgtatccatgtataaagagaacaaaatctacatgtctgaacccttgtatggggatccatacgacttggtccatcgtttggagatcgttgatatttctaccggcacatctgaagtgaagcccgtccacgaaaagacgatgcagggttccgaggctctaggttggattcgacccaatctctggaagggagtacccaatctttctcattag

SEQ ID NO: 9062 - protein, 423 aa, Sorghum bicolor
  misc_feature: Ceres ANNOT ID no. 6096902
  misc_feature (14)..(415): NCBI GI: 38567950 NCBI Desc: osjnbb0115i21.6 [oryza sativa (japonica cultivar-group)]
  misc_feature (14)..(415): NCBI GI: 116311101 NCBI Desc: osigba0136o08-osigba0153h12.7 [oryza sativa (indica cultivar-group)]
  misc_feature (1)..(415): NCBI GI: 116311099 NCBI Desc: osigba0136o08-osigba0153h12.5 [oryza sativa (indica cultivar-group)]
  misc_feature (14)..(150): NCBI GI: 115439105 NCBI Desc: os01g0673300 [oryza sativa (japonica cultivar-group)]
  misc_feature (20)..(372): NCBI GI: 38345140 NCBI Desc: osjnbb0050n09.7 [oryza sativa (japonica cultivar-group)]
MAQPPNPKRRSSLPLPDWRSGLPEELLQSIAQRLASGHDAASFRSACSPWRAAVPFATFGPLLLLPFDPDSDRVDFYCASEEKVFSKTLPDVRGKVACGSSCGWLALMDEAASVTLLNPFAGARARARAQRVELPPAGEHVAAASSSEPVSKVHGRWVVHPTNNGYGNADAAGRGIKLEDMRDVFFREIVLSAPPDADGGSECVAMAMLGCSTEVAFCRVGVDSAWTLLDTKLDCSVASVVHCQDKFLAIDYTGEISICSISNAAAGATPTATLLPSLSPPAGLCHRSYLESNGELHIVGAMVSTFHETQSFAYSSAIYKCNLHDRTPEWSRVRDIGDRTLFVSKHFKGGFSGTSVSMYKENKIYMSEPLYGDPYDLVHRLEIVDISTGTSEVKPVHEKTMQGSEALGWIRPNLWKGVPNLSH

SEQ ID NO: 9063 - DNA, 1272 bp, Sorghum bicolor; identical to SEQ ID NO: 9061
  misc_feature: Ceres ANNOT ID no. 6096905
  misc_feature: Encodes the peptide sequence at SEQ ID NO 9064

SEQ ID NO: 9064 - protein, 423 aa, Sorghum bicolor; identical to SEQ ID NO: 9062
  misc_feature: Ceres ANNOT ID no. 6096905
  misc_feature (14)..(415): NCBI GI: 38567950 NCBI Desc: osjnbb0115i21.6 [oryza sativa (japonica cultivar-group)]
  misc_feature (14)..(415): NCBI GI: 116311101 NCBI Desc: osigba0136o08-osigba0153h12.7 [oryza sativa (indica cultivar-group)]
  misc_feature (1)..(415): NCBI GI: 116311099 NCBI Desc: osigba0136o08-osigba0153h12.5 [oryza sativa (indica cultivar-group)]
  misc_feature (14)..(150): NCBI GI: 115439105 NCBI Desc: os01g0673300 [oryza sativa (japonica cultivar-group)]
  misc_feature (20)..(372): NCBI GI: 38345140 NCBI Desc: osjnbb0050n09.7 [oryza sativa (japonica cultivar-group)]

SEQ ID NO: 9065 - DNA, 2604 bp, Sorghum bicolor
  misc_feature: Ceres ANNOT ID no. 6097053
  misc_feature: Encodes the peptide sequence at SEQ ID NO 9066
atggaagaggggaccacggaatccggatcgttctcccgctcttcctccttcggcgggttcgaggagtgggtggcattggtgaggaaacgcaatgggaaggcctcctcgtgcgggcgtctgggtctccgttcatcagccagttcagaagtactagatcttgcagatcctgatagcaatgtcattgaccctgacccttgtgaccaagtgccagaaggaatcctttgggagaggcttgggagggtttccatgatggatattgagtcaagtaacttcagttggagctctctcacctcactgcaccatacaaaacatgctgctacaagtactgatccatctgaggatgacattagcagaagttttgaggtgacagtaaattcaggtggcgttgtttttattgcattattcaaagctattgaaaatgttgatcttccatccaaggaaacagctgcagtcattaaaatagcaccttcaaggatggccacgcagtccgaacgctttgggtacgaacttgctaaatggcttggagtgagaactcctcaaggtagagtcattcatagctcctcgtctgaatggcaacaaatcaaggatgcagttgaaaatgctcgacatggatccatagctgctggtgatgaacttgaggagatgatttgcgccgagatgctagaagcccttgaattgagtcgttgcctatttctgatgaattatgtacatggctcccctctgctagagaatgtaatgccatttgagtcacggcaagctgctgaaaaaactgctgaagcattaggtagggtcttaatcctagacctcgtattgaggaatgaggatagactgcgatgccgtccccttggctggcgtggaaattatgcaaatctacttgttgccaacagggaagcttatgcaaaccttgacacgctagatgatgtttatgattctgctatcattcgatacaagccagagatcatcagaagccctcagaaacagaagcagagaagagctgtttcaattagtggcagtatcggctcagatgtctctgacctcatattggaggactcttatgcttctggtggacatgagttttctagctttaatattgtagccattgattcaggtgtaccacgcaggccacctgccagtaagcgggcaaaagatcaggagagctaccccaaactagtggaattaacactgaacaactttgactattcttccaaacttctatttgaggtgtccttcggaaaacttggcaccccaggacatgaagaatttgatgtatcatctgattatagttataattctcctctctctgagagtgatatggtagcaacagtgcattcattccgaggaggttttcgtagtgctctgagagaccttcagcgattccacattttcctcgtcacactctatcagaagctggatggtctattgaaaattttcttcaatcttatgtataaatgctccaatgaatatgctagggaggatgctggtacttctgattcaccattgtgttcagtggaatcacaggcagattcaaatgatactgatgttccaaggaatctgcgtaagccttcccgaaccttatcacgtgacaatctagacctatcatctccttcctgtcgagagaactttatcagcaaacatttcaaaggaaatggtgatgcctcccgtggccttcggttaacaatgaagctgcgagattttaacaagtatgccaaggtagacagtgaattaagcaaagagatagaacaatggaatgacatgctgaggactgaagtagtaaagttgtgtcaagacaacaatttttacacaggcttttttgaaggtactgataatagcactgctgttgatgcttacgagttgaaggttcgacttgagcacattctcgagaggatatctttgatctctgatgctgcaagcactgagcgtccatcacagatcacagattacctgtatattggtggtgctctagctgctcggtcaacacacacacttaagcatcttggcatcacccatatattgtgcttgtgtgcaaatgaaattggacagtcagaatcacagaagcctgacctttttgagtataggaatttctcgataaaggatgatgacaatgcagacattggtgatctctttcaagatggttctgatttcatcgattacgtggatcacttgcgtggcaaagtacttgtgcattgctttgagggaaaaagtcgtagtgcgactgttgttcttgcctacctgatgctgaggaaaaaatgtactctcctggaagcatggaacatgctgaagaaggtccaccgacgtgcacatcctaatgatgggtttgctaaggtcttgctggatcttgacaagaaactgcacgggaaaatctccatggaatggcaacacaagaggccagcaatgaaggtgtgtcccatctgtggcaagaatgctggtctcagcagcagctcactgaagctccacttgcagaaggcgcacaagaagatatcctctgggagcgtagacagtgcaatgactctggagatacaaaaagcaatagaggcaatcaaagctggctggagcggcagtgacagcccagtgcataaatcacaatcacacatcgaaggattttga

SEQ ID NO: 9066 - protein, 867 aa, Sorghum bicolor
  misc_feature: Ceres ANNOT ID no. 6097053
  misc_feature (70)..(371): Pfam Id: Act-Frag_cataly Pfam Desc: Actin-fragmin kinase, catalytic
  misc_feature (640)..(782): Pfam Id: DSPc Pfam Desc: Dual specificity phosphatase, catalytic domain
  misc_feature (360)..(863): NCBI GI: 47076838 NCBI Desc: propyzamide-htpersensitive 1 [arabidopsis thaliana]
  misc_feature (360)..(863): NCBI GI: 79328583 NCBI Desc: phs1 (propyzamide-hypersensitive 1); phosphoprotein phosphatase/ protein tyrosine/serine/threonine phosphatase [arabidopsis thaliana]
  misc_feature (360)..(863): NCBI GI: 30689114 NCBI Desc: dual specificity protein phosphatase family protein [arabidopsis thaliana]
  misc_feature (613)..(783): NCBI GI: 9294518 NCBI Desc: dual-specificity protein phosphatase-like protein [arabidopsis thaliana]
  misc_feature (613)..(783): NCBI GI: 4150963 NCBI Desc: dsptp1 protein [arabidopsis thaliana]
MEEGTTESGSFSRSSSFGGFEEWVALVRKRNGKASSCGRLGLRSSASSEVLDLADPDSNVIDPDPCDQVPEGILWERLGRVSMMDIESSNFSWSSLTSLHHTKHAATSTDPSEDDISRSFEVTVNSGGVVFIALFKAIENVDLPSKETAAVIKIAPSRMATQSERFGYELAKWLGVRTPQGRVIHSSSSEWQQIKDAVENARHGSIAAGDELEEMICAEMLEALELSRCLFLMNYVHGSPLLENVMPFESRQAAEKTAEALGRVLILDLVLRNEDRLRCRPLGWRGNYANLLVANREAYANLDTLDDVYDSAIIRYKPEIIRSPQKQKQRRAVSISGSIGSDVSDLILEDSYASGGHEFSSFNIVAIDSGVPRRPPASKRAKDQESYPKLVELTLNNFDYSSKLLFEVSFGKLGTPGHEEFDVSSDYSYNSPLSESDMVATVHSFRGGFRSALRDLQRFHIFLVTLYQKLDGLLKIFFNLMYKCSNEYAREDAGTSDSPLCSVESQADSNDTDVPRNLRKPSRTLSRDNLDLSSPSCRENFISKHFKGNGDASRGLRLTMKLRDFNKYAKVDSELSKEIEQWNDMLRTEVVKLCQDNNFYTGFFEGTDNSTAVDAYELKVRLEHILERISLISDAASTERPSQITDYLYIGGALAARSTHTLKHLGITHILCLCANEIGQSESQKPDLFEYRNFSIKDDDNADIGDLFQDGSDFIDYVDHLRGKVLVHCFEGKSRSATVVLAYLMLRKKCTLLEAWNMLKKVHRRAHPNDGFAKVLLDLDKKLHGKISMEWQHKRPAMKVCPICGKNAGLSSSSLKLHLQKAHKKISSGSVDSAMTLEIQKAIEAIKAGWSGSDSPVHKSQSHIEGF

SEQ ID NO: 9067 - DNA, 2172 bp, Sorghum bicolor
  misc_feature: Ceres ANNOT ID no. 6097086
  misc_feature: Encodes the peptide sequence at SEQ ID NO 9068
atggcggccaaggggaggacggagctggacgtgggcgctgacggcgtggccgtaatcaccatccacaatccgcctgtcaactcgctctccatcgacgtcctatatagcttaaaggaaagctatgaagaagcatttcggagaagcgatgttaaagcgattgttgttacagggaaaggagggaaattttctggaggatttgatattagttcctttggtggtcttcagggaggccaaaaaatgcaaccaaaggttggttacatagcaatagatattctcacagatactgtagaagctgctacaaagccatcagtggcagcaattgatggtcttgctcttggtgggggtttagaagttgccatggcatgccatgcacggattgcaactccaacagctcaattaggtcttccagaacttcaattaggaattattccaggatttggaggaacacagcgactcccacgactagttggactgacaaaatctttggaaatgatgctgttatctaagccaatcaagggtggtgaggcacaccaactgggtctggttgatgccttggtttctcctaatgatttggtgaatactgctcgtcaatgggctttggatatatatgaatgtaggaggccctggatcaaaagcctttataagactgacaagctagaacctcttggggaggctagggaaattctgaagtttgcaagagctcaagctcaaaagcaggcagctaatctacatcacccacttgtttgtattgatgtcattgaagaaggtatagttgcaggaccacgagctggactctggaaggaagcaacttctttccaggaactgcttttctcagatacttgtaaaagcttagttcatgtgttcttttctcagcgggcaacgtctaagattccaggtgctacagacttggggttgatgcctaggaaaataactaaagttgccattttaggtggtggacttatgggttcaggaattgcgactgcaatgatattaagtaactatcctgtggtacttaaagaagtaaatgagaaattcctaaatgctggaatcgacagaatcaaagccaatttgcagagtcgagtaaggaaagggaaaatgaccgaagagagatatgagaaggctatgtctctcgtcacaggtgtccttgattatgaacgtttcaaagatgtggacctcgttatagaggcagttattgagaatgtgaagttgaagcagcaaatatttgcggacttggagaagtactgtccttcacattgcgtccttgctactaacacatctacaattgatcttaatctgattggggagaaaacaaagtctcaagatcgtattgttggtgcacacttctttagtcctgcacatgtaatgccacttctggaaatagttcgtactcagcacacttcaccacaagttgttgttgacttgctggacgttgggaagaagattaagaagacaccaatagtggttgggaactgtactggctttgcagttaacaggatgttctttccatacactcaatcagcactcttttttgttgatcttggtatggatgtttataagattgatcgtgcctgtacaaaatttggaatgcccatgggtcctttcagactggcagatctggttggttttggtgtggctgtagccactggcatgcaatacctggaaaacttctcagagagggtctacaaatcaatgctacttcctctgatgatggaggacaatagggcaggtgaagccacccaaaaaggattttacaagtatgagggcaagaggaaggccactcctgatcctgaaattatgaaatatattgaaaaatctaggagcatggcaggagttgcaccagatcctgagttgctgaagctaagtgagaaagacatagttgagatggtgtttttcccggtgataaatgaagcctgccgagtccttgatgagggtattgcagtgaaggcttctgatctagacattgcttcaatcttcggcatggggttcccaccttataggggcggtgtcatatactgggcagattccatcggtgcaaattacatccatggaaagttggaggagtggacaaagcggtatggtggcttcttcaagccttgctcttacctcgctgagagagctgcgaaagggattcctctgagtgcaccggcaaagaaagctcaggctcggctataa

SEQ ID NO: 9068 - protein, 723 aa, Sorghum bicolor
  misc_feature: Ceres ANNOT ID no. 6097086
  misc_feature (312)..(491): Pfam Id: 3HCDH_N Pfam Desc: 3-hydroxyacyl-CoA dehydrogenase, NAD binding domain
  misc_feature (17)..(187): Pfam Id: ECH Pfam Desc: Enoyl-CoA hydratase/isomerase family
  misc_feature (493)..(586): Pfam Id: 3HCDH Pfam Desc: 3-hydroxyacyl-CoA dehydrogenase, C-terminal domain
  misc_feature (1)..(723): NCBI GI: 115462175 NCBI Desc: os05g0155000 [oryza sativa (japonica cultivar-group)]
  misc_feature (4)..(723): NCBI GI: 6728993 NCBI Desc: fatty acid multifunctional protein (atmfp2) [arabidopsis thaliana]
  misc_feature (4)..(723): NCBI GI: 2832898 NCBI Desc: tetrafunctional protein of glyoxysomal fatty acid beta-oxidation [brassica napus]
  misc_feature (3)..(723): NCBI GI: 551428 NCBI Desc: tetrafunctional protein [cucumis sativus]
  misc_feature (91)..(723): NCBI GI: 551444 NCBI Desc: protein mfp-b [cucumis sativus]
MAAKGRTELDVGADGVAVITIHNPPVNSLSIDVLYSLKESYEEAFRRSDVKAIVVTGKGGKFSGGFDISSFGGLQGGQKMQPKVGYIAIDILTDTVEAATKPSVAAIDGLALGGGLEVAMACHARIATPTAQLGLPELQLGIIPGFGGTQRLPRLVGLTKSLEMMLLSKPIKGGEAHQLGLVDALVSPNDLVNTARQWALDIYECRRPWIKSLYKTDKLEPLGEAREILKFARAQAQKQAANLHHPLVCIDVIEEGIVAGPRAGLWKEATSFQELLFSDTCKSLVHVFFSQRATSKIPGATDLGLMPRKITKVAILGGGLMGSGIATAMILSNYPVVLKEVNEKFLNAGIDRIKANLQSRVRKGKMTEERYEKAMSLVTGVLDYERFKDVDLVIEAVIENVKLKQQIFADLEKYCPSHCVLATNTSTIDLNLIGEKTKSQDRIVGAHFFSPAHVMPLLEIVRTQHTSPQVVVDLLDVGKKIKKTPIVVGNCTGFAVNRMFFPYTQSALFFVDLGMDVYKIDRACTKFGMPMGPFRLADLVGFGVAVATGMQYLENFSERVYKSMLLPLMMEDNRAGEATQKGFYKYEGKRKATPDPEIMKYIEKSRSMAGVAPDPELLKLSEKDIVEMVFFPVINEACRVLDEGIAVKASDLDIASIFGMGFPPYRGGVIYWADSIGANYIHGKLEEWTKRYGGFFKPCSYLAERAAKGIPLSAPAKKAQARL

SEQ ID NO: 9069 - DNA, 981 bp, Sorghum bicolor
  misc_feature: Ceres ANNOT ID no. 6097087
  misc_feature: Encodes the peptide sequence at SEQ ID NO 9070
atgatgatgacgcgggcgtcgatgggggcgatggatgcggcggcggtggacgaggtggtgcgtcgcctcgtcgagggcggccgcgggggccggcaggtgcagctgtccgaggccgagatccgccagctctgcgtcgaggccaaacaggtgctgctgtcgcagccaaacctcctgcgcatccacgcgcccgtcaagatctgcggtgatatccatggacagtttgttgatctcttgaggcttttcgatttgggtggttatcctccaacttcaacttatattttccttggagactatgtggatagaggcaaacaaagcttagaaaccatatgtctgcttctggcatacaagttgaagtaccctgataatatataccttttaaggggaaaccatgaagatgccaaaattaacagagtttatggtttctatgatgaatgtaaaaggagatttaatgttcgactctggaagatattctgtgattgcttcaactgcttgcctatgtcagcacttattgatgacaaagtattatgcatgcatggtggcctctcaccagagttgaatagcttggatcaaataaaagatattgagaggcctactgaaattcctgactatggtcttctgtgcgatctcctttggtctgatcctagtcatgatacagaaggatggggggagagtgatagaggtgtttcttgcacttttggtgcagataagcttgtcgaatttttggataagaatgatctcgaccttgtgtgccgagctcatcaggtggtagaagatggctacgaattctttgcagaaagaagactagtgacgatattttcagctccaaactactgtggcgaatttgataatgcaggtgctctattgagcatagatgaaagcttgatgtgttcttttcagatcttgaaaccaaatgaaacaggtggaccacattcaaggaaacctcttccaagcaaggtaattatcaagctccaaatgatttaa

SEQ ID NO: 9070 - protein, 326 aa, Sorghum bicolor
  misc_feature: Ceres ANNOT ID no. 6097087
  misc_feature (62)..(257): Pfam Id: Metallophos Pfam Desc: Calcineurin-like phosphoesterase
  misc_feature (1)..(318): NCBI GI: 115436440 NCBI Desc: os01g0349400 [oryza sativa (japonica cultivar-group)]
  misc_feature (2)..(313): NCBI GI: 29290586 NCBI Desc: serine threonine protein phosphatase [phaseolus acutifolius]
  misc_feature (11)..(313): NCBI GI: 667049 NCBI Desc: protein phosphatase pp1 [phaseolus vulgaris]
  misc_feature (2)..(313): NCBI GI: 38503411 NCBI Desc: serine/threonine protein phosphatase pp1 isozyme 8
  misc_feature (2)..(316): NCBI GI: 3153205 NCBI Desc: serine/threonine protein phosphatase type one [arabidopsis thaliana]
  misc_feature (11)..(313): SWISSPROT Homolog: EC 3.1.3.16 Serine/threonine-protein phosphatase PP1
MMMTRASMGAMDAAAVDEVVRRLVEGGRGGRQVQLSEAEIRQLCVEAKQVLLSQPNLLRIHAPVKICGDIHGQFVDLLRLFDLGGYPPTSTYIFLGDYVDRGKQSLETICLLLAYKLKYPDNIYLLRGNHEDAKINRVYGFYDECKRRFNVRLWKIFCDCFNCLPMSALIDDKVLCMHGGLSPELNSLDQIKDIERPTEIPDYGLLCDLLWSDPSHDTEGWGESDRGVSCTFGADKLVEFLDKNDLDLVCRAHQVVEDGYEFFAERRLVTIFSAPNYCGEFDNAGALLSIDESLMCSFQILKPNETGGPHSRKPLPSKVIIKLQMI

SEQ ID NO: 9071 - DNA, 2433 bp, Sorghum bicolor
  misc_feature: Ceres ANNOT ID no. 6097100
  misc_feature: Encodes the peptide sequence at SEQ ID NO 9072
atgcggcgcaagctccccggcgacgcgccgctgtcggcggcgggggccggtcatgcgtcgtccgcatccgcgccgtccgaggcggacctcgcgcagctctccgccgccatcgcggccggggaggacctgggccccttcgtgcgccgggccttcgcgtgcggccgccccgagccgctgctcgcctcgctccgcggcgcggcgcgggaccgcgaggccgagatcgaggagctctgccgcgcgcacttccacgatttcatccgcgctgtcgacgacctccgttccctcctggccgacgccgacgcgctcaagggctccctctccgcgtcccactccgcgcttctctcatcggcggccccgctgctcgcctcgcttgagtccttcctcgtcgcgcgctcgctcgcggggaacctctcctccgcgctagcctcctcccgccggtgcgtacggctgctcgcgctcgcggcgcgggcgaacgcgcacctccaggccggcaaccatgggctctatctcgccctgcgcgccgtcgacgccatcgaccgtgatctcgcctcgggacccgagccgctgccgctacccacgctccgccgcatgctgctcagcgtcgtccctgcggtgcgcgcgcatgccgagcgcgagatctccagggagttctccgactggatggttagcatccgcgctgcttccaggcacctcggccaggtggccatcggccgctcggctgccgccaggcagcgccaggaagagctccgctccaagcaccgcccgctggaggagtgcatcaccctggatgacgatggagttggtgaccttgatgattttgcggcagccgccgcaacagctgacgcagcagatggtgccgctgcagcctcttttgaccttacaccgctctatcgagcgatgcatatacaccagacgctggagctgggtgagcggttcaagaagtactacctggaaaacaggaagctgcagctgacatcagactttgatgtcattgcggcgacgccattcctcgagtcccaccaggtgtttttctcgcagattgctgggttctttattgttgaggaccgggtatttagaacaggtggtgggctcacatctcggccagatgtagatgcactttgggatgccgctgtggggaagatggtctctgtgatggaagacaacttctccaggatgcagacagcaaaccacttgcttctcatcactgattatgctgctttgctttctgccacaatgcggcggtatggttatccagtagggatgttgctggatgtgctggctaagcacagagacaagtaccatgatttgctgcttgcggattgccgtaggcaggtggcagaggcactggctgcagataagtttgatcagatgctcatgagaaaggagtatgaatactcaatgaatgtccttgcatttggaattcagagctcagatatcaccccagctttcccatatgttgcaccattttcatgcactgtcccagacatttgccgtattgttcgttcattcattgaagattctgtgagcttcatggcacacgggggtggtggggatacctatgcagcagtgaagaagtaccttggtcggatcctctctgaggtggtggatgcttcgattcaaaagcttgtggattcaggcagtggtctaagtgtgtcccaggcaatgcaggttgctgctaacatgtccgtgatggagcgggcatgcgagttcttcacacgccatgctgcacaactgtgtggtgtgccgctgcgtgctgtggagcgtggtcggcgggacttcccacttcgcaggtcacgtgatgctgcggaggcactcctgctgcggcttctgcgcgccaaggctgacgagttcatgcggcaatctgatggtgtcagctggatggctgatgaccctcctcctggtggcaatgagtatgcgaacgaggtcatcatctaccttgagacgctcacatcaactgcacagcagatccttccccttcccgtgctccgccgtgtacttgtggcagtgcttgcccacatctctgaaaggatcatcgagctcttcttgaacgattcagtaaagcggttcaatgccaatgcagtcactggtatagatactgatctcaaaatgtttgagacgtttgcagagggcatgtctagcctgttcgtggactcaggtcaagaatctgcaaaaaatgaaatgaaggctgcactagtggaagcaaggcagctagtgaatcttcttttgagcaatagtccagagaatttcctaaatccagtgattcgtgaaaagaactataacaagctagattatagaaaggttgcaatcatctcagagaagtttagagatacctcagagagttacttctcaacatttgggacaaggggtgccaggcagaacccaaagaagaaatctctggataccctgatcaagaggctcagagaagccagttag

SEQ ID NO: 9072 - protein, 810 aa, Sorghum bicolor
  misc_feature: Ceres ANNOT ID no. 6097100
  misc_feature (464)..(811): Pfam Id: Sec15 Pfam Desc: Exocyst complex subunit Sec15-like
  misc_feature (1)..(810): NCBI GI: 21104839 NCBI Desc: sec15 (s. cerevisiae)-like protein [oryza sativa (japonica cultivar-group)]
  misc_feature (422)..(810): NCBI GI: 7268995 NCBI Desc: at4g02350 [arabidopsis thaliana]
  misc_feature (30)..(808): NCBI GI: 31218569 NCBI Desc: ensangp00000011350 [anopheles gambiae]
  misc_feature (37)..(807): NCBI GI: 21355951 NCBI Desc: cg7034-pa [drosophila melanogaster]
  misc_feature (2)..(807): NCBI GI: 7513970 NCBI Desc: exocyst complex protein sec15 - rat
MRRKLPGDAPLSAAGAGHASSASAPSEADLAQLSAAIAAGEDLGPFVRRAFACGRPEPLLASLRGAARDREAEIEELCRAHFHDFIRAVDDLRSLLADADALKGSLSASHSALLSSAAPLLASLESFLVARSLAGNLSSALASSRRCVRLLALAARANAHLQAGNHGLYLALRAVDAIDRDLASGPEPLPLPTLRRMLLSVVPAVRAHAEREISREFSDWMVSIRAASRHLGQVAIGRSAAARQRQEELRSKHRPLEECITLDDDGVGDLDDFAAAAATADAADGAAAASFDLTPLYRAMHIHQTLELGERFKKYYLENRKLQLTSDFDVIAATPFLESHQVFFSQIAGFFIVEDRVFRTGGGLTSRPDVDALWDAAVGKMVSVMEDNFSRMQTANHLLLITDYAALLSATMRRYGYPVGMLLDVLAKHRDKYHDLLLADCRRQVAEALAADKFDQMLMRKEYEYSMNVLAFGIQSSDITPAFPYVAPFSCTVPDICRIVRSFIEDSVSFMAHGGGGDTYAAVKKYLGRILSEVVDASIQKLVDSGSGLSVSQAMQVAANMSVMERACEFFTRHAAQLCGVPLRAVERGRRDFPLRRSRDAAEALLLRLLRAKADEFMRQSDGVSWMADDPPPGGNEYANEVIIYLETLTSTAQQILPLPVLRRVLVAVLAHISERIIELFLNDSVKRFNANAVTGIDTDLKMFETFAEGMSSLFVDSGQESAKNEMKAALVEARQLVNLLLSNSPENFLNPVIREKNYNKLDYRKVAIISEKFRDTSESYFSTFGTRGARQNPKKKSLDTLIKRLREAS

SEQ ID NO: 9073 - DNA, 1977 bp, Sorghum bicolor
  misc_feature: Ceres ANNOT ID no. 6097104
  misc_feature: Encodes the peptide sequence at SEQ ID NO 9074
atgtcggcgaggctaagggtggaggagctccgcgcggcgctgctgagccgcggcctcgatgtctccggcaccaagaacgctctcgtgcggaggctggacgccgcaatctgcaaggacgagaagatcgcggttgctgctgcggcaaccgaggtggcagatgggtatggcgtagccgtagatggtgtgctcgtggatggcaaagggaacggcaggaacaacaagaggaaaaggtccggggatggggatgaagaggggaacggcgatacgtctatagacctggcaaaactagagggcatgagctatcgcgagctgcagggattggctaaggcacggggactcgcagcaaatgggggcaagaaggatgttatccagaggttgctctcagcgactgttgatcctgttgcagttgctgatggtggtcctcagggcgaaaaggaagtcataaaaggtggtgatgaggaggctgaggtgaaaaaggagaagattgttacagccacgaagaagggagctgcagtgctggatcaacacattcctgatcacataaaagtgaactatcatgtcttgcaagtgggtgatgaaatctatgatgccaccttgaaccagactaatgttggagacaacaacaataagttctatatccttcaagttttagaatctgatgctggtggaagcttcatggtttacaatagatggggaagagtaggggcacgaggtcaagataaactacatggtccctttttaacacgagaccaagcaatatatgaatttgaggggaagttccatgacaaaactaataatcattggtctgatcgcaagaacttcaaatgttatgcaaagaaatacacttggcttgaaatggattatggtgaaactaataaagaaatagagaaaggttccattactgatcagataaaagagacaaaacttgaaactagaattgcgcagttcatatccctgatctgcaatattagcatgatgaagcaacaaatggtggaaataggttataatgctgacaagcttccccttggaaagctaagcaaatctacaatacttcagggttatgatgttttgaaaaggatatccaatgttatttcaaaggcagacaggagacagcttgagcaattgactggggaattctacaccgtgattcctcatgactttggtttcagaaagatgggtgaatttattatcgacactcctcagaaactaaaagctaagctggagatggttgaagcccttggtgagattgaaattgcaactaaacttttggaggatgattccagtgaccaggatgatccgctatatgctcgatacaagcaacttcattgtgatctcgcacctcttgaagctgattcggatgagtactctatgataaaaacatatttgaggaatacacatggaaaaacacactctggttatacggtggacatagtgcaaatatttaatgtttcaaggcatggtgaaacagagcgatttcagaaatttgctagtacaagaaataggatgcttttgtggcatggttctcggttgagcaactggactgggatcctttctcagggtctgcgaatcgctcctcctgaagcacctgttagtggttacatgtttggcaagggtgtttactttgctgacatgttttcaaagagtgcaaactattgctgcgcttcagaagcatgtagatctggagtactgcttttatgtgaggttgcattgggcgatatgaatgagctactaaatgcagattacgatgctaataacctgcccaagggaaaattaagcacgaagggagttggtcaaacagcacctgacatggtcgagtctaagatcactgacgatggtgtggttgttccccttggcaaacctaaacaggaaccttccaaaaggggtggcttgcgttacaatgagtacattgtgtacaacgtagatcagataagaatgcggtatgtcctgcttgttaacttcaacttcaagagacggtag

SEQ ID NO: 9074 - protein, 658 aa, Sorghum bicolor
  misc_feature: Ceres ANNOT ID no. 6097104
  misc_feature (441)..(653): Pfam Id: PARP Pfam Desc: Poly(ADP-ribose) polymerase catalytic domain
  misc_feature (306)..(439): Pfam Id: PARP_reg Pfam Desc: Poly(ADP-ribose) polymerase, regulatory domain
  misc_feature (190)..(275): Pfam Id: WGR Pfam Desc: WGR domain
  misc_feature (2)..(36): Pfam Id: SAP Pfam Desc: SAP domain
  misc_feature (96)..(130): Pfam Id: SAP Pfam Desc: SAP domain
  misc_feature (1)..(658): NCBI GI: 2959360 NCBI Desc: poly(adp-ribose) polymerase [zea mays]
  misc_feature (1)..(658): NCBI GI: 118573124 NCBI Desc: poly [adp-ribose] polymerase 2-a (parp-2-a) (adprt 2-a) (nad(+) adp-ribosyltransferase 2-a) (poly[adp-ribose] synthetase 2-a)
  misc_feature (1)..(627): NCBI GI: 115436452 NCBI Desc: os01g0351200 [oryza sativa (japonica cultivar-group)]
  misc_feature (60)..(656): NCBI GI: 853722 NCBI Desc: parp protein [arabidopsis thaliana]
  misc_feature (60)..(656): NCBI GI: 7268999 NCBI Desc: nad+ adp-ribosyltransferase [arabidopsis thaliana]
  misc_feature (1)..(658): SWISSPROT Homolog: EC 2.4.2.30 Poly [ADP-ribose] polymerase 2
  misc_feature: Useful for making plants with altered alkaloid content
  misc_feature: GREAT-hit functional homolog of the protein sequence given in SEQ ID NO 13326
  misc_feature: Useful for making plants with modulated abiotic stress sensitivity
  misc_feature: Functional homolog of the protein sequence given in SEQ ID NO 14037
  misc_feature: Useful for making plants with altered alkaloid content
  misc_feature: Functional homolog of the protein sequence given in SEQ ID NO 13326
MSARLRVEELRAALLSRGLDVSGTKNALVRRLDAAICKDEKIAVAAAATEVADGYGVAVDGVLVDGKGNGRNNKRKRSGDGDEEGNGDTSIDLAKLEGMSYRELQGLAKARGLAANGGKKDVIQRLLSATVDPVAVADGGPQGEKEVIKGGDEEAEVKKEKIVTATKKGAAVLDQHIPDHIKVNYHVLQVGDEIYDATLNQTNVGDNNNKFYILQVLESDAGGSFMVYNRWGRVGARGQDKLHGPFLTRDQAIYEFEGKFHDKTNNHWSDRKNFKCYAKKYTWLEMDYGETNKEIEKGSITDQIKETKLETRIAQFISLICNISMMKQQMVEIGYNADKLPLGKLSKSTILQGYDVLKRISNVISKADRRQLEQLTGEFYTVIPHDFGFRKMGEFIIDTPQKLKAKLEMVEALGEIEIATKLLEDDSSDQDDPLYARYKQLHCDLAPLEADSDEYSMIKTYLRNTHGKTHSGYTVDIVQIFNVSRHGETERFQKFASTRNRMLLWHGSRLSNWTGILSQGLRIAPPEAPVSGYMFGKGVYFADMFSKSANYCCASEACRSGVLLLCEVALGDMNELLNADYDANNLPKGKLSTKGVGQTAPDMVESKITDDGVVVPLGKPKQEPSKRGGLRYNEYIVYNVDQIRMRYVLLVNFNFKRR

SEQ ID NO: 9075 - DNA, 987 bp, Sorghum bicolor
  misc_feature: Ceres ANNOT ID no. 6097657
  misc_feature: Encodes the peptide sequence at SEQ ID NO 9076
atggacagggcaacatcgaacgtcggctgtggcgccgtcgccctcctcgtcctcgtgttggtcagcttcgcgcgcccgtgccactcctccctctaccgcccgccaccgcccgtcatggtctaccacgccggcgaggtgctcgacggcgttgtgccggtctctgtcctctactatggcgccttctcaccacaccagaaggccatcatctccgacttcctgctctccctctccccgcgcggccgccagccgcagcaccataggttcggggcgccagggcccgcgcctgcgccgtcggtggcgcggtggtgggagactgtggaccggtacgtgcgcaaggccggccgagggcccccacgggtactgctggccagccaggtgcacgacgagtcgtgctcgctggggaagactctgtccagggtccaggtcgagcggctggcgtcgcggctcggcgtggcgccgaggggcgtggccgtcgtgctcacggccgccgacgtcgccgtcgaggggcaatgcggcagcgcgtgcggaacgcacggggcctccgcgtcggggggagcgacgcacgtgtgggtgggcgacgccgccgtgcagtgcccagggcggtgcacgtggccgttccaccccgcggagggcttcgcctacggtgccaggcatgtgcccgggcgcggccgcggcgagacgctgcgcgcgcccaacggcgacgtcggtatcgacggcatgctgatcaacctcgcggcgctgctggccgccgcggtcaccaacccatatgggcacggatacttccagggcgaccccggcgcacccgtagaggtggcggctgcgtgcccgggcgtctacggccgcggcgcgtacccggggtaccccggcgcggtcaggctcgacacggccaccggcgctgggttcaacgtggtcggccggaacggcaggaagtatctcgtgccagcgctggtcgatcctgacaccaattcttgtatcatcatgacctaa

SEQ ID NO: 9076 - protein, 328 aa, Sorghum bicolor
  misc_feature: Ceres ANNOT ID no. 6097657
  misc_feature (39)..(328): Pfam Id: Phi_1 Pfam Desc: Phosphate-induced protein 1 conserved region
  misc_feature (12)..(324): NCBI GI: 115448781 NCBI Desc: os02g0756800 [oryza sativa (japonica cultivar-group)]
  misc_feature (42)..(324): NCBI GI: 115467136 NCBI Desc: os06g0220000 [oryza sativa (japonica cultivar-group)]
  misc_feature (94)..(324): NCBI GI: 31074969 NCBI Desc: erg-1 [solanum tuberosum]
  misc_feature (15)..(324): NCBI GI: 3759184 NCBI Desc: phi-1 [nicotiana tabacum]
  misc_feature (41)..(324): NCBI GI: 115467140 NCBI Desc: os06g0220300 [oryza sativa (japonica cultivar-group)]
MDRATSNVGCGAVALLVLVLVSFARPCHSSLYRPPPPVMVYHAGEVLDGVVPVSVLYYGAFSPHQKAIISDFLLSLSPRGRQPQHHRFGAPGPAPAPSVARWWETVDRYVRKAGRGPPRVLLASQVHDESCSLGKTLSRVQVERLASRLGVAPRGVAVVLTAADVAVEGQCGSACGTHGASASGGATHVWVGDAAVQCPGRCTWPFHPAEGFAYGARHVPGRGRGETLRAPNGDVGIDGMLINLAALLAAAVTNPYGHGYFQGDPGAPVEVAAACPGVYGRGAYPGYPGAVRLDTATGAGFNVVGRNGRKYLVPALVDPDTNSCIIMT

SEQ ID NO: 9077 - DNA, 1911 bp, Sorghum bicolor
  misc_feature: Ceres ANNOT ID no. 6097670
  misc_feature: Encodes the peptide sequence at SEQ ID NO 9078
atgacgctcagcctccgccgcaagcagctcgtgctggctctaatcgcgctttctgcctctgatccagatgttatcgtgcggatgctgcacctgagccagcagcagttgtcgaacgccggcgaggggcagggggaggacgatgcgtacaagatcctggtgatggatcagccctgtatctccgtcctctcgccggtgctcaagctcggcgacctccgccaccacggtgtcaccctcaccctcaacatcgaccgtccgcggcaggcggtgcccgatgcgccggccgtctacttcgtccggcccacccccggaaacgtggaccgcctagcggccgacgccgccgcggggctatacgggtctttccatgtcaacttctccacctccgtcccgcgatcgctgcttgagcgcctcgcaaccgcctgcgccgccgctccgcccgcgtgtgcgggccgcgtggcgcgcgttgctgaccagtacatcgacttcgtctgcctcgaggatggcctcttctcgctagcgcagccccgggcctacgtcgcactaaacgaccccgcggctgccgacactgacatcactgccctcgtcgacgccgtcgcgctgggtctcttctgcgtcgtcgtcacgcttggtgttgtgcctgtcatcaggtgtgcgcgcggtgggccagcggagatggtggccggcgccctagacgcccggctccgcgatcacctactcgccaagcccaacctcttcacggaagctgcatctgccgccgtcgcgtcattccagcgccctgtgctgtgcctcttcgacaggaatttcgagctgtctgttggggtgcagcacgactggagctaccgcccgttggtgcatgatgtgcttggcttgaagcagaacattctgaagttgccggcagagaagtacgaattggacgactctgacaaattctgggtggcaaacagctggtctccattccccaaagttgctgaggaaatcgaggcgcagctggccaagtacaagcaggatgtggatgaagtgaaccatcgcactggtggtggcaaggttggggctgagtttgatggtactgatctgattggcaacactaagcatctcatgaatgcggtgaactcactaccagaactgacagagcggaagaagatgattgataagcacaccaatattgcaacatcattgcttgggcatatcaaggagaggtctctggatggatactgcgactgtgagaatgatatgcttgtgaatggtactgttgaccggaatacactgctgagtctcctcagagggaagggcactaaggaagataagcttcggctagctgtgacctacctgctgtccttcgagacaccaccatcatctgaactggagcaggttgaggccactctgcgggaatccgaagttgacatgtgtgcatttcagtatgtaaagaggataaaggcattgaatacccaatttgcagctgcttcaggcacagcaactaagagcaacattgtcgattgggcagagaagctgtatgggcagtccattagcgctgtgactgcaggtgtaaagaatctcttgtcagatgggaggcagctggccttgacaagaacagttgaagctctgatggaagggaaaccaaacccagaggtggatgactaccttttgtttgatccacgggctcctaggtcaggaactggtgggcagtttaaaggacccttcagagaagctgttgttttcatgatcggtggtggaaattacattgagtacaagagcttgatggagctagtgcaacactcacagccttccaagcatgttatttatggtgcaacagaaattctgagtgggtccgagtttattcaccaactggcagaattggggcagaaagccggattgggtggtggcagcagcaacataccactaggttcagcacaatag

SEQ ID NO: 9078 - protein, 636 aa, Sorghum bicolor
  misc_feature: Ceres ANNOT ID no. 6097670
  misc_feature (49)..(614): Pfam Id: Sec1 Pfam Desc: Sec1 family
  misc_feature (1)..(631): NCBI GI: 75149556 NCBI Desc: sec1-family transport protein sly1
  misc_feature (239)..(618): NCBI GI: 45552183 NCBI Desc: cg3539-pc, isoform c [drosophila melanogaster]
  misc_feature (299)..(620): NCBI GI: 33469966 NCBI Desc: vesicle transport-related protein isoform a [homo sapiens]
  misc_feature (299)..(620): NCBI GI: 17389391 NCBI Desc: vesicle transport-related protein, isoform a [homo sapiens]
  misc_feature (299)..(620): NCBI GI: 34327968 NCBI Desc: kiaa0917 protein [homo sapiens]
MTLSLRRKQLVLALIALSASDPDVIVRMLHLSQQQLSNAGEGQGEDDAYKILVMDQPCISVLSPVLKLGDLRHHGVTLTLNIDRPRQAVPDAPAVYFVRPTPGNVDRLAADAAAGLYGSFHVNFSTSVPRSLLERLATACAAAPPACAGRVARVADQYIDFVCLEDGLFSLAQPRAYVALNDPAAADTDITALVDAVALGLFCVVVTLGVVPVIRCARGGPAEMVAGALDARLRDHLLAKPNLFTEAASAAVASFQRPVLCLFDRNFELSVGVQHDWSYRPLVHDVLGLKQNILKLPAEKYELDDSDKFWVANSWSPFPKVAEEIEAQLAKYKQDVDEVNHRTGGGKVGAEFDGTDLIGNTKHLMNAVNSLPELTERKKMIDKHTNIATSLLGHIKERSLDGYCDCENDMLVNGTVDRNTLLSLLRGKGTKEDKLRLAVTYLLSFETPPSSELEQVEATLRESEVDMCAFQYVKRIKALNTQFAAASGTATKSNIVDWAEKLYGQSISAVTAGVKNLLSDGRQLALTRTVEALMEGKPNPEVDDYLLFDPRAPRSGTGGQFKGPFREAVVFMIGGGNYIEYKSLMELVQHSQPSKHVIYGATEILSGSEFIHQLAELGQKAGLGGGSSNIPLGSAQ

SEQ ID NO: 9079 - DNA, 975 bp, Sorghum bicolor
  misc_feature: Ceres ANNOT ID no. 6097681
  misc_feature: Encodes the peptide sequence at SEQ ID NO 9080
atggcattgctggatgccgtggtgcatccgtcccaaccccaaggccatttaggctacgggcacagggactactgctcctacggggctccttttttttggtcagatgcgactggccatggcgataaccatgtgccgtacgccggcgactgggaccccttcctgctcgcttccctcgtgcacaatgccgaggagtcggggaaggtggtgggctcctccaaggcctcgccggagcgcgaagtcgcgctgtcgtcggccattgagccgccgtcatcgccggtcatgacgacgacagccaagagaaagaggagacgggctaataaggtcgtcaagaacgaggaggagatggagagccagcggatgactcacattgccgttgagcggaaccgccgccggcagatgaacgagtacctcgccgtgctccgctccctcatgccaccgtcctatgggcaaaggggcgatcaagcctctattgttgggggagcaatcaactacgtgagggagcttgagcagctgctccaatcccttgaggtgcataggagcctacaggagcacagcagcaacagcaaatcgtgcaatccctttgctgccttcttcagctttccacagtactcctccgctacctcttcttcccacagcggcgccggcaaccacaccatcaaggtgtccgccgggagctctcggtcaccgtcgtcgtcagtcgtcaccgccgacattgaggcaagcatggtggatggacacgccagcgtcaaggttcaggccccgcggcggccaaggcagttgctgaggctggcggccggcctccagcagctcggcctcacgaccttgcatctcaacgtcagcacggctggtaccatggtcatgtacgccttcagcctcaaggttgaggttgattgcaagctcggctctgtggaggagattgcagctgcagtgcatgagatcctggggaggattcaggatgaggctggctttagctag

SEQ ID NO: 9080 - protein, 324 aa, Sorghum bicolor
  misc_feature: Ceres ANNOT ID no. 6097681
  misc_feature (118)..(169): Pfam Id: HLH Pfam Desc: Helix-loop-helix DNA-binding domain
  misc_feature (74)..(179): NCBI GI: 116311027 NCBI Desc: osigba0142i02-osigba0101b20.1 [oryza sativa (indica cultivar-group)]
  misc_feature (89)..(318): NCBI GI: 124359713 NCBI Desc: helix-loop-helix dna-binding [medicago truncatula]
  misc_feature (4)..(320): NCBI GI: 18395124 NCBI Desc: basic helix-loop-helix (bhlh) family protein [arabidopsis thaliana]
  misc_feature (99)..(324): NCBI GI: 140063709 NCBI Desc: helix-loop-helix dna-binding [medicago truncatula]
  misc_feature (4)..(294): NCBI GI: 28558779 NCBI Desc: helix-loop-helix-like protein [cucumis melo]
  misc_feature: The plant produces a reduced number of seeds.
  misc_feature: The sequence is a functional homolog of SEQ ID NO 1500 in the 10/374,780US patent application
  misc_feature: The sequence is a functional homolog of SEQ ID NO 1501 in the 10/374,780US patent application
  misc_feature: The sequence is a functional homolog of SEQ ID NO 1503 in the 10/374,780US patent application
  misc_feature: The sequence is a functional homolog of SEQ ID NO 1504 in the 10/374,780US patent application
  misc_feature: The sequence is a functional homolog of SEQ ID NO 226 in the 10/714,887US patent application
  misc_feature: The sequence is a functional homolog of SEQ ID NO 226 in the 11/435,388US patent application
  misc_feature: The sequence is a functional homolog of SEQ ID NO 24 in the 10/225,068US patent application
  misc_feature: The sequence is a functional homolog of SEQ ID NO 486 in the 10/666,642US patent application
  misc_feature: The sequence is a functional homolog of SEQ ID NO 52 in the 10/374,780US patent application
  misc_feature: The sequence is a functional homolog of SEQ ID NO 94 in the 10/225,068US patent application
  misc_feature: Useful for biocontainment applications
  misc_feature: Useful for making plants with modulated growth and phenotype characteristics
  misc_feature: Functional homolog of the protein sequence given in SEQ ID NO 13213
  misc_feature: The sequence is a functional homolog of SEQ ID NO 24 in the 20050120408 US patent application
  misc_feature: The sequence is a functional homolog of SEQ ID NO 1500 in the 20060162006 US patent application
  misc_feature: The sequence is a functional homolog of SEQ ID NO 1501 in the 20060162006 US patent application
  misc_feature: The sequence is a functional homolog of SEQ ID NO 1503 in the 20060162006 US patent application
  misc_feature: The sequence is a functional homolog of SEQ ID NO 1504 in the 20060162006 US patent application
  misc_feature: The sequence is a functional homolog of SEQ ID NO 486 in the 20070033671 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MALLDAVVHPSQPQGHLGYGHRDYCSYGAPFFWSDATGHGDNHVPYAGDWDPFLLASLVHNAEESGKVVGSSKASPEREVALSSAIEPPSSPVMTTTAKRKRRRANKVVKNEEEMESQRMTHIAVERNRRRQMNEYLAVLRSLMPPSYGQRGDQASIVGGAINYVRELEQLLQSLEVHRSLQEHSSNSKSCNPFAAFFSFPQYSSATSSSHSGAGNHTIKVSAGSSRSPSSSVVTADIEASMVDGHASVKVQAPRRPRQLLRLAAGLQQLGLTTLHLNVSTAGTMVMYAFSLKVEVDCKLGSVEEIAAAVHEILGRIQDEAGFS

SEQ ID NO: 9081 - DNA, 741 bp, Sorghum bicolor; identical to SEQ ID NO: 8403
  misc_feature: Ceres ANNOT ID no. 6097854
  misc_feature: Encodes the peptide sequence at SEQ ID NO 9082

SEQ ID NO: 9082 - protein, 246 aa, Sorghum bicolor; identical to SEQ ID NO: 8404
  misc_feature: Ceres ANNOT ID no. 6097854
  misc_feature (104)..(167): Pfam Id: DnaJ Pfam Desc: DnaJ domain
  misc_feature (102)..(179): NCBI GI: 22297662 NCBI Desc: heat shock protein [thermosynechococcus elongatus bp-1]
  misc_feature (102)..(233): NCBI GI: 126658449 NCBI Desc: heat shock protein dnaj-like [cyanothece sp. ccy0110]
  misc_feature (95)..(172): NCBI GI: 56751256 NCBI Desc: dnaj protein [synechococcus elongatus pcc 6301]
  misc_feature (102)..(172): NCBI GI: 81299077 NCBI Desc: heat shock protein dnaj-like [synechococcus elongatus pcc 7942]
  misc_feature (100)..(171): NCBI GI: 116073719 NCBI Desc: heat shock protein dnaj-like [synechococcus sp. rs9916]

SEQ ID NO: 9083 - DNA, 654 bp, Sorghum bicolor
  misc_feature: Ceres ANNOT ID no. 6097862
  misc_feature: Encodes the peptide sequence at SEQ ID NO 9084
atggcatgcatcaacagcaccttccagagttgctccattgccagaggagcaaagatcagcacaagggctagtaggggcagtagtggggggaaggggtcaccgacctttcagtgcaaggcgtcgactttcgtgaacgctgccagcctccggcttgagctcgacgaaaaccctgaggcaatcatctccagggtgtggcctgagaacgtctcccttctgagctacgacgatctccgcgcctacctcgagtcgcaggagacggtccaagtagaagatgatcagcacgtggcgctcttgggtgaggccatgtcaacacctgtgctaatggccacagcagatcagacactggaggaggttgaatgccactttgaggccgtgtcagggcttccagttgtagacagcagcctcagatgtgttggggtggtcgtcaagaatgaccgggccagagcttctcatgggtcaaagacaaaggtctcagaagtgatgacctctccagccatcacactatcttctgacaaaactgtgatggatgctgcggttctgatgctcaagatgaagatccacagactaccagttgtaaatcaggacgaacaagtaataggtatagttacccgtgctgatgttcttcgtgtgttggaaggcatgctgaaggtttag

SEQ ID NO: 9084 - protein, 217 aa, Sorghum bicolor
  misc_feature: Ceres ANNOT ID no. 6097862
  misc_feature (100)..(212): Pfam Id: CBS Pfam Desc: CBS domain pair
  misc_feature (36)..(217): NCBI GI: 115449677 NCBI Desc: os02g0818000 [oryza sativa (japonica cultivar-group)]
  misc_feature (1)..(185): NCBI GI: 33771378 NCBI Desc: brown planthopper-induced resistance protein 1 [oryza sativa (indica cultivar-group)]
  misc_feature (49)..(212): NCBI GI: 116317809 NCBI Desc: osigba0147b06.5 [oryza sativa (indica cultivar-group)]
  misc_feature (20)..(212): NCBI GI: 38347506 NCBI Desc: osjnba0095e20.4 [oryza sativa (japonica cultivar-group)]
  misc_feature (154)..(211): NCBI GI: 15669617 NCBI Desc: inosine-5'-monophosphate dehydrogenase, (guab) [methanocaldococcus jannaschii dsm 2661]
MACINSTFQSCSIARGAKISTRASRGSSGGKGSPTFQCKASTFVNAASLRLELDENPEAIISRVWPENVSLLSYDDLRAYLESQETVQVEDDQHVALLGEAMSTPVLMATADQTLEEVECHFEAVSGLPVVDSSLRCVGVVVKNDRARASHGSKTKVSEVMTSPAITLSSDKTVMDAAVLMLKMKIHRLPVVNQDEQVIGIVTRADVLRVLEGMLKV

SEQ ID NO: 9085 - DNA, 567 bp, Sorghum bicolor
  misc_feature: Ceres ANNOT ID no. 6097870
  misc_feature: Encodes the peptide sequence at SEQ ID NO 9086
atgaagcacggcaacagcatgctgctccagctagcactactcatctctctgtcgctcgccggcggcgtcgccgtcgtcgtcggcggaagcgcaccgacgagcacgcacctcctgttctacatgcacgacctcgtgacggcatatccgggggctccggcgacggcggtacgtgtggccaggggcacgacgccgctgcctacggccggcagcctccggttcggggacacattcgtcgtcgatgacgcgctgacggaagggcccgacgcggcgtcccgcgccatgggccgcgcgcaggggttctacctgttcgcgtcgcagacggagctggcgccgctgctctgcgtcaacgtcgtgttcacggcggggcctcacaacggcagcaccgtcgccgtgctgggcagggacctcatccttgacaaggtcgacgtcagggagctcgccgtcgtcggcggcaccggcacgttgcgcggcgtcaccgggtatagcgagttcaggacccacaccttgaacgcaaccgacggcaacgccgtgctcaagattgacatgtacctgagcctgagcgtgtag

SEQ ID NO: 9086 - protein, 188 aa, Sorghum bicolor
  misc_feature: Ceres ANNOT ID no. 6097870
  misc_feature (11)..(186): Pfam Id: Dirigent Pfam Desc: Dirigent-like protein
  misc_feature (1)..(186): NCBI GI: 40253353 NCBI Desc: disease resistance response protein-like [oryza sativa (japonica cultivar-group)]
  misc_feature (11)..(184): NCBI GI: 115484459 NCBI Desc: os11g0179700 [oryza sativa (japonica cultivar-group)]
  misc_feature (11)..(182): NCBI GI: 88771131 NCBI Desc: dirigent-like protein pdir4 [picea engelmannii x picea glauca]
  misc_feature (10)..(186): NCBI GI: 34394264 NCBI Desc: disease resistance response protein-like protein [oryza sativa (japonica cultivar-group)]
  misc_feature (6)..(184): NCBI GI: 6227011 NCBI Desc: f12p19.3 [arabidopsis thaliana]
MKHGNSMLLQLALLISLSLAGGVAVVVGGSAPTSTHLLFYMHDLVTAYPGAPATAVRVARGTTPLPTAGSLRFGDTFVVDDALTEGPDAASRAMGRAQGFYLFASQTELAPLLCVNVVFTAGPHNGSTVAVLGRDLILDKVDVRELAVVGGTGTLRGVTGYSEFRTHTLNATDGNAVLKIDMYLSLSV

SEQ ID NO: 9087 - DNA, 540 bp, Sorghum bicolor
  misc_feature: Ceres ANNOT ID no. 6097886
  misc_feature: Encodes the peptide sequence at SEQ ID NO 9088
atggccaatatcaagctcagtacgatgcagctccaactcatacttgtctccatggcgctcgccaccgccgccgccaccaccaccaccacgcacctccagttctacatgcacgacatttttacggcaacagcagacagcccggcaacgggggtgactgtggcgaagggcacggcggggctgccgggagaccccaacgtccacttcggcgacatacacgtgatcgatgacccactgacggaagggcccgatccgtcatcgccggcagtggggcaggtgcaggggttcgaagtcttcgcggtgcagcaggagatatcggtgatgctctccgccaacatagtgttcacggccgggaagtacaatggcagctacctcgtcgtcctgggaaaggacgccttctttgacgaggtcagggagctgccggtcattggcggaagcggcaggttccgtggagccaccggttactctctgttcacgacgcacggtttcaacgacaccaccaagaacgccgttgtgaagatcgacgtgtacctgcgcgtgtag

SEQ ID NO: 9088 - protein, 179 aa, Sorghum bicolor
  misc_feature: Ceres ANNOT ID no. 6097886
  misc_feature (12)..(179): Pfam Id: Dirigent Pfam Desc: Dirigent-like protein
  misc_feature (3)..(175): NCBI GI: 88771131 NCBI Desc: dirigent-like protein pdir4 [picea engelmannii x picea glauca]
  misc_feature (2)..(175): NCBI GI: 88771147 NCBI Desc: dirigent-like protein pdir12 [picea glauca]
  misc_feature (30)..(175): NCBI GI: 88771141 NCBI Desc: dirigent-like protein pdir9 [picea engelmannii x picea glauca]
  misc_feature (11)..(177): NCBI GI: 115484459 NCBI Desc: os11g0179700 [oryza sativa (japonica cultivar-group)]
  misc_feature (29)..(175): NCBI GI: 88771151 NCBI Desc: dirigent-like protein pdir14 [picea engelmannii x picea glauca]
MANIKLSTMQLQLILVSMALATAAATTTTTHLQFYMHDIFTATADSPATGVTVAKGTAGLPGDPNVHFGDIHVIDDPLTEGPDPSSPAVGQVQGFEVFAVQQEISVMLSANIVFTAGKYNGSYLVVLGKDAFFDEVRELPVIGGSGRFRGATGYSLFTTHGFNDTTKNAVVKIDVYLRV

SEQ ID NO: 9089 - DNA, 615 bp, Sorghum bicolor
  misc_feature: Ceres ANNOT ID no. 6097966
  misc_feature: Encodes the peptide sequence at SEQ ID NO 9090
atggcttccctccagtccaccatcttcctcggcgccgccttcctcctcgccgcagctgtctacttccgcagcctcgacacggccggtagccgcagcgccaccacacacctccacttcttcatgcacgacgactacaccgggccgcaccccaccgccatgcggatcgtgtccggcaggtccctcttgttacccacggcgtccagcaacgacggcggcgccgccaacaacgacagcgccacggctgggagcaccctgtcgttgctgtcatcgccgcggcagttcggcgacgtcgtggtgctcaacaacgcgctgacggaaggcccccgtggtgacagcgcgcgcgtcggcacggcgcagggtttcgccgtgcgcgtgtcggagggcggcatcgtgtcgcacctgaccatgcacatggtcctcgaggccagcgagcaccgcggcagctccgtgacagcgaacggccgcatcgacatggatgccaaggtgcgtgagtcggtgatcatcggcggcaccggaaagttccggtacgcgcgggggtacatgctcaccaggaactacgactacgaccttgcccgtggaggcgttgtcgagatcgatgtctacgtgcggcactag

SEQ ID NO: 9090 - protein, 204 aa, Sorghum bicolor
  misc_feature: Ceres ANNOT ID no. 6097966
  misc_feature (12)..(204): Pfam Id: Dirigent Pfam Desc: Dirigent-like protein
  misc_feature (1)..(74): NCBI GI: 115484715 NCBI Desc: os11g0214700 [oryza sativa (japonica cultivar-group)]
  misc_feature (73)..(204): NCBI GI: 88771147 NCBI Desc: dirigent-like protein pdir12 [picea glauca]
  misc_feature (77)..(204): NCBI GI: 88771141 NCBI Desc: dirigent-like protein pdir9 [picea engelmannii x picea glauca]
  misc_feature (89)..(204): NCBI GI: 88771129 NCBI Desc: dirigent-like protein pdir3 [picea engelmannii x picea glauca]
  misc_feature (89)..(204): NCBI GI: 88771137 NCBI Desc: dirigent-like protein pdir7 [picea glauca]
MASLQSTIFLGAAFLLAAAVYFRSLDTAGSRSATTHLHFFMHDDYTGPHPTAMRIVSGRSLLLPTASSNDGGAANNDSATAGSTLSLLSSPRQFGDVVVLNNALTEGPRGDSARVGTAQGFAVRVSEGGIVSHLTMHMVLEASEHRGSSVTANGRIDMDAKVRESVIIGGTGKFRYARGYMLTRNYDYDLARGGVVEIDVYVRH

SEQ ID NO: 9091 - DNA, 585 bp, Sorghum bicolor
  misc_feature: Ceres ANNOT ID no. 6098077
  misc_feature: Encodes the peptide sequence at SEQ ID NO 9092
atgtcgtttctggtggattggttctacgacatgtttgtctctctgggcctctggcagaaggaggccaaaatcctcttcctcggcctcgacaacgccggcaagaccacgctgctccacatgctcaaggacgagcggttgagtcagcacgcgccgacgcagcagccgacgtcggaggagctgagcatcgggcggatcaggttcaaggcgttcgacctcggcggccaccggatcgcgcgccgtgtctggaaggactactacgccaaggttgacgcggtggtgtacatggtggacgccgccgacggcacccgattcggcgagtcgaaggcggagctaggcgcgctgctttcggacgacgcgctggcgggcgtgccgttcctcgtgctggggaacaagattgacatcccgcaggcggcacctgagcacgcgcttgcctactacctcgggctcgccggctgcaccaccggcaagggcaccgtcgacctcgccggcaccggcgtgcggcccgtcgaggtcttcatgtgcagcgtcgtccgtaagatgggctacggcgaagggttcaggtggatgtcgcagtacatcaagtag

SEQ ID NO: 9092 - protein, 194 aa, Sorghum bicolor
  misc_feature: Ceres ANNOT ID no. 6098077
  misc_feature (7)..(193): Pfam Id: Arf Pfam Desc: ADP-ribosylation factor family
  misc_feature (22)..(133): Pfam Id: MMR_HSR1 Pfam Desc: GTPase of unknown function
  misc_feature (23)..(133): Pfam Id: Miro Pfam Desc: Miro-like protein
  misc_feature (1)..(194): NCBI GI: 51536071 NCBI Desc: small gtp-binding protein [oryza sativa (japonica cultivar-group)]
  misc_feature (1)..(194): NCBI GI: 47499876 NCBI Desc: small gtp-binding protein [oryza sativa (japonica cultivar-group)]
  misc_feature (3)..(194): NCBI GI: 6563322 NCBI Desc: small gtp-binding protein sar1bnt [nicotiana tabacum]
  misc_feature (3)..(194): NCBI GI: 3334321 NCBI Desc: gtp-binding protein sar1a
  misc_feature (3)..(194): NCBI GI: 76573331 NCBI Desc: small gtp-binding protein sar1bnt-like protein [solanum tuberosum]
  misc_feature: The sequence is a functional homolog of SEQ ID NO 11 in US patent 7259294
MSFLVDWFYDMFVSLGLWQKEAKILFLGLDNAGKTTLLHMLKDERLSQHAPTQQPTSEELSIGRIRFKAFDLGGHRIARRVWKDYYAKVDAVVYMVDAADGTRFGESKAELGALLSDDALAGVPFLVLGNKIDIPQAAPEHALAYYLGLAGCTTGKGTVDLAGTGVRPVEVFMCSVVRKMGYGEGFRWMSQYIK

SEQ ID NO: 9093 - DNA, 1131 bp, Sorghum bicolor
  misc_feature: Ceres ANNOT ID no. 6098142
  misc_feature: Encodes the peptide sequence at SEQ ID NO 9094
atggagttggctgtgctgatcatcggtgccggaccagctggactggcgacggcggcatgcctcagccagcgttccatcccctacctcatcgttgagcgtgaggactgcagcgcgtcgctgtggcgctaccgcacctacaaccgcgtcaagcttcacctgtccaaggagttcagctccctgccgtacatgccgcatccggatggcaccccaacctacattcccaaggaggagtttctgaagtacctggactgctacgcccaacattttgacatcaagcccaggtattgcacttgcgttgtgtcagcagcatacgatgagggaaccagacgctggattgtcgctgcacgtgacacggcagcgggcacagaaatcctgtatgcagcgaagttcctggtcgtggccaccggtgagaatggagaggggaggattccggagatcttgggtctagagagcttccacggggaggctatccactcttcaacctacaagtcaggaagcagctatgctgggaaaagggttctcgtggttggtgctggaaattctgggatggagattgcctatgatctcgcaagccatggcgccgacacctcaattgttgctcgcagtccggtacacataatgaccaaggaactgatccgtctgggaatgacatttatccaatatataccaattacaatagtggatctttttataatgaacatagccgatgtcatatttggtgatctatcaaagtatggcatcgtgcggcctagaattggccccctcctactcaaatccaaaacgggacgatcttgtgtaattgatgttgggacagccgggttgattaagaatggcatcgtcaaggtgttcaaggggatatcgaagatcactggaaacaaagttcaattcgaatgtgggaatggttccgaatttgatgccatcgtgtttgcaacaggttacaaaagcactgcgaatttgtggctcaaggacgacaagtgcatgctgaacagtgacggacatccaaacaaaggttatcccaatatttggaaaggtgaaaatggcctctatttctctggttttgcgaggatgggattggctggtatttccaaggatgcttacaacattgccaatgacgtggcgtctgtctattga

SEQ ID NO: 9094 - protein, 376 aa, Sorghum bicolor
  misc_feature: Ceres ANNOT ID no. 6098142
  misc_feature (5)..(377): Pfam Id: FMO-like Pfam Desc: Flavin-binding monooxygenase-like
  misc_feature (2)..(372): NCBI GI: 119214834 NCBI Desc: flavin monooxygenase [zea mays]
  misc_feature (2)..(376): NCBI GI: 140041704 NCBI Desc: fad-dependent pyridine nucleotide-disulphide oxidoreductase [medicago truncatula]
  misc_feature (1)..(375): NCBI GI: 15218988 NCBI Desc: flavin-containing monooxygenase family protein / fmo family protein [arabidopsis thaliana]
  misc_feature (3)..(372): NCBI GI: 115439755 NCBI Desc: os01g0732700 [oryza sativa (japonica cultivar-group)]
  misc_feature (6)..(376): NCBI GI: 3142293 NCBI Desc: contains similarity to myosin ib heavy chain gbx70400 from gallus gallus. [arabidopsis thaliana]
MELAVLIIGAGPAGLATAACLSQRSIPYLIVEREDCSASLWRYRTYNRVKLHLSKEFSSLPYMPHPDGTPTYIPKEEFLKYLDCYAQHFDIKPRYCTCVVSAAYDEGTRRWIVAARDTAAGTEILYAAKFLVVATGENGEGRIPEILGLESFHGEAIHSSTYKSGSSYAGKRVLVVGAGNSGMEIAYDLASHGADTSIVARSPVHIMTKELIRLGMTFIQYIPITIVDLFIMNIADVIFGDLSKYGIVRPRIGPLLLKSKTGRSCVIDVGTAGLIKNGIVKVFKGISKITGNKVQFECGNGSEFDAIVFATGYKSTANLWLKDDKCMLNSDGHPNKGYPNIWKGENGLYFSGFARMGLAGISKDAYNIANDVASVY

SEQ ID NO: 9095 - DNA, 1086 bp, Sorghum bicolor
  misc_feature: Ceres ANNOT ID no. 6098144
  misc_feature: Encodes the peptide sequence at SEQ ID NO 9096
atggagttggctgtgctgatcatcggcgccggaccagctggactggcgacggcagcatgcctcagccagcgttccatcccctacctcatcgttgagcgtgaggactgcagcgcgtcgctgtggcactaccgcacctacaaccgcgtcaagcttcacctgtccaaggagttcagctcgctgccatacatgccgcatccggatggcaccccgacctacattcccaaggaggagtttctgaagtacctggactgctacgccgaacattttgacatcaagcccagacgctggattgtcgctgcacgtgacacggctgcgggcacagaaatcctgtatgcagccaagttcctggtcgtggccaccggtgagaatggagaggggaggatcccggagatcttgggtctagagagcttccacggggaggctatccactcttcaacctacaagtcaggaagcagctatgctgggaaaagggttctcgtggttggtgctggaaattctgggatggagattgcctatgatctcgcaagccatggcgccgacacctcaattgttgctcgcagtccggtacacataatgaccaaggaactgatccgtctgggaatgacatttatccaatatataccaattacaatagtggatctttttataatgaacatagccgatgtcacatttggtgatctatcaaagtatggcatcgtgcggcctagaattggccccctcctactcaaatccaaaacgggacgatcttgtgtaattgatgttgggacagccgggttgattaagaaaggcatcgtcaaggtgttcaaggggatatcgaagatcactggaaacaaagttcaattcgaatgtgggaatggttgcgaatttgatgccatcgtgtttgcaacaggttacaaaagcactgcgaatttgtggctcaaggacgacaagtgcatgctgaacagtgacggacatccaaacaaaggttatcccaatatttggaaaggtgaaaatggcctctatttctctggttttgcgaggatgggattggctggtatttccaaggatgcttacaacattgccaatgacgtggcgtctgtctactaa

SEQ ID NO: 9096 - protein, 361 aa, Sorghum bicolor
  misc_feature: Ceres ANNOT ID no. 6098144
  misc_feature (5)..(362): Pfam Id: FMO-like Pfam Desc: Flavin-binding monooxygenase-like
  misc_feature (89)..(357): NCBI GI: 119214834 NCBI Desc: flavin monooxygenase [zea mays]
  misc_feature (2)..(361): NCBI GI: 140041704 NCBI Desc: fad-dependent pyridine nucleotide-disulphide oxidoreductase [medicago truncatula]
  misc_feature (1)..(360): NCBI GI: 15218988 NCBI Desc: flavin-containing monooxygenase family protein / fmo family protein [arabidopsis thaliana]
  misc_feature (6)..(358): NCBI GI: 118624210 NCBI Desc: flavin monooxygenase-like protein [solanum lycopersicum]
  misc_feature (6)..(359): NCBI GI: 92895305 NCBI Desc: pyridine nucleotide-disulphide oxidoreductase, class i; fad-dependent pyridine nucleotide-disulphide oxidoreductase [medicago truncatula]
MELAVLIIGAGPAGLATAACLSQRSIPYLIVEREDCSASLWHYRTYNRVKLHLSKEFSSLPYMPHPDGTPTYIPKEEFLKYLDCYAEHFDIKPRRWIVAARDTAAGTEILYAAKFLVVATGENGEGRIPEILGLESFHGEAIHSSTYKSGSSYAGKRVLVVGAGNSGMEIAYDLASHGADTSIVARSPVHIMTKELIRLGMTFIQYIPITIVDLFIMNIADVTFGDLSKYGIVRPRIGPLLLKSKTGRSCVIDVGTAGLIKKGIVKVFKGISKITGNKVQFECGNGCEFDAIVFATGYKSTANLWLKDDKCMLNSDGHPNKGYPNIWKGENGLYFSGFARMGLAGISKDAYNIANDVASVY

SEQ ID NO: 9097 - DNA, 996 bp, Sorghum bicolor
  misc_feature: Ceres ANNOT ID no. 6098356
  misc_feature: Encodes the peptide sequence at SEQ ID NO 9098
atgcttctcctgctcctcatcgctgtcctcaccgccgtcgctgccttcctcctcttcaagttcgccaccgtcgtcgatggggacttgacgctcgtatcccgcggcccgccgcggcgggatagggtggacggcaaggttgtgtggattactggagctagccgcgggattggggaggttcttgcaatgcaatttgcaaatttaggagcaaagctgatactatctgcacgtaccaaggatgagcttgagagagtgaaaaaaaacatcctcagcaagaatccagatagcagagttgaagtgttacccatggatttatcagctggtgaagaatctctaaaagaagtcgtacatgtggcagaatcatttttttctaatgcaggcgttgactatatgatccataatgcagccttcgaacgtcctaaacggggggctctggaagaaagtgaggaaggtcttaaggctactttgaatgtcaatgtctttggaactattactttaactcgccttctagcaccttacatgctggatagaggaacgggacattttgttgtgatgagcagtgctgctggaaaggttcctgctcctggccaggccatttactctgcctccaaacatgctcttaatggatattttgcttctctgcgatctgagttgtgtacaaagggcattaaggtcactgttgtctgccccggaccgattgaaacaccacaatcttctgctgcagcctctcaagtacaaacacattctgctgagaaacgtgagaaacgtgtttcggtggaaaggtgtgttgaacttacaattattgctgctactcatggactgaaagaagcatggatatcatatcagcctgtgttgactgttatgtacttggtgcaatacatgccaacagttggttactggctcatggacaaggttggtgcaaaacggctggatgcggctgcaaagaaagggaacacgtatagttggaatctcattttcggcagcaagaaatcagcatga

SEQ ID NO: 9098 - protein, 331 aa, Sorghum bicolor
  misc_feature: Ceres ANNOT ID no. 6098356
  misc_feature (45)..(218): Pfam Id: adh_short Pfam Desc: short chain dehydrogenase
  misc_feature (46)..(235): Pfam Id: KR Pfam Desc: KR domain
  misc_feature (1)..(328): NCBI GI: 23308299 NCBI Desc: at3g03330/t21p5_25 [arabidopsis thaliana]
  misc_feature (1)..(330): NCBI GI: 92867894 NCBI Desc: short-chain dehydrogenase/reductase sdr [medicago truncatula]
  misc_feature (6)..(309): NCBI GI: 49116832 NCBI Desc: mgc80755 protein [xenopus laevis]
  misc_feature (3)..(310): NCBI GI: 119601176 NCBI Desc: dehydrogenase/reductase (sdr family) member 7, isoform cra_b [homo sapiens]
  misc_feature (46)..(310): NCBI GI: 37183180 NCBI Desc: oxidoreductase/s-2 h [homo sapiens]
  misc_feature: The sequence is a functional homolog of SEQ ID NO. 389 in the 11/188,298 US application
  misc_feature: The sequence is a functional homolog of SEQ ID NO. 453 in the 11/188,298 US application
MLLLLLIAVLTAVAAFLLFKFATVVDGDLTLVSRGPPRRDRVDGKVVWITGASRGIGEVLAMQFANLGAKLILSARTKDELERVKKNILSKNPDSRVEVLPMDLSAGEESLKEVVHVAESFFSNAGVDYMIHNAAFERPKRGALEESEEGLKATLNVNVFGTITLTRLLAPYMLDRGTGHFVVMSSAAGKVPAPGQAIYSASKHALNGYFASLRSELCTKGIKVTVVCPGPIETPQSSAAASQVQTHSAEKREKRVSVERCVELTIIAATHGLKEAWISYQPVLTVMYLVQYMPTVGYWLMDKVGAKRLDAAAKKGNTYSWNLIFGSKKSA

SEQ ID NO: 9099 - DNA, 1128 bp, Sorghum bicolor
  misc_feature: Ceres ANNOT ID no. 6098371
  misc_feature: Encodes the peptide sequence at SEQ ID NO 9100
atgtgggccgcctccccggcattccgcaggcagctcgtcctgctccgctccctcctcccttccccgcctgccccctcctccgtcgccggctttcccccatcctgcccctcgtgctccagcttcctccgggtccggaccaaccacgcgatggcggcgtccgccgggacggtgtacgaggcggacgcggaggccgtcgtgcgccggatcacgccgccactcgaccgcgccaggcacaagggccaggcagggaagatagcagtaatcggaggatgtcgtgagtacactggtgctccttattttgccgctatctctgccttgaaagttggtgcagatctttcacatgttttctgcacaaaagatgctgctacagtaattaagagctatagccctgaactaattgtacatccaatattagaagaatcttacagtgtaagggatgatgaacgagcatctgtttcttctaagattcttactgaagttggaaaatggatggagcgctttgattgcattgttgttggtcctggccttggaagggactcatttcttctggattgtgtgagtaatatcatgaggcatgcacggcaggctaatattccaactgttgtggatggggatggcctgtttcttgtaaccaataaccttagtcttgttgaaggaaaccctcttgccattttaacaccaaatgtctatgagtacaagcgtcttgttcagaaggttcttaactgtgatgtagatgaggaaactgcttctgagcagctaatcacactttgccaaaaaattggtgatgtaacaataatgcagaaaggaaaagctgatgtcatcagtgatggtaaaacagttacgcaagtgagtacttttggttccccaagacgatgtggtggtcaaggtgacatcctttctggaagtgtggctgtatttgcatcgtgggcacgacactttgtcttgacaaatgaacaacctacagagaaaagagttaatcctatgacccttgggtgcatagctggctctcttctactcaggaaagctgcatcacatgcttttgagaagaacaagagatcaactgtcacctctgatatcattgagttcttgggcaaaagcttggaagatatctgccctgccgagcactag

SEQ ID NO: 9100 - protein, 375 aa, Sorghum bicolor
  misc_feature: Ceres ANNOT ID no. 6098371
  misc_feature (85)..(365): Pfam Id: Carb_kinase Pfam Desc: Carbohydrate kinase
  misc_feature (18)..(373): NCBI GI: 20856361 NCBI Desc: at5g19150/t24g5_50 [arabidopsis thaliana]
  misc_feature (66)..(373): NCBI GI: 3947854 NCBI Desc: spcc61.03 [schizosaccharomyces pombe]
  misc_feature (66)..(323): NCBI GI: 119403470 NCBI Desc: yjef domain protein [aspergillus clavatus nrrl 1]
  misc_feature (66)..(323): NCBI GI: 119480935 NCBI Desc: yjef domain protein [neosartorya fischeri nrrl 181]
  misc_feature (164)..(370): NCBI GI: 25353001 NCBI Desc: protein r107.2 [imported] - caenorhabditis elegans
MWAASPAFRRQLVLLRSLLPSPPAPSSVAGFPPSCPSCSSFLRVRTNHAMAASAGTVYEADAEAVVRRITPPLDRARHKGQAGKIAVIGGCREYTGAPYFAAISALKVGADLSHVFCTKDAATVIKSYSPELIVHPILEESYSVRDDERASVSSKILTEVGKWMERFDCIVVGPGLGRDSFLLDCVSNIMRHARQANIPTVVDGDGLFLVTNNLSLVEGNPLAILTPNVYEYKRLVQKVLNCDVDEETASEQLITLCQKIGDVTIMQKGKADVISDGKTVTQVSTFGSPRRCGGQGDILSGSVAVFASWARHFVLTNEQPTEKRVNPMTLGCIAGSLLLRKAASHAFEKNKRSTVTSDIIEFLGKSLEDICPAEH

SEQ ID NO: 9101 - DNA, 1209 bp, Sorghum bicolor
  misc_feature: Ceres ANNOT ID no. 6098436
  misc_feature: Encodes the peptide sequence at SEQ ID NO 9102
atgggttctttgaaggaaccagatgtgaataatcatcgaatgggctgtcgtcatgaaggcagaaatgcaaccattttgggagtcggcaaagctgttccactgcatgagtttgaacaaaattcattctctgattactattttgagattagcagaagcaatcacatggtggacttgaaggcaaagtttgcaaacatttgtgagaagaccatgatcgagaagcgacacttttacatgtccgacgaaatgttgagggaaagcccgtcgatcacggcgtacagctccccttccctcacccgccggcaggagctcgccgatgcgggtgtacccgagctcggcgtggcagcggcaggcagggccatgagtgactggggcaagcaggcctccgacatcacgcatctcgtggccagcacgtcaagcagcggctgcatgcctggcgcagactgtgagctcgccaggctcctcggcctgaaaccatcgacgaagcgcttcatgctgtaccagaccggctgccatggtggctgcaccgcccttcgcctctccaaggaccttgcggagaacaaccccggcgcccgggtccttgtggtgtgctccgaggtgtgcaccctgtcgcttcgaggcccctcggcgtcccacatgggggacctcgtcggccaggccatcttgggtgacgctgccggtgctgttgtcgtcggctgcagccccaccgccgaagagcacgccatgtttgagcttgtgatggcgtgtcaggagaccgtggcggggacggaggaggccttggtgtccaagctccgggaggaagggatagtgtacacacttgaccgagacataccccggcatgtgtccggctccgtggagcggttggtggagcttatgctgcaggaggccacggtggtgcccgttccggatttgaacgatgaggtgttctgggtggtgcatccaggtggacgaggtatacttgacaggattgagagcaagctgggcctcggggagaagaagctggcggcgtcgagggctgtgatgaggcaatatggcaacacaaggtgttcctctgtcatcctagttttggaagagatgcggcggatgtcagagcagctgggtctgagcacggcaggggaaggcctcgactggggcctcctcgtcggctatggccctggcatcacagtcgaagctatactcctccgcgcgctgccaaacaaattaaaaccatag

SEQ ID NO: 9102 - protein, 402 aa, Sorghum bicolor
  misc_feature: Ceres ANNOT ID no. 6098436
  misc_feature (7)..(234): Pfam Id: Chal_sti_synt_N Pfam Desc: Chalcone and stilbene synthases, N-terminal domain
  misc_feature (243)..(397): Pfam Id: Chal_sti_synt_C Pfam Desc: Chalcone and stilbene synthases, C-terminal domain
  misc_feature (167)..(250): Pfam Id: ACP_syn_III Pfam Desc: 3-Oxoacyl-[acyl-carrier-protein (ACP)] synthase III
  misc_feature (23)..(397): NCBI GI: 38346200 NCBI Desc: osjnba0094o15.7 [oryza sativa (japonica cultivar-group)]
  misc_feature (23)..(397): NCBI GI: 116317793 NCBI Desc: osigba0148i18.6 [oryza sativa (indica cultivar-group)]
  misc_feature (92)..(397): NCBI GI: 53793551 NCBI Desc: chalcone synthase-like [oryza sativa (japonica cultivar-group)]
  misc_feature (7)..(397): NCBI GI: 67942380 NCBI Desc: chalcone synthase [phalaenopsis hybrid cultivar]
  misc_feature (9)..(398): NCBI GI: 86604613 NCBI Desc: chalcon synthase [lilium speciosum]
MGSLKEPDVNNHRMGCRHEGRNATILGVGKAVPLHEFEQNSFSDYYFEISRSNHMVDLKAKFANICEKTMIEKRHFYMSDEMLRESPSITAYSSPSLTRRQELADAGVPELGVAAAGRAMSDWGKQASDITHLVASTSSSGCMPGADCELARLLGLKPSTKRFMLYQTGCHGGCTALRLSKDLAENNPGARVLVVCSEVCTLSLRGPSASHMGDLVGQAILGDAAGAVVVGCSPTAEEHAMFELVMACQETVAGTEEALVSKLREEGIVYTLDRDIPRHVSGSVERLVELMLQEATVVPVPDLNDEVFWVVHPGGRGILDRIESKLGLGEKKLAASRAVMRQYGNTRCSSVILVLEEMRRMSEQLGLSTAGEGLDWGLLVGYGPGITVEAILLRALPNKLKP

SEQ ID NO: 9103 - DNA, 3525 bp, Sorghum bicolor
  misc_feature: Ceres ANNOT ID no. 6098518
  misc_feature: Encodes the peptide sequence at SEQ ID NO 9104
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
atggacgcggtcgacgcggagctcgcgcgcgcgcaggaggagcggcgcaaggtggaggcggcgctggcggcaggcgcgcccatggccgtgtcctccgtcaccttcgacaccgacctctacggcggcgggggcgccgacccgcaccgcttcgctggctacgacacctccatcgcggcctccgaggacgacgacgcagcagcggaggaggacgcggaggccgccgccaaacccgcgccgcgccggctcgcgacctacacgggccacgccatcgccgccgccgacctcccgcgctcgaccgacggcggcgacggcgacgggctggggttgcccaagcggtcccagcgcatcatcgaccgcgaggacgactaccgccgccgccgcctcaaccagatcatctcgccggagcgccatgacgcgttcgccgttggggaggccaccccggaccctgcggtgcggacctacgctgacgtcatgcgcgatgcggcgctgcagaagaagaaggagtacctgctgagggagatttctaagaagaaggaagaggaggagaaggtgaaggaggagaggaaggcctttgccgcgcctgagcagctggccgccacgacgacaaagcgccgcaacaggtgggatcagtcgcaggaaggcgatgctgctgccggtgccaagaaggcaaagacatcgtcggattgggatgctcctgacgcgactcctgggattgggcgttgggatgccacccctggacgtgttggagacgcgacgccttccgtgagaaggaacagatgggatgagacaccgactccagggaggatggctgatgttgatgcgacgcctgcagctggcggtgcgactccttccggggcttgggatgcgaccccaaagctgccgggtggtgtcacgccaacccctggtaagaagcagagatcaaggtgggatgagacgccagccagtatggggattgcaaccccgggtggtcttggtggtgctgcaactgcaacacctgctggttatactcctgggccgacgccatttggtgctgataaccttgccacgccaactcctagccagatcgctcgtggacctatgactctggacctgtacaaccaatcccggtggcagcaagacattcaggagaggaacaggcctctcaccgatgaggagcttgatctgacagacaaagcccgggaattcggtgccggaccacttttcaacaaaatccttcccttactcatgcagccaacactggaggaccaggagaggcaccttctggtgaaggttattgacagggtactgtataagctggatgagcttgtccgtcccttcgtgcacaagattcttgtggttattgaaccgttgttgattgatgaggactactacgctcgtgttgagggcagggagattatctcaaatcttagcaaagcagctggtcttgctactatgattgctgccatgagaccggatattgataacgttgatgagtatgtgaggaacaccactgctagggcgttcagtgtggtggcttctgctttgggcatccctgctcttttaccattcttgaaggctgtctgtcaaagtaagaagtcttggcaggctcggcacactggtatcaaaatcgttcagcagatttctattctcatgggctgtgctgttctgccgcatctcaagtcactggttgagatcattgagcatggtctaagcgatgagaaccagaaagtcaggacaattactgcactttctcttgccgcacttgctgaggctgctgcaccatatggtatagaaagttttgatactgtattgaagcctttgtggaagggtgtcagatctcaccgcgggaaggtccttgctgccttcctgaaggctattggtttcatcatccctcttatggatgctgcgtatgctagtctctacacaaagggggtgatgcaggtcctcattagggagttccagtctccagatgaagagatgaagaagattgtcctcaaggttgtgaaacagtgtgtcagtacagagggtgtggaggctgattatatccggaatgacatccttccaaaattcttcgagcacttctgggtgaggagaatggctctagatcgcaggaactataaacagcttgtggaaactacagtggagatggcaaacaaggttggagttcctgatattgttgggaggattgttgaggatctgaaagacgaaggcgagcactacagaagaatggtgatggaaacaattgagaaggtggtggccaacttgggtgcttcagatattgatgctcgtctggaggagctgcttattgacggtatcttatatgctttccaagagcagactagtgatgatgcaaatgtcatgcttaatggttttggagctgtggttaatgcaattggacagagagttaagccttaccttcctcagatttgtggtaccatcaagtggcgattgaacaacaagagtgcaaaagttaggcagcaagctgctgatctgatctccaggatagccattgtcatgaagcagtgccaggaggagcagcttatgggtcacttgggtgttgtgctgtatgagtacttaggagaggagtatcctgaggtgttgggttcaattcttggagccttgaaggctatcgtcaatgtcattggtatgactaaaatgactcctccaatcaaagatcttcttcctcgtctgacccccatcttgaagaacaggcatgagaaggtgcaagagaactgcattgatcttgttggtaggattgctgatcgtggagcagaatttgtgccagcaagggaatggatgaggatttgttttgagctgcttgaaatgttgaaggctcataagatgggtattaggagagccactgtgaacacatttggttatattgcaaaggctatagggccacaggacgtgttggccaccctgttgaataacttgaaggtgcaggagcgacagaaccgtgtctgcacaactgtagcaattgccattgttgctgaaacttgctcacctttcacagttttgcctgcccttatgaatgagtaccgggtcccagagctcaatgtgcaaaatggtgttctgaagtcactctctttcctctttgagtatattggtgagatgggcaaagattacatatatgctgtctctcccttacttgaagatgctttaatggatagagatctggttcaccgccagactgctgcctctgctgttaagcacatggctctaggtgttgctggcttgggttgtgaggatgctcttgttcatctgcttaactatgtttggcccaacatatttgagacatctccccatgttataaatgctgtcatggaggcgattgaggggatgagggttgcgctaggtccagctatgattttgaattattgcctgcaaggtctcttccatccagcaaggaaagtacgtgaagtgtattggaagatatacaactctttgtacattggtgcacaggatgcgcttgttgcttcttaccctgccatggaagacaatggggataacatctttagccgtccagagctggtagtgtttgtctga

SEQ ID NO: 9104 - protein, 1174 aa, Sorghum bicolor
  misc_feature: Ceres ANNOT ID no. 6098518
  misc_feature (549)..(585): Pfam Id: HEAT Pfam Desc: HEAT repeat
  misc_feature (299)..(424): Pfam Id: SF3b1 Pfam Desc: Splicing factor 3B subunit 1
  misc_feature (1)..(1174): NCBI GI: 115444207 NCBI Desc: os02g0147300 [oryza sativa (japonica cultivar-group)]
  misc_feature (182)..(1170): NCBI GI: 54112117 NCBI Desc: splicing factor 3b, subunit 1 isoform 1 [homo sapiens]
  misc_feature (182)..(1170): NCBI GI: 119590552 NCBI Desc: splicing factor 3b, subunit 1, 155kda [homo sapiens]
  misc_feature (182)..(1170): NCBI GI: 14042921 NCBI Desc: splicing factor 3b, subunit 1 [mus musculus]
  misc_feature (182)..(1170): NCBI GI: 2791896 NCBI Desc: 146kda nuclear protein [xenopus laevis]
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
MDAVDAELARAQEERRKVEAALAAGAPMAVSSVTFDTDLYGGGGADPHRFAGYDTSIAASEDDDAAAEEDAEAAAKPAPRRLATYTGHAIAAADLPRSTDGGDGDGLGLPKRSQRIIDREDDYRRRRLNQIISPERHDAFAVGEATPDPAVRTYADVMRDAALQKKKEYLLREISKKKEEEEKVKEERKAFAAPEQLAATTTKRRNRWDQSQEGDAAAGAKKAKTSSDWDAPDATPGIGRWDATPGRVGDATPSVRRNRWDETPTPGRMADVDATPAAGGATPSGAWDATPKLPGGVTPTPGKKQRSRWDETPASMGIATPGGLGGAATATPAGYTPGPTPFGADNLATPTPSQIARGPMTLDLYNQSRWQQDIQERNRPLTDEELDLTDKAREFGAGPLFNKILPLLMQPTLEDQERHLLVKVIDRVLYKLDELVRPFVHKILVVIEPLLIDEDYYARVEGREIISNLSKAAGLATMIAAMRPDIDNVDEYVRNTTARAFSVVASALGIPALLPFLKAVCQSKKSWQARHTGIKIVQQISILMGCAVLPHLKSLVEIIEHGLSDENQKVRTITALSLAALAEAAAPYGIESFDTVLKPLWKGVRSHRGKVLAAFLKAIGFIIPLMDAAYASLYTKGVMQVLIREFQSPDEEMKKIVLKVVKQCVSTEGVEADYIRNDILPKFFEHFWVRRMALDRRNYKQLVETTVEMANKVGVPDIVGRIVEDLKDEGEHYRRMVMETIEKVVANLGASDIDARLEELLIDGILYAFQEQTSDDANVMLNGFGAVVNAIGQRVKPYLPQICGTIKWRLNNKSAKVRQQAADLISRIAIVMKQCQEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKMGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVSPLLEDALMDRDLVHRQTAASAVKHMALGVAGLGCEDALVHLLNYVWPNIFETSPHVINAVMEAIEGMRVALGPAMILNYCLQGLFHPARKVREVYWKIYNSLYIGAQDALVASYPAMEDNGDNIFSRPELVVFV

SEQ ID NO: 9105 - DNA, 906 bp, Sorghum bicolor
  misc_feature: Ceres ANNOT ID no. 6098584
  misc_feature: Encodes the peptide sequence at SEQ ID NO 9106
atggcggcggcgcgcaacgacgacacggccaccatcatcagctccgagcccgccgccgggaggagcaggtggtcccttcgtggcatgacggccctcgtcaccggcggcacccgcggcatcgggcgtgccgtggtcgaggagctggcggcgctgggcgcggcggtgcacacgtgctcccggaacgaggcggagctccgcgaccgcctggccgagtgggaggccgccgccaagaccaacggcggcggcggggtcgtcacgggctccgtctgcgacgtgtcggcgcgtgaccagcgagagcgtctcctccgcgacgtggccgagcgcttcggcggcaagctcaacatcctggtgaacaacgtgggcaccaacttcggcaagccgacggcggagtacaccgccgaggactacgcgttcctgatgtccaccaacctggagtccgcctaccacctgtgccagctcgcctacccgctgctgaaagcccccgccgccgccgccggcaacggtaacggcggcagcgtggtgctcgtctcctccgtgtgcggcggcgtggcagtgtgcacgggctccgtctacgccatggcgaaggccggcatgaaccagctggcgaggaacctggcgtgcgagtgggccggcgacggcatccgggccaactccgttgcgccgtggtacaccaggacgccgctcgtggaaggggacctgtcgcgggggcagtacgtggaggagatcctccggcggacgccgcagcggcgcgtcggcgagcccgaggagatctcgtcgctggtggccttcctctgcatgccctgcgcgtcctacatcaccggacagaccatcgccgtcgacggcggcatgaccgtcaatggcctctaccccagctcatcgccgtcaggactaagctacagtaattaa

SEQ ID NO: 9106 - protein, 301 aa, Sorghum bicolor
  misc_feature: Ceres ANNOT ID no. 6098584
  misc_feature (29)..(210): Pfam Id: adh_short Pfam Desc: short chain dehydrogenase
  misc_feature (23)..(294): NCBI GI: 21536785 NCBI Desc: short chain alcohol dehydrogenase-like [arabidopsis thaliana]
  misc_feature (8)..(286): NCBI GI: 38707448 NCBI Desc: short chain alcohol dehydrogenase-like protein [daucus carota]
  misc_feature (126)..(294): NCBI GI: 6457349 NCBI Desc: short chain alcohol dehydrogenase [arabidopsis thaliana]
  misc_feature (23)..(296): NCBI GI: 8778545 NCBI Desc: f22g5.20 [arabidopsis thaliana]
  misc_feature (23)..(287): NCBI GI: 42569437 NCBI Desc: short-chain dehydrogenase/reductase (sdr) family protein [arabidopsis thaliana]
  misc_feature (23)..(287): SWISSPROT Homolog: EC 1.1.1.206 Tropinone reductase 1
  misc_feature (23)..(286): SWISSPROT Homolog: EC 1.1.1.236 Tropinone reductase 2
MAAARNDDTATIISSEPAAGRSRWSLRGMTALVTGGTRGIGRAVVEELAALGAAVHTCSRNEAELRDRLAEWEAAAKTNGGGGVVTGSVCDVSARDQRERLLRDVAERFGGKLNILVNNVGTNFGKPTAEYTAEDYAFLMSTNLESAYHLCQLAYPLLKAPAAAAGNGNGGSVVLVSSVCGGVAVCTGSVYAMAKAGMNQLARNLACEWAGDGIRANSVAPWYTRTPLVEGDLSRGQYVEEILRRTPQRRVGEPEEISSLVAFLCMPCASYITGQTIAVDGGMTVNGLYPSSSPSGLSYSN

SEQ ID NO: 9107 - DNA, 1464 bp, Sorghum bicolor
  misc_feature: Ceres ANNOT ID no. 6098632
  misc_feature: Encodes the peptide sequence at SEQ ID NO 9108
atggcgtcggagaaggtggagacgatcgtggcggggaactacatggagatggagcgcgacgtcgtcgtcggcggcggccatggcgacgaccaacccggcggcggcgacgcggcgtcgtccggggccagagccgccggcggcaagaagaagcttgggctgtcgtcgaggctgttctggcacggcgggtcggtgtacgacgcgtggttcagctgcgcgtcgaaccaggtggcgcaggtgctgctgacgctgccctactccttctcgcagctggggatggcgtccggggtggtgttccagctcttctatggcctcatgggcagctggaccgcctacctcatcagcgtcctctacgtcgagtaccgcaccaggaaggagcgtgacaaggtcgacttcaggaaccatgtcatccagtggtttgaggttcttgatgggctactggggaagcactggaggaacgtcggcctcttcttcaactgcacgttcctcctcttcggctccgtcatccagctcatcgcatgtgcaagcaacatctactacatcaacgacaagtacgacaagcggacatggacgtacatcttcggcgcctgctgcgccaccaccgtgttcatcccctccttccacaactaccggatctggtccttcctcggcctcctcatgaccacctacaccgcatggtacctcaccattgccgccatcgcacacggtcaggtggaaggagtgacacactcaggtccaagcaagatggtgctctacttcacgggggccactaacatcctctacacatttggaggccatgctgtcactgtggagatcatgcacgcgatgtggaagcctcagaagttcaagctcatctacctggtggccacgctctacgtgctgacactgacgctgccatccgcctccgccgtctactgggcgttcggcgacatgctcctggaccactccaacgccttctccctcctcccgcgctccggcttccgtgacgctgccgtcatcctcatgctcatccaccagttcatcacgttcgggttcgcgtgcacgccgctctacttcgtgtgggagaagctgatcggcgtgcacgagacggggagcgtggcgctgcgcgccgcagcgcggctccccgtcgtggtgcccatctggttcctggccatcatctttcccttcttcggccccatcaactccaccgtgggctcgctgctggtcagcttcaccgtctacatcatcccggcgctggcgcacatggccaccttcgcgccgccggccgccagggagaacgccgtcgagcggccgccacgcggggtcggcggctgggccgggatgtacgccgccaactgcttcgtcgtggcgtgggtgctcgtcgttggatttgggtttggaggctgggctagcaccgtcaacttcgtccgacaggtcgatacctttgggctcttcacaaggtgctaccagtgcccgcccaagcactga

SEQ ID NO: 9108 - protein, 487 aa, Sorghum bicolor
  misc_feature: Ceres ANNOT ID no. 6098632
  misc_feature (60)..(454): Pfam Id: Aa_trans Pfam Desc: Transmembrane amino acid transporter protein
  misc_feature (15)..(485): NCBI GI: 126217796 NCBI Desc: auxin influx transport protein [casuarina glauca]
  misc_feature (48)..(485): NCBI GI: 126217798 NCBI Desc: auxin influx transport protein [casuarina glauca]
  misc_feature (46)..(484): NCBI GI: 89511764 NCBI Desc: auxin influx carrier [lupinus albus]
  misc_feature (48)..(485): NCBI GI: 21586474 NCBI Desc: auxin influx carrier protein [medicago truncatula]
  misc_feature (44)..(485): NCBI GI: 6689614 NCBI Desc: aux1 protein [zea mays]
MASEKVETIVAGNYMEMERDVVVGGGHGDDQPGGGDAASSGARAAGGKKKLGLSSRLFWHGGSVYDAWFSCASNQVAQVLLTLPYSFSQLGMASGVVFQLFYGLMGSWTAYLISVLYVEYRTRKERDKVDFRNHVIQWFEVLDGLLGKHWRNVGLFFNCTFLLFGSVIQLIACASNIYYINDKYDKRTWTYIFGACCATTVFIPSFHNYRIWSFLGLLMTTYTAWYLTIAAIAHGQVEGVTHSGPSKMVLYFTGATNILYTFGGHAVTVEIMHAMWKPQKFKLIYLVATLYVLTLTLPSASAVYWAFGDMLLDHSNAFSLLPRSGFRDAAVILMLIHQFITFGFACTPLYFVWEKLIGVHETGSVALRAAARLPVVVPIWFLAIIFPFFGPINSTVGSLLVSFTVYIIPALAHMATFAPPAARENAVERPPRGVGGWAGMYAANCFVVAWVLVVGFGFGGWASTVNFVRQVDTFGLFTRCYQCPPKH

SEQ ID NO: 9109 - DNA, 828 bp, Sorghum bicolor
  misc_feature: Ceres ANNOT ID no. 6098711
  misc_feature: Encodes the peptide sequence at SEQ ID NO 9110
atggatagataccacagggtagagaagcctcggaatgacacgccaatcagccagaatgagatcaggatcactactcaggggaggatgaggaactatatcagctatgggatgtcgctgcttgaggaaaatggccatgatgagattaatatcaaggccatgggacgggccataaataagacagttatggttgttgaattgatcaagagaagggttggaggtcttcatcagaacactgctactgaatctgttgatatcacggacacatgggaacctttggaagaaggccttctcccactagagacaactcgccatgtgtcgatgatcactgtaacactgtcaaagaagcctctggatacatcatctccaggataccaaccacctatcccagctgaagaggtgaaacctgcttttgactatgatcatgaagaatcgtatcccactggtcgtggaagaggacgttttggtgggagaagaggcaggggaagaggtatgagcaatggtccccctccacctgcttatggttacaatgacgagtgggaggaggatggagattattacaacagagggcgtgggagaggaaggtcacgtggacgaggagggagaggccgtggtggctactatggaggtgggaggcgtggtggctacggttatgattatggctatggcgggagaggcgggtactatgaagagcaagatgaatactacgatgagcccgaagaatatgcccctccccctggccgtgggcgtggcagaggaagaagggggatgccttggcgcgggcgtggtgggcgtgggccgccgcgcggcggccgaggaggctactactag

SEQ ID NO: 9110 - protein, 275 aa, Sorghum bicolor
  misc_feature: Ceres ANNOT ID no. 6098711
  misc_feature (17)..(87): Pfam Id: Alba Pfam Desc: Alba
  misc_feature (1)..(253): NCBI GI: 92873121 NCBI Desc: alba, dna binding [medicago truncatula]
  misc_feature (1)..(246): NCBI GI: 32526671 NCBI Desc: chloroplast nucleoid dna-binding protein -like protein [oryza sativa (japonica cultivar-group)]
  misc_feature (42)..(274): NCBI GI: 8778814 NCBI Desc: t4o12.22 [arabidopsis thaliana]
  misc_feature (15)..(226): NCBI GI: 23485324 NCBI Desc: arabidopsis thaliana at1g20220/t20h2_3-related [plasmodium yoelii yoelii]
  misc_feature (14)..(167): NCBI GI: 51261680 NCBI Desc: mgc84124 protein [xenopus laevis]
MDRYHRVEKPRNDTPISQNEIRITTQGRMRNYISYGMSLLEENGHDEINIKAMGRAINKTVMVVELIKRRVGGLHQNTATESVDITDTWEPLEEGLLPLETTRHVSMITVTLSKKPLDTSSPGYQPPIPAEEVKPAFDYDHEESYPTGRGRGRFGGRRGRGRGMSNGPPPPAYGYNDEWEEDGDYYNRGRGRGRSRGRGGRGRGGYYGGGRRGGYGYDYGYGGRGGYYEEQDEYYDEPEEYAPPPGRGRGRGRRGMPWRGRGGRGPPRGGRGGYY

SEQ ID NO: 9111 - DNA, 708 bp, Sorghum bicolor
  misc_feature: Ceres ANNOT ID no. 6098714
  misc_feature: Encodes the peptide sequence at SEQ ID NO 9112
atgacccccgcgcaggatcccttctacatcgtcaaggacgagatccaggactcgattgataaagtgcaagatactttcctccaatggaagcagacacctgaaaatactggagagtatgtgcatctgaccaaagaactactaaccagctgcgaaagtatccagtggcaggtggatgaactggagaaggcaatttcagttgctcagagagatccagcatactacggacttaatgaggctgaaattgggagaagaaggagctggactagcactgcacgtaaccaggttcttgctttaaagcgaaatgttgaaggtggaagacagaagagtgtctttggacgttcaaccaatccttctgaatcaatcagatccaagaagaatattgtacaagacaatgatgaattcattgcttcagaatctgatcagcagattctcctgataaagcgacaagatgaggagttggatgctcttagtgctagtgtacagcgaattggaggtgtaggtctcactattcatgatgagcttgttgggcaggagaagcttctgggcgagcttagcctcgatatggaaactactacaaatcggcttgactttgtgcagaaaagagtggctatggtcatgaagaaagccagctggaaagggcagatcatgatgatcgcgttccttgttattcttttcatcattcttttcgttttggtgtttttgacttga

SEQ ID NO: 9112 - protein, 235 aa, Sorghum bicolor
  misc_feature: Ceres ANNOT ID no. 6098714
  misc_feature (6)..(99): Pfam Id: Syntaxin-6_N Pfam Desc: Syntaxin 6, N-terminal
  misc_feature (148)..(210): Pfam Id: SNARE Pfam Desc: SNARE domain
  misc_feature (1)..(180): NCBI GI: 498040 NCBI Desc: orf
  misc_feature (44)..(235): NCBI GI: 145323020 NCBI Desc: syp61 (syntaxin of plants 61) [arabidopsis thaliana]
  misc_feature (56)..(199): NCBI GI: 6560768 NCBI Desc: f3m18.7 [arabidopsis thaliana]
  misc_feature (3)..(234): NCBI GI: 20148776 NCBI Desc: syntaxin 6 [chlamydomonas reinhardtii]
  misc_feature (5)..(108): NCBI GI: 45552581 NCBI Desc: cg7736-pd, isoform d [drosophila melanogaster]
MTPAQDPFYIVKDEIQDSIDKVQDTFLQWKQTPENTGEYVHLTKELLTSCESIQWQVDELEKAISVAQRDPAYYGLNEAEIGRRRSWTSTARNQVLALKRNVEGGRQKSVFGRSTNPSESIRSKKNIVQDNDEFIASESDQQILLIKRQDEELDALSASVQRIGGVGLTIHDELVGQEKLLGELSLDMETTTNRLDFVQKRVAMVMKKASWKGQIMMIAFLVILFIILFVLVFLT

SEQ ID NO: 9113 - DNA, 1074 bp, Sorghum bicolor
  misc_feature: Ceres ANNOT ID no. 6098741
  misc_feature: Encodes the peptide sequence at SEQ ID NO 9114
atggaccggggccagcgcctcggccgcgcgctggacgccttcgggggcgacatgtgggcgctggttgacgccgcgctggacgcggccgcgcgggaccgccccgacgacctgcgcgcgcgccgcgacggcatcgtcgagcgcctctacgccgccgccaccgccggctgtagcaactgcgccgggcgtccgccgcctcttgctgctttagcggcggcggggctggatgaggaggacggcgaggaggcggctccggcttcttcagcggtggctttggaggcggaggctgacgcgcaagccggtggcgcagaggagcgagcagaggagctcggcgccggcgcgcccgggctcgagagcaagatcgtggccataagggacttcttggatgaccccaatcagcccgaggacgagctggtgcgcttgctgcagagcctggcagacatggacgtcacctacagcgccctccaggagactgacatcgggcggcaggtgaatggtctgcgcaagcactcttctgccgaggtcaggcgactggtgaagcagctgatcaggaagtggaaggagatagtggacgaatgggtgcgcctgcacaattccggcagtgacggcagcgccacagttatgactgatggtgactccccagataaaatccaaggcaggagccaccaaagccctcgggtttcaggatttcagtattctcccagcccacagaggcaaaatggttcagcttcagagagggctatcaatgggtttgattcaacaatggatgcaaagcgtagggccagccctgtaccagcacatcataattccaagcagatgaacaacaaccataactctgctactactacgtcatctgctccagctaaagtgacaagggagcaaaggcagagtcttttggaccttgacaagcttgactctgctaggaagaggctccaggagaattatcaagaagcacaaaatgccaaaaagcagaggacaatccaagtgatggacatcaatgacataccgaagccaaaaaacagaaacgccttcatccgcaagagcgccagcagtgggctcccggcgaggaaccgataa

SEQ ID NO: 9114 - protein, 357 aa, Sorghum bicolor
  misc_feature: Ceres ANNOT ID no. 6098741
  misc_feature (114)..(199): Pfam Id: TFIIS Pfam Desc: Transcription elongation factor S-II protein N terminal
  misc_feature (119)..(357): NCBI GI: 115484349 NCBI Desc: os11g0166800 [oryza sativa (japonica cultivar-group)]
  misc_feature (11)..(351): NCBI GI: 92873111 NCBI Desc: transcription factors tfiis, elongin a, crsp70, conserved [medicago truncatula]
  misc_feature (11)..(350): NCBI GI: 18416107 NCBI Desc: transcription elongation factor-related [arabidopsis thaliana]
  misc_feature (11)..(350): NCBI GI: 72384441 NCBI Desc: 52o08_11 [brassica rapa subsp. pekinensis]
  misc_feature (56)..(350): NCBI GI: 20147241 NCBI Desc: at5g09850/myh9_6 [arabidopsis thaliana]
MDRGQRLGRALDAFGGDMWALVDAALDAAARDRPDDLRARRDGIVERLYAAATAGCSNCAGRPPPLAALAAAGLDEEDGEEAAPASSAVALEAEADAQAGGAEERAEELGAGAPGLESKIVAIRDFLDDPNQPEDELVRLLQSLADMDVTYSALQETDIGRQVNGLRKHSSAEVRRLVKQLIRKWKEIVDEWVRLHNSGSDGSATVMTDGDSPDKIQGRSHQSPRVSGFQYSPSPQRQNGSASERAINGFDSTMDAKRRASPVPAHHNSKQMNNNHNSATTTSSAPAKVTREQRQSLLDLDKLDSARKRLQENYQEAQNAKKQRTIQVMDINDIPKPKNRNAFIRKSASSGLPARNR

SEQ ID NO: 9115 - DNA, 1440 bp, Sorghum bicolor
  misc_feature: Ceres ANNOT ID no. 6098745
  misc_feature: Encodes the peptide sequence at SEQ ID NO 9116
atgcatctgagcgcgaacgaggggatcgagggcgtgcggttcgcggtgacgggcgggcagggcttcgtcggcgccgcactctgcctcgagctgctccgccgcggcgcgcgcgaggtccgctccttcgacctccgcgccgtctccgcctggtccccgcagctgctcgacgccggcgtccgcctcatccaaggggatgttagaaacaaggatgaagtggggagggctttccgcggagtggactgtgtcttccaccttgcttcttatggcatgtcagggaaggagatggtgcaggctgggagatgcgatcagatcaacataagcgggacctgcaatgtgctcgatgcttgccatgaacatggtgttagaaggcttgtttatgtgagcacgtacaatgtggtgtttggagggaagccgatcgccaacggaaatgaggcgctgccttatttccctatcgaagaccatgtcgatgcttatgggcgcagcaaatcagttgctgaacagttggtactgaagagtaatgggcggccggctaaaagtgataaaagtacatgtctttatacatgtgctattcgccctgcagctatatatggcccaggtgaagagcgtcacattccaagaatcctgtcacttgcaaagttgggattagcattcttcaagattgggggcccagatgtgaagacagattgggtctatatcgataatctagttcttgctctgatattagcaagcatgggacttttagatgacattcctgacaggaagggaacacctgtagcagctggtcaggcgtatttcatctgtgatggatcaccatgcaatacttttgaatttatcatcagccccctatttcaaagtttgggttatgctgctcctcgagtggcgctggatacctctgtcgcccttgccatttcaagaatatttttattcatatctacaatgttctatccatggctcgattgtaaatggatcccacagcctctaattcttcctgctgaagtgtataaggttggtgttacgcactacttttcgttcctgaaagctagagaagaactcggctatgtacctatggtgagcccccgggaaggcttggctgcaactatctcgtattggcaggagtggaagagaagggaactagatggcccgaccatatttacctggctggctgtaataattgggatgctggctgtattttcttctgcttatcttccaccagttggcccgctgaaatgggtgcttgacatccatttgtttgtttttcgatcaatgctggtgatccggctggtctttgtgacagcagttgcagcgcatcttggtgaagctgtgtatgcctggttcttggccaaaaaggttgatccaaggaatgctacagggtggttttggcaaacctttgttctagggatcttctctctcaggtatcttctcaagagagccagagggtga

SEQ ID NO: 9116 - protein, 479 aa, Sorghum bicolor
  misc_feature: Ceres ANNOT ID no. 6098745
  misc_feature (15)..(301): Pfam Id: 3Beta_HSD Pfam Desc: 3-beta hydroxysteroid dehydrogenase/isomerase family
  misc_feature (14)..(261): Pfam Id: Epimerase Pfam Desc: NAD dependent epimerase/dehydratase family
  misc_feature (16)..(239): Pfam Id: NAD_binding_4 Pfam Desc: Male sterility protein
  misc_feature (16)..(403): NCBI GI: 116268111 NCBI Desc: nad(p) dependent steroid dehydrogenase-like [homo sapiens]
  misc_feature (16)..(353): NCBI GI: 18043625 NCBI Desc: nad(p) dependent steroid dehydrogenase-like [homo sapiens]
  misc_feature (16)..(353): NCBI GI: 123980766 NCBI Desc: nad(p) dependent steroid dehydrogenase-like [synthetic construct]
  misc_feature (51)..(403): NCBI GI: 119615929 NCBI Desc: nad(p) dependent steroid dehydrogenase-like, isoform cra_c [homo sapiens]
  misc_feature (16)..(374): NCBI GI: 63034416 NCBI Desc: 4alpha-carboxysterol-c3-dehydrogenase/c4-decarboxylase isoform 1-1 [arabidopsis thaliana]
MHLSANEGIEGVRFAVTGGQGFVGAALCLELLRRGAREVRSFDLRAVSAWSPQLLDAGVRLIQGDVRNKDEVGRAFRGVDCVFHLASYGMSGKEMVQAGRCDQINISGTCNVLDACHEHGVRRLVYVSTYNVVFGGKPIANGNEALPYFPIEDHVDAYGRSKSVAEQLVLKSNGRPAKSDKSTCLYTCAIRPAAIYGPGEERHIPRILSLAKLGLAFFKIGGPDVKTDWVYIDNLVLALILASMGLLDDIPDRKGTPVAAGQAYFICDGSPCNTFEFIISPLFQSLGYAAPRVALDTSVALAISRIFLFISTMFYPWLDCKWIPQPLILPAEVYKVGVTHYFSFLKAREELGYVPMVSPREGLAATISYWQEWKRRELDGPTIFTWLAVIIGMLAVFSSAYLPPVGPLKWVLDIHLFVFRSMLVIRLVFVTAVAAHLGEAVYAWFLAKKVDPRNATGWFWQTFVLGIFSLRYLLKRARG

SEQ ID NO: 9117 - DNA, 1371 bp, Sorghum bicolor
  misc_feature: Ceres ANNOT ID no. 6098777
  misc_feature: Encodes the peptide sequence at SEQ ID NO 9118
atgtcattccgtagcatcgtgcgtgatgtaagggatggtttcgggagcttatctaggagggggtttgaggtcaggtttctgagtcctcgcagagggaaatctcatggtgctgtccatgaactgcacgacccagtgcctgtggtacagagcagctgctgggctagcttgcctcctgaattacttcgagatgtgattgagaggttggagaccagtgaggatacatggccttctaggaagcatgtagttgcttgtgcagctgtctgcagaacatggagggagatgtgtagagagattgtcaagagcccagaggtctctggaaaaatcacttttcctgtttccctaaagcagcctgggcctcgagatggaactattcagtgtttcattaagagggataaatctacccaagtctacagtctgtaccttagttttagctctgctgtccctgccgaagatggtaaattccttctatcagccaaaaggaactgccgtccaacatatacagaatatacaatatcaataaattctggtgatatatctaggtctacaagtaacaacacatacattgggaaattaaggtcaaatttccttggtacaaaatttgtaatatacgatactcagccaccatataatgcaactagtcctaccgtggcagggaaaacaaaccagagattctactccaagaagggggggtcgaccaagggttcttgcagccgttacagcataggacaagtctcatacgagctgaatgtcctgggaactcgaggtccaaggcggatgaactgcgtaatgcactccatcccagcttcatgcctcgaggctggtggcagtgtcccttgccagccggacagcattgttgcccactctgttggcgaaatgttcagcagcatccccttgtcaaagtcatctactatggaccactctatgcacttcagcagttcccggttctctgacgccataacagcggatgccattgttagcggaggccaggcattgagcaacgctgatgacgaagagagcacggacacacctttggtcctccgcaacaaggctccgagatggcatgagcagctgcagtgctggtgcctcaacttccggggtcgggtgaccgtcgcctcggtcaagaacttccagctagtcgctgctgtgatgacgcagcctgccgtcggagccccgaccccgtcgcaggcagccccgctgccactgccagctccagctccaggtccgcctctgccagaccaggagaaggtcttactgcagttcgggaaggtcggcaaggacattttcaccatggactactgctacccgctgtccgccttccaggccttcgccatctgcctcagcagcttcgacaccaagctggcttgcgaataa

SEQ ID NO: 9118 - protein, 456 aa, Sorghum bicolor
  misc_feature: Ceres ANNOT ID no. 6098777
  misc_feature (117)..(450): Pfam Id: Tub Pfam Desc: Tub family
  misc_feature (51)..(106): Pfam Id: F-box Pfam Desc: F-box domain
  misc_feature (1)..(456): NCBI GI: 90399022 NCBI Desc: h0701f11.8 [oryza sativa (indica cultivar-group)]
  misc_feature (1)..(456): NCBI GI: 5777631 NCBI Desc: caa303719.1 protein [oryza sativa]
  misc_feature (1)..(456): NCBI GI: 32480039 NCBI Desc: osjnba0039k24.2 [oryza sativa (japonica cultivar-group)]
  misc_feature (116)..(456): NCBI GI: 115484341 NCBI Desc: os11g0163600 [oryza sativa (japonica cultivar-group)]
  misc_feature (1)..(303): NCBI GI: 7635492 NCBI Desc: tubby-like protein [cicer arietinum]
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
  misc_feature: The sequence is a functional homolog of SEQ ID NO 460 in the 10/666,642 US patent application
MSFRSIVRDVRDGFGSLSRRGFEVRFLSPRRGKSHGAVHELHDPVPVVQSSCWASLPPELLRDVIERLETSEDTWPSRKHVVACAAVCRTWREMCREIVKSPEVSGKITFPVSLKQPGPRDGTIQCFIKRDKSTQVYSLYLSFSSAVPAEDGKFLLSAKRNCRPTYTEYTISINSGDISRSTSNNTYIGKLRSNFLGTKFVIYDTQPPYNATSPTVAGKTNQRFYSKKGGSTKGSCSRYSIGQVSYELNVLGTRGPRRMNCVMHSIPASCLEAGGSVPCQPDSIVAHSVGEMFSSIPLSKSSTMDHSMHFSSSRFSDAITADAIVSGGQALSNADDEESTDTPLVLRNKAPRWHEQLQCWCLNFRGRVTVASVKNFQLVAAVMTQPAVGAPTPSQAAPLPLPAPAPGPPLPDQEKVLLQFGKVGKDIFTMDYCYPLSAFQAFAICLSSFDTKLACE

SEQ ID NO: 9119 - DNA, 396 bp, Sorghum bicolor
  misc_feature: Ceres ANNOT ID no. 6098786
  misc_feature: Encodes the peptide sequence at SEQ ID NO 9120
atggcatccaagcttatttccctgttcctggccctgaccatcctctccactgtcctggccctggtgcatggctgcacgccgtactgtcctactccgccggtggtgccgccaccatcgccgccttctggcggtggcggcgggtcgtgcccgatgaacgcgctgaagctggaggtgtgtgccaacgtgctgaacctactgaagctcagcatccccccgaagaacgaccagtgctgtccgctgctggaaggcctggtggacctagacgccgccgtctgcctctgcaccgccatcaaggccaacatcctgggcatcaacctcaacgtgcccgtcgacctgaccctcctcctcaaccactgcggcaagatctgccccgcggacttcacctgccccgcttaa

SEQ ID NO: 9120 - protein, 131 aa, Sorghum bicolor
  misc_feature: Ceres ANNOT ID no. 6098786
  misc_feature (49)..(129): Pfam Id: Tryp_alpha_amyl Pfam Desc: Protease inhibitor/seed storage/LTP family
  misc_feature (1)..(130): NCBI GI: 2226329 NCBI Desc: physical impedance induced protein [zea mays]
  misc_feature (1)..(129): NCBI GI: 115483320 NCBI Desc: os10g0552300 [oryza sativa (japonica cultivar-group)]
  misc_feature (1)..(129): NCBI GI: 39748094 NCBI Desc: lipid transfer protein-like protein [oryza sativa (japonica cultivar-group)]
  misc_feature (1)..(130): NCBI GI: 124484377 NCBI Desc: extensin like protein [ipomoea nil]
  misc_feature (42)..(129): NCBI GI: 21693573 NCBI Desc: extensin-like protein [glycine max]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated salt sensitivity
  misc_feature: Functional homolog of the protein sequence given in SEQ ID NO 13766
  misc_feature: Useful for making plants with modulated oxidative stress sensitivity
  misc_feature: Functional homolog of the protein sequence given in SEQ ID NO 13086
MASKLISLFLALTILSTVLALVHGCTPYCPTPPVVPPPSPPSGGGGGSCPMNALKLEVCANVLNLLKLSIPPKNDQCCPLLEGLVDLDAAVCLCTAIKANILGINLNVPVDLTLLLNHCGKICPADFTCPA

SEQ ID NO: 9121 - DNA, 1023 bp, Sorghum bicolor
  misc_feature: Ceres ANNOT ID no. 6098798
  misc_feature: Encodes the peptide sequence at SEQ ID NO 9122
atggacccgcgcttcccgccgccagcgccgtcgtcctgcttcggcgggggaggggggctgctcccagcgcgggggcaccaccggcgggcgcactcggagacgttcatccggctgcccgacgatgacctgctgctggacgcggacgccgacttcggcttctccgacatcgacttcccctcgctctccgacgactcgcccgcggcgtccgacccgacgccgcagccccagccccaggcgccgccgccacagcagccgatgccgcagcagcaggcggcttcctcggcgccgccgaggccgccgagcggggcgcacatgcggagcctctccctcgacgccgccttcttcgacagcctctcgctgcagggaggaggaggaggaggtggaggtgggggcgtggtggggcacaagaggagcggctccatggacgggtcctcctcgtcgttcgagggcgagtccgcgccgtcgtcgtccgtgtttccggactacgccaagaaggccgtgcccgacgacaagctcgccgagctcgcgctcctcgaccccaagcgcgccaagaggatcctggcgaaccggcagtccgcggcgaggtccaaggagaggaagatcaagtacaccagtgagctggagaggaaggtgcagacgctgcagacagaggccaccacgctttcggcacagctcacgcttcttcagagggacacctcaggtttaaccaccgagaacagggagctgaaactccggttgcaggccatggaagaacaagcgaaactccgagatgctctaaatgacgccctgagagaagaagtccagcggctcaaaatagctgtagggcaggttcctaacatgaacggaaatcccttcaatggaggactaccacagcagcagcagatgccaagctatttctcacaacaacagcagatgcaatacttcggcagccaccagggccagcatcacaatccaaaccatcacccccagaactcttcaaacggtggtggccagtccttgagtgactccatggatttcatgtga

SEQ ID NO: 9122 - protein, 340 aa, Sorghum bicolor
  misc_feature: Ceres ANNOT ID no. 6098798
  misc_feature (179)..(240): Pfam Id: bZIP_1 Pfam Desc: bZIP transcription factor
  misc_feature (177)..(231): Pfam Id: bZIP_2 Pfam Desc: Basic region leucine zipper
  misc_feature (7)..(229): NCBI GI: 62733344 NCBI Desc: bzip transcriptional activator rsg-related [oryza sativa (japonica cultivar-group)]
  misc_feature (1)..(339): NCBI GI: 8777512 NCBI Desc: bzip transcriptional activator rsg [nicotiana tabacum]
  misc_feature (21)..(339): NCBI GI: 113367224 NCBI Desc: bzip transcription factor bzip131 [glycine max]
  misc_feature (160)..(340): NCBI GI: 19401702 NCBI Desc: susceptibility transcription factor rvs1 [oryza sativa]
  misc_feature (26)..(322): NCBI GI: 21553989 NCBI Desc: vire2-interacting protein vip1 [arabidopsis thaliana]
  misc_feature: The sequence is a functional homolog of SEQ ID NO 186 in the 10/225,068US patent application
  misc_feature: The sequence is a functional homolog of SEQ ID NO 2802 in the 10/374,780US patent application
  misc_feature: The sequence is a functional homolog of SEQ ID NO 908 in the 10/225,066US patent application
  misc_feature: Useful for making plants with modulated growth and phenotype characteristics
  misc_feature: The sequence is a functional homolog of SEQ ID NO 186 in the 20050120408 US patent application
  misc_feature: The sequence is a functional homolog of SEQ ID NO. 337 in the 11/188,298 US application
MDPRFPPPAPSSCFGGGGGLLPARGHHRRAHSETFIRLPDDDLLLDADADFGFSDIDFPSLSDDSPAASDPTPQPQPQAPPPQQPMPQQQAASSAPPRPPSGAHMRSLSLDAAFFDSLSLQGGGGGGGGGGVVGHKRSGSMDGSSSSFEGESAPSSSVFPDYAKKAVPDDKLAELALLDPKRAKRILANRQSAARSKERKIKYTSELERKVQTLQTEATTLSAQLTLLQRDTSGLTTENRELKLRLQAMEEQAKLRDALNDALREEVQRLKIAVGQVPNMNGNPFNGGLPQQQQMPSYFSQQQQMQYFGSHQGQHHNPNHHPQNSSNGGGQSLSDSMDFM

SEQ ID NO: 9123 - DNA, 2073 bp, Sorghum bicolor
  misc_feature: Ceres ANNOT ID no. 6098817
  misc_feature: Encodes the peptide sequence at SEQ ID NO 9124
atggcggcgtactaccacggcggcgccggcacggacatccaggccagcaccgacggcctgcagacgctgtacctcatgaacccgagctacgccggctacgcggacgacggcggcgcgtccacggcgccgggggcgaccaacatgatgctcctcaactcggccgtgaccaccatgacgccggcgtccttcgcccaccaccaccagcagcagcagtcgccgtcgtcggccgcgcatcatcagcagcagcagcactttgtcggcatcccgctgcaggcgccgccgtcgggctacaacctgtggaccccggccacggtcgccgcggacatgtcgatgtcgtcgccaacgcaggcgcagactcccggcggcgccgcggcgggtggagtcagcgccgtgctcagcctgtcgtcccgcgaggcagcgccgccgccggtcacggtggccgcggtggccggccccggctgcaccgacgaggcgggcaagtaccacctgggcgtgtcggccacgtcgcaggggcagatggtgatgagctccaagtacctcaaggctgcgcaggagctgctcgacgaggtggtcagcgtcagcaagggcgtcgaggacgccaacaagacgacgaccaagagcctggcggcggtgaagaagaaggaggactcggagggggtgtccggtggcggcaccgaggacggttccggcgcaaagagcggcggcagcggcgcggcggagatgtccaccgcggagcggcaggagctgcagatgaagaagagcaagcttatcaacatgcttgacgaggtggagcagcggtaccggcagtaccacgggcagatgcaggcggtgtcgtcgtcgttcgaggcggcggcgggcgccgggtcggcgcggacgtacacggcgctggcgctgcgcaccatctcgcgtcagttccggtgcctgcgcgacgcgatcgcgtcgcaggtgcgcgccgcgagccgcgcgctgggcgaggacgcggacgccgccgtcgccgccggcggccgcaccgtcggctcccgcctccgctacatcgaccaccagctccggcagcagcgcgcgctccagcagctcggcatgatgcagggcggcgcctggcggccccagcgcggcctccccgagcgctccgtctccatcctccgcgcctggctcttcgaacacttcctgcacccataccccaaggattcggacaagatcatgctcgccaagcaaaccggcctcaccaggagtcaggtgtcgaactggttcatcaacgcgagggtgcggctatggaagcccatggtggaggagatgtacctggaggagaccaaggaccaggacggaggcggcaacgacgaggggaagtccggtggaggagggagcaagagcggggacactgtcgacggcgtcacgccgagggcggacgccatgtcgtccaagtccgcggtggtgcgcgtgggaggcggaggtggggcggcggagagcgcgtccaccaacaagggcatccatggctcctccctgctcgagctcggcggcggtggcgaccaccagcagtctcacgcggggttctacgacgacgatgaagacgacggcgacgacgcgatgggaaggaggctcaagaaggcgcgcggggacgagccgccggcgccggcgttccaccacgtgcacgacatggccgcgctgcacgcgcaggccgcggcggccgcgaggcagcagcacgaggaggtcagccaccgggagctgctcatgaagttcatggagagcggcggcggcggtggcgccggagcgagggaccaccaccaccatcacgacggcggcgggtactcgctgttcgcgccggggccgtacgggcagttcgccgcggagcccgccgcgttcgcgttcgccgggaacggcggggtgtcgctgacgctcggcctcccgcacggcgcggccggaggcagcgccgccgaacagaccgcgtcgttcctcatgggcagcaccacggccggcgccgacagcggcagccacggcgccggcgctggcggctacgacatgaacatgcagagcaccaagtcgttcgcggcgcagctcatgagggacttcgtggcctag

SEQ ID NO: 9124 - protein, 690 aa, Sorghum bicolor
  misc_feature: Ceres ANNOT ID no. 6098817
  misc_feature (172)..(314): Pfam Id: POX Pfam Desc: Associated with HOX
  misc_feature (262)..(690): NCBI GI: 115484293 NCBI Desc: os11g0158600 [oryza sativa (japonica cultivar-group)]
  misc_feature (43)..(449): NCBI GI: 84453182 NCBI Desc: bel1-like homeodomain transcription factor [trifolium pratense]
  misc_feature (173)..(455): NCBI GI: 31323447 NCBI Desc: bell-like homeodomain protein 2 [lycopersicon esculentum]
  misc_feature (169)..(455): NCBI GI: 22652115 NCBI Desc: bel1-related homeotic protein 5 [solanum tuberosum]
  misc_feature (127)..(474): NCBI GI: 22652125 NCBI Desc: bel1-related homeotic protein 29 [solanum tuberosum]
  misc_feature: The sequence is a functional homolog of SEQ ID NO 262 in the 10/666,642US patent application
  misc_feature: Useful for making plants with modulated drought sensitivity
  misc_feature: Useful for making plants with modulated growth and phenotype characteristics
  misc_feature: Useful for making plants with modulated light quality response
  misc_feature: Useful for making plants with modulated low light sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13495
  misc_feature: GREAT-hit functional homolog of the protein sequence given in SEQ ID NO 13498
  misc_feature: The sequence is a functional homolog of SEQ ID NO 262 in the 20070033671 US patent application
  misc_feature: The sequence is a functional homolog of SEQ ID NO. 320 in the 11/188,298 US application
  misc_feature: The sequence is a functional homolog of SEQ ID NO. 499 in the 11/188,298 US application
MAAYYHGGAGTDIQASTDGLQTLYLMNPSYAGYADDGGASTAPGATNMMLLNSAVTTMTPASFAHHHQQQQSPSSAAHHQQQQHFVGIPLQAPPSGYNLWTPATVAADMSMSSPTQAQTPGGAAAGGVSAVLSLSSREAAPPPVTVAAVAGPGCTDEAGKYHLGVSATSQGQMVMSSKYLKAAQELLDEVVSVSKGVEDANKTTTKSLAAVKKKEDSEGVSGGGTEDGSGAKSGGSGAAEMSTAERQELQMKKSKLINMLDEVEQRYRQYHGQMQAVSSSFEAAAGAGSARTYTALALRTISRQFRCLRDAIASQVRAASRALGEDADAAVAAGGRTVGSRLRYIDHQLRQQRALQQLGMMQGGAWRPQRGLPERSVSILRAWLFEHFLHPYPKDSDKIMLAKQTGLTRSQVSNWFINARVRLWKPMVEEMYLEETKDQDGGGNDEGKSGGGGSKSGDTVDGVTPRADAMSSKSAVVRVGGGGGAAESASTNKGIHGSSLLELGGGGDHQQSHAGFYDDDEDDGDDAMGRRLKKARGDEPPAPAFHHVHDMAALHAQAAAAARQQHEEVSHRELLMKFMESGGGGGAGARDHHHHHDGGGYSLFAPGPYGQFAAEPAAFAFAGNGGVSLTLGLPHGAAGGSAAEQTASFLMGSTTAGADSGSHGAGAGGYDMNMQSTKSFAAQLMRDFVA

SEQ ID NO: 9125 - DNA, 2217 bp, Sorghum bicolor
  misc_feature: Ceres ANNOT ID no. 6098824
  misc_feature: Encodes the peptide sequence at SEQ ID NO 9126
atggccagcttcggcgtcgacacccgcccggccgccgcggcctccggcggcggtggcggagcggggacgacgggtgaaggtgcgctctcgttcctctcccgcgggctgcgggaggacctccgcctcatccgggcgcgggccgaggagctcgagacgttcctgagcgcgccggtgccggagcccgagctgttcgcgcgcctccgccgcgcctactcgtcctcggcgtcctcggcgcggacgcggctggacctgtccgcgatcgggaaggcgttcgaggccgacgcgtggagtggcgccagggccgccaggtggaggtgggaggcggaggaggccgaggagtgggagcccgtcaggatggtcaaggcacgcctcagggagctcgagcggaggacgcaggcccagtcgcccagcgacatgctgcacaagctcaagctcagcttgaaatctatgacctttgcgcctgaaacatctgaggatgttccaccactggatttaggagaacttcttgcttattttgtaaaacaatctgtaccactatttgaccaacttggtataaaaagagatgtatgtgacaagttggtggagtctctatgcagcaagcgcaaggaccaccctgcatataggttcttgtcagaaagtgaaccatcttcattgagaaatgacaatgttggggatgaactcgacctaagaatagctagtgtcctacagagtacaggacaccattatgaaggtggattttggagtgatggccctaagtctgacatatctggcaagagacatgttgccatagtcaccactgccagtcttccctggatgactggaacggctgtgaatcctttgtttcgagctgcatacttggctaaatcttccaagcaagatgtaactttggtagtgccctggctttgtaagtcggatcaagaacttgtgtaccccaatagcatgacttttagttcaccacaagagcaagaaacttatatgaggaattggctggaggaaagagttggtttcaagacagacttcaaaatatcgttttatcctggaaagtttcaaaaagaaaggagaagcataattcccgctggggacacttcacagtttataccatcaaaggaagctgatattgcaatcttggaagagcccgagcacctcaactggtatcatcatgggaaacgttggacagacaaattcaatcatgtggtcggtgtagtgcatacaaattatttggagtacatcaagagggagaagaatggtgctattcaggcctttttcgttaagcatattaataacctggtcgccagagcttattgccataagattttgcggctgtctggtgctactcaagatctgcccaagtcgatgatctgcaatgtgcatggtgtgaacccaaagtttctggaggtcggagagaggatagcagcagagcgggagtctggccagcaatccttctctaaaggagcttattttctggggaagatggtatgggccaagggttacagagagttaatagatttgttcgcaaagcacaagagtgatttggaaggcttcaagctggacatctatgggaacggcgaggattcacacgaggtgcaatcggctgccaggaagttgaatctgaacctcaactttcataaaggccgggaccatgctgatgattctcttcatgggtacaaggttttcataaacccgagcatcagcgacgtcctctgcaccgcgaccgcggaggcgctagcgatgggcaagtttgtggtgtgcgccgaccatccatccaacgacttcttccggtcgttccccaactgcctgacctacaaaacatccgaggacttcgtcgccagagtgaaggaagccatgacgcgcgacccgcagccgctgacccccgagcagcggtacgacctgtcctgggaggccgccacccagcggttcatggagcactccgagctcgacaaggtcctgaacagcgacagcagcagcgaatgcaccagctccgtcaccactgaatccggcaagagcagggacacaaggatgaggagatccgcctcggcgccgaacatgtcggacgtcgtggacggtggcctggcgttcgtgcactactgcttcaccggcagcgagctcctgaggctgtcgacgggcgccgtccccggaacccgggactacaacaagcagcatagcttggacctccacctcccaccgccccaggtacagaacccggtctacggctggtag

SEQ ID NO: 9126 - protein, 738 aa, Sorghum bicolor
  misc_feature: Ceres ANNOT ID no. 6098824
  misc_feature (469)..(629): Pfam Id: Glycos_transf_1 Pfam Desc: Glycosyl transferases group 1
  misc_feature (38)..(738): NCBI GI: 76800640 NCBI Desc: digalactosyldiacylglycerol synthase 1 [vigna unguiculata]
  misc_feature (104)..(738): NCBI GI: 49617329 NCBI Desc: digalactosyldiacylglycerol synthase 1 [glycine max]
  misc_feature (110)..(738): NCBI GI: 49617333 NCBI Desc: digalactosyldiacylglycerol synthase 1 [lotus corniculatus var. japonicus]
  misc_feature (70)..(738): NCBI GI: 116310807 NCBI Desc: osigba0092m08.9 [oryza sativa (indica cultivar-group)]
  misc_feature (113)..(738): NCBI GI: 6041825 NCBI Desc: digalactosyldiacylglycerol synthase [arabidopsis thaliana]
  misc_feature (104)..(738): SWISSPROT Homolog: EC 2.4.1.241 Digalactosyldiacylglycerol synthase 1, chloroplast precursor
MASFGVDTRPAAAASGGGGGAGTTGEGALSFLSRGLREDLRLIRARAEELETFLSAPVPEPELFARLRRAYSSSASSARTRLDLSAIGKAFEADAWSGARAARWRWEAEEAEEWEPVRMVKARLRELERRTQAQSPSDMLHKLKLSLKSMTFAPETSEDVPPLDLGELLAYFVKQSVPLFDQLGIKRDVCDKLVESLCSKRKDHPAYRFLSESEPSSLRNDNVGDELDLRIASVLQSTGHHYEGGFWSDGPKSDISGKRHVAIVTTASLPWMTGTAVNPLFRAAYLAKSSKQDVTLVVPWLCKSDQELVYPNSMTFSSPQEQETYMRNWLEERVGFKTDFKISFYPGKFQKERRSIIPAGDTSQFIPSKEADIAILEEPEHLNWYHHGKRWTDKFNHVVGVVHTNYLEYIKREKNGAIQAFFVKHINNLVARAYCHKILRLSGATQDLPKSMICNVHGVNPKFLEVGERIAAERESGQQSFSKGAYFLGKMVWAKGYRELIDLFAKHKSDLEGFKLDIYGNGEDSHEVQSAARKLNLNLNFHKGRDHADDSLHGYKVFINPSISDVLCTATAEALAMGKFVVCADHPSNDFFRSFPNCLTYKTSEDFVARVKEAMTRDPQPLTPEQRYDLSWEAATQRFMEHSELDKVLNSDSSSECTSSVTTESGKSRDTRMRRSASAPNMSDVVDGGLAFVHYCFTGSELLRLSTGAVPGTRDYNKQHSLDLHLPPPQVQNPVYGW

SEQ ID NO: 9127 - DNA, 585 bp, Sorghum bicolor
  misc_feature: Ceres ANNOT ID no. 6098825
  misc_feature: Encodes the peptide sequence at SEQ ID NO 9128
atgcggttgcgccggcgctacgcggaattcctccgccgggcgtccgccctgccgtccctgccgctggtggcctctctccacgccgcggtgctccggcgcgggatccccgccctcctcgcggcgtccctcatccagggctactcagcctgcggggacctcccctccgcgcgcgccctgttcgacgaaacgcccccgacgctctcgtcccgcaccgcgctcgccggcgcgctctcggcgcacggccggtgcgcggaggcgctggcgctgctcgccgtcccggaggcggaggcggacgacagggccgtgacggtgctcctggcggcgtgcgcgcgcgccgggatggtggccgaggggaggcgcgtgttcgcgagggtgccccgccccgcgctgcagcactacacgtgcatggtggagatgctgggacgcgccggggaggtggacgaggcggagcggctcgtggcccggatggaggcgcgccccgacagggtcatcttcgcggcgctcctcgccgcgtgccgcgtgcacggccgcgtcgacgtcgccgagcgggtggccgggctcatgcgccggtatggcattgcgtga

SEQ ID NO: 9128 - protein, 194 aa, Sorghum bicolor
  misc_feature: Ceres ANNOT ID no. 6098825
  misc_feature (11)..(192): NCBI GI: 124359886 NCBI Desc: tetratricopeptide-like helical [medicago truncatula]
  misc_feature (11)..(185): NCBI GI: 87240912 NCBI Desc: tetratricopeptide-like helical [medicago truncatula]
  misc_feature (17)..(189): NCBI GI: 115435084 NCBI Desc: os01g0197500 [oryza sativa (japonica cultivar-group)]
  misc_feature (26)..(190): NCBI GI: 115466006 NCBI Desc: os06g0114300 [oryza sativa (japonica cultivar-group)]
  misc_feature (7)..(184): NCBI GI: 9294022 NCBI Desc: selenium-binding protein-like [arabidopsis thaliana]
MRLRRRYAEFLRRASALPSLPLVASLHAAVLRRGIPALLAASLIQGYSACGDLPSARALFDETPPTLSSRTALAGALSAHGRCAEALALLAVPEAEADDRAVTVLLAACARAGMVAEGRRVFARVPRPALQHYTCMVEMLGRAGEVDEAERLVARMEARPDRVIFAALLAACRVHGRVDVAERVAGLMRRYGIA

SEQ ID NO: 9129 - DNA, 951 bp, Sorghum bicolor
  misc_feature: Ceres ANNOT ID no. 6098829
  misc_feature: Encodes the peptide sequence at SEQ ID NO 9130
atgaacatggagcagcaaatcaagcacagccatctcccgatccgaggcctcagcctccacgtggcccaagcaggcaaaggcgagctgggcacggtggtgttcctgcacgggttcccggagatatggtactcgtggcgccaccagatgctggccgtggccgccgccgggtaccgcgccgtcgcgccggactggcgagggtacgggctctcggaccagccgccggaggcggaggccgcgtcgtacgacgacctggtggaggatctcctcgcaatcctcgatgctctctccattcccaaggctttccttgtggcgaaggatttcggagccatgccagcctatgactttgctcttcgtcaccctagccgcacatgtggtgtcatgtgtttggggatccccttccttcacggtggctcatccttcaccagcttgccagaaggcttctacattttgcgctggcgggaaccaggaagagcagaggctgattttggccggtatgatgtgaagagagttgttcggaccatctacgtgctcttctctaggagcgaaataccaatagcaaaagaaggccaagagattatggaccttgcagacttgtcaacacctcttccagagtggttgactgaggatgatctagctgtgtatgcttcactctatgagaaatcgggtttccggtatccaatggaaatgccatataggtcgctccataaaaggatgccaattgaagatccaagattccaagtcccagtgtttgttgtcatgggggagaaagactatgtgttcaagttccctggtgttgagtccgttttgaaagatggcatcatggagaaattcacaccggacctaaagatcacctacatccctgaaggaagccatttcgttcaggagcagttcccggacaaggtgaatgatctcctggtcagtttcttgaaggaccaccctgtggctgcatag

SEQ ID NO: 9130 - protein, 316 aa, Sorghum bicolor
  misc_feature: Ceres ANNOT ID no. 6098829
  misc_feature (57)..(307): Pfam Id: Abhydrolase_1 Pfam Desc: alpha/beta hydrolase fold
  misc_feature (13)..(315): NCBI GI: 115482748 NCBI Desc: os10g0498300 [oryza sativa (japonica cultivar-group)]
  misc_feature (5)..(310): NCBI GI: 1354849 NCBI Desc: epoxide hydrolase [nicotiana tabacum]
  misc_feature (6)..(185): NCBI GI: 115482744 NCBI Desc: os10g0498100 [oryza sativa (japonica cultivar-group)]
  misc_feature (2)..(309): NCBI GI: 2764804 NCBI Desc: epoxide hydrolase [glycine max]
  misc_feature (7)..(310): NCBI GI: 124360004 NCBI Desc: epoxide hydrolase [medicago truncatula]
MNMEQQIKHSHLPIRGLSLHVAQAGKGELGTVVFLHGFPEIWYSWRHQMLAVAAAGYRAVAPDWRGYGLSDQPPEAEAASYDDLVEDLLAILDALSIPKAFLVAKDFGAMPAYDFALRHPSRTCGVMCLGIPFLHGGSSFTSLPEGFYILRWREPGRAEADFGRYDVKRVVRTIYVLFSRSEIPIAKEGQEIMDLADLSTPLPEWLTEDDLAVYASLYEKSGFRYPMEMPYRSLHKRMPIEDPRFQVPVFVVMGEKDYVFKFPGVESVLKDGIMEKFTPDLKITYIPEGSHFVQEQFPDKVNDLLVSFLKDHPVAA

SEQ ID NO: 9131 - DNA, 855 bp, Sorghum bicolor
  misc_feature: Ceres ANNOT ID no. 6098892
  misc_feature: Encodes the peptide sequence at SEQ ID NO 9132
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
atggccatgaatcatctctcccaagagcacccccaggcctggccctggggtgtggccatgtacacaaacctacactaccaacaccactacgagaaggagcacctgttcgagaagcccctgacgccgagcgacgtgggcaagctcaacaggctggtgatccccaagcagcatgccgaaaggtacttccctctcagtggcgactctggtgagaaaggccttatcttgtccttcgaggacgaggctggcaagccatggcggtttcggtactcgtattggacgagcagccagagctacgtgctcaccaagggctggagccggtacgtcaaggagaagcaacttgacgctggcgacgtggtgcacttcgagaggatgcgtagttttggcatgggtgaccgcctattcatcagctacaggcgtcatggtgagagtgcaacggtggctgcggcaccgccgccgccgccgccgccgcctgccgtgcgcgtggtggcacctgcgcagagcactggcggcggagagcagcagccttggagcccaatgtgctacagcacatcaggctcatacccaaccagcccggcaaattcccatgcctaccgtcactcagtggaccatgaccatagcaacatgcaacatgcaggagaatctcaatcggacagagacaacaggagttgcagtgcagcttcagcaccgtcgtcacggcagctccggctgttcggcgtgaaccttgactgcggtccaggaccggagctggagccagagacaccaacggcaatgtatggctacatgcaccaaagcccctacacttccaataactggtcagcactgaaaatccatcagaatttgacgcatcatatataa

SEQ ID NO: 9132 - protein, 284 aa, Sorghum bicolor
  misc_feature: Ceres ANNOT ID no. 6098892
  misc_feature (35)..(139): Pfam Id: B3 Pfam Desc: B3 DNA binding domain
  misc_feature (1)..(268): NCBI GI: 62701878 NCBI Desc: similar to probable rav2-like dna binding protein [imported] - arabidopsis thaliana [oryza sativa (japonica cultivar-group)]
  misc_feature (22)..(148): NCBI GI: 145357701 NCBI Desc: transcription factor [arabidopsis thaliana]
  misc_feature (31)..(171): NCBI GI: 50251902 NCBI Desc: rav-like b3 domain dna binding protein-like [oryza sativa (japonica cultivar-group)]
  misc_feature (31)..(123): NCBI GI: 116311012 NCBI Desc: h0303a11-b0406h05.5 [oryza sativa (indica cultivar-group)]
  misc_feature (32)..(162): NCBI GI: 18565433 NCBI Desc: dna-binding protein rav2-like [oryza sativa (japonica cultivar-group)]
  misc_feature: The sequence is a functional homolog of SEQ ID NO 1176 in the 10/374,780US patent application
  misc_feature: The sequence is a functional homolog of SEQ ID NO 1177 in the 10/374,780US patent application
  misc_feature: The sequence is a functional homolog of SEQ ID NO 1178 in the 10/374,780US patent application
  misc_feature: The sequence is a functional homolog of SEQ ID NO 1179 in the 10/374,780US patent application
  misc_feature: The sequence is a functional homolog of SEQ ID NO 118 in the 10/666,642US patent application
  misc_feature: The sequence is a functional homolog of SEQ ID NO 1180 in the 10/374,780US patent application
  misc_feature: The sequence is a functional homolog of SEQ ID NO 1181 in the 10/374,780US patent application
  misc_feature: The sequence is a functional homolog of SEQ ID NO 1372 in the 10/412,699US patent application
  misc_feature: The sequence is a functional homolog of SEQ ID NO 1373 in the 10/412,699US patent application
  misc_feature: The sequence is a functional homolog of SEQ ID NO 1374 in the 10/412,699US patent application
  misc_feature: The sequence is a functional homolog of SEQ ID NO 1404 in the 10/666,642US patent application
  misc_feature: The sequence is a functional homolog of SEQ ID NO 20 in the 10/838,616US patent application
  misc_feature: The sequence is a functional homolog of SEQ ID NO 2728 in the 10/374,780US patent application
  misc_feature: The sequence is a functional homolog of SEQ ID NO 30 in the 10/838,616US patent application
  misc_feature: The sequence is a functional homolog of SEQ ID NO 32 in the 10/838,616US patent application
  misc_feature: The sequence is a functional homolog of SEQ ID NO 34 in the 10/838,616US patent application
  misc_feature: The sequence is a functional homolog of SEQ ID NO 36 in the 10/838,616US patent application
  misc_feature: The sequence is a functional homolog of SEQ ID NO 374 in the 10/225,066US patent application
  misc_feature: The sequence is a functional homolog of SEQ ID NO 42 in the 10/838,616US patent application
  misc_feature: The sequence is a functional homolog of SEQ ID NO 44 in the 10/838,616US patent application
  misc_feature: The sequence is a functional homolog of SEQ ID NO 46 in the 10/838,616US patent application
  misc_feature: The sequence is a functional homolog of SEQ ID NO 52 in the 10/838,616US patent application
  misc_feature: The sequence is a functional homolog of SEQ ID NO 53 in the 10/838,616US patent application
  misc_feature: The sequence is a functional homolog of SEQ ID NO 732 in the 11/435,388US patent application
  misc_feature: The sequence is a functional homolog of SEQ ID NO 734 in the 11/435,388US patent application
  misc_feature: The sequence is a functional homolog of SEQ ID NO 736 in the 11/435,388US patent application
  misc_feature: The sequence is a functional homolog of SEQ ID NO 738 in the 11/435,388US patent application
  misc_feature: Useful for making plants with modulated growth and phenotype characteristics
  misc_feature: The sequence is a functional homolog of SEQ ID NO 1372 in the 20040045049 US patent application
  misc_feature: The sequence is a functional homolog of SEQ ID NO 1373 in the 20040045049 US patent application
  misc_feature: The sequence is a functional homolog of SEQ ID NO 1374 in the 20040045049 US patent application
  misc_feature: The sequence is a functional homolog of SEQ ID NO 374 in the 20050160493 US patent application
  misc_feature: The sequence is a functional homolog of SEQ ID NO 20 in the 20060008874 US patent application
  misc_feature: The sequence is a functional homolog of SEQ ID NO 34 in the 20060008874 US patent application
  misc_feature: The sequence is a functional homolog of SEQ ID NO 36 in the 20060008874 US patent application
  misc_feature: The sequence is a functional homolog of SEQ ID NO 42 in the 20060008874 US patent application
  misc_feature: The sequence is a functional homolog of SEQ ID NO 44 in the 20060008874 US patent application
  misc_feature: The sequence is a functional homolog of SEQ ID NO 46 in the 20060008874 US patent application
  misc_feature: The sequence is a functional homolog of SEQ ID NO 1180 in the 20060162006 US patent application
  misc_feature: The sequence is a functional homolog of SEQ ID NO 1181 in the 20060162006 US patent application
  misc_feature: The sequence is a functional homolog of SEQ ID NO 118 in the 20070033671 US patent application
  misc_feature: The sequence is a functional homolog of SEQ ID NO 2728 in the 10/374,780 US patent application
  misc_feature: The sequence is a functional homolog of SEQ ID NO 374 in the 10/225,066 US patent application
  misc_feature: The sequence is a functional homolog of SEQ ID NO 396 in the 10/666,642 US patent application
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: The sequence is a functional homolog of SEQ ID NO. 467 in the 11/188,298 US application
MAMNHLSQEHPQAWPWGVAMYTNLHYQHHYEKEHLFEKPLTPSDVGKLNRLVIPKQHAERYFPLSGDSGEKGLILSFEDEAGKPWRFRYSYWTSSQSYVLTKGWSRYVKEKQLDAGDVVHFERMRSFGMGDRLFISYRRHGESATVAAAPPPPPPPPAVRVVAPAQSTGGGEQQPWSPMCYSTSGSYPTSPANSHAYRHSVDHDHSNMQHAGESQSDRDNRSCSAASAPSSRQLRLFGVNLDCGPGPELEPETPTAMYGYMHQSPYTSNNWSALKIHQNLTHHI

SEQ ID NO: 9133 - DNA, 1827 bp, Sorghum bicolor
  misc_feature: Ceres ANNOT ID no. 6098893
  misc_feature: Encodes the peptide sequence at SEQ ID NO 9134
atggacaaggccgcgctggtgtccgagagcaccgacgacgtcggtcccgcgggcggcggctcgtcgtcgtcgttctcggggctgcgcgcgtacgggcgggcgctggcgcagacgccgcgtcggctggcgcggcgcgcgtgcgcggccacggcgccgcacgaggagatgagccgcgtgcgggcgcggtcgggcacccggatggcgcgcgctctgcggtggtgggacctcgtcgggctggggctcggcggcatggtcggcgccggggtgttcgtcaccacgggccgcgccgcgcggctctacgcggggccagggctcgtcgtgtcctacgccattgcggggctctgcgcgctgctctccgccttctgctacaccgaattcgccgtcgacatgcccgtcgccggcggcgccttcagctacctccgcgtcaccttcggggagttcgcggcgttcctgacgggggcgaacctgatcatggagtacgtcttctccaacgccgccgtggcgcgcagcttcacggcgtacctgggcacggcggtcggcgtggacgcgcccagcaagtggcggatcccagtgccgggcctgcccgaagggttcaaccaggtggaccttgtcgccgtcggcgtcatcctcctgctctccgtctgcatctgctacagcaccaaggagagctcggtggtgaacctggtgctgacgggggtgcacgtggcgttcatcctcttcatcatcgtgatggggttcgtgcacggcgacgcgcggaacctgtcccgccccgccgaccccgtccacaaccccggcggcttcttcccgcacggcgcggcgggggtgttcaacggcgccgccgcggtgtacctgagctacatcggctacgacgccgtgtccaccatggccgaggaagtggagcggcccgaccgcgacatccccgccggcgtctccggctccgtcgtcctcgtcaccgcgctctactgcctcatggctgcctccatgtccatgctcctcccctacgacgcgatcgacccggaggcgccgttctcgggggcgttcaaggggcgggacgggatggcgtgggtgtcgaacgtcatcggcgccggcgccagcctcggcatcctcacgtcgctcatggtggccatgctggggcaggcccggtacctgtgcgtcatcggccgctccggcgtcgtgcccgcctggctcgcccgggtcgaccgccgcaccgccacccccgtcaatgcctccgccttcctcggcctgctgacggcggcgctggcgctgttcacggagctggacgtgctcctgaacctcgtctccatcggcacgctcttcgtcttctacatggtggcaaacgccgtcgtgtaccgccgctacgtcggcgacccctgcccggccggcaccggcaccgcacacgagacgagggcgtggccgacgctggcgttcatcggggccttctccctgatcgcgctctccttcacgctgctgtggcagttcgcgccggggggcgccgccaaggccgtgatgctgtcggcgaccgcggcggccgccgtggccgtggtcgccgcgttccaggcgctggtgccgcaggcgcgggagcccgaggtgtggggcgtgcccgggatgccatgggtgcccgccgcgtccgtcttcctcaacgtcttcctgctcggctcgctggaccgcccgtcgtacgcccggttcggcttcttctccgccgccgtcgtgctggtctacgtgctctacagcgtgcacgccagctacgacgccgaggagggcggcgccgcggcggacggaggcgccggcgccggcgacaagctgcaggaccatgggtgcgaggtgtag

SEQ ID NO: 9134 - protein, 608 aa, Sorghum bicolor
  misc_feature: Ceres ANNOT ID no. 6098893
  misc_feature (75)..(533): Pfam Id: AA_permease Pfam Desc: Amino acid permease
  misc_feature (1)..(607): NCBI GI: 115484255 NCBI Desc: os11g0155500 [oryza sativa (japonica cultivar-group)]
  misc_feature (67)..(607): NCBI GI: 62701650 NCBI Desc: amino acid transporter-like protein [oryza sativa (japonica cultivar-group)]
  misc_feature (67)..(608): NCBI GI: 77553705 NCBI Desc: al162972 amino acid transport-like protein [oryza sativa (japonica cultivar-group)]
  misc_feature (26)..(489): NCBI GI: 38345950 NCBI Desc: osjnbb0038f03.3 [oryza sativa (japonica cultivar-group)]
  misc_feature (145)..(589): NCBI GI: 115459710 NCBI Desc: os04g0543600 [oryza sativa (japonica cultivar-group)]
  misc_feature: The sequence is a functional homolog of SEQ ID NO. 510 in the 11/188,298 US application
MDKAALVSESTDDVGPAGGGSSSSFSGLRAYGRALAQTPRRLARRACAATAPHEEMSRVRARSGTRMARALRWWDLVGLGLGGMVGAGVFVTTGRAARLYAGPGLVVSYAIAGLCALLSAFCYTEFAVDMPVAGGAFSYLRVTFGEFAAFLTGANLIMEYVFSNAAVARSFTAYLGTAVGVDAPSKWRIPVPGLPEGFNQVDLVAVGVILLLSVCICYSTKESSVVNLVLTGVHVAFILFIIVMGFVHGDARNLSRPADPVHNPGGFFPHGAAGVFNGAAAVYLSYIGYDAVSTMAEEVERPDRDIPAGVSGSVVLVTALYCLMAASMSMLLPYDAIDPEAPFSGAFKGRDGMAWVSNVIGAGASLGILTSLMVAMLGQARYLCVIGRSGVVPAWLARVDRRTATPVNASAFLGLLTAALALFTELDVLLNLVSIGTLFVFYMVANAVVYRRYVGDPCPAGTGTAHETRAWPTLAFIGAFSLIALSFTLLWQFAPGGAAKAVMLSATAAAAVAVVAAFQALVPQAREPEVWGVPGMPWVPAASVFLNVFLLGSLDRPSYARFGFFSAAVVLVYVLYSVHASYDAEEGGAAADGGAGAGDKLQDHGCEV

SEQ ID NO: 9135 - DNA, 1518 bp, Sorghum bicolor
  misc_feature: Ceres ANNOT ID no. 6098907
  misc_feature: Encodes the peptide sequence at SEQ ID NO 9136
atgatccgactaccgacgtacgcggcgttcagcctgctggcgacggcgtcggcggcgtactacgcgttcagcagccgggagcagttctacccggcgatggtgtacctctccacgtccaagatctgcttcgtgctgctcctcaacacgggcctcgtcgccatgtgcgtcgcctggcagctcgccaggcgcctcttcctcggcccgctccgggaggctgaggtcgagcgcctcaacgagcagtcctggcgggaggtcatcgagatcctctttgctgtcaccatcttccggcaggacttctcggtgtccttcctcgccatggtcgccgcgctgctcctcgtcaaggcgctgcactggctcgcgcagaagagggtcgagtacatcgagaccaccccctcggtgcccttgctctcgcacgtcaggatcgtctccttcatggttttcctgctcaccgtcgactgcctcttcctgtctaactcgctcaggtcactcatacagaagcgggaggcatccgttgccatcttcttctcctttgagtatatgatattagcaacatccacagtatcaacattcgtgaagtatatattctatgtcagtgacatgctaatggaaggccaatgggagagaaaggcagtgtatacattttacttggagctcatcagtgaccttgtgcacttgtccttatacatgctcttcttcatagctatcttcctgaactacggtgtcccactgcacttgattcgtgagctatatgagaccttccgcaacttcagaatccgcattgcagattatgtgcgctacagaaagatcacttccaacatgaatgaacgctttccagatgctacagcagaagagctcgatgcgagcgatgctacatgtattatttgccgtgaggagatgactacagcaaagaaactgctctgcgggcatctgttccatgtgcattgtctaaggtcttggctagagcgccagcacacttgccctacatgcagagctccaatcattcccgcagataatggacgcgctgcatcagcacgacaacatggagctcaagctggagttcagcctgctgcaggtactgctactccatcctcagaaggagcaccaggtgagaacataagcaggcgccaagcaaaacttgaagctgctgcagcggcagcttctttatatggaagatcttttgtttatcctccagcaaacaccctaaacaggtctggtcctccccagtctacatcaagcacaccacaatctgaagcaagtagctccaatcagtcacaaaaagaccaagaaatgcagttacaaaacagcagtgacggtttagtgcctctgcatgttaatgcaaatggtgctgttggttcaggaacaagcacaagggatcttgaaaattcattgcagaaggcacaagaaaactttattaagagccagattgagatgttacaaatccaactgcaaatggtgcagcgtggtgctgctgcgtcggccagtaacaatgggaatgctgaacacagaaagaatgactga

SEQ ID NO: 9136 - protein, 505 aa, Sorghum bicolor
  misc_feature: Ceres ANNOT ID no. 6098907
  misc_feature (292)..(329): Pfam Id: zf-C3HC4 Pfam Desc: Zinc finger, C3HC4 type (RING finger)
  misc_feature (1)..(425): NCBI GI: 140058509 NCBI Desc: zinc finger, ring-type [medicago truncatula]
  misc_feature (1)..(426): NCBI GI: 92893762 NCBI Desc: zinc finger, ring-type; ringv [medicago truncatula]
  misc_feature (129)..(434): NCBI GI: 6227002 NCBI Desc: contains a pf00097 zinc finger, c3hc4 type (ring finger) domain. ests gbn96912 and gbai994359 come from this gene. [arabidopsis thaliana]
  misc_feature (180)..(434): NCBI GI: 145337183 NCBI Desc: protein binding / zinc ion binding [arabidopsis thaliana]
  misc_feature (1)..(369): NCBI GI: 134035038 NCBI Desc: e3 ubiquitin-protein ligase synoviolin precursor (synovial apoptosis inhibitor 1)
  misc_feature: The sequence is a functional homolog of SEQ ID NO. 271 in the 11/188,298 US application
  misc_feature: The sequence is a functional homolog of SEQ ID NO. 329 in the 11/188,298 US application
MIRLPTYAAFSLLATASAAYYAFSSREQFYPAMVYLSTSKICFVLLLNTGLVAMCVAWQLARRLFLGPLREAEVERLNEQSWREVIEILFAVTIFRQDFSVSFLAMVAALLLVKALHWLAQKRVEYIETTPSVPLLSHVRIVSFMVFLLTVDCLFLSNSLRSLIQKREASVAIFFSFEYMILATSTVSTFVKYIFYVSDMLMEGQWERKAVYTFYLELISDLVHLSLYMLFFIAIFLNYGVPLHLIRELYETFRNFRIRIADYVRYRKITSNMNERFPDATAEELDASDATCIICREEMTTAKKLLCGHLFHVHCLRSWLERQHTCPTCRAPIIPADNGRAASARQHGAQAGVQPAAGTATPSSEGAPGENISRRQAKLEAAAAAASLYGRSFVYPPANTLNRSGPPQSTSSTPQSEASSSNQSQKDQEMQLQNSSDGLVPLHVNANGAVGSGTSTRDLENSLQKAQENFIKSQIEMLQIQLQMVQRGAAASASNNGNAEHRKND

SEQ ID NO: 9137 - DNA, 1461 bp, Sorghum bicolor
  misc_feature: Ceres ANNOT ID no. 6098922
  misc_feature: Encodes the peptide sequence at SEQ ID NO 9138
atgacggaggtggcgctgccccggggcccggccaacctcgcttcccccgcaagccgcgcctcctcgtcctcctcgctgcgctatttagccagtgccgacagcgacgtgctccctggaagcggcagccccgagcggtcagcgggatctacagggagccgaggaatccggcaggcaggagggtcggaggaggaggaggaagaagaggagcggtggtcgttcttggcgctgctgtttgagctgctgcggaagtccctgctcggctgcagtgtggtaggcggcggcggcgaaggtgaaggccgcggctgtgggatggagattgggttgccgacggacgtgcagcacgtggcgcacgtcaccttcgataggttccatggattcctggggctccccgtcgagttcgagcctgaggtgtcccgccgcgctcccagtgccagtgcaagcgtctttggagtttcaacagaatcaatgcagtgttcctacgatgcgagaagaaatagcgtcccaacaatcctgttgatgatgcaaagacgcctttatgaacagggtggtcttcaggcagaaggtattttccgtattaacgcggagaatagccaggaggaatttgtaagagaccagttaaatagtggaattgttccggatggcattgaggtccattgtttggcaggcctaattaaagcctggtttagggagatgccaagtggggtgctggactcgatcccgcctgaacaggtgatgcaatgccaatctgaagaggattgtgctcatgttgctaaatgccttccaccagctgaagctgctttgcttgcttggtctgttaatctgatggctgatgtagtccaagaagaacagataaacaagatgaacgctcgcaatattgctatggtttttgcaccgaatatgactcagatggcagatccattgactgcactgatgtatgctgtgcaagtgatgaattttctgaagatgttaatacaaaggaccctcaaggatagagaagagtccagtccagaggatgttttgctaccccagaaggatccatctgatgaaaatgggcatcagaaacccagcgtgacacttgattctctccttgaggaaggatccaggcgtccctctttcgtcaaggatgagcccctcctgaacagtcctgcacacagtaatgaggacaaacctaatggaatcaatgccgccgaaggagccactcctgctttcactgtcgagacaagtccggagagctccgccagttgctcgcaacctgcacttgctgctcacgctgctactgctgatgcttccaacacaactacaaattctcttcaagggaaggagatccaaaacctgaattataggaggactagaaagggtcagtctgcaacgcgtgccacacctccagctgagaaatcaagaggtgtgagcattgtgagccggataaattccaaggctgaacggattgaagcatggagatga

SEQ ID NO: 9138 - protein, 486 aa, Sorghum bicolor
  misc_feature: Ceres ANNOT ID no. 6098922
  misc_feature (168)..(305): Pfam Id: RhoGAP Pfam Desc: RhoGAP domain
  misc_feature (105)..(151): Pfam Id: PBD Pfam Desc: P21-Rho-binding domain
  misc_feature (62)..(486): NCBI GI: 110676572 NCBI Desc: rhogap1 [nicotiana tabacum]
  misc_feature (62)..(486): NCBI GI: 3695059 NCBI Desc: rac gtpase activating protein 1 [lotus japonicus]
  misc_feature (56)..(486): NCBI GI: 87240813 NCBI Desc: rhogap; wiscott-aldrich syndrome, c-terminal [medicago truncatula]
  misc_feature (81)..(428): NCBI GI: 34451568 NCBI Desc: rho gtpase activating protein 2 [oryza sativa (japonica cultivar-group)]
  misc_feature (81)..(446): NCBI GI: 116309679 NCBI Desc: h0404f02.3 [oryza sativa (indica cultivar-group)]
MTEVALPRGPANLASPASRASSSSSLRYLASADSDVLPGSGSPERSAGSTGSRGIRQAGGSEEEEEEEERWSFLALLFELLRKSLLGCSVVGGGGEGEGRGCGMEIGLPTDVQHVAHVTFDRFHGFLGLPVEFEPEVSRRAPSASASVFGVSTESMQCSYDARRNSVPTILLMMQRRLYEQGGLQAEGIFRINAENSQEEFVRDQLNSGIVPDGIEVHCLAGLIKAWFREMPSGVLDSIPPEQVMQCQSEEDCAHVAKCLPPAEAALLAWSVNLMADVVQEEQINKMNARNIAMVFAPNMTQMADPLTALMYAVQVMNFLKMLIQRTLKDREESSPEDVLLPQKDPSDENGHQKPSVTLDSLLEEGSRRPSFVKDEPLLNSPAHSNEDKPNGINAAEGATPAFTVETSPESSASCSQPALAAHAATADASNTTTNSLQGKEIQNLNYRRTRKGQSATRATPPAEKSRGVSIVSRINSKAERIEAWR

SEQ ID NO: 9139 - DNA, 1656 bp, Sorghum bicolor
  misc_feature: Ceres ANNOT ID no. 6098924
  misc_feature: Encodes the peptide sequence at SEQ ID NO 9140
  misc_feature: Down-regulated in shoot tissues in response to salicylic acid treatment
atggaggccaccgcgcccgcgctctcgctctcgctcgcgctccactcgtccccggccgtcgcccgccgctcggcagggaagccaatcttcgcctacctccaccgtggcgggccttccacggcctcctccgtccacctccgcgcgtcccggacccccgccagctctccggtatggagaagacggaggagggggagcgggctggttgtgcgcgcggagatgttcggccaactcaccaccgggctcgagtccgcctggaacaagctgcgcggcgttgacgtgctaacaaaggaaaatatcgccgaaccaatgcgggacattaggcgagcacttctggaagcagatgttagtttgcccgttgtgagacgatttgtttcatctgttagtgataaggctctaggtgcaaatgctatcagaggagtccggccagaccagcaattagtgaagattgtgcatgacgaacttgtacaactgatgggtggagaagtatcagatctggtattttcaaaaagtggcccgacagttatcttgctcgcaggtctacagggtgttgggaagactactgtttgcgcaaagcttgcattctatttgaagaaactggggaagagctgtatgctggttgctgcagatgtttacaggcctgccgccattgatcaactcactatactgggtaaacaggtgggtgtaccagtttactcggaagggacagaagccaaacctacacaaataaccaagaatgctatggaagaggccaaaagcaagaatattgatgctattgtggtggatactgctggaagactgcagattgataaatcaatgatggatgaattgaaagaagtgaagaaggctgttaatcctacagaagttctgcttgtcgttgatgccatgactggccaagaagctgcagcactagtcaccaccttcaatattgagattggtatcactggtgctatattgactaaattggatggtgactccaggggcggagccgcactaagtgttaaagaggtctctgggaagcccatcaagtttgttgggcgtggggaacgattggaggaccttgagcttttctaccctgatcgcatggcacagcgagtattgggaatgggagatgtactctcatttgttgaaaagacacaagaagttatgcggcaagaagaggctgtagaattacagaaaaagatcatgagtgcaaaattcgacttcaacgacttcttaaaacaatctcaaaatgttgcgaaaatgggttccatgagccgcattattggaatgatgccaggcatgaacaagataactcctgcacaaattcgagaagctgagaaaagacttgcattcgtggagtcaatgatcaatgccatgactgctgaggaaagggagaagccagagttactggctgagtcacgtgagaggaggataagagtagcagaggagtctggaaagactgaacaagaggtgagccaactagttgcccagcttttccaaatgcgtgctcagatgcagaagttgatgagtatggtgcaaggacaagatgcaatagcagggatgggagatctcatggactcgcttaaagctgaagagaaggctcctcctggcaccgcgcggcgcaggagaaggaatagcaagcccaaacaaagggagttggacgcagttctgagctag

SEQ ID NO: 9140 - protein, 551 aa, Sorghum bicolor
  misc_feature: Ceres ANNOT ID no. 6098924
  misc_feature (171)..(367): Pfam Id: SRP54 Pfam Desc: SRP54-type protein, GTPase domain
  misc_feature (398)..(498): Pfam Id: SRP_SPB Pfam Desc: Signal peptide binding domain
  misc_feature (74)..(159): Pfam Id: SRP54_N Pfam Desc: SRP54-type protein, helical bundle domain
  misc_feature (174)..(352): Pfam Id: CbiA Pfam Desc: CobQ/CobB/MinD/ParA nucleotide binding domain
  misc_feature (27)..(542): NCBI GI: 3746964 NCBI Desc: signal recognition particle 54 kda subunit precursor [arabidopsis thaliana]
  misc_feature (67)..(537): NCBI GI: 3746903 NCBI Desc: signal recognition particle 54 kda subunit precursor [pisum sativum]
  misc_feature (73)..(539): NCBI GI: 119510257 NCBI Desc: signal recognition particle protein [nodularia spumigena ccy9414]
  misc_feature (73)..(545): NCBI GI: 113476149 NCBI Desc: signal recognition particle protein [trichodesmium erythraeum ims101]
  misc_feature (73)..(542): NCBI GI: 22299516 NCBI Desc: signal recognition particle protein [thermosynechococcus elongatus bp-1]
  misc_feature: Down-regulated in shoot tissues in response to salicylic acid treatment
MEATAPALSLSLALHSSPAVARRSAGKPIFAYLHRGGPSTASSVHLRASRTPASSPVWRRRRRGSGLVVRAEMFGQLTTGLESAWNKLRGVDVLTKENIAEPMRDIRRALLEADVSLPVVRRFVSSVSDKALGANAIRGVRPDQQLVKIVHDELVQLMGGEVSDLVFSKSGPTVILLAGLQGVGKTTVCAKLAFYLKKLGKSCMLVAADVYRPAAIDQLTILGKQVGVPVYSEGTEAKPTQITKNAMEEAKSKNIDAIVVDTAGRLQIDKSMMDELKEVKKAVNPTEVLLVVDAMTGQEAAALVTTFNIEIGITGAILTKLDGDSRGGAALSVKEVSGKPIKFVGRGERLEDLELFYPDRMAQRVLGMGDVLSFVEKTQEVMRQEEAVELQKKIMSAKFDFNDFLKQSQNVAKMGSMSRIIGMMPGMNKITPAQIREAEKRLAFVESMINAMTAEEREKPELLAESRERRIRVAEESGKTEQEVSQLVAQLFQMRAQMQKLMSMVQGQDAIAGMGDLMDSLKAEEKAPPGTARRRRRNSKPKQRELDAVLS

SEQ ID NO: 9141 - DNA, 717 bp, Sorghum bicolor
  misc_feature: Ceres ANNOT ID no. 6098935
  misc_feature: Encodes the peptide sequence at SEQ ID NO 9142
atggggatatccaaggtgaccggcatcgccgcgacagcttttcttgtcacatctgttggtctgtgccagctgggcatgggagttgttgtgcttcctttcctacacacctgtattgttgcttttgttgtcacggttgcatcccatgatgccatcaacctaccgtggatcttggggaagaattcggtgggaagatttccattttggtcgtttatactgtttggtcctttcttgttgcttgctcggacatatgcaatggttaagagatacatgaggaaggagtccgtgcatgacaagatcgtggaaggcctatatctgggaggatggccctttctcttgacacatttgccccctggaagcccgtctgtcatagattgcacctgtgagcttccaagaagttgcttcgttccagcagacgagtatctttgtcttgcaacgtgggatacaagagctccaacaccgcaccaaattgaaaaggctgcacgttgggcttgtgaaaagagatctgaggggaagccggtttatgtccattgtgcatttggtcatggaagaagtgcttgtgttgtgtgtgcaattctagtagcgctgggcgttgctgagaactggaaagatgctgagaacatcatccgtgaacgaagaaagataaaaatgaacgcccttcaccggaaaacgttggaagagtggtccaaacaacgagcttctcagaaaaaggataagtag

SEQ ID NO: 9142 - protein, 238 aa, Sorghum bicolor
  misc_feature: Ceres ANNOT ID no. 6098935
  misc_feature (98)..(230): Pfam Id: DSPc Pfam Desc: Dual specificity phosphatase, catalytic domain
  misc_feature (28)..(226): NCBI GI: 88796605 NCBI Desc: methylglyoxal synthase [alteromonas macleodii 'deep ecotype']
  misc_feature (58)..(230): NCBI GI: 75515002 NCBI Desc: cog0671: membrane-associated phospholipid phosphatase [escherichia coli 53638]
  misc_feature (58)..(230): NCBI GI: 83569240 NCBI Desc: cog0671: membrane-associated phospholipid phosphatase [shigella dysenteriae 1012]
  misc_feature (58)..(230): NCBI GI: 75195524 NCBI Desc: cog0671: membrane-associated phospholipid phosphatase [escherichia coli hs]
  misc_feature (30)..(230): NCBI GI: 113949087 NCBI Desc: diacylglycerol kinase, catalytic region [shewanella baltica os195]
MGISKVTGIAATAFLVTSVGLCQLGMGVVVLPFLHTCIVAFVVTVASHDAINLPWILGKNSVGRFPFWSFILFGPFLLLARTYAMVKRYMRKESVHDKIVEGLYLGGWPFLLTHLPPGSPSVIDCTCELPRSCFVPADEYLCLATWDTRAPTPHQIEKAARWACEKRSEGKPVYVHCAFGHGRSACVVCAILVALGVAENWKDAENIIRERRKIKMNALHRKTLEEWSKQRASQKKDK

SEQ ID NO: 9143 - DNA, 1377 bp, Sorghum bicolor
  misc_feature: Ceres ANNOT ID no. 6098957
  misc_feature: Encodes the peptide sequence at SEQ ID NO 9144
atgcagcccgccgtgcgcacgaggcggcggcgcaccaccaccgtcgtcgtcccgctcccctccgccgtccgccgcgtgccgctgtcccctctggacacgcgctgggtcgcgctgccacccatgtgccatgtcttcttcttccccgctgctgctgctcaggtccctttctccgacatcgtcagcgtcctccgctcctcactcgcggcggtcctcccggcgttccacccgttggccggtgaggtcgcctactcgccacagctgggcacggtctccatcgtctacggcgaggatgatgcgggcggcgttgcgttcgtcgagtctgagacggatctcgacttcgccaggctcgtcgcggaccgggacgacgacgacgacgcgcttctgcagctcgtgccggatatcgcccaggaggagctgccggcgccggtgtttgcggcgcaggtgacggagttcgtccaagggagccggggaatagcgctaggcgtggccttcaaccacgtcgccatggacgggatcggcttctttcggttcatggagatgtggggcgcgtcggcgatggctgccgccggtgccagctctcatgcgaccgaaccaccactacatgaccggaggctcgtacgcttcgacggcgacgaggagttggccggcaggttgttgcggcaggtggcgccggacttgcccaggattgtgccgaaacaacctggttgcacgccccaacaccagctcctactcagccggcgaacattcaccttctccgcacaggcgctgcggcgtctgaagcagcggctcaccgccaccagaccggagttcgccggagcggcgccgccatccaccttcgccacgctggcagcgcacggctgggtctgcttggctcttgccagcggtttcaccgacgccgccccggtgtttgcagtcttcgcctccgactgccgcgcccacatgtcaccgccggtgccggacgcctacgtaggcaactgtgtggcttcgtgcgtggtcgcgctgagcggggaggagctcaccggagcagacgggcctgcggtggcgttcatggccatcagggacgccgtcacggcggcgaagcagcaggacccccttgtggatgtcagcagtttgatcaccaagatcagagccattccgccgggccgcagggtcctcgtggcggggtcgccatggtttccggcgtacgcggtggatttcgggtttgggaagccggagagggtggagagggcgtccttgcaccaggacggcatgatggctgtctacgctgggaaggagactggctcggtgcaggtttctgtggccattgcagcggaaaagatgcaggcattcgagaggatgttcgcagttaagtcgagaagcaatatgtcgaggctttga

SEQ ID NO: 9144 - protein, 458 aa, Sorghum bicolor
  misc_feature: Ceres ANNOT ID no. 6098957
  misc_feature (5)..(450): Pfam Id: Transferase Pfam Desc: Transferase family
  misc_feature (15)..(444): NCBI GI: 115460852 NCBI Desc: os04g0638100 [oryza sativa (japonica cultivar-group)]
  misc_feature (56)..(444): NCBI GI: 115475015 NCBI Desc: os08g0174100 [oryza sativa (japonica cultivar-group)]
  misc_feature (31)..(444): NCBI GI: 32492183 NCBI Desc: osjnbb0034i13.22 [oryza sativa (japonica cultivar-group)]
  misc_feature (26)..(444): NCBI GI: 115466378 NCBI Desc: os06g0145300 [oryza sativa (japonica cultivar-group)]
  misc_feature (62)..(443): NCBI GI: 57899019 NCBI Desc: acyltransferase -like [oryza sativa (japonica cultivar-group)]
MQPAVRTRRRRTTTVVVPLPSAVRRVPLSPLDTRWVALPPMCHVFFFPAAAAQVPFSDIVSVLRSSLAAVLPAFHPLAGEVAYSPQLGTVSIVYGEDDAGGVAFVESETDLDFARLVADRDDDDDALLQLVPDIAQEELPAPVFAAQVTEFVQGSRGIALGVAFNHVAMDGIGFFRFMEMWGASAMAAAGASSHATEPPLHDRRLVRFDGDEELAGRLLRQVAPDLPRIVPKQPGCTPQHQLLLSRRTFTFSAQALRRLKQRLTATRPEFAGAAPPSTFATLAAHGWVCLALASGFTDAAPVFAVFASDCRAHMSPPVPDAYVGNCVASCVVALSGEELTGADGPAVAFMAIRDAVTAAKQQDPLVDVSSLITKIRAIPPGRRVLVAGSPWFPAYAVDFGFGKPERVERASLHQDGMMAVYAGKETGSVQVSVAIAAEKMQAFERMFAVKSRSNMSRL

SEQ ID NO: 9145 - DNA, 732 bp, Sorghum bicolor
  misc_feature: Ceres ANNOT ID no. 6098972
  misc_feature: Encodes the peptide sequence at SEQ ID NO 9146
atggcgtcgggcgtgtcgccgagcatggcgctggcgctggcggggttctgcttcagcctaatcttcatcgccttcgtctgctcccgcctggcctgcgcgctcctccgccgccaccgccgccgcgcccgctcacgcctcgccgccgtcctcccgcggtacgcggccgactacaccttcaccgtcgtccaggtccaccaccccgcggccgacgccgccgccggcgggctcggtcccgccgcggtcgccgccctccccacccgggctttcgccgcgcgccccggcggttcggacgccgactcccagtgcgtcatttgtctcgcagaatacgaagagggggatgttctacgcgttcttcctcactgcggccatgattttcacatggcctgtatagatttatggctggagcagaactcgacctgccccgtctgtagagtctcattgctccataaccctgacagcgagcacactgctcctcctccaccgctacccagtgtggtagtgatcagccctccaagctctcctgaaccatcagcatcagatccatgccgctgcctgtttgccggcaccgggcactcgtcaagggcatcagaggctaccaggaatgagcccgaccaggagaatcaggtggcatctaggtcatcagtggacagcatgccgctgtccgaaggtaaccccactcctgagaataacagccaaacagtaaggaagcagcagatagggccctgcaaatag

SEQ ID NO: 9146 - protein, 243 aa, Sorghum bicolor
  misc_feature: Ceres ANNOT ID no. 6098972
  misc_feature (102)..(143): Pfam Id: zf-C3HC4 Pfam Desc: Zinc finger, C3HC4 type (RING finger)
  misc_feature (4)..(158): NCBI GI: 124360239 NCBI Desc: zinc finger, ring-type [medicago truncatula]
  misc_feature (9)..(164): NCBI GI: 20160754 NCBI Desc: p0503c12.20 [oryza sativa (japonica cultivar-group)]
  misc_feature (11)..(181): NCBI GI: 115489396 NCBI Desc: os12g0596200 [oryza sativa (japonica cultivar-group)]
  misc_feature (68)..(169): NCBI GI: 115439793 NCBI Desc: os01g0736600 [oryza sativa (japonica cultivar-group)]
  misc_feature (62)..(184): NCBI GI: 115480585 NCBI Desc: os09g0554200 [oryza sativa (japonica cultivar-group)]
  misc_feature: The sequence is a functional homolog of SEQ ID NO 1133 in the 10/666,642US patent application
  misc_feature: The sequence is a functional homolog of SEQ ID NO 670 in the 10/666,642US patent application
  misc_feature: Useful for making plants with modulated growth and phenotype characteristics
  misc_feature: The sequence is a functional homolog of SEQ ID NO 1133 in the 20070033671 US patent application
  misc_feature: The sequence is a functional homolog of SEQ ID NO 670 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MASGVSPSMALALAGFCFSLIFIAFVCSRLACALLRRHRRRARSRLAAVLPRYAADYTFTVVQVHHPAADAAAGGLGPAAVAALPTRAFAARPGGSDADSQCVICLAEYEEGDVLRVLPHCGHDFHMACIDLWLEQNSTCPVCRVSLLHNPDSEHTAPPPPLPSVVVISPPSSPEPSASDPCRCLFAGTGHSSRASEATRNEPDQENQVASRSSVDSMPLSEGNPTPENNSQTVRKQQIGPCK

SEQ ID NO: 9147 - DNA, 1500 bp, Sorghum bicolor
  misc_feature: Ceres ANNOT ID no. 6098978
  misc_feature: Encodes the peptide sequence at SEQ ID NO 9148
atgctccaactcgcccccaccccgcggccgccgtcgccggcggccgctggccggcgtaggccccgtcactccacctccatcgcatgcatctgctgctcgagcgtgcacgagctggagcggtccccgagcccgcgcccgggcgcgtcgtcgctgccgccgctgcaggaggcgaagcgggtggtgctggtgcggcacggccagagcacgtggaacgccgagggccgcatccaggggagctccgacctctccgtgctcacgcccaagggggagtcccaggccgagacctcccgccagatgctcctctccgactccttcgacgcctgcttcaccagcccgctggcgcgctcccgccgcaccgccgagatcatctgggaggggcgtcacgaccacctcatcccggactccgacctccgagagatcgatctctactcgttccagggactgctcaagcatgaagggaaggagaggtacggggttctgtaccggcagtggcagaagaatgcagccaacttcagcattgacggccactacccggtgcaggagttgtggggccgcgcacagaactgctgggagaggattttagcacaccagggcaagtcagtgcttgtggttgcgcacaatgcagtgaatcaggcacttgttgccacctctttgggacttggtgcggagtactttcgggttttgctccagagtaattgtggtgtcagtgtgctggacttcaccccacagactgctggaggtcctcctagtgtttgtcttaaccgcttaaatcagaccccaaattctcctgttgctgggggaagttctgctggaagaaagacaagcaagaggatcattctggcctgtcaaggggctacacaaagcagttctgagattagcttaggtggaatgggatatgcaccgctgaacatgcttgggactatacagtctcagaagactgcagaactactactggatttgaaggtcaacggcattatctgtagcccacaagttgcagctgttgatactgcaactgttatatgtgaggtccaagaggctgcagattgcttaggtgctgattgtgtacctcgttacgtagaaatgaaaaggttgatagaacttgaaattgaagatgcctttcaagcaaagcagaagagctttggggaaatagttcgatctggttggttgagcggcatggaatacaaattactggagcgactatgggctcagtccaagaatgcatggcaggcactgctaaatgaattaccagatgatacatcagaacatgtccttgtggccgtaggtcatcctgccattcacctagctctaatctgccggtgtcttgatttgccaatggagtacgtgtcgtcttttcacctggacgatggcagcatcagtgtgatggatttcccagatgggccgaaaggaagaggtatcatcagatgcataaactacacagcccatctgggaagatggtcaatacccattacaaggccaatggagaacgatgaagaattctaa

SEQ ID NO: 9148 - protein, 499 aa, Sorghum bicolor
  misc_feature: Ceres ANNOT ID no. 6098978
  misc_feature (59)..(213): Pfam Id: PGAM Pfam Desc: Phosphoglycerate mutase family
  misc_feature (277)..(436): Pfam Id: PGAM Pfam Desc: Phosphoglycerate mutase family
  misc_feature (59)..(483): NCBI GI: 17230830 NCBI Desc: phosphoglycerate mutase [nostoc sp. pcc 7120]
  misc_feature (59)..(483): NCBI GI: 75909856 NCBI Desc: phosphoglycerate/bisphosphoglycerate mutase [anabaena variabilis atcc 29413]
  misc_feature (61)..(482): NCBI GI: 86608499 NCBI Desc: phosphoglycerate mutase family protein [cyanobacteria bacterium yellowstone b-prime]
  misc_feature (59)..(483): NCBI GI: 23128494 NCBI Desc: cog0406: fructose-2,6-bisphosphatase [nostoc punctiforme pcc 73102]
  misc_feature (59)..(483): NCBI GI: 67923033 NCBI Desc: phosphoglycerate/bisphosphoglycerate mutase [crocosphaera watsonii wh 8501]
MLQLAPTPRPPSPAAAGRRRPRHSTSIACICCSSVHELERSPSPRPGASSLPPLQEAKRVVLVRHGQSTWNAEGRIQGSSDLSVLTPKGESQAETSRQMLLSDSFDACFTSPLARSRRTAEIIWEGRHDHLIPDSDLREIDLYSFQGLLKHEGKERYGVLYRQWQKNAANFSIDGHYPVQELWGRAQNCWERILAHQGKSVLVVAHNAVNQALVATSLGLGAEYFRVLLQSNCGVSVLDFTPQTAGGPPSVCLNRLNQTPNSPVAGGSSAGRKTSKRIILACQGATQSSSEISLGGMGYAPLNMLGTIQSQKTAELLLDLKVNGIICSPQVAAVDTATVICEVQEAADCLGADCVPRYVEMKRLIELEIEDAFQAKQKSFGEIVRSGWLSGMEYKLLERLWAQSKNAWQALLNELPDDTSEHVLVAVGHPAIHLALICRCLDLPMEYVSSFHLDDGSISVMDFPDGPKGRGIIRCINYTAHLGRWSIPITRPMENDEEF

SEQ ID NO: 9149 - DNA, 1536 bp, Sorghum bicolor
  misc_feature: Ceres ANNOT ID no. 6098981
  misc_feature: Encodes the peptide sequence at SEQ ID NO 9150
atgaggcgaggcaagggcgacgatccggcgatcgccgccgccgctgccatcgccgtgctctgcgtcacatcagcggtgctcctggtcaacggcgccaccgagggagaagagctcacgacgcagctgtccaacggcttcaccgcggcacacgcggcgggcgcgccggtgccgttcgagccggtgctgtacgcggccagcggcgccttcgcgttcggcttcctccgcgtcggcgcggcgtcgctggacctcgccgtggtccacctcccgtcctccttccccgtctggcgcgccacgccggcccgcctcgggaactggtcgcgcccggccacgctcacgttcgacgacggcagcctggtcctcctcaccgaccacgacgacaacgacgacgtgctgtggcggacggtcgacgccgtcggcgacgtcgtggtgctgctcgagtcgtccaacctcgtcgtgcggcggtacgagaggacggtgccggagtgggagagcttcgaccacccgtccgacacgctggtcctgggccagaacttcacgggctcctcgccgccgctcgtctccgcgaaccgccgcttcgcgctgcggctcgggaagacgtacatggcgctgcacatggagttctacggcggcggccgcacgaagatgacgccgacgtactggcggcacacggcgctgatggccaacccggagaacgccacggagccgccggtgtacggccgcctcgacgcccgcgggttcttcggcctgtacctcgacggcgggcgcggtgacgagagggtagacgtgctctcgttcgacacgttcgtgcagaacctcaccggcgtgttccggcggatgacgctggacgacgacggcaacctccgagcgtactactgggccagcggctccaaggcgtggacgtcggactacagggccatctcggagcggtgcgagctgccgacgccgtgcggcgcgtacggcctgtgcgtccccgggaaggccgagtgccagtgcctcctcgacaacagcacgagggccgccgcgccgtcgtgccacgccgaggagaccgccgacctgtgcgccggcagcggacagcagctgggattcgaggtggtgcggcggaagcgggtgtcggtggcgtacaaggaggagctgccgttcgagacgaacaggacggcggcagagtgcgaggcggcgtgcgcggccaactgcagctgctgggccgcgctgcacagcggcgccagcgggtactgctacctcatcgacttccccgtggagacgctggtgtacgaggccgacgaccggaaggtgggctacttcaaggtcaggaagtcgccgccggcgtcgacgacgacgggtatgtcgccggacgtcgccgcagtgacggcagcgctgtcgctggtcctggtcggcctggccatggccggagtttgcatcgggtaccagattcgggagaggagggagcggaggcgagcggggatggagcacgagctggtgccggtgacgtacaaggatctcaggtccatggacagctccaacaattcgttcagggcatga

SEQ ID NO: 9150 - protein, 511 aa, Sorghum bicolor
  misc_feature: Ceres ANNOT ID no. 6098981
  misc_feature (90)..(187): Pfam Id: B_lectin Pfam Desc: D-mannose binding lectin
  misc_feature (139)..(507): NCBI GI: 7340655 NCBI Desc: s-receptor kinase-like protein [arabidopsis thaliana]
  misc_feature (9)..(459): NCBI GI: 115441493 NCBI Desc: os01g0885700 [oryza sativa (japonica cultivar-group)]
  misc_feature (19)..(480): NCBI GI: 115468174 NCBI Desc: os06g0494100 [oryza sativa (japonica cultivar-group)]
  misc_feature (68)..(494): NCBI GI: 38344588 NCBI Desc: osjnba0079m09.4 [oryza sativa (japonica cultivar-group)]
  misc_feature (68)..(494): NCBI GI: 115457624 NCBI Desc: os04g0303500 [oryza sativa (japonica cultivar-group)]
  misc_feature: The sequence is a functional homolog of SEQ ID NO. 495 in the 11/188,298 US application
MRRGKGDDPAIAAAAAIAVLCVTSAVLLVNGATEGEELTTQLSNGFTAAHAAGAPVPFEPVLYAASGAFAFGFLRVGAASLDLAVVHLPSSFPVWRATPARLGNWSRPATLTFDDGSLVLLTDHDDNDDVLWRTVDAVGDVVVLLESSNLVVRRYERTVPEWESFDHPSDTLVLGQNFTGSSPPLVSANRRFALRLGKTYMALHMEFYGGGRTKMTPTYWRHTALMANPENATEPPVYGRLDARGFFGLYLDGGRGDERVDVLSFDTFVQNLTGVFRRMTLDDDGNLRAYYWASGSKAWTSDYRAISERCELPTPCGAYGLCVPGKAECQCLLDNSTRAAAPSCHAEETADLCAGSGQQLGFEVVRRKRVSVAYKEELPFETNRTAAECEAACAANCSCWAALHSGASGYCYLIDFPVETLVYEADDRKVGYFKVRKSPPASTTTGMSPDVAAVTAALSLVLVGLAMAGVCIGYQIRERRERRRAGMEHELVPVTYKDLRSMDSSNNSFRA

SEQ ID NO: 9151 - DNA, 1107 bp, Sorghum bicolor
  misc_feature: Ceres ANNOT ID no. 6099020
  misc_feature: Encodes the peptide sequence at SEQ ID NO 9152
atggctgtcgtcgaagaagacgcggcgccgtctgcagatcccgccgccggttccagtgataacgagatcacagtggaagaggcttctttcgtgcattctgaacctccccaggatggcagcgccccacccgtggtttcctctgacatggaggtgcttcatgacaaggttaagaagcaagtcatcaaagaaggccatggcaggaagccgctcaagttcgcgacgtgctttgtgcactatagagcatgggctcaaggatcgtcgcataaatttgaggatacctggcaagagcagcatccaatcgaactggtacttggaaaagagaaaaaacaaatgtctggtttaggcattggtgttagcagtatgaaaagcggggagcgggcactgttgcatgttggttgggagctaggctatggcaaagaaggaagcttttcattcccaaatgtccctccaatggcagacctggtttatgaagttgaacttattggatttgatgatgttaaagagggtaaagcccgaagtgacatgacagttgaagagaggattgcagctgcagacaggaggaagattgagggcaatggatattttaaagaacagaagcttgaggaagccatgcaacaatatgaaatggcgattgcatacatgggagatgatttcatgtttcaattatttggaaagtacagagacatggccttggctgtgaaaaatccatgccatctcaatatagctgcatgtctgatcaaactgaagagattcgatgaagctattgcgcagtgcagcattgttttgtcagaagatgaaagtaatgtgaaagcactgttcaggcgaggaaaagctaaatctgaacttggccagacagaatcagcgagggaagatttcctgaaagcgaagaagtactccccagaagacaaggagatccttcgagagcttcgtttgctcgcagaacaagacaaggctctgtaccagaagcagaaggagctctacaaaggtctctttgggccaagacctgaagtgaaaccaaagaaggcaaactacctggttgttttctggcagtggctggtgtcattttttctttatctgtttaggatgttcaaacgaaagaaagagtag

SEQ ID NO: 9152 - protein, 368 aa, Sorghum bicolor
  misc_feature: Ceres ANNOT ID no. 6099020
  misc_feature (64)..(161): Pfam Id: FKBP_C Pfam Desc: FKBP-type peptidyl-prolyl cis-trans isomerase
  misc_feature (269)..(302): Pfam Id: TPR_2 Pfam Desc: Tetratricopeptide repeat
  misc_feature (269)..(302): Pfam Id: TPR_1 Pfam Desc: Tetratricopeptide repeat
  misc_feature (1)..(307): NCBI GI: 115484171 NCBI Desc: os11g0148300 [oryza sativa (japonica cultivar-group)]
  misc_feature (6)..(368): NCBI GI: 92873999 NCBI Desc: peptidylprolyl isomerase, fkbp-type [medicago truncatula]
  misc_feature (20)..(336): NCBI GI: 118138347 NCBI Desc: chain a, crystal structure of a multi-domain immunophilin from arabidopsis thaliana
  misc_feature (20)..(185): NCBI GI: 88192843 NCBI Desc: chain b, n-terminal domain of fkbp42 from arabidopsis thaliana
  misc_feature (120)..(336): NCBI GI: 145356566 NCBI Desc: trp-containing protein [ostreococcus lucimarinus cce9901]
  misc_feature (20)..(368): SWISSPROT Homolog: EC 5.2.1.8 42 kDa peptidyl-prolyl isomerase
MAVVEEDAAPSADPAAGSSDNEITVEEASFVHSEPPQDGSAPPVVSSDMEVLHDKVKKQVIKEGHGRKPLKFATCFVHYRAWAQGSSHKFEDTWQEQHPIELVLGKEKKQMSGLGIGVSSMKSGERALLHVGWELGYGKEGSFSFPNVPPMADLVYEVELIGFDDVKEGKARSDMTVEERIAAADRRKIEGNGYFKEQKLEEAMQQYEMAIAYMGDDFMFQLFGKYRDMALAVKNPCHLNIAACLIKLKRFDEAIAQCSIVLSEDESNVKALFRRGKAKSELGQTESAREDFLKAKKYSPEDKEILRELRLLAEQDKALYQKQKELYKGLFGPRPEVKPKKANYLVVFWQWLVSFFLYLFRMFKRKKE

SEQ ID NO: 9153 - DNA, 1374 bp, Sorghum bicolor
  misc_feature: Ceres ANNOT ID no. 6099021
  misc_feature: Encodes the peptide sequence at SEQ ID NO 9154
atggaaaacctgctacctgaagatgtactcaccaacatcatccaccgtcttgcaccacgctaccttgccatatcccactgtgtttgcaagacctggtgtaccatcattgatgcccacaacctgctccgtgtagacctcctcccacggtcggtgtgtggaatcttcattaactttaatgagttaagcatgtcagaattcttctcccgcccctcaaaaggcccaacggtatctggcaactttgactatttgcctctcagctcccgcatcataggccactgcaatgggcttctcttgtttcacaagtatgtggttaacccagccacacgacagtcagcgccactgcccccatgctcaagcccaaatattgtcgtagagcactttttccacagggagtaccttgttttcgaccccacattgtcaccgcattataaggtattcatgatccctgaggtccgacgacccaatgtgaggtataccatgttgaattcagatgacaagttagaccctgcaatagaggaattagaatggccaccgtcgccttgcatcctgcgtgtgttctcatcaaggacaaaggtgtgggaggagaggtcgtttgttcgagaaggggaggctgcagggaatgttgctgacatgtggttggatcacccatatgttccagacacttctgtgtattggcggggagtactttatgtatattgccaaaacaagtttgttatgagaatatcattatcaaatgggaaatatcaagtaatcaagccacctttagattgtaaggggatggcatacacaaatctttatttggggaaatcagtgaaaggggtgtattgtgctgtgcgtcacttggcatcccatttttcgatcaatattcttgatgaatcgagtggcaaaatggagtgggtattcaaggattcgtgtagtattcagccatgtgaaataattgacgggcctggaccctggactttacaagatattaacaatcaggagcagggatttgagtatgaagatggtaacaatgaggcagtggtagaggacaggtttgaatgggactcggataatgataatgttattgagaccaacagcaggggcaagtataactctggtggttatattaattttcttgttgacaccaaaaggaggggcagatataactctggtggttatattgattttcttggatttcacccttacaaggaggttatcttcttgagtgatacgttgagaagaggattggcctaccacttaaatagctcaaagattcaagacttgggcaacctccgtccaacaaattatggaacagaggtgggcattcagccatttatacaagagtcttttccatacacaccttggatgggatggtttccagaagacaattaa

SEQ ID NO: 9154 - protein, 457 aa, Sorghum bicolor
  misc_feature: Ceres ANNOT ID no. 6099021
  misc_feature (1)..(457): NCBI GI: 115456876 NCBI Desc: os04g0113000 [oryza sativa (japonica cultivar-group)]
  misc_feature (1)..(457): NCBI GI: 116308824 NCBI Desc: osigba0112g01.1 [oryza sativa (indica cultivar-group)]
  misc_feature (5)..(422): NCBI GI: 53370641 NCBI Desc: f-box domain containing protein [oryza sativa (japonica cultivar-group)]
  misc_feature (1)..(324): NCBI GI: 57900269 NCBI Desc: f-box domain containing protein-like [oryza sativa (japonica cultivar-group)]
  misc_feature (1)..(324): NCBI GI: 115440773 NCBI Desc: os01g0824700 [oryza sativa (japonica cultivar-group)]
  misc_feature: The sequence is a functional homolog of SEQ ID NO. 456 in the 11/188,298 US application
MENLLPEDVLTNIIHRLAPRYLAISHCVCKTWCTIIDAHNLLRVDLLPRSVCGIFINFNELSMSEFFSRPSKGPTVSGNFDYLPLSSRIIGHCNGLLLFHKYVVNPATRQSAPLPPCSSPNIVVEHFFHREYLVFDPTLSPHYKVFMIPEVRRPNVRYTMLNSDDKLDPAIEELEWPPSPCILRVFSSRTKVWEERSFVREGEAAGNVADMWLDHPYVPDTSVYWRGVLYVYCQNKFVMRISLSNGKYQVIKPPLDCKGMAYTNLYLGKSVKGVYCAVRHLASHFSINILDESSGKMEWVFKDSCSIQPCEIIDGPGPWTLQDINNQEQGFEYEDGNNEAVVEDRFEWDSDNDNVIETNSRGKYNSGGYINFLVDTKRRGRYNSGGYIDFLGFHPYKEVIFLSDTLRRGLAYHLNSSKIQDLGNLRPTNYGTEVGIQPFIQESFPYTPWMGWFPEDN

SEQ ID NO: 9155 - DNA, 1239 bp, Sorghum bicolor
  misc_feature: Ceres ANNOT ID no. 6099044
  misc_feature: Encodes the peptide sequence at SEQ ID NO 9156
atggcggcggcggcggcgtctatctccggatcccgcacctgctaccctagcggcggcgtcccaatggccagcggcggccggcggcgcaccgtcatcaggagctccttcgcgcccggctcgccggcgtcgacgccatcgacggtgcggatcggcagcaagtggacggagctccagggcgcgcgggactgggacggcctgctgagcccgctggacggcgcgctccggggcgagctggtccggtacggggagttcgtgcgcgcggcgtacgccagcttcgacttcgagggcggcgcgccgtcctacggctcctgccggttcccgagccgctccctgctgcgccgcgcggggatgccggggaccgggtaccgggtcacgcgcctcctccacgccgcgtcgtcgtgcaccgcgtcgctccggtggtggctaccctcgtcgtcgccgccgccgtgcgggtccagctacatcggcttcgtcgcggtgtgcgacgacgagcgcgagatcgaacggctcggccgccgcgacgtcgtcgtcgcgttccgcggcaccgccacgtgcggcgagtgggtggacaacttcaagtccggcctcacacggctcccgacgatcccgacgacgatgaccggcgggggggaggacgacggcgaggaggcgatggtggagcgcgggttctggaggctcttcacggcgccaggcgaggcgcacagcagcctgcagcagcaggtgcgcgacgaggcgcggcggatcgcccacgagtacggcggcagcggcatgccgccgctgagcatcacggtgacggggcacagcctcggcgcggcgctcgcggtcctcaccgcccacgagatcgcgacgacgcagcagcagcagcagcgacaggaagacggcgagccggcggcgatgatggtgacggccgtgtcgttcggcgggccgcgcgtgggcaacgcggcgttccggcggaggatggaggagagcggcggcaaggtgctccgcgtggtgaactcggacgacatcgtgaccaaggtgccggggttcccagtgcacgagcagggcgacggcggcgaccagccggcgaaggggatgatgaaggcgaggctgccgaggtggctcgtcgccaagatggggtgggcgtacgccgacgtagggcgcgagctgcggctgagccaggccggctcgccgcccaacgtggtggcctcgcatgacctcgacttgtacctcaagctcgtcgcttcctgcacagactag

SEQ ID NO: 9156 - protein, 412 aa, Sorghum bicolor
  misc_feature: Ceres ANNOT ID no. 6099044
  misc_feature (176)..(345): Pfam Id: Lipase_3 Pfam Desc: Lipase (class 3)
  misc_feature (38)..(284): NCBI GI: 16215706 NCBI Desc: defective in anther dehiscence1 [arabidopsis thaliana]
  misc_feature (40)..(284): NCBI GI: 145203171 NCBI Desc: phospholipase a1 [brassica rapa]
  misc_feature (40)..(284): NCBI GI: 24898901 NCBI Desc: dad1 [brassica rapa]
  misc_feature (40)..(351): NCBI GI: 115483446 NCBI Desc: os10g0562200 [oryza sativa (japonica cultivar-group)]
  misc_feature (38)..(341): NCBI GI: 115474763 NCBI Desc: os08g0143600 [oryza sativa (japonica cultivar-group)]
MAAAAASISGSRTCYPSGGVPMASGGRRRTVIRSSFAPGSPASTPSTVRIGSKWTELQGARDWDGLLSPLDGALRGELVRYGEFVRAAYASFDFEGGAPSYGSCRFPSRSLLRRAGMPGTGYRVTRLLHAASSCTASLRWWLPSSSPPPCGSSYIGFVAVCDDEREIERLGRRDVVVAFRGTATCGEWVDNFKSGLTRLPTIPTTMTGGGEDDGEEAMVERGFWRLFTAPGEAHSSLQQQVRDEARRIAHEYGGSGMPPLSITVTGHSLGAALAVLTAHEIATTQQQQQRQEDGEPAAMMVTAVSFGGPRVGNAAFRRRMEESGGKVLRVVNSDDIVTKVPGFPVHEQGDGGDQPAKGMMKARLPRWLVAKMGWAYADVGRELRLSQAGSPPNVVASHDLDLYLKLVASCTD

SEQ ID NO: 9157 - DNA, 2370 bp, Sorghum bicolor
  misc_feature: Ceres ANNOT ID no. 6099063
  misc_feature: Encodes the peptide sequence at SEQ ID NO 9158
atgagccagctccccgccccggccagccggctgtgggaggcgagcatccgcaagctccagaccatccgccgcgcgaccacgaccgcggggcccgtccccgagggcgccgatggcgcgtccgccgcctccctgatcacggtgcccaccctcctccatgtcagctcctccgcgtccagcaccatctaccagtaccaccacgaggacggcgaggacagcgacaccagcaccgacggcagcaacgactcggacgccggcgacgacgacgacgccgcgctcggcgaggccacgcagggggagcaggtgcttcccagcggggacttctaccagggcgacctccgcggggaactcccgcacggcgccggcaagtacctctggaccgacggcagcatgtacgagggcgcctggcgccgcggccgcgcgtccgggcgaggcaagttctcctggacctccggcgccacctacgagggcgacttcgccggagggtacatgcatggacagggcacctacatcggcgagttcggggacacgttcgcggggctctgggcaaacaacctccgccatggccggggcacgcaggcgtacgccaacggggacgtctacgacgggcactggcgcgacggcctgcaggatgggcacggccggtacatctggcgccacggccacgagtacatcggaacctggagggccggcgacatgcacggctgcgggaccgtcatctgggccgacggcgaccgctacgacggcgcgtgggaggacaccaggcccaagggacagggcacgttccggtgggccgacggcgggatgtacatcggcacctggtgcgaggaggccggcgccgtgcacgccgacggcgtctactacccgccgtccggtggccccgccgtgcccgtgccccgcgagccctgcgaccccatcacggcgctgctccaggacctggaggtgtgcgagggcaagacgccgtcgctgatgccgtcgcagaagatcctcacctggcccggggtggacgccgtgcagaagaagcctgtgtggcggccgcccaaggtgagcgctgaccaagggcggaggtccagcgtgagcaggaggagcagcgcgtcgctggacctggacatgctgcaggccgccgccgagggtggcgacagcgaggagccgcgcgcggacaggtcgtgcctgcggtcgtcgtcgtgcatgcgcacgccgccgaggccggggaagaagcagggggagaccatctccaaggggcacaggaactacgagctcatgctcaacctgcagcttggcatcaggcacgctgtcggaaggcagtcagcgccaactacgctggatctcaagtcatcagcatttgatccaaaggagaaggtgtggacaagatttcctcctgaaggatcaaagcatactcctcctcaccaatcatgcgattttcggtggaaagactactgccccctggttttcaggactttgcgcaagcttttcgatgttgatccggcagactacatgatctccatttgtggcgatgaggcactcagggaactctcatctcctggtaaaagtggaagcttcttttacctcacaaatgatgacaagtacatgatcaaaacaatgaagaagtcagaagttaaagtactccttaggatgcttccagcctattataaacatgtccgcgcttttgaaaatactctgataactaaattctttggtctgcactgtgtgaacgttaaacttacaggagctatccagaaaaaggtccggtttgttataatggggaatcttttctgctccagctatgcaatccataggcgcttcgatttgaaaggatcttcacatggtcgcatgacagacaaacccatcgatcaaattagcgagcacaccacattgaaggatcttgatcttaatttcattttccggctaccaggaacttggtttgaggaattctgcaggcaagtggacaaagattgtgaattgctagagatggagaggatcatggattatagtcttttggttggtattcacttcaaggacagatacagcagcaatggtgacaacgggtcgtctcatactgctgaagattctgaggaaaatagaaaaggatcattaaaactgggaatctgcatgccctcaagggtggagaacgtagtgaagaatcctgagagtgaatctccgctcattggtgagcccacaggcgaattccaggaggtcatcttgttctttggaatcattgacatcctgcaggactatgatattagtaagaagctggagcacgcatacaaatctatgcaatatgatcccaactctatatcagctgttgacccaaagcaatactgcaagcgattcagggacttcatttttaaggctttcgccgacgatgtacaataa

SEQ ID NO: 9158 - protein, 789 aa, Sorghum bicolor
  misc_feature: Ceres ANNOT ID no. 6099063
  misc_feature (499)..(784): Pfam Id: PIP5K Pfam Desc: Phosphatidylinositol-4-phosphate 5-Kinase
  misc_feature (108)..(130): Pfam Id: MORN Pfam Desc: MORN repeat
  misc_feature (131)..(153): Pfam Id: MORN Pfam Desc: MORN repeat
  misc_feature (154)..(176): Pfam Id: MORN Pfam Desc: MORN repeat
  misc_feature (177)..(199): Pfam Id: MORN Pfam Desc: MORN repeat
  misc_feature (200)..(222): Pfam Id: MORN Pfam Desc: MORN repeat
  misc_feature (223)..(245): Pfam Id: MORN Pfam Desc: MORN repeat
  misc_feature (246)..(268): Pfam Id: MORN Pfam Desc: MORN repeat
  misc_feature (399)..(787): NCBI GI: 33354203 NCBI Desc: phosphatidylinositol-4-phosphate 5-kinase-like protein [oryza sativa (japonica cultivar-group)]
  misc_feature (404)..(672): NCBI GI: 9280673 NCBI Desc: f2e2.1 [arabidopsis thaliana]
  misc_feature (404)..(672): NCBI GI: 3702691 NCBI Desc: atpip5k1 [arabidopsis thaliana]
  misc_feature (379)..(787): NCBI GI: 140065036 NCBI Desc: phosphatidylinositol-4-phosphate 5-kinase [medicago truncatula]
  misc_feature (64)..(787): NCBI GI: 87162536 NCBI Desc: phosphatidylinositol-4-phosphate 5-kinase [medicago truncatula]
  misc_feature (82)..(787): SWISSPROT Homolog: EC 2.7.1.68 Phosphatidylinositol-4-phosphate 5-kinase 6
MSQLPAPASRLWEASIRKLQTIRRATTTAGPVPEGADGASAASLITVPTLLHVSSSASSTIYQYHHEDGEDSDTSTDGSNDSDAGDDDDAALGEATQGEQVLPSGDFYQGDLRGELPHGAGKYLWTDGSMYEGAWRRGRASGRGKFSWTSGATYEGDFAGGYMHGQGTYIGEFGDTFAGLWANNLRHGRGTQAYANGDVYDGHWRDGLQDGHGRYIWRHGHEYIGTWRAGDMHGCGTVIWADGDRYDGAWEDTRPKGQGTFRWADGGMYIGTWCEEAGAVHADGVYYPPSGGPAVPVPREPCDPITALLQDLEVCEGKTPSLMPSQKILTWPGVDAVQKKPVWRPPKVSADQGRRSSVSRRSSASLDLDMLQAAAEGGDSEEPRADRSCLRSSSCMRTPPRPGKKQGETISKGHRNYELMLNLQLGIRHAVGRQSAPTTLDLKSSAFDPKEKVWTRFPPEGSKHTPPHQSCDFRWKDYCPLVFRTLRKLFDVDPADYMISICGDEALRELSSPGKSGSFFYLTNDDKYMIKTMKKSEVKVLLRMLPAYYKHVRAFENTLITKFFGLHCVNVKLTGAIQKKVRFVIMGNLFCSSYAIHRRFDLKGSSHGRMTDKPIDQISEHTTLKDLDLNFIFRLPGTWFEEFCRQVDKDCELLEMERIMDYSLLVGIHFKDRYSSNGDNGSSHTAEDSEENRKGSLKLGICMPSRVENVVKNPESESPLIGEPTGEFQEVILFFGIIDILQDYDISKKLEHAYKSMQYDPNSISAVDPKQYCKRFRDFIFKAFADDVQ

SEQ ID NO: 9159 - DNA, 1440 bp, Sorghum bicolor
  misc_feature: Ceres ANNOT ID no. 6099068
  misc_feature: Encodes the peptide sequence at SEQ ID NO 9160
atgtgcagcaagaagatggtggaccagacgacgacacggcggcttcatgacaatctcatcttcgacgagatccttatgcgtttaccgcctgccgccgtcgcccgctgccgagccgtgtgccgtgcgtggcacacggcactcacctcggacgatttcctccgggcctacggcgcggcgctccaaccggagctcctcttcttcgcgacggccgacgccagcaccagcaccaccctgtacacctgcgcgctccgcaacaacggggaggcgccgagcgccgcccgcgagctgctcaccctgggcaacctcagcgcggcgcacgccgtggtgtccccgaggccgtgccacggcctgacgctcgtctccgacggccccgcggcgcagcactacgtgtgcaacctgtcgaccggcgagcacgtcgcgctcccgccgtgcgagcgcgccgcggccgtggagtttccggtcccgatgcgcatcggcgtggcgggccggtgccaccggtctccgccatgggtccccttcgagatcgcgagcaccgggctcggcttcgacccggccaccggcgagcacaaggtggtgaggctcttcaagaagcggattggggagacgggctgcgaggtgtgtactccggccatggccatggcgggggacgggtggcggccctgcgctgggcgagtgccgccgccgtcggccagctttatagccggtctgccgccggtgtacctccgcggctccctctacttcctcctcgagctgaacagcttcaccggcaccgatcagcctgtcatgtccttctccgtcggcgccgagcggttcgggtgggtgcacatgccgccgttcctggcgcaacgcgtcggaacgctcacggaactggatggcgccctgtgcgccgtcgtcgacctccgctacgaccacgagaggtacttgctctacacgtggggcggcggcggcgacggcgacggcgacagctggtcgaagcgctacttgatcgacctgcagagcttgcctccggcgataagcgacgagttcgtggaggaggacgatgtcatcccgctctgcagttgcaggacggggggaagcgatgataaactgctgctcgccacgggctttcacaaggtgttcgcgtatgaccccaagcgcgtcgccatggagagggtgctgtgcatgcaggagttcgtcgacgtcccggcggggcggcgagaggcccgctttcttctccaatttggactctaccaggacagcatcgccagcgccgtccaccatagcgatagcggcgacagcagcaggctgcaggtaaagcgaggcaccaacacggtttgcaggcggcaagttcgtcatgtgtaccgcaacgtcggttcacgtagaatgagagacttgttcaaacacttcctgaaggagacagccggacgcatgagcaagtttcacaacgcgcgcgggacataa

SEQ ID NO: 9160 - protein, 479 aa, Sorghum bicolor
  misc_feature: Ceres ANNOT ID no. 6099068
  misc_feature (158)..(415): NCBI GI: 115471483 NCBI Desc: os07g0268000 [oryza sativa (japonica cultivar-group)]
  misc_feature (166)..(386): NCBI GI: 115464951 NCBI Desc: os05g0521400 [oryza sativa (japonica cultivar-group)]
  misc_feature (15)..(142): NCBI GI: 38346710 NCBI Desc: osjnba0086o06.8 [oryza sativa (japonica cultivar-group)]
  misc_feature (174)..(417): NCBI GI: 108862971 NCBI Desc: f-box domain containing protein [oryza sativa (japonica cultivar-group)]
  misc_feature (23)..(239): NCBI GI: 110289289 NCBI Desc: f-box domain containing protein [oryza sativa (japonica cultivar-group)]
MCSKKMVDQTTTRRLHDNLIFDEILMRLPPAAVARCRAVCRAWHTALTSDDFLRAYGAALQPELLFFATADASTSTTLYTCALRNNGEAPSAARELLTLGNLSAAHAVVSPRPCHGLTLVSDGPAAQHYVCNLSTGEHVALPPCERAAAVEFPVPMRIGVAGRCHRSPPWVPFEIASTGLGFDPATGEHKVVRLFKKRIGETGCEVCTPAMAMAGDGWRPCAGRVPPPSASFIAGLPPVYLRGSLYFLLELNSFTGTDQPVMSFSVGAERFGWVHMPPFLAQRVGTLTELDGALCAVVDLRYDHERYLLYTWGGGGDGDGDSWSKRYLIDLQSLPPAISDEFVEEDDVIPLCSCRTGGSDDKLLLATGFHKVFAYDPKRVAMERVLCMQEFVDVPAGRREARFLLQFGLYQDSIASAVHHSDSGDSSRLQVKRGTNTVCRRQVRHVYRNVGSRRMRDLFKHFLKETAGRMSKFHNARGT

SEQ ID NO: 9161 - DNA, 1758 bp, Sorghum bicolor
  misc_feature: Ceres ANNOT ID no. 6099080
  misc_feature: Encodes the peptide sequence at SEQ ID NO 9162
atgcggcacgtcctcctctcccgcttcctcctccgccgccaacagggcggcggcatgcctaccgcccaccaccaccacctcctccgcgccctctcctccgccccgtccccggtctcctccgacgccgagctccgcaagtacgcgggctacgcgctgctcctcgtcggctgcggcgccgcgacctactactccttcccgctccccgccgacgcgctgcacaagaaggccgtgccgttccgctacgcgccgctgccggaggacctccacgccgtctccaactggagcggtacccacgaggtacacgcccgcgtcttgctccagccggactcgctcccggcactcgagggcgcgctcgccgccgcgcacaaggagcgccgcaagctcaggcccctcggctccggcctgtcccccaatggcatcgcgctctcccgcgccgggatggtcaacctcgcgcttatggacaaggtgctcgacgtcgacgccaagaagaagaccgtcactgtgcaggctgggatacgtgtcgcggagctcgtcgacacgctccgggaacatggcctcacgctgcagaactttgcgtccattcgggagcagcaggtcggagggttcactcaggttggtgcccatggcactggtgcaacattacctccggttgatgagcaagtcattagcatgaaactggttacccctgccaaagggacaatagagttatcgagggagaaggatcctgagttattttatcttgctcgctgtggacttggtggcctaggtgtcgtcgcagaagttaccttgcaatgtgtagaaagacaccagcttgtggaacatacatttgtttccaatgcagatgaagtcaagaaaaaccacaagaagtggctctctgaaaacaaacatatcaagtacttgtggattccatatactgatacggttgttgttgtccaatgcaatcctccctcaaagtggagaaccccaaagttgggatcaaaatatggaaatgacgaagctttacagcatgttcgggacctttatcgtgagtcactgaaaaaatatagaactgaagcagaaagtaatgacccagacatagatacactttcatttactgagctgagggacaaactgcttgctcttgatcctctggataaagatcatgtgatgaaaatcaataaagcagaagctgagtattggaagaagtcagaagggtatcgcatgggttggagtgatgagatactgggctttgattgtggtgggcagcagtgggtttctgaaaactgcttccccgctggaaccctagcaacaccaagtatgaaggatcttgattatatagataagctgctgcggttgattgaaaaggaagagatacccgcacctggacctattgagcagcgttggactgcccgcagcaagagcccaatgagcccagcatcaagctctgaagaagaagacatattttcatgggttggtattataatgtacctgccaacatcagatgctcgccaaaggaaggaaattacagaggagttcttcaactacaggagcctggctcaaagtctctgggatgattattctgcctatgaacactgggccaaaattgaggttccaaaagacaaggatgaacttgctgaagtccaggcccggttgaggaagcgtttccctgtggatgcatataacaaggcacgtttggagctggacccccacaaggttctctcaaatgcgaagctagagaagctgttcccagtgttggagccggttcaccaaacaaagtag

SEQ ID NO: 9162 - protein, 585 aa, Sorghum bicolor
  misc_feature: Ceres ANNOT ID no. 6099080
  misc_feature (102)..(237): Pfam Id: FAD_binding_4 Pfam Desc: FAD binding domain
  misc_feature (261)..(574): Pfam Id: ALO Pfam Desc: D-arabinono-1,4-lactone oxidase
  misc_feature (1)..(583): NCBI GI: 115484125 NCBI Desc: os11g0143500 [oryza sativa (japonica cultivar-group)]
  misc_feature (19)..(575): NCBI GI: 91982114 NCBI Desc: mitochondrial l-galactono-1,4-lactone dehydrogenase [lotus japonicus]
  misc_feature (5)..(579): NCBI GI: 66279530 NCBI Desc: l-galactono-1,4-lactone dehydrogenase [capsicum annuum]
  misc_feature (23)..(575): NCBI GI: 10047219 NCBI Desc: l-galactono-1,4-lactone dehydrogenase [nicotiana tabacum]
  misc_feature (33)..(581): NCBI GI: 49616715 NCBI Desc: mitochondrial l-galactono-1,4-lactone dehydrogenase [rosa roxburghii]
MRHVLLSRFLLRRQQGGGMPTAHHHHLLRALSSAPSPVSSDAELRKYAGYALLLVGCGAATYYSFPLPADALHKKAVPFRYAPLPEDLHAVSNWSGTHEVHARVLLQPDSLPALEGALAAAHKERRKLRPLGSGLSPNGIALSRAGMVNLALMDKVLDVDAKKKTVTVQAGIRVAELVDTLREHGLTLQNFASIREQQVGGFTQVGAHGTGATLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVQCNPPSKWRTPKLGSKYGNDEALQHVRDLYRESLKKYRTEAESNDPDIDTLSFTELRDKLLALDPLDKDHVMKINKAEAEYWKKSEGYRMGWSDEILGFDCGGQQWVSENCFPAGTLATPSMKDLDYIDKLLRLIEKEEIPAPGPIEQRWTARSKSPMSPASSSEEEDIFSWVGIIMYLPTSDARQRKEITEEFFNYRSLAQSLWDDYSAYEHWAKIEVPKDKDELAEVQARLRKRFPVDAYNKARLELDPHKVLSNAKLEKLFPVLEPVHQTK

SEQ ID NO: 9163 - DNA, 1122 bp, Sorghum bicolor
  misc_feature: Ceres ANNOT ID no. 6099110
  misc_feature: Encodes the peptide sequence at SEQ ID NO 9164
atgaagaagacggccgtgctcgccgtgctcgcggccattgcggcggcggcgctcctgtcctcctccgacgactcccggcgcgacgtcacggtgctggagataggcggcagcgacgacggccgcgtggagctggtccccgtggacgctggcgccgctgggccagagagcctggcgttcgacgccgccggcgtcggcccgtacgttggcgtgtcggacggacgtgtcctccggtgggtccccggcgagaggcggctggacagctgcagaggctcccaggacccgggccgtgagcacgagtgcggccgcccactgggcctcaagttcaaccacgccaccggggagctctacgtggcggacgcctaccacggcctccgcgtcgtctcgccggacgacggcaaggtgtcgaggccggtggcgccgcagtggtggcggcagggcaccggccgccccttcagcttcgccaacggcgtcgagctcgacccggaaaccggcgccgtctacttcaccgagacgagcacgaggttccagcggagggagttcctgagcatcgtcatctccggcgacaccacggggaggctgctgcggtacgacccgaagagcggggaggtggaggtgctggtcgacggcctggcgttccccaacggcctcgcgatgagcagggacggcacgcacctgctcctcgcggagaccaccacggggaggatcctccggtactggctccggccgccggcggcgaaggcggcgggggcgatggaagaggtggcgcggctgccgtggttcccggacaacatcaggatgagcccccggggaggcttctgggtggggatccacgccaagaggggcaagattgccgagtggtgcatctcctacccgtggctccggcgggtcgtgctgtcgctgccgccgcgccatgtccagcgcgcctcgtggctgctgaaccggcttgggcggcaggtgatcgcggtgaggttgagtgaggaggacgggaaggtgatggagatgatcagcgttcatggggatcttcagaaggtgttcaggtcggtcagtgaagtggaggagaggaatggcagcctctggattggctctgtcatgtcgccgtttcttggagtgtacaagttgtag

SEQ ID NO: 9164 - protein, 373 aa, Sorghum bicolor
  misc_feature: Ceres ANNOT ID no. 6099110
  misc_feature (155)..(243): Pfam Id: Str_synth Pfam Desc: Strictosidine synthase
  misc_feature (46)..(338): Pfam Id: SGL Pfam Desc: SMP-30/Gluconolaconase/LRE-like region
  misc_feature (84)..(373): NCBI GI: 115484115 NCBI Desc: os11g0142400 [oryza sativa (japonica cultivar-group)]
  misc_feature (4)..(373): NCBI GI: 30694556 NCBI Desc: strictosidine synthase family protein [arabidopsis thaliana]
  misc_feature (53)..(373): NCBI GI: 140040327 NCBI Desc: strictosidine synthase [medicago truncatula]
  misc_feature (5)..(277): NCBI GI: 115478879 NCBI Desc: os09g0374900 [oryza sativa (japonica cultivar-group)]
  misc_feature (53)..(371): NCBI GI: 115455371 NCBI Desc: os03g0750700 [oryza sativa (japonica cultivar-group)]
MKKTAVLAVLAAIAAAALLSSSDDSRRDVTVLEIGGSDDGRVELVPVDAGAAGPESLAFDAAGVGPYVGVSDGRVLRWVPGERRLDSCRGSQDPGREHECGRPLGLKFNHATGELYVADAYHGLRVVSPDDGKVSRPVAPQWWRQGTGRPFSFANGVELDPETGAVYFTETSTRFQRREFLSIVISGDTTGRLLRYDPKSGEVEVLVDGLAFPNGLAMSRDGTHLLLAETTTGRILRYWLRPPAAKAAGAMEEVARLPWFPDNIRMSPRGGFWVGIHAKRGKIAEWCISYPWLRRVVLSLPPRHVQRASWLLNRLGRQVIAVRLSEEDGKVMEMISVHGDLQKVFRSVSEVEERNGSLWIGSVMSPFLGVYKL

SEQ ID NO: 9165 - DNA, 594 bp, Sorghum bicolor
  misc_feature: Ceres ANNOT ID no. 6099111
  misc_feature: Encodes the peptide sequence at SEQ ID NO 9166
atgaagctgagcatgcctttcttcagctcgtcctcctcctccggcaagaagcagcaggagacgacgacgatcatcagcaagaagaggacgaagggatcaacaaagagcggctccttcggctccacctcctcgtcctccgactgcgcgtcgccgtccgccgtcacgacgccgcgcaccgtgctccctgctgtcaagccaaacccaaagccggcgccggcgccggcggtattattagccgctaccgtgacgagggaggacctggaggtggcgctgcgacgggtggtgcggagcgaggcggagctggcggcggtgctggcggaggcggaggcggccgggctggcgcccgaggaggccgcggcggccgaggccgaggacgaggccgagctccgcgaaacgttcgcggtgttcgacgcggacggcgacggcaggatctcggccgaggagctccgcgccgtgctcgcctcgctcggcgacgaggcctgctccgtcgaggattgccggcgcatgatcggcggcgtcgacgccgacggcgatgggttcgtctgcttcgacgagttctcccgcatgatgatgccgcagggggcggcagcgtga

SEQ ID NO: 9166 - protein, 197 aa, Sorghum bicolor
  misc_feature: Ceres ANNOT ID no. 6099111
  misc_feature (128)..(156): Pfam Id: efhand Pfam Desc: EF hand
  misc_feature (165)..(193): Pfam Id: efhand Pfam Desc: EF hand
  misc_feature (1)..(191): NCBI GI: 115487248 NCBI Desc: os12g0138000 [oryza sativa (japonica cultivar-group)]
  misc_feature (104)..(191): NCBI GI: 115484107 NCBI Desc: os11g0141400 [oryza sativa (japonica cultivar-group)]
  misc_feature (1)..(197): NCBI GI: 19386813 NCBI Desc: b1147a04.8 [oryza sativa (japonica cultivar-group)]
  misc_feature (82)..(190): NCBI GI: 92898447 NCBI Desc: calcium-binding ef-hand [medicago truncatula]
  misc_feature (72)..(197): NCBI GI: 38346226 NCBI Desc: oj990528_30.6 [oryza sativa (japonica cultivar-group)]
MKLSMPFFSSSSSSGKKQQETTTIISKKRTKGSTKSGSFGSTSSSSDCASPSAVTTPRTVLPAVKPNPKPAPAPAVLLAATVTREDLEVALRRVVRSEAELAAVLAEAEAAGLAPEEAAAAEAEDEAELRETFAVFDADGDGRISAEELRAVLASLGDEACSVEDCRRMIGGVDADGDGFVCFDEFSRMMMPQGAAA

SEQ ID NO: 9167 - DNA, 915 bp, Sorghum bicolor
  misc_feature: Ceres ANNOT ID no. 6099119
  misc_feature: Encodes the peptide sequence at SEQ ID NO 9168
atggccggctacccgcctcccggctccggctacccctacggcccgggcggcgggggtgggggctacggcgccccgcctccctacggctcgtcgcccgcgccctcggccccgccctacggcgagacgaagccgcccaaggaaggcaagacctcctcctcctcctcctccggcggctccgcgcccccctactacggcggcgcgccacccccttcccatccctcctacggcggcgggggcggctacggcgcgccacccccgcagtacggcgcgccaccgccccagcagtacggggcgccgccgccccagtcctacgggggcggcccgcctgcgccgtacgggggcggagggtacggaggcagcccgttcgcgtcgctggtgccctcggcgttcccgccggggaccgaccccaacgtggtcgcctgcttccaggccgccgaccgcgacggcagcggcatgatcgatgacaaggagctgcagtctgcgctgtccgggtataaccagagcttcagcctccgcactgttcatctactcatgtacctcttcaccaacaccaacgtccgcaagatcggacccaaggaattcacttctgtgttttacagtcttcagaactggagagcaatatttgagaggtttgatcgtgatcgaagtggcaggattgacacatcagaactgcgtgatgctcttctcagtctgggatattctgtctctccaaccgtcctagatctgcttgtgtctaaatttgacaagactgggggcaagagcaaagcaattgaatatgataacttcatcgaatgctgcctcactgttaagggactgactgagaagttcaaggagaaggacactgcatactctgggtcagcgacttttacctacgaggccttcatgctgaccgtgctccctttcctcatcgcgtag

SEQ ID NO: 9168 - protein, 304 aa, Sorghum bicolor
  misc_feature: Ceres ANNOT ID no. 6099119
  misc_feature (203)..(231): Pfam Id: efhand Pfam Desc: EF hand
  misc_feature (3)..(304): NCBI GI: 31711842 NCBI Desc: at5g04170 [arabidopsis thaliana]
  misc_feature (5)..(264): NCBI GI: 30681239 NCBI Desc: calcium-binding ef hand family protein [arabidopsis thaliana]
  misc_feature (5)..(264): NCBI GI: 79313177 NCBI Desc: calcium ion binding [arabidopsis thaliana]
  misc_feature (5)..(203): NCBI GI: 30681234 NCBI Desc: calcium-binding ef hand family protein [arabidopsis thaliana]
  misc_feature (54)..(303): NCBI GI: 51011121 NCBI Desc: zgc:100787 [danio rerio]
MAGYPPPGSGYPYGPGGGGGGYGAPPPYGSSPAPSAPPYGETKPPKEGKTSSSSSSGGSAPPYYGGAPPPSHPSYGGGGGYGAPPPQYGAPPPQQYGAPPPQSYGGGPPAPYGGGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGRIDTSELRDALLSLGYSVSPTVLDLLVSKFDKTGGKSKAIEYDNFIECCLTVKGLTEKFKEKDTAYSGSATFTYEAFMLTVLPFLIA

SEQ ID NO: 9169 - DNA, 3114 bp, Sorghum bicolor
  misc_feature: Ceres ANNOT ID no. 6099122
  misc_feature: Encodes the peptide sequence at SEQ ID NO 9170
  misc_feature: Up-regulated in shoot tissues in response to methyl jasmonate treatment
atggagaggctggagagctacctgaaggagcacttcgaagtgccggcgaagaacccctccgaagaggcgcagcggcgatggcgctccgccgtgggcctcgtcaagaaccgccgccgccgcttccgcatggtgcccgacctcgaccgccgcagccaggacgaggcccagcgacaatccgtccaggaaaaaattcggcttgccctggttgtgcagaaggctgccatcaccttcattgatggtgccaagcataaagaatatcggataacagaggatatcataaaagctggattttccattaatccagacgaactggcatcgatcacaagcaaacatgacgtgaaagctttgaagatgcacggtggggcagacggtatatccaaaaaaatccgatcgtcattcgaccatggcatatctgctaatgacctagacacaaggcaaaacatctacggcgtcaatcgctatgcggagaagccttcaagaagtttctggatgtttgtctgggatgcgttgcaggacatgactcttatcattcttatggtttgtgctttggtatctgctgttgtcggtctggcgtctgaaggttggcccaagggtatgtatgatggtttgggaataatactcagcattttgctggttgtgatggttactgctatcagtgactacaggcagtcgcttcagttcaaggagctagataatgagaagaagaagatatttatccatgtgaccagagatggctctcggcagaagatctctatatatgacttggcagttggtgatatcgtgcatctatcaattggagaccaagtacctgccgatggactgtacattcatggatactcccttttgattgatgagtccagcttgtcaggtgagagcgatccagtttatatttctcaagataagccgttcatcttggcaggaactaaggttcaggatggatcagctaagatgatggtaaccgctgttggtatgcgcacggaatggggaaggttgatgagcacattgagtgaaggaggagaggacgagacgccactgcaggttaagctaaacggagttgcaaccatcattggcaagattggcctgatgtttgccacattaacatttgtggtcctgatggttagattccttattgaaaaaggtttaacagttggtttgtccaaatggtattctaccgatgcactgactatagtaaactactttgcaacggcagtcactattattgtcgttgctgttcctgaagggctgcctctagctgttactttgagtcttgcatttgcaatgaaacagctaatgaatgataaagcacttgtaaggcatctttcagcatgcgaaacaatgggatctgctggtaccatctgcacagataaaacgggtactctgactacaaaccatatggtggttgagaagatatggatatctgaggtctcaaagtcggttaccagtaacaatagtttggaagatctgacctctgccatttctccagctacattgagcctacttttgcagggcatttttgagaacaccagtgcagagttagtcactgagaaggatggtaagcaaactgttttaggaactccaacagaaagggcaatatttgaatttggcttgaaattggaaggtcttgatgctgaggataggacctgtaccaaggttaaggttgagcctttcaattcggttaagaagaagatggcagtgttggtctcattacagaatggcatgtaccgttggttcaccaagggtgcatcagagattattgtgcagatgtgtgacatgatgatagatggcgatggaaacagtgttcccttatcagaagctcagagaaagaacatcttggatacaatcaactcctttgcttcggatgctttaaggacactgtgcttggcgtataaggaagtggatgatttcgaagatgatgcagatagcccaacaagtggttttactctagtatccatttttggcatcaaggatcctttgcgcccaggagtcaaggatgctgtgaaggcctgtatgtctgctggcatcattgtgagaatggtgactggtgataatatcaatacagctaaagctatagccaaagagtgtggaatactaactgatggtgacgtagcaatagaaggaccagaattccgcagcaagagcccagaagagatgagggacataatacctaagattcgggtcatggctcgttctttaccattggacaagcatacccttgtgacaaacttgcgaggtatgtttcgtgaggtggttgctgtgacaggtgacggcacaaatgatgctccagcattacatgaagcagatattggccttgctatgggcatagcaggaacagaggttgccaaggagagtgcagatgtgatagttcttgatgacaattttacaactataataaatgttgcaaggtggggtcgtgcggtttacataaacatccaaaagtttgtgcagtttcagttgactgtcaatattgttgctttggtcatcaactttgtttcagcatgtattacagggagtgctcctctcacagcggtgcaactgttgtgggtcaatatgattatggatacattgggagctttagctctagcaacagagcctccaaatgatgacatgatgaagaggccgcctgttgggcgaggggaaagtttcattaccaaagtcatgtggagaaatatcattgggcaaagtttatatcagttggttgtacttggagttctcatgtttgcaggggaacagtttctgagtatcaagggtgcagattccaaatctgttatcaatacactcatattcaactcctttgtgttctgccaggtgttcaacgaaataaacagcagggaaatggagaagattaatgtttttcgtggtatggtcaccaactggatctttattgcaatcatagctgtgacagtcgtatttcaagtggtgatcatagaattcctcggcacttttgcaagtactgttccacttaactggcagcattggctgctaagcattggccttggatcggtcagcttgattatcggtgccatcttgaagtgcataccagttaccaaatcaaatgaagttcctgcaagtccaaatggctatgcgccgcttcccagcggtcctgatgacatatag

SEQ ID NO: 9170 - protein, 1037 aa, Sorghum bicolor
  misc_feature: Ceres ANNOT ID no. 6099122
  misc_feature (204)..(445): Pfam Id: E1-E2_ATPase Pfam Desc: E1-E2 ATPase
  misc_feature (872)..(1016): Pfam Id: Cation_ATPase_C Pfam Desc: Cation transporting ATPase, C-terminus
  misc_feature (449)..(776): Pfam Id: Hydrolase Pfam Desc: haloacid dehalogenase-like hydrolase
  misc_feature (114)..(190): Pfam Id: Cation_ATPase_N Pfam Desc: Cation transporter/ATPase, N-terminus
  misc_feature (1)..(1037): NCBI GI: 110832728 NCBI Desc: probable calcium-transporting atpase 4, plasma membrane-type (ca(2+)-atpase isoform 4)
  misc_feature (84)..(1037): NCBI GI: 110832729 NCBI Desc: probable calcium-transporting atpase 5, plasma membrane-type (ca(2+)-atpase isoform 5)
  misc_feature (4)..(1035): NCBI GI: 18483249 NCBI Desc: type iib calcium atpase [medicago truncatula]
  misc_feature (7)..(1037): NCBI GI: 75330630 NCBI Desc: calcium-transporting atpase 3, plasma membrane-type (ca(2+)-atpase isoform 3)
  misc_feature (4)..(1037): NCBI GI: 16508162 NCBI Desc: type iib calcium atpase [medicago truncatula]
  misc_feature (7)..(1037): SWISSPROT Homolog: EC 3.6.3.8 Calcium-transporting ATPase 3, plasma membrane-type
  misc_feature: Up-regulated in shoot tissues in response to methyl jasmonate treatment
MERLESYLKEHFEVPAKNPSEEAQRRWRSAVGLVKNRRRRFRMVPDLDRRSQDEAQRQSVQEKIRLALVVQKAAITFIDGAKHKEYRITEDIIKAGFSINPDELASITSKHDVKALKMHGGADGISKKIRSSFDHGISANDLDTRQNIYGVNRYAEKPSRSFWMFVWDALQDMTLIILMVCALVSAVVGLASEGWPKGMYDGLGIILSILLVVMVTAISDYRQSLQFKELDNEKKKIFIHVTRDGSRQKISIYDLAVGDIVHLSIGDQVPADGLYIHGYSLLIDESSLSGESDPVYISQDKPFILAGTKVQDGSAKMMVTAVGMRTEWGRLMSTLSEGGEDETPLQVKLNGVATIIGKIGLMFATLTFVVLMVRFLIEKGLTVGLSKWYSTDALTIVNYFATAVTIIVVAVPEGLPLAVTLSLAFAMKQLMNDKALVRHLSACETMGSAGTICTDKTGTLTTNHMVVEKIWISEVSKSVTSNNSLEDLTSAISPATLSLLLQGIFENTSAELVTEKDGKQTVLGTPTERAIFEFGLKLEGLDAEDRTCTKVKVEPFNSVKKKMAVLVSLQNGMYRWFTKGASEIIVQMCDMMIDGDGNSVPLSEAQRKNILDTINSFASDALRTLCLAYKEVDDFEDDADSPTSGFTLVSIFGIKDPLRPGVKDAVKACMSAGIIVRMVTGDNINTAKAIAKECGILTDGDVAIEGPEFRSKSPEEMRDIIPKIRVMARSLPLDKHTLVTNLRGMFREVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDDMMKRPPVGRGESFITKVMWRNIIGQSLYQLVVLGVLMFAGEQFLSIKGADSKSVINTLIFNSFVFCQVFNEINSREMEKINVFRGMVTNWIFIAIIAVTVVFQVVIIEFLGTFASTVPLNWQHWLLSIGLGSVSLIIGAILKCIPVTKSNEVPASPNGYAPLPSGPDDI

SEQ ID NO: 9171 - DNA, 1383 bp, Sorghum bicolor
  misc_feature: Ceres ANNOT ID no. 6099168
  misc_feature: Encodes the peptide sequence at SEQ ID NO 9172
atgccgcaagagcaaggtgtggaggagccgccgccgcaggcggaaggcgaggcacagccggccgccgatgtccccatgagcgaggccgcggcggcggaggatgaggaggaggaacccgtcatgggggagggggagggcggtgcagacggggccgacgccgccgttggttccgtcaaggcttcagtgaagcccgaagcagagggcgcggaggagggggacagggaggagctgaatggtggcccgacggcggatttggttggcgaggctgtgaaactggagaacggggatgggtccgtgacggtgggtggctcggcggatgaggctggagctggagatggcggtgatgataagggtctggttggtcagaatcagcctgctgtgaaccagcttgtgctggcgccggctgaggaggatccggcattgaccaagatctcaaataattccttcatgttcgattacaccactggtggtgatgactcggggactgaggaggagcaggctgccttcatgaaggagctcgagcgtttccacagggagaaaatgttggagttcaagccccccaagttttatggtgaaggattgaattgcctcaaattgtggagacaagttactggattgggtggctatgatcaggtgacatcatgcaagctgtggcgtcaagtgggagagtcattcaaacctccaaagacatgcacaactgtttcatggactttccgtaacttctatgagaaggcactccttgaatatgagaaacacaaaatcgaaacaggagagtttcaagtagcttcatctgctctaccagatcggattggttctgagagccaggtgggtggaagcaatgtatctggttctggaagagccagaagagaatccgcaactcgtgcaatgcaaggctggcattctcagcgcctactaggcaatggtgaaatcgctgatcctgtaattaaggataaagggcctattgtcttaaagaaggataaaactccaaaaagcagtggttctgccaagaggaaaaggacaccatccctggaagatgacagggtgataccttataagtccgataagctacaaaatgactcgatggtcattgacatgggccctcctgctgattgggtgaaaataaatgttagaaaaactaaggattgctatgaagtctatgcgttagttcctggccttctgcgggaagaggtacatgttcagtccgaccccgctggtcgtttgatagttactggagagcctgagcaattggataacccatggggtgtcactccattcaagaaggtcattagtttgccttcccgcattgatcctcaccaaacctctgctgttgtcaccctccatgggcagctatttgtgcgtgcaccatttgaacaatcaaaataa

SEQ ID NO: 9172 - protein, 460 aa, Sorghum bicolor
  misc_feature: Ceres ANNOT ID no. 6099168
  misc_feature (160)..(268): Pfam Id: ARID Pfam Desc: ARID/BRIGHT DNA binding domain
  misc_feature (15)..(460): NCBI GI: 51090844 NCBI Desc: dna-binding protein-like [oryza sativa (japonica cultivar-group)]
  misc_feature (5)..(456): NCBI GI: 41052881 NCBI Desc: dna-binding protein-like [oryza sativa (japonica cultivar-group)]
  misc_feature (141)..(458): NCBI GI: 140043723 NCBI Desc: at-rich interaction region; heat shock protein hsp20 [medicago truncatula]
  misc_feature (103)..(458): NCBI GI: 30687082 NCBI Desc: arid/bright dna-binding domain-containing protein [arabidopsis thaliana]
  misc_feature (15)..(217): NCBI GI: 51090845 NCBI Desc: dna-binding protein-like [oryza sativa (japonica cultivar-group)]
MPQEQGVEEPPPQAEGEAQPAADVPMSEAAAAEDEEEEPVMGEGEGGADGADAAVGSVKASVKPEAEGAEEGDREELNGGPTADLVGEAVKLENGDGSVTVGGSADEAGAGDGGDDKGLVGQNQPAVNQLVLAPAEEDPALTKISNNSFMFDYTTGGDDSGTEEEQAAFMKELERFHREKMLEFKPPKFYGEGLNCLKLWRQVTGLGGYDQVTSCKLWRQVGESFKPPKTCTTVSWTFRNFYEKALLEYEKHKIETGEFQVASSALPDRIGSESQVGGSNVSGSGRARRESATRAMQGWHSQRLLGNGEIADPVIKDKGPIVLKKDKTPKSSGSAKRKRTPSLEDDRVIPYKSDKLQNDSMVIDMGPPADWVKINVRKTKDCYEVYALVPGLLREEVHVQSDPAGRLIVTGEPEQLDNPWGVTPFKKVISLPSRIDPHQTSAVVTLHGQLFVRAPFEQSK

SEQ ID NO: 9173 - DNA, 915 bp, Sorghum bicolor
  misc_feature: Ceres ANNOT ID no. 6099179
  misc_feature: Encodes the peptide sequence at SEQ ID NO 9174
atggacatcgacctcttcgccgacatcgacctcgacgccctcctcgcctccttctccggcgaacccgccgccgtctccgacctcatcgtcccgtccccgcctccgccggccccggcggcgcacgatgcggcggaagcggggtcgccggagtcggtgacctcccgggcgaacccggccggggaggtgggtctctcggagatcgagaggttcctgatgcaggaaggggaggcggaggcggagttgggcggggaggtcgaggggatcagcgtggaccagttcttcgacgcgctgtacgacggcggggaggggaaagatgaaggggaggcagaggcgggggcaagcacggatgcggactccggcagggacgaggtggtggaagtcgtgacgccggaggcggagacggtggaggtggatggcgatgatcccgtcagcaagaagaagaagaggcaaatgaggaacagagattcggcaatgaaatccagggagaggaagaagtcgtacataaaggacttggagacgaagagcaagtatttggaggcagagtgccgccgcctcagctacgcacttcagtgctacgcagctgagaacatggtactgcgccagagcttgatgaaggataggcctgttggtgctcccacagccatgcaggagtctgccgtactcacggaaaccctgccgctggtttccctgctgtggctggtgagcatcgtctgcctcttcctgatgcccgttctgcccaaccgaagcccagctgctccaagcagcggcggaagagatctcgtgatggcagccggaaagacaagcagtgaaaccccagagatactggaactcatcctccatggaaggcgttgcaagagcacgagggcgaggattaagctatataatttaccatttcatccagtaattgcttgctag

SEQ ID NO: 9174 - protein, 304 aa, Sorghum bicolor
  misc_feature: Ceres ANNOT ID no. 6099179
  misc_feature (141)..(204): Pfam Id: bZIP_1 Pfam Desc: bZIP transcription factor
  misc_feature (141)..(195): Pfam Id: bZIP_2 Pfam Desc: Basic region leucine zipper
  misc_feature (1)..(304): NCBI GI: 51090849 NCBI Desc: bzip transcription factor-like [oryza sativa (japonica cultivar-group)]
  misc_feature (66)..(292): NCBI GI: 60459369 NCBI Desc: bzip transcription factor protein [capsicum annuum]
  misc_feature (49)..(298): NCBI GI: 113367186 NCBI Desc: bzip transcription factor bzip68 [glycine max]
  misc_feature (143)..(185): NCBI GI: 116739260 NCBI Desc: at1g42990-like protein [arabidopsis halleri subsp. halleri]
  misc_feature (143)..(185): NCBI GI: 116739262 NCBI Desc: at1g42990-like protein [arabidopsis lyrata subsp. lyrata]
  misc_feature: The sequence is a functional homolog of SEQ ID NO 1540 in the 10/412,699US patent application
  misc_feature: The sequence is a functional homolog of SEQ ID NO 1542 in the 10/412,699US patent application
  misc_feature: Useful for making plants with modulated growth and phenotype characteristics
  misc_feature: Useful for making plants with modulated nitrogen use efficiency
  misc_feature: GREAT-hit functional homolog of the protein sequence encoded by LOCUS at1g42990
  misc_feature: The sequence is a functional homolog of SEQ ID NO 1540 in the 20040045049 US patent application
  misc_feature: The sequence is a functional homolog of SEQ ID NO 1542 in the 20040045049 US patent application
  misc_feature: The sequence is a functional homolog of SEQ ID NO. 337 in the 11/188,298 US application
MDIDLFADIDLDALLASFSGEPAAVSDLIVPSPPPPAPAAHDAAEAGSPESVTSRANPAGEVGLSEIERFLMQEGEAEAELGGEVEGISVDQFFDALYDGGEGKDEGEAEAGASTDADSGRDEVVEVVTPEAETVEVDGDDPVSKKKKRQMRNRDSAMKSRERKKSYIKDLETKSKYLEAECRRLSYALQCYAAENMVLRQSLMKDRPVGAPTAMQESAVLTETLPLVSLLWLVSIVCLFLMPVLPNRSPAAPSSGGRDLVMAAGKTSSETPEILELILHGRRCKSTRARIKLYNLPFHPVIAC

SEQ ID NO: 9175 - DNA, 981 bp, Sorghum bicolor
  misc_feature: Ceres ANNOT ID no. 6099186
  misc_feature: Encodes the peptide sequence at SEQ ID NO 9176
atggaagtcgcagcagggaggacgaggccggggacggcggtgtgcgtgaccggcgcgggaggcttcgtggcctcgtggctcgtcgagcgcctcctcgccggcggccggtacgtggtccatggcaccgtccgtgatccgggcgacgccaagaacgcgcacctggcggcgatggacggcgccgcggcccggctgcgcctgttcagggccgacttgctggactacggcagcgtggcggcggccgtcgccggctgcgacggcgtcttccacgtcgcgtccccagtccccagcacctacccaatcggtgaccccgaggtagagctgctggctccggccgtgacgggcaccatgaacgtcctcaaggcgagctccgaggccaaggtcaagagggtcgtcgtggtgtcgtcggtggccgccgtgatggtgaaccctggctggccccaggacgaggtcatggacgaagcttgttggtctgatgtcgaattctgcagaaccaatcagaactggtattgtctctccaagacactagcagagacggaggcatttgattacgccaagagaacgggactagatgtggtgtcagtctgcccatccctggtgatcgggcccttgcggcagtcgacagtgaacgcaagcagctccatcatagtcgattgcttgaaaggagatcatgaggtgaaactgaagctgaggaacttcgtggatgttcgcgacgtcgccaatgctctgctcctggtgtacgagactccggaggcgtctggacgctacatctgcgatgcaaatgcaaggcaggtgtctgatgtcatagcgctgctgaagaactggtaccctgcctacaatcatgccaccaagctcgtgcaagtgagcgatgaacctttgttcagctccaagaagctggaggcgctgggctggaaattcaggacgttcgaggagaccctcagggacagcgttgaatccttcacggcggcaggtgtcctggattga

SEQ ID NO: 9176 - protein, 326 aa, Sorghum bicolor
  misc_feature: Ceres ANNOT ID no. 6099186
  misc_feature (14)..(258): Pfam Id: Epimerase Pfam Desc: NAD dependent epimerase/dehydratase family
  misc_feature (16)..(242): Pfam Id: NAD_binding_4 Pfam Desc: Male sterility protein
  misc_feature (15)..(285): Pfam Id: 3Beta_HSD Pfam Desc: 3-beta hydroxysteroid dehydrogenase/isomerase family
  misc_feature (12)..(151): Pfam Id: adh_short Pfam Desc: short chain dehydrogenase
  misc_feature (14)..(325): NCBI GI: 145337634 NCBI Desc: cinnamoyl-coa reductase [arabidopsis thaliana]
  misc_feature (4)..(325): NCBI GI: 9998901 NCBI Desc: cinnamoyl-coa reductase [populus balsamifera subsp. trichocarpa]
  misc_feature (11)..(325): NCBI GI: 31414896 NCBI Desc: cinnamoyl coa reductase [fragaria x ananassa]
  misc_feature (4)..(325): NCBI GI: 40233135 NCBI Desc: cinnamoyl coa reductase [populus tomentosa]
  misc_feature (11)..(325): NCBI GI: 2058311 NCBI Desc: cinnamoyl-coa reductase [eucalyptus gunnii]
  misc_feature: Useful for making plants with altered Lignin content
  misc_feature: Useful for making plants with altered cell wall content and/or composition
  misc_feature: Functional homolog of the protein sequence given in SEQ ID NO 13345
  misc_feature: Functional homolog of the protein sequence encoded by LOCUS at2g33600
  misc_feature: Useful for making plants with altered carbohydrate content
  misc_feature: Functional homolog of the protein sequence given in SEQ ID NO 13643
  misc_feature: Useful for making plants with altered cell wall content and/or composition
  misc_feature: Useful for making plants with altered lignin content
  misc_feature: Functional homolog of the protein sequence given in SEQ ID NO 13345
MEVAAGRTRPGTAVCVTGAGGFVASWLVERLLAGGRYVVHGTVRDPGDAKNAHLAAMDGAAARLRLFRADLLDYGSVAAAVAGCDGVFHVASPVPSTYPIGDPEVELLAPAVTGTMNVLKASSEAKVKRVVVVSSVAAVMVNPGWPQDEVMDEACWSDVEFCRTNQNWYCLSKTLAETEAFDYAKRTGLDVVSVCPSLVIGPLRQSTVNASSSIIVDCLKGDHEVKLKLRNFVDVRDVANALLLVYETPEASGRYICDANARQVSDVIALLKNWYPAYNHATKLVQVSDEPLFSSKKLEALGWKFRTFEETLRDSVESFTAAGVLD

SEQ ID NO: 9177 - DNA, 981 bp, Sorghum bicolor
  misc_feature: Ceres ANNOT ID no. 6099190
  misc_feature: Encodes the peptide sequence at SEQ ID NO 9178
atggaggcagcaggcgggggaagaacgacgacgatggagacggtgtgcgtgaccggcgcgggcgggttcgtggcctcgtggctcgtcgagcgcctcctcgccgctggccgatacatggtccacggcaccgtccgcgatcccggcgacgccaagaacgcgcacctgctggcgctggacggcgccgcggagcggctgcgcctgttcaaggccgacctgctcgactccggcagcgtggcggcggccgtcgcaggctgcgacggcgtcttccacgtcgcctgccctgtccccgactatgccctcactgaccccgaggtcgagcttgtggctcctgccgtgacgggcaccatgaacgtcctcagggcgtgctccgaggccgaggtcaagagggtcgtcgtggtgtcgtctctctcggctgtgatgataaagcctgagtgggacgagtgcaaggtcatggacgaaggttgctggtctgacgtcggccactgcagaaccactgagaactggtattgcctttccaagacactggcagagatggaggcatttgaatacgccaagagaactggggtcgatgtggtttcagtctgcccatccctggtaatcgggcccttgctgcaacccacactgaacgcgagcagtgcggtcgttgttgatttcctcaaaggagatcgcttggtgaaaatgaaactcagacactttgtggatgttcgcgatgtcgctgatgctcttctcctagtgtatgagaccccagaggcatctgggaggtatatctgcaattcgcacgcaaggctggtatctgatgtcataaagctacttaagagctggtacccgacttatcaatatgccaccaagttcgtccaagtgaaccacgagcccccattcagttccaagaagttgcaggcgcttggctggaaattcaggccgttcgaggagaccctcagggacagcgttgaatccttcaaagcggcaggtgtcttggattga

SEQ ID NO: 9178 - protein, 326 aa, Sorghum bicolor
  misc_feature: Ceres ANNOT ID no. 6099190
  misc_feature (15)..(258): Pfam Id: Epimerase Pfam Desc: NAD dependent epimerase/dehydratase family
  misc_feature (17)..(242): Pfam Id: NAD_binding_4 Pfam Desc: Male sterility protein
  misc_feature (16)..(278): Pfam Id: 3Beta_HSD Pfam Desc: 3-beta hydroxysteroid dehydrogenase/isomerase family
  misc_feature (13)..(325): NCBI GI: 145337634 NCBI Desc: cinnamoyl-coa reductase [arabidopsis thaliana]
  misc_feature (13)..(325): NCBI GI: 3341511 NCBI Desc: cinnamoyl-coa reductase [saccharum officinarum]
  misc_feature (13)..(325): NCBI GI: 31414896 NCBI Desc: cinnamoyl coa reductase [fragaria x ananassa]
  misc_feature (13)..(325): NCBI GI: 9998901 NCBI Desc: cinnamoyl-coa reductase [populus balsamifera subsp. trichocarpa]
  misc_feature (13)..(325): NCBI GI: 9964087 NCBI Desc: cinnamoyl coa reductase [lolium perenne]
  misc_feature: Useful for making plants with altered Lignin content
  misc_feature: Useful for making plants with altered cell wall content and/or composition
  misc_feature: GREAT-hit functional homolog of the protein sequence given in SEQ ID NO 13345
  misc_feature: GREAT-hit functional homolog of the protein sequence encoded by LOCUS at2g33600
  misc_feature: Useful for making plants with altered carbohydrate content
  misc_feature: Functional homolog of the protein sequence given in SEQ ID NO 13643
  misc_feature: Useful for making plants with altered cell wall content and/or composition
  misc_feature: Useful for making plants with altered lignin content
  misc_feature: Functional homolog of the protein sequence given in SEQ ID NO 13345
MEAAGGGRTTTMETVCVTGAGGFVASWLVERLLAAGRYMVHGTVRDPGDAKNAHLLALDGAAERLRLFKADLLDSGSVAAAVAGCDGVFHVACPVPDYALTDPEVELVAPAVTGTMNVLRACSEAEVKRVVVVSSLSAVMIKPEWDECKVMDEGCWSDVGHCRTTENWYCLSKTLAEMEAFEYAKRTGVDVVSVCPSLVIGPLLQPTLNASSAVVVDFLKGDRLVKMKLRHFVDVRDVADALLLVYETPEASGRYICNSHARLVSDVIKLLKSWYPTYQYATKFVQVNHEPPFSSKKLQALGWKFRPFEETLRDSVESFKAAGVLD

SEQ ID NO: 9179 - DNA, 930 bp, Sorghum bicolor
  misc_feature: Ceres ANNOT ID no. 6099193
  misc_feature: Encodes the peptide sequence at SEQ ID NO 9180
atggcggcggcggcgaagagcgtatgcgtgaccggcgcgggcggcttcatcgcgtcgtggctcgtgaagctcctcctctcccgtggccaatacacggtccgcggcaccgtgcgcgaccctggtgctagcaagaatgctcatctcaaggcgctggaaggagctatggaaaggttgcagcttcttaaggttgatttgttggactacagcagtgttgcatcagcaattgccggctgtgagggtgtcttccatgtagctagtcctgttccttccggtcggtcctccaaccctgaggtggaggtcataggtcctgctgtattaggaacaaccaatgtgttaaaggcttgctatgaggcaaaagttaagcgagttgtggtggtgtcttctgttgcagctatattcagtaacccttactggcctaagggcaaggcctttgatgaagactgttggtcagatgaggattactgcaggaagaatgaggattggtattacctttccaaaactctgtccgaacgtgaggcttttgcttatgcagcaaaaacggggttggatgttgtaactatttgcccggccttggtatttggacccttgatgcagtctatattaaatgcgagtagtaaaatactccttaactatttcaaaggagatcgtgagaccattgaaaatagactcagaaatattgtggatgttcgtgatgttgctgatgctcttcttctggcatatgaaaaaccagaagcgtctggacgatacatctgcagctcacaaccaataaaagtttctgatatgataaacatattaaagactttatatccaacttacccttatcccaaaaattctgagaaacttcagaagctagggtggaccttcaggcctatagaggagaccctccgcgaaagtgttgaatcctacaaagcatttggcatcctgaattga

SEQ ID NO: 9180 - protein, 309 aa, Sorghum bicolor
  misc_feature: Ceres ANNOT ID no. 6099193
  misc_feature (8)..(252): Pfam Id: Epimerase Pfam Desc: NAD dependent epimerase/dehydratase family
  misc_feature (9)..(284): Pfam Id: 3Beta_HSD Pfam Desc: 3-beta hydroxysteroid dehydrogenase/isomerase family
  misc_feature (10)..(236): Pfam Id: NAD_binding_4 Pfam Desc: Male sterility protein
  misc_feature (6)..(147): Pfam Id: adh_short Pfam Desc: short chain dehydrogenase
  misc_feature (3)..(308): NCBI GI: 145337634 NCBI Desc: cinnamoyl-coa reductase [arabidopsis thaliana]
  misc_feature (4)..(308): NCBI GI: 65306614 NCBI Desc: cinnamoyl-coa reductase [lycopersicon esculentum]
  misc_feature (4)..(306): NCBI GI: 104162062 NCBI Desc: cinnamoyl coa reductase [picea abies]
  misc_feature (6)..(306): NCBI GI: 17978649 NCBI Desc: cinnamoyl-coa reductase [pinus taeda]
  misc_feature (4)..(308): NCBI GI: 25140434 NCBI Desc: cinnamoyl coa reductase [solanum tuberosum]
  misc_feature: Useful for making plants with altered Lignin content
  misc_feature: Useful for making plants with altered cell wall content and/or composition
  misc_feature: Functional homolog of the protein sequence given in SEQ ID NO 13345
  misc_feature: Functional homolog of the protein sequence encoded by LOCUS at2g33600
  misc_feature: Useful for making plants with altered carbohydrate content
  misc_feature: Functional homolog of the protein sequence given in SEQ ID NO 13643
  misc_feature: Useful for making plants with altered cell wall content and/or composition
  misc_feature: Useful for making plants with altered lignin content
  misc_feature: Functional homolog of the protein sequence given in SEQ ID NO 13345
MAAAAKSVCVTGAGGFIASWLVKLLLSRGQYTVRGTVRDPGASKNAHLKALEGAMERLQLLKVDLLDYSSVASAIAGCEGVFHVASPVPSGRSSNPEVEVIGPAVLGTTNVLKACYEAKVKRVVVVSSVAAIFSNPYWPKGKAFDEDCWSDEDYCRKNEDWYYLSKTLSEREAFAYAAKTGLDVVTICPALVFGPLMQSILNASSKILLNYFKGDRETIENRLRNIVDVRDVADALLLAYEKPEASGRYICSSQPIKVSDMINILKTLYPTYPYPKNSEKLQKLGWTFRPIEETLRESVESYKAFGILN

SEQ ID NO: 9181 - DNA, 3204 bp, Sorghum bicolor
  misc_feature: Ceres ANNOT ID no. 6099206
  misc_feature: Encodes the peptide sequence at SEQ ID NO 9182
atggacgctggagggctcggcttcctcgtcgcgggctcccggcgcgagttcgtcgtcctcaacgtcgacgacttctccaagcaagggtcttcacagggctgtccagactatatttgtcagatatgcggagatgacattgacatactccaggaagaaaatgagtatttcgtcgcatgtaatgattgtgctttccctgtttgccgcacttgttatgagtacgagcgtcaggagggcacacaagtatgccctcgctgcaagacccggtacaaacgccacaaaggtagtcctcgagtccatggggatgaggaagaagaaggttctgatgacattgagagtgagtttgcttccagtatagctggaagatcaaatatagtgcatccataccgtgtctctgtggcagaaagctccatcaactcatgggacattgatagtgtcagtatcacgaacagtggaacaagtgtccatttctatgaagagcatgttggaactccaacaaatcatcatgctcttgttgttcaccctaacactggagaaattatgcgatataatcccttgcaaacgagaccaataaatcccaatagagacctagcattgtatggctatggatcggttgcctggaagaacagagttgagtggaaaagaaaacaacagcataaaatgcaaaaggtctcatctgatggtgaaggatctgatttgaatgattttgacagtgatcgcgatattcccaggtgtgctgaaagcaagcagcaactatcaaggaagttacctattccatctagcaaaataaacccttacaggattgtaatcagtttgcggctagccattcttgccttatttttccactatcggattctgaatcctgtacctgatgctcactggttgtggttgacttcagttatttgtgaaatttggttcgctttttcatggattttagaccaatttcccaagtggcacccaatccagagagaaacatatttggatcgattatcattaagatacgagaaggaaggaaaaccaccagaactggctccaatcgatgtatttgtcagtacagttgatccaatgaaggaacctcctttaattactgcaaacacagttttgtccatactggctgtggattatcctgttgataaagtttgctgctatgtgtcggatgatggtgctgcaatgcttacttttgaagcacttacagaaacatgtctatttgcacgaaaatgggttcccttctgtaagaagcacaaaatcgagcctcgggctcctgaatggtattttgctcagaaaattgactatctaagagaaaaggttcacccagagtttgttcgagaacgacgtgcaatgaagagagaatatgaagaatttaagattcgtataaacggagtagttgctaattcacgcaaagttcccgagggaggatggtccctaccagaaggagctccatggcacggaaataatgttcgagaccatgccgggatggtccaggtcatcactggccatgattgtgtcatggatgatgctggaaataagctgccttggttggtctatgtttcacgagagaaaaggcctggttatgatcatcataaaaaggctggtgccttgaatgcattgctgcgaacttcagcaattctctccaacgcaccttttgtcctgaatgtggattgtgaccactatatcaacaatagcaaagcattacgggaggcaatgtgttttctgatggatccagtattgggagagaagatttgttatgttcaatttccgcagagatttgatggcattgatcaacacgatagatattcaaaccacaatgttgtattttttgatattaacatgaaaggtcttgatgggatccaaggaccaatatatgttgggactggttgtgttttcagaaggcatgctttgtatggatatgatgccccaactgcaacaaaacctcctagcaagacatgtaactgctggccgaagtcatgctgcttgtgttgtggatcgaaaagaaaatgttccaaagctaagaagaagcaagaacaccaaaagaaagtgaaatgcaaggatgcatccaagcaagttcatgctcttgaagtggttggaagagaaacagcaccccctgttgctcaagaaaagtttgagaagagatttgggcagtcagattcatttttggcttctacattgcaagatagtggtgaaggttgtcgctttgacatgctcaaaagccttgatgattgcatccatgtgctaagttgcgggtacgagaataagacacaatgggggaaagaggttggttggatttatggatctgtcactgaggatatcctcacgggcttcaagatgcactgccatggttggcgatctgtttactgcatgcccaagagaccagcattcaagggatccgctcctatcaatctcactgatcgtctccatcaagttttaagatgggcacttggctctgtggagatctttcttagcaagcactgcccaatatggtatgggtaccgatgtggtctgaaaccattggagagattgtcatatatcaattctgtcatctatccgtggacatcaattccgctgctaatttactgtgccctgccagcattttgcctgttatctgggaagtttatggtgcctgagatgaatatctattcgagcatattgttcatagctctatttgtctccatagcagctaccagcatccttgagatgcagtggggaggagtcagaatcgatgattggtggagaaatgaacaattttgggttattggcggtgtctcatcacacctctttgcactgtgccaagggcttcttaaggttcttggtggtgtgaacactaagttcagggtgactctgaagggaggcgacacggatgagttctcagagctgtatgagttcaagtggacctggctattggtccctccgatgacattgctcttgctaaacgttgtcggagtcttggccggtgtatccaaggcaataacggatggatacgaagcctgggggccactgattggcaagctgttcttctccttctgggttatcctccatctccacccgttcctcaagggcgtgattggcaagcagagcagggtgccgaccattgttgttgttttgtcagtgctactagcatccatattgtctcttttgtgggtccgtgtaagtccgttcgccaccaagtttgatggcccagttctagaggtttgtggtttggaatgtgaatga

SEQ ID NO: 9182 - protein, 1067 aa, Sorghum bicolor
  misc_feature: Ceres ANNOT ID no. 6099206
  misc_feature (250)..(1062): Pfam Id: Cellulose_synt Pfam Desc: Cellulose synthase
  misc_feature (1)..(1066): NCBI GI: 4914447 NCBI Desc: cellulose synthase catalytic subunit (ath-a) [arabidopsis thaliana]
  misc_feature (56)..(1066): NCBI GI: 33186653 NCBI Desc: cellulose synthase [solanum tuberosum]
  misc_feature (9)..(1066): NCBI GI: 3135611 NCBI Desc: cellulose synthase [arabidopsis thaliana]
  misc_feature (1)..(1043): NCBI GI: 72384442 NCBI Desc: 52o08_12 [brassica rapa subsp. pekinensis]
  misc_feature (9)..(1066): NCBI GI: 9622886 NCBI Desc: cellulose synthase-7 [zea mays]
  misc_feature (1)..(1066): SWISSPROT Homolog: EC 2.4.1.12 Cellulose synthase A catalytic subunit 2 [UDP-forming]
  misc_feature: Useful for making plants with altered cell wall content and/or composition
  misc_feature: Functional homolog of the protein sequence encoded by LOCUS at2g21770
  misc_feature: Functional homolog of the protein sequence encoded by LOCUS at4g39350
  misc_feature: Functional homolog of the protein sequence encoded by LOCUS at5g09870
  misc_feature: Functional homolog of the protein sequence encoded by LOCUS at5g64740
  misc_feature: Useful for making plants with altered cell wall content and/or composition
  misc_feature: Functional homolog of the protein sequence given in SEQ ID NO 13363
  misc_feature: Useful for making plants with modulated biomass
  misc_feature: Functional homolog of the protein sequence given in SEQ ID NO 14005
  misc_feature: The sequence is a functional homolog of SEQ ID NO 26 in US patent 7312377
  misc_feature: Useful for making plants with altered carbohydrate content
  misc_feature: Functional homolog of the protein sequence given in SEQ ID NO 13628
  misc_feature: The sequence is a functional homolog of SEQ ID NO 6 in US patent 7285702
  misc_feature: The sequence is a functional homolog of SEQ ID NO 2 in US patent 7049481
MDAGGLGFLVAGSRREFVVLNVDDFSKQGSSQGCPDYICQICGDDIDILQEENEYFVACNDCAFPVCRTCYEYERQEGTQVCPRCKTRYKRHKGSPRVHGDEEEEGSDDIESEFASSIAGRSNIVHPYRVSVAESSINSWDIDSVSITNSGTSVHFYEEHVGTPTNHHALVVHPNTGEIMRYNPLQTRPINPNRDLALYGYGSVAWKNRVEWKRKQQHKMQKVSSDGEGSDLNDFDSDRDIPRCAESKQQLSRKLPIPSSKINPYRIVISLRLAILALFFHYRILNPVPDAHWLWLTSVICEIWFAFSWILDQFPKWHPIQRETYLDRLSLRYEKEGKPPELAPIDVFVSTVDPMKEPPLITANTVLSILAVDYPVDKVCCYVSDDGAAMLTFEALTETCLFARKWVPFCKKHKIEPRAPEWYFAQKIDYLREKVHPEFVRERRAMKREYEEFKIRINGVVANSRKVPEGGWSLPEGAPWHGNNVRDHAGMVQVITGHDCVMDDAGNKLPWLVYVSREKRPGYDHHKKAGALNALLRTSAILSNAPFVLNVDCDHYINNSKALREAMCFLMDPVLGEKICYVQFPQRFDGIDQHDRYSNHNVVFFDINMKGLDGIQGPIYVGTGCVFRRHALYGYDAPTATKPPSKTCNCWPKSCCLCCGSKRKCSKAKKKQEHQKKVKCKDASKQVHALEVVGRETAPPVAQEKFEKRFGQSDSFLASTLQDSGEGCRFDMLKSLDDCIHVLSCGYENKTQWGKEVGWIYGSVTEDILTGFKMHCHGWRSVYCMPKRPAFKGSAPINLTDRLHQVLRWALGSVEIFLSKHCPIWYGYRCGLKPLERLSYINSVIYPWTSIPLLIYCALPAFCLLSGKFMVPEMNIYSSILFIALFVSIAATSILEMQWGGVRIDDWWRNEQFWVIGGVSSHLFALCQGLLKVLGGVNTKFRVTLKGGDTDEFSELYEFKWTWLLVPPMTLLLLNVVGVLAGVSKAITDGYEAWGPLIGKLFFSFWVILHLHPFLKGVIGKQSRVPTIVVVLSVLLASILSLLWVRVSPFATKFDGPVLEVCGLECE

SEQ ID NO: 9183 - DNA, 1245 bp, Sorghum bicolor
  misc_feature: Ceres ANNOT ID no. 6099213
  misc_feature: Encodes the peptide sequence at SEQ ID NO 9184
atggagagcaccgcggggccgaggaagaggcagcaggccacgtcgtcggcctctggatccgtggccccgcacttgcccgaggagctcgtccggaacatcctcctctacctgccttccaggtccgtccaccgctgccgcgccgtttgcaaggtctggctccagatcgtctccgaccccgagttcgccgtcgaccaccaccgcctccagcccacggtgcctctcatctgcttcctccgcggcggcgcccccgccggtaccaaggcggagacggagacggagacgacgacgggccccgtggacgtggactgctgcgtcgacgccttcgacctcggcgccggcggcagtttccgtcccgtcgtccgcttcaccgacaaggaggagcggtgccgtggcggcttccacatccacggctcctgcgacggcctcctcctcctcagcttcgaggaccgcttctacgtctgcaacccggcgacgcaccagtggacgcgcctctcgacgccgctccgcgcctcgtggttcgccggcttctaccgccacgaccctaccggagagtaccgtgccatgttctaccggggccggtggcccagcgagcacgaggactactacatcatggtgccggactccaggagagggaggggaatcgggctgccggcggagagagacgggtacaagttcaggggacagccgtatggcccgccggtgctgcgccgcggccacctccactggatgccgcggcagacggaagcaggctacgggatactggcgttcaacacgaccaccgaggcgctcaccgtcatgtgccctcctgtggttcgggagcacatgtcgctggctgaggtgggcggcgagctcgccatggtcagttgcggcaacaacaatgacacaatggtcgagctctggcttctcaaggactacgagaaagagatctgggtctgcaagcaccggatccggctgccggcggcggtgaagatgagcaccttcacgttcgatgagtcctggcgtatgttcttcatgtcagaagagggagttgtggtagtcaccccagagcagaagctggtgcactatgacatgaatgggacactgctggaaaccttcccttgcgataatggccgccatctcaagattgctccgtataccttcaaggaaagcctcgttcgacatgaattctttgaggcacaggattgcaatgccggtgatcatgaagatgaaccagaactacaaccgccattcttccaggggctgtag

SEQ ID NO: 9184 - protein, 414 aa, Sorghum bicolor
  misc_feature: Ceres ANNOT ID no. 6099213
  misc_feature (20)..(67): Pfam Id: F-box Pfam Desc: F-box domain
  misc_feature (128)..(390): NCBI GI: 38346536 NCBI Desc: osjnba0040d17.11 [oryza sativa (japonica cultivar-group)]
  misc_feature (138)..(397): NCBI GI: 38346527 NCBI Desc: osjnba0040d17.2 [oryza sativa (japonica cultivar-group)]
  misc_feature (138)..(397): NCBI GI: 115457216 NCBI Desc: os04g0193300 [oryza sativa (japonica cultivar-group)]
  misc_feature (9)..(390): NCBI GI: 38344215 NCBI Desc: osjnbb0026e15.3 [oryza sativa (japonica cultivar-group)]
  misc_feature (25)..(390): NCBI GI: 38346045 NCBI Desc: osjnba0059d20.17 [oryza sativa (japonica cultivar-group)]
  misc_feature: The sequence is a functional homolog of SEQ ID NO. 456 in the 11/188,298 US application
MESTAGPRKRQQATSSASGSVAPHLPEELVRNILLYLPSRSVHRCRAVCKVWLQIVSDPEFAVDHHRLQPTVPLICFLRGGAPAGTKAETETETTTGPVDVDCCVDAFDLGAGGSFRPVVRFTDKEERCRGGFHIHGSCDGLLLLSFEDRFYVCNPATHQWTRLSTPLRASWFAGFYRHDPTGEYRAMFYRGRWPSEHEDYYIMVPDSRRGRGIGLPAERDGYKFRGQPYGPPVLRRGHLHWMPRQTEAGYGILAFNTTTEALTVMCPPVVREHMSLAEVGGELAMVSCGNNNDTMVELWLLKDYEKEIWVCKHRIRLPAAVKMSTFTFDESWRMFFMSEEGVVVVTPEQKLVHYDMNGTLLETFPCDNGRHLKIAPYTFKESLVRHEFFEAQDCNAGDHEDEPELQPPFFQGL

SEQ ID NO: 9185 - DNA, 1611 bp, Sorghum bicolor
  misc_feature: Ceres ANNOT ID no. 6099218
  misc_feature: Encodes the peptide sequence at SEQ ID NO 9186
atggccggtgcggcggtggtgccgggccactactccggcagcagcagcggcgacgtcgtcgacgtcgcggcgctgtggcagcaggtcaagtccccggtagtggtgccgctgctgcggctgtcggtgtcgctgtgcctggccatgtccgtgatgctgttcgcggagaaggtgtacatggccgtggtgctcctggtgtcgcgcctgccgctgctcgggcggcggtaccggtgggagcccatcgtccgcgacggcgacggcgacctcgaggccggcggcggcggcgcggccgcctgctaccccatggtgctcgtccagatccccatgtacaacgagcgcgaggtgtaccatgtgtcgatcggggcggcgtgcgggctgtcgtggccgtcggaccggatcatcgtgcaggtgctggacgactccaccgaccccgtcatcaaggagctggttcgtgcggagtgttggcggtgggcgagcaagggcgtgaacgtcaagtacgaggtccgggacagccggcgagggtacaaggccggcgcgctccgtgacggcatgaagcgcgcctacgtccgcggctgcgacgtggtggccatcttcgacgccgacttccagccggacccggacttcctgcgccgcaccgtgcccttcctcctccacaaccccgacctcgcgctcgtccaggcgcgctggaacttcgtgaacgcagatgaatgcctgatgacaaggatgcaggagatctccctggattaccactttacagtggagcaggaggtcggctcctccacctacgccttcttcggcttcaatggaactgctggtgtatggcgcatatccgctttgaacgaggcaggaggatggaaggacaggaccacggttgaggacatggatctggcagtccgagcaagcctcaaaggatggaagtttgtattccttggtgatctcatggtgaaaaatgagctcccaagtacactcaaagcgtacagatatcagcaacacagatggtcatgtggaccggcgaacttgtttaggaaaatgttgatggagatcgtcagaaacaagaaagtgacactttggaagaagatccatgtcatctacaacttcttccttgtgcgcaagatcatagcacacattgtgacgtttgtgttctactgcatcgttatccctgcgacggtcttagttcctgaggttgaaataccaaagtggggctctgtctatatcccaaccataataagccttctcaatgctgttggcactccaaggtcggtccacttgattgtcttctggatcctctttgagaatgtgatgtcattgcatagaacaaaggccactttcattggcctattggaggcaggcagggtgaacgaatgggtggtgacagaaaaacttggtgatgccctgaggatgaaaatgccagccaaggcatgcaagaagccccgcataaagataggagataggttgcatattctggagcttggtgttgcagcttacctcttcttctgtggatgctatgacattgcatttgggaacaaccactactacatattcctattccttcaatccatcgctttcttcattgttggcataggctatgttggaacattcgtcccccactcatag

SEQ ID NO: 9186 - protein, 536 aa, Sorghum bicolor
  misc_feature: Ceres ANNOT ID no. 6099218
  misc_feature (103)..(278): Pfam Id: Glycos_transf_2 Pfam Desc: Glycosyl transferase family 2
  misc_feature (14)..(535): NCBI GI: 16519223 NCBI Desc: cellulose synthase-like protein oscsla9 [oryza sativa]
  misc_feature (16)..(536): NCBI GI: 109628383 NCBI Desc: cellulose synthase-like a1 [pinus taeda]
  misc_feature (2)..(534): NCBI GI: 109628385 NCBI Desc: cellulose synthase-like a2 [pinus taeda]
  misc_feature (6)..(534): NCBI GI: 20259890 NCBI Desc: glucosyltransferase-like protein [arabidopsis thaliana]
  misc_feature (22)..(533): NCBI GI: 92872976 NCBI Desc: glycosyl transferase, family 2 [medicago truncatula]
  misc_feature: Useful for making plants with altered cell wall content and/or composition
  misc_feature: Functional homolog of the protein sequence encoded by LOCUS at2g35650
  misc_feature: Functional homolog of the protein sequence encoded by LOCUS at4g16590
  misc_feature: GREAT-hit functional homolog of the protein sequence encoded by LOCUS at5g03760
  misc_feature: Functional homolog of the protein sequence encoded by LOCUS at5g16190
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: The sequence is a functional homolog of SEQ ID NO. 403 in the 11/188,298 US application
MAGAAVVPGHYSGSSSGDVVDVAALWQQVKSPVVVPLLRLSVSLCLAMSVMLFAEKVYMAVVLLVSRLPLLGRRYRWEPIVRDGDGDLEAGGGGAAACYPMVLVQIPMYNEREVYHVSIGAACGLSWPSDRIIVQVLDDSTDPVIKELVRAECWRWASKGVNVKYEVRDSRRGYKAGALRDGMKRAYVRGCDVVAIFDADFQPDPDFLRRTVPFLLHNPDLALVQARWNFVNADECLMTRMQEISLDYHFTVEQEVGSSTYAFFGFNGTAGVWRISALNEAGGWKDRTTVEDMDLAVRASLKGWKFVFLGDLMVKNELPSTLKAYRYQQHRWSCGPANLFRKMLMEIVRNKKVTLWKKIHVIYNFFLVRKIIAHIVTFVFYCIVIPATVLVPEVEIPKWGSVYIPTIISLLNAVGTPRSVHLIVFWILFENVMSLHRTKATFIGLLEAGRVNEWVVTEKLGDALRMKMPAKACKKPRIKIGDRLHILELGVAAYLFFCGCYDIAFGNNHYYIFLFLQSIAFFIVGIGYVGTFVPHS

SEQ ID NO: 9187 - DNA, 2463 bp, Sorghum bicolor
  misc_feature: Ceres ANNOT ID no. 6099220
  misc_feature: Encodes the peptide sequence at SEQ ID NO 9188
atgaagagcccccctgtcatggatcccgaggcgccgccgccgccgggcactcctccctacgacgacgaggaggaggaggaggaggaggaggaggagaaggcgcggggagcacggaagcgggtgccgtggcggatgacgctgagcctggcgtaccagagcctcggcgtggtgtacggcgacctcagcacgtcgccgctgtacgtgtacaaggcggcgttcgcggaggacatccagcactcggagagcaacgacgagatcctcggcgtgctctccttcgtcttctggacgctcacgctcgtcccgctcctcaagtacgtctgcgtcgtcctccgcgccgacgaccacggcgagggtggcaccttcgcgctctactccctcctctgccgccacgcgcgcgccgcgctgctcccgccgggacggaccgccgccggcgaggaggacaagttcttggacggagccaccaagaaggctacggcgcagaacggcaatgctgcgacgctgggcgggggcgccgccgccagcgtcaggaggctgctgcagcggcacaaggtcctccagcgtgtgctgctcgtgctggcgctggtgggcacctgcatggtgatcggcgacggcgtgctcacgccggccatctccgtcttctctgcggtctccgggctggagctgtccatggagaaggaacatcataaatatgtggaacttcctattgcctgtatcatactggtttgcctgtttgcactgcaacactatggtacacaccgggttggcttcatttttgctccagttgtgataacatggctcctatgtataagcgtgatcggtgtttacaatattattcactgggaacccactgtatatcgagcattatctccgtattacatgtacaagttcttgaggaagacacagagaggaggttggatgtccctgggaggaatactgttatgcgtaactggttctgaagcaatgtttgctgatctggggcatttcaaccagttgtcaatacagattgcttttacatgcatggtgtatccagcattgatccttgcatacatgggacaagctgcttatctgtgtaagcatcataacatggaaactgactacaggattggattctatgtgtctgtgccagagaaaattaggtggcccgttatggcaattgctattcttgcagcagttgtgggaagccaagctgtcatcactggtacattctcaatgatcaagcagtgcacttctctgggctgctttcctcgggtgaagataattcatacatctgccaaagtacacgggcaaatatacatccctgagatcaattggattctgatgatactgtgcttagctgtaaccattggattcaggaacacaaaacacttggggaatgcatcaggattggctgttataactgtcatgctggtcacaacgtgtctgatgtccctggtgatagtcttgtgctggcataagagcatatttcttgcaattgccttcattgtgttctttggaaccattgaggcactgtacttctcagctgcactcatcaagttcaaggagggagcctgggtcccaatagtccttgctctgatcttcattttgataatgtgcatctggcactatggcaccattaagaagtatgagtttgacgttcagagcaaggtctccatcaactggctccttggtctcagcccaaacctcggtattgttcgtgtccgtggcattggcctcatccacactgagctcgaaaccggcatcccagctatcttctcgcattttgtcaccaacttaccggcctttcaccaggtactcatatttatgtgcatcaagaacgtgccaataccacatgtacggcctgaagagcggttcctcgttggaaggatcggtccgaagcagtacagaatctaccggtgcattgtcaggtacggttaccacgacttccacaaagacgacattgagttcgagaaggagctagtgtgcagcgtcgcggagttcatccggtcagggtcatccaagttgaacggcatgcccgtggagttcgacgaggagcagcacatggcggtcgtgcgctccaacagcatccgcatgcttgaggaagaggccaccacagtggagaagaccgttggcccgtcgcatgccagcagggagatacagtcaccatcaccgtcaccgtcgccgtcaccagcgaccccagtggttgtccccaagaagcgggtgcggttcgtgctgccggcagcgagcccgaagccaaacgccggcgtgcaggaggagctgcaggagctgtccgacgcgcgggaggctggcatggcgttcatcctgggccactcgcacgtgaaggccaagagcgggtccagcttcctccgccggttcgtgatcaacttctgctacgacttcctgcggaggaacagccggggacccaactacgccgtctccatcccgcacgcctccacgctggaggtgggcatgatgtactatatctga

SEQ ID NO: 9188 - protein, 820 aa, Sorghum bicolor
  misc_feature: Ceres ANNOT ID no. 6099220
  misc_feature (48)..(820): Pfam Id: K_trans Pfam Desc: K+ potassium transporter
  misc_feature (1)..(694): NCBI GI: 62900352 NCBI Desc: potassium transporter 10 (oshak10)
  misc_feature (231)..(820): NCBI GI: 3176686 NCBI Desc: similar to high affinity potassium transporter, hak1 protein gbu22945 from schwanniomyces occidentalis. [arabidopsis thaliana]
  misc_feature (30)..(820): NCBI GI: 75232649 NCBI Desc: probable potassium transporter 9 (oshak9)
  misc_feature (38)..(820): NCBI GI: 91204710 NCBI Desc: potassium transporter [phragmites australis]
  misc_feature (38)..(820): NCBI GI: 91204708 NCBI Desc: potassium transporter [phragmites australis]
  misc_feature: The plants are small.
  misc_feature: Useful for making plants with modulated biomass
  misc_feature: GREAT-hit functional homolog of the protein sequence given in SEQ ID NO 13565
  misc_feature: Useful for making plants with modulated biomass
  misc_feature: Functional homolog of the protein sequence given in SEQ ID NO 13565
  misc_feature: The sequence is a functional homolog of SEQ ID NO. 279 in the 11/188,298 US application
MKSPPVMDPEAPPPPGTPPYDDEEEEEEEEEEKARGARKRVPWRMTLSLAYQSLGVVYGDLSTSPLYVYKAAFAEDIQHSESNDEILGVLSFVFWTLTLVPLLKYVCVVLRADDHGEGGTFALYSLLCRHARAALLPPGRTAAGEEDKFLDGATKKATAQNGNAATLGGGAAASVRRLLQRHKVLQRVLLVLALVGTCMVIGDGVLTPAISVFSAVSGLELSMEKEHHKYVELPIACIILVCLFALQHYGTHRVGFIFAPVVITWLLCISVIGVYNIIHWEPTVYRALSPYYMYKFLRKTQRGGWMSLGGILLCVTGSEAMFADLGHFNQLSIQIAFTCMVYPALILAYMGQAAYLCKHHNMETDYRIGFYVSVPEKIRWPVMAIAILAAVVGSQAVITGTFSMIKQCTSLGCFPRVKIIHTSAKVHGQIYIPEINWILMILCLAVTIGFRNTKHLGNASGLAVITVMLVTTCLMSLVIVLCWHKSIFLAIAFIVFFGTIEALYFSAALIKFKEGAWVPIVLALIFILIMCIWHYGTIKKYEFDVQSKVSINWLLGLSPNLGIVRVRGIGLIHTELETGIPAIFSHFVTNLPAFHQVLIFMCIKNVPIPHVRPEERFLVGRIGPKQYRIYRCIVRYGYHDFHKDDIEFEKELVCSVAEFIRSGSSKLNGMPVEFDEEQHMAVVRSNSIRMLEEEATTVEKTVGPSHASREIQSPSPSPSPSPATPVVVPKKRVRFVLPAASPKPNAGVQEELQELSDAREAGMAFILGHSHVKAKSGSSFLRRFVINFCYDFLRRNSRGPNYAVSIPHASTLEVGMMYYI

SEQ ID NO: 9189 - DNA, 1497 bp, Sorghum bicolor
  misc_feature: Ceres ANNOT ID no. 6099226
  misc_feature: Encodes the peptide sequence at SEQ ID NO 9190
atgtggcatgtaactccggcgtgcgtggtggaactggtagcttgcgagacttcggccgggccagagcacagagcttccctgctgtgcacaccgaagcacagagtttctgccagtgccagcaggagaagcttgagattcaccgctagggccagctcgaatccgggcgcccaggtgagcatcccgaagcaatggtacaacctcatcgccgacctgccggtgaagccgccgccaccactgcacccgcagacacaccagcctctgaatcccagcgatctctcccctctcttccccgacgagctgatcaggcaggaggtcaccgacgagcgcttcgtcgacattcccgaggaggtcatcgacgtctacaagctctggcgcccgacgcccctgatcagggccaggaggctggagaagctgctgggcacgccggcgaagatctactacaagtacgaggggacgagcccggcggggtcgcacaagcccaacaccgccgtgccgcaggcgtggtacaacgccgcggcaggggtgaagaacgtggtcaccgagaccggcgccggccagtggggcagcgcgctgtccttcgccagcagcctcttcggcctcaactgcgaggtgtggcaagtgcgcgcgtcgttcgaccagaagccgtaccggaggctgatgatggagacgtggggcgccaaggtgcacccgtcgccgtcgacggcgacggaggccggcaagaggatcctggaggcggacccgtcgagccccggcagcctcgggatcgccatctccgaggcggtggaggtggcggccaccaacgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcctgcgcgagaagctgcgcggcaacatgagccccgcgttcagggccgtggagcccgcggcgtgccccacgctcaccaagggcgtctacgcctacgacttcggcgacacggccggcctcacgccgctgatgaagatgcacaccctcggccacggcttcgtccccgacccgatccatgcaggtgggcttcgctaccatggaatggcacctctgatctcgcacgtctacgagctgggcttcatggatgccattgctatacagcagactgaatgcttccaagctgccctgcaattcgccaggacggagggcatcatcccggcgccggagccgacgcacgcgatcgcggcggcgatcagggaggcgctggagtgcaagcggaccggggaggagaaggtcatcctgatggccatgtgcggccacggccacttcgacctcgccgcgtacgagaagtacctgaggggcgacatggtcgatctctcgcacccggcggagaagctggaggcctccctcgctgccgtgcccaaagtctga

SEQ ID NO: 9190 - protein, 498 aa, Sorghum bicolor
  misc_feature: Ceres ANNOT ID no. 6099226
  misc_feature (120)..(461): Pfam Id: PALP Pfam Desc: Pyridoxal-phosphate dependent enzyme
  misc_feature (34)..(498): NCBI GI: 23198094 NCBI Desc: tryptophan synthase beta chain [arabidopsis thaliana]
  misc_feature (60)..(496): NCBI GI: 119475807 NCBI Desc: tryptophan synthase subunit beta [marine gamma proteobacterium htcc2143]
  misc_feature (59)..(498): NCBI GI: 86573852 NCBI Desc: tryptophan synthase, beta chain-like [rhodopseudomonas palustris haa2]
  misc_feature (60)..(498): NCBI GI: 118045251 NCBI Desc: tryptophan synthase, beta chain-like [chloroflexus aggregans dsm 9485]
  misc_feature (60)..(498): NCBI GI: 76258962 NCBI Desc: tryptophan synthase, beta chain-like [chloroflexus aurantiacus j-10-fl]
  misc_feature (60)..(480): SWISSPROT Homolog: EC 4.2.1.20 Tryptophan synthase beta chain 2
MWHVTPACVVELVACETSAGPEHRASLLCTPKHRVSASASRRSLRFTARASSNPGAQVSIPKQWYNLIADLPVKPPPPLHPQTHQPLNPSDLSPLFPDELIRQEVTDERFVDIPEEVIDVYKLWRPTPLIRARRLEKLLGTPAKIYYKYEGTSPAGSHKPNTAVPQAWYNAAAGVKNVVTETGAGQWGSALSFASSLFGLNCEVWQVRASFDQKPYRRLMMETWGAKVHPSPSTATEAGKRILEADPSSPGSLGIAISEAVEVAATNADTKYCLGSVLNHVLLHQTVIGEECLEQLAALGETPDVVIGCTGGGSNFGGLAFPFLREKLRGNMSPAFRAVEPAACPTLTKGVYAYDFGDTAGLTPLMKMHTLGHGFVPDPIHAGGLRYHGMAPLISHVYELGFMDAIAIQQTECFQAALQFARTEGIIPAPEPTHAIAAAIREALECKRTGEEKVILMAMCGHGHFDLAAYEKYLRGDMVDLSHPAEKLEASLAAVPKV

SEQ ID NO: 9191 - DNA, 1155 bp, Sorghum bicolor
  misc_feature: Ceres ANNOT ID no. 6099249
  misc_feature: Encodes the peptide sequence at SEQ ID NO 9192
atgggcgcggtggcgtcgacggtggcggcgcgcttcgcgttcttcccgccgaccccgccgtcgtacggggtggagccgccgccgtcgccggccgcggcggcggcggactcggaggtggtggagctcagcggggtgcccgtgtcgaggggccgcggcgtggaggcgcggcggctgcccacgaagcgcggcaccgaggtggtggccatgtacgtgcgccagcccggggcgcgcctcacgctgctctactcccacggcaacgccgccgacctgggccagatgtacgagctcttcgtcgagctcagcgcccacctcaacgtcaacctcatgggttatgattattctgggtacggacaatcatctgggaagccaagtgagcaaaacacgtatgctgatatagaagctgtttataggtgtcttatagaaacatatggagcctctgaggaaaacatcattctatatggtcaatcagtggggagtggccctactttggatttagcatcccgtttgcctcatttacgagctgttgttctacatagcccaatttcatctggtttaagagtgatgtatcctgtaaagcatacatattggtttgacatatataagaacattgacaaaattcctctggtcaagtgtcctgtattagttatacatggtacagcggatgaggttgttgactgttctcatgggagggcactatgggaactatccaaagtgaaatacgagcctctatgggtcaaaggagggaaccactgtaatttggaattgtatccagaatacattaagcacctgaaaaaatttgtcaatgccatagagagatcaccaccagttaaagatgaatctccggagagttcaggtccttcagatcctagtgaaacaggatccgaaagtgcggagagctcacggagaagcacagatatccgggagaaaccaagatcaagcattgatcatagacctagcattgatcgacgggagaaacctaggggaagtatagacaggagagataaaagcagaaagagcgttgatcagcttgacaaaccacgggctagtgtggatcaacctgaccggccgcggaagagcattgatcgcttcgggggtatgatgaggtcagtcaagttgtgcaatattgactgtttcactgcggcttctgggagctga

SEQ ID NO: 9192 - protein, 384 aa, Sorghum bicolor
  misc_feature: Ceres ANNOT ID no. 6099249
  misc_feature (1)..(384): NCBI GI: 51535771 NCBI Desc: cgi67 serine protease-like [oryza sativa (japonica cultivar-group)]
  misc_feature (1)..(362): NCBI GI: 124359459 NCBI Desc: esterase/lipase/thioesterase [medicago truncatula]
  misc_feature (1)..(338): NCBI GI: 56784467 NCBI Desc: cgi67 serine protease-like [oryza sativa (japonica cultivar-group)]
  misc_feature (1)..(338): NCBI GI: 115439289 NCBI Desc: os01g0689800 [oryza sativa (japonica cultivar-group)]
  misc_feature (1)..(272): NCBI GI: 140067578 NCBI Desc: c2; esterase/lipase/thioesterase [medicago truncatula]
MGAVASTVAARFAFFPPTPPSYGVEPPPSPAAAAADSEVVELSGVPVSRGRGVEARRLPTKRGTEVVAMYVRQPGARLTLLYSHGNAADLGQMYELFVELSAHLNVNLMGYDYSGYGQSSGKPSEQNTYADIEAVYRCLIETYGASEENIILYGQSVGSGPTLDLASRLPHLRAVVLHSPISSGLRVMYPVKHTYWFDIYKNIDKIPLVKCPVLVIHGTADEVVDCSHGRALWELSKVKYEPLWVKGGNHCNLELYPEYIKHLKKFVNAIERSPPVKDESPESSGPSDPSETGSESAESSRRSTDIREKPRSSIDHRPSIDRREKPRGSIDRRDKSRKSVDQLDKPRASVDQPDRPRKSIDRFGGMMRSVKLCNIDCFTAASGS

SEQ ID NO: 9193 - DNA, 861 bp, Sorghum bicolor
  misc_feature: Ceres ANNOT ID no. 6099253
  misc_feature: Encodes the peptide sequence at SEQ ID NO 9194
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atgtcaagttccacgaattcaacagtggccgcggagttgtcgatggctgagaagagtgggggtattgagccgctaccttttgtgcatgacaaacatggaggtgtcatcattgagatggcgaccccaatggatcctgcagtgttttcagcttctttgaaagcagcgctggcgaaatggagggagcagggaataagaggtgtctggatcaaattgcccatcgccctttccaaccttattccaccagttgtagaggaaggtttctggtaccatcatgcagaggaaacttacttgatgcttgcatactggcttccaaatacaacacatacactaccagtaaacgcaacccaccgcgttggtgttggagcttttataatgaatgacaaaagagaggtcttggttgtacaagaaaagagtggtgtacttcgaggcctaggtgtgtggaaatttccaactggcgtagttgaaccgggggaagatattaatgttggagctgtaagagaagtaaaagaagagacagggattgatgcagaatttgttgaagtgctggccttcaggcagagccacaaatctttttttgataaatcagatctatttttcgtgtgcctgctacgaccactttcatatgacattacaaagcaagactcggaaatagaggcatgccagtggatgccaatagaggaatttgcggcgcaaccatttgtccagaaacatgagcttgtgaagtacatcctcgaagtaggcctggctaaagttgacaaggaatatgcagggttttcgccaatctccataaaatcagcatttacagacaaattgtccttattttacatgaaccggagggacctggacagggcctcaggatag

SEQ ID NO: 9194 - protein, 286 aa, Sorghum bicolor
  misc_feature: Ceres ANNOT ID no. 6099253
  misc_feature (116)..(246): Pfam Id: NUDIX Pfam Desc: NUDIX domain
  misc_feature (1)..(281): NCBI GI: 17978727 NCBI Desc: mutt domain protein-like [arabidopsis thaliana]
  misc_feature (25)..(281): NCBI GI: 9758793 NCBI Desc: mutt domain protein-like [arabidopsis thaliana]
  misc_feature (23)..(280): NCBI GI: 38604044 NCBI Desc: at4g25434 [arabidopsis thaliana]
  misc_feature (3)..(281): NCBI GI: 89257502 NCBI Desc: hydrolase, nudix family protein [brassica oleracea]
  misc_feature (23)..(174): NCBI GI: 79325255 NCBI Desc: catalytic [arabidopsis thaliana]
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MSSSTNSTVAAELSMAEKSGGIEPLPFVHDKHGGVIIEMATPMDPAVFSASLKAALAKWREQGIRGVWIKLPIALSNLIPPVVEEGFWYHHAEETYLMLAYWLPNTTHTLPVNATHRVGVGAFIMNDKREVLVVQEKSGVLRGLGVWKFPTGVVEPGEDINVGAVREVKEETGIDAEFVEVLAFRQSHKSFFDKSDLFFVCLLRPLSYDITKQDSEIEACQWMPIEEFAAQPFVQKHELVKYILEVGLAKVDKEYAGFSPISIKSAFTDKLSLFYMNRRDLDRASG

SEQ ID NO: 9195 - DNA, 1338 bp, Sorghum bicolor
  misc_feature: Ceres ANNOT ID no. 6099256
  misc_feature: Encodes the peptide sequence at SEQ ID NO 9196
atggccgccggggacgcaggccgcgcgccgacggcagcggccgcgcaatcgctggtggagtccttctgcggcgtgacctccgcgaccccccaggaggcggccttctacctcgagagccacaactgggccctggaatccgccgtccgctcctactacgactccgcggacggcgaacccgacgccggcgccgccgatccagtgcccccgccaccagctgcaccagccggaggtggggaggacaccgaggatgaggattacgtggtcggcggcggcggcgacgaggacgaggatgatgaggactacgtcgatggcgacgacggagacgatgaggacgccgcgctcgccgctgaggccgcggcggaagaggagaggaggaggcctgtgaagaggcagaagaaaagccacgacgcgcggggtgggagcggtagcagaagcggcagcagggccagggcgggtggtgcgagtgcgcgggggaatgtgaggacgctctccgatctcggtggtggcaagggaaccgcggggtccgacgagaactccgaagacgacgatgaatgggcaccaccaccggagtacttcactggcggcgagacgagtggaatggttgttagagatcgatcaaaacgtaaaaacaacacagatgaggtattcaagcaagctaaaaggaagggggctaagcaaggtccgtttgaggctcgccggcgatctagttcgaggaactttactgggactggcagacttctgacaggtgaaactgtagagcgtgatgcaccacagccaccagaagaaattgtccataacatctacttctggaggaatggcttcacagtaaacgatggcccacttagaagtttcgatgatccagcaaatgcgtcctttttgaagagcatcaaggattctgtctgcccaactgagcttgagccggctgatgggaaatctaaggtgaatgtgaatcttgtccggaaggaagaagaatttactgagccagtcaagcatgctgctccttttgaaggggaacgcaggaccctcatggaaccttctgacaataatacttccaatgctgctgcttccagtagtgtacctgctcctcggacaatcacagtggatgattctttgccatcaacctccctccaaatcaggtttgcagatggcagtcgcttggttgcccgtttcaacacaagccacacaattggcgacgtgcggtcatttatcgacgcgacaaggcctgcatccagtgattacacgctgcaggccgggttccccccaaagccgcttgaggacgcgaccaagaccattgaggaagccggcatcgccaactcggtgatcattcagtcggtctag

SEQ ID NO: 9196 - protein, 445 aa, Sorghum bicolor
  misc_feature: Ceres ANNOT ID no. 6099256
  misc_feature (267)..(340): Pfam Id: SEP Pfam Desc: SEP domain
  misc_feature (368)..(445): Pfam Id: UBX Pfam Desc: UBX domain
  misc_feature (1)..(444): NCBI GI: 51535897 NCBI Desc: phosphatase-like [oryza sativa (japonica cultivar-group)]
  misc_feature (134)..(445): NCBI GI: 115458836 NCBI Desc: os04g0464500 [oryza sativa (japonica cultivar-group)]
  misc_feature (143)..(443): NCBI GI: 13123657 NCBI Desc: phosphatase-like protein mtc923 [medicago truncatula]
  misc_feature (130)..(445): NCBI GI: 13123659 NCBI Desc: phosphatase-like protein psc923 [pisum sativum]
  misc_feature (38)..(441): NCBI GI: 7268288 NCBI Desc: phosphatase like protein [arabidopsis thaliana]
MAAGDAGRAPTAAAAQSLVESFCGVTSATPQEAAFYLESHNWALESAVRSYYDSADGEPDAGAADPVPPPPAAPAGGGEDTEDEDYVVGGGGDEDEDDEDYVDGDDGDDEDAALAAEAAAEEERRRPVKRQKKSHDARGGSGSRSGSRARAGGASARGNVRTLSDLGGGKGTAGSDENSEDDDEWAPPPEYFTGGETSGMVVRDRSKRKNNTDEVFKQAKRKGAKQGPFEARRRSSSRNFTGTGRLLTGETVERDAPQPPEEIVHNIYFWRNGFTVNDGPLRSFDDPANASFLKSIKDSVCPTELEPADGKSKVNVNLVRKEEEFTEPVKHAAPFEGERRTLMEPSDNNTSNAAASSSVPAPRTITVDDSLPSTSLQIRFADGSRLVARFNTSHTIGDVRSFIDATRPASSDYTLQAGFPPKPLEDATKTIEEAGIANSVIIQSV

SEQ ID NO: 9197 - DNA, 804 bp, Sorghum bicolor
  misc_feature: Ceres ANNOT ID no. 6099272
  misc_feature: Encodes the peptide sequence at SEQ ID NO 9198
atggccaaacgacccacggtgccaaagttcggcgcctgggacaacgacgatgtcgggtacacggtctacttcgacaaggtgcgcgagaacaagggcgccacggcgccgccgctgcaccggccgcacagcctcgacgacccggaggaggggcccatgatgagagtccctccgccgtcgtcgtcgaggccggccaccgcgggaggccaccgcgaggcgccgccgtcgtcgaggcggcaccacgggcagggcggccaccggcgaacggagagcagcagcagcgtggcgtccgacccaggctccgcccaccaaagcaagttcgcgccgccgccgcagtactaccaacgcacgagccacggccaccaccgtcaccacagcggtggccaccaccaccaccagcagcagcagcagcagcagcagcagcccccgtcctcccacggccacggccacggccacggccaccgagcctcgcacgcgcacagcaggcagcagcagcaccaccacgcggcgccgggtccccgggcgcggtccgcctcgccgcagagcaacgccccgaatcgacagcggccgtcggccgtgcccaggttcggcgtgtgggacgagcagtccgccgagtcggcggcgcaggggttcacggtggtgttcgagaacgtgaagcggcaccgggaggtggccaggtccggggtgccggctgtgccgcgcgtgccgtcgccgccggagggcgccgcgttgaggcgccaccatcaaaagacccctttcgtgtccaagatgtttggatgtttccttcccaccactgccaaaggctga

SEQ ID NO: 9198 - protein, 267 aa, Sorghum bicolor
  misc_feature: Ceres ANNOT ID no. 6099272
  misc_feature (3)..(73): NCBI GI: 115477405 NCBI Desc: os08g0526400 [oryza sativa (japonica cultivar-group)]
  misc_feature (118)..(167): NCBI GI: 9246934 NCBI Desc: vrrb [bacillus anthracis]
  misc_feature (118)..(167): NCBI GI: 9246938 NCBI Desc: vrrb [bacillus anthracis]
  misc_feature (118)..(167): NCBI GI: 9246942 NCBI Desc: vrrb [bacillus anthracis]
  misc_feature (118)..(167): NCBI GI: 9246940 NCBI Desc: vrrb [bacillus anthracis]
MAKRPTVPKFGAWDNDDVGYTVYFDKVRENKGATAPPLHRPHSLDDPEEGPMMRVPPPSSSRPATAGGHREAPPSSRRHHGQGGHRRTESSSSVASDPGSAHQSKFAPPPQYYQRTSHGHHRHHSGGHHHHQQQQQQQQQPPSSHGHGHGHGHRASHAHSRQQQHHHAAPGPRARSASPQSNAPNRQRPSAVPRFGVWDEQSAESAAQGFTVVFENVKRHREVARSGVPAVPRVPSPPEGAALRRHHQKTPFVSKMFGCFLPTTAKG

SEQ ID NO: 9199 - DNA, 942 bp, Sorghum bicolor
  misc_feature: Ceres ANNOT ID no. 6099288
  misc_feature: Encodes the peptide sequence at SEQ ID NO 9200
atgggcgcggaggcggagtgcgacaggatcagggggccgtggagccccgaggaggacgacgcgctgcggcggctggtggagcggcacggcgcgcgcaactggacggcgatcgggcgcgagatccctggccggtcgggcaagtcgtgccgcctgcggtggtgcaaccagctgtcgccgcaggtggagcgccggcccttcacgcccgaggaggacgccgccatcgtccgcgcccacgcgcggctcggcaaccgctgggccgccatcgcgcgcctcctcccagggcgcaccgacaacgccgtcaagaaccactggaactgctccctcaagcgcaagctcgccgtcgccaccaccgccgccgccgtgtccggttcgggagtggtctccgctgacgccgccgccgagatcgaggcgacgcgcccgatcaagcgcgtcagcctctcgcccgacagcccgtcgggttccgggtcggggtccgggtctaggtccgaccgtagcgacctcagccacggctccggctccggctccggccagatttaccgcccggtggcgcggtccggtgggttcgagccagcagactgcgcgatgagccgtccgcaggaggacgacgacccgctgacctccctcagcctgtcgctcccgggcacggaccaccagcggttccaccacgaccgcgcccacagccagttccaggagctcccggcgtcgccgccctcaccctccccgccttctccggcggcggcaccaccctcggcgtacccgttcagcccggacttcatggcggcgatgcaggagctgatccgcacggaggtgcagcggtacatggcgagcgtgggcgtgcgcgccgggtgcggcgccacgggcggtgccgccgacctctgcatgccgcagcttgtcgagggcgtcatgcgcgccgccgccgagcgagtcggccggatgcagtag

SEQ ID NO: 9200 - protein, 313 aa, Sorghum bicolor
  misc_feature: Ceres ANNOT ID no. 6099288
  misc_feature (11)..(57): Pfam Id: Myb_DNA-binding Pfam Desc: Myb-like DNA-binding domain
  misc_feature (63)..(108): Pfam Id: Myb_DNA-binding Pfam Desc: Myb-like DNA-binding domain
  misc_feature (1)..(285): NCBI GI: 86129720 NCBI Desc: myb transcription factor tamyb1 [triticum aestivum]
  misc_feature (8)..(267): NCBI GI: 9954112 NCBI Desc: tuber-specific and sucrose-responsive element binding factor [solanum tuberosum]
  misc_feature (6)..(273): NCBI GI: 27529846 NCBI Desc: myb-like protein [nicotiana tabacum]
  misc_feature (8)..(280): NCBI GI: 124389898 NCBI Desc: myb transcription factor [capsicum annuum]
  misc_feature (6)..(310): NCBI GI: 63054325 NCBI Desc: sucrose responsive element binding protein [vitis vinifera]
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGAEAECDRIRGPWSPEEDDALRRLVERHGARNWTAIGREIPGRSGKSCRLRWCNQLSPQVERRPFTPEEDAAIVRAHARLGNRWAAIARLLPGRTDNAVKNHWNCSLKRKLAVATTAAAVSGSGVVSADAAAEIEATRPIKRVSLSPDSPSGSGSGSGSRSDRSDLSHGSGSGSGQIYRPVARSGGFEPADCAMSRPQEDDDPLTSLSLSLPGTDHQRFHHDRAHSQFQELPASPPSPSPPSPAAAPPSAYPFSPDFMAAMQELIRTEVQRYMASVGVRAGCGATGGAADLCMPQLVEGVMRAAAERVGRMQ

SEQ ID NO: 9201 - DNA, 1188 bp, Sorghum bicolor
  misc_feature: Ceres ANNOT ID no. 6099292
  misc_feature: Encodes the peptide sequence at SEQ ID NO 9202
atgatcgcttctatctgccggcggcagctcctccgccttcgccaaatcccctccgccgccggcataaaccccagccggcccaaccccagcgatgccctcctctcccacgcctgctcctcagctgccctcgtgggtgtccccgtctccaagccctgcccaaccaccatctcctacctcatctcctgcgggctcccccccgccgccgcgtccgcctgcaagcgccgcatccgctccaccgccaaggccgacgccgtccgcgctctcttccgcacctacggcttcactgatgcggacatcaccgaggtggtccgcagaaaggcatggatcctcaccctcgaccctgaccggatcctccggcccaagctcgatcttttcgcttccctccgcatcaagccgcggaggctcgccaccgcgccgaacctcctcgatcgcagcctcgacaagcacctcctgccccgcatccagttcctccgcggcataatcggcagcgacggcgacgtcggttccgcgatctaccgcgccccacgcgccctccaggtcgacctggacaagaggatgcgcccggtcgtggacgccctccgccgactcggcctccccgacaagtccatctcgaagctcctcaccatcgagatgagcgtgctcacactttcagtcgaccgcataacccagatctttgatgacgtcaaggtgcttggcctgggcgtaacagacacgggctttgtctacggcatcaggctgttctgcaacctcagtagggaaacgtggctgcgaaaggtggccctgtaccggagcttcggtgtctctgagggcgacctccaaaaggcgatcaagaggcaacccacgatactgcatctctctgatgagaacataaagaagaagctccggttcttcctggatgacttgaagtttgaactaagcgaagtaatggagcgacctgtgcttatagattatagcttggagaagaccatcataccaaggtgtgccgtgataagcgttttgatgagggagagaaagattgaccccaacatcaagttaccttcagcattgcttggtagtgccaagggtttctccaaaaggtatgtcttgaggcatgctcaggatgtgccagatgttgttaaggcatatgagggtaaaattgcatttgaaggatttagggatggagatgttttagttccactgaagccatga

SEQ ID NO: 9202 - protein, 395 aa, Sorghum bicolor
  misc_feature: Ceres ANNOT ID no. 6099292
  misc_feature (3)..(358): Pfam Id: mTERF Pfam Desc: mTERF
  misc_feature (50)..(375): NCBI GI: 15218140 NCBI Desc: mitochondrial transcription termination factor family protein / mterf family protein [arabidopsis thaliana]
  misc_feature (27)..(379): NCBI GI: 115460850 NCBI Desc: os04g0637500 [oryza sativa (japonica cultivar-group)]
  misc_feature (10)..(375): NCBI GI: 51536063 NCBI Desc: mitochondrial transcription termination factor-like [oryza sativa (japonica cultivar-group)]
  misc_feature (53)..(379): NCBI GI: 140038634 NCBI Desc: mitochodrial transcription termination factor-related [medicago truncatula]
  misc_feature (22)..(383): NCBI GI: 51536067 NCBI Desc: mitochondrial transcription termination factor-like [oryza sativa (japonica cultivar-group)]
  misc_feature: Useful for making plants with altered alkaloid content
  misc_feature: Useful for making plants with altered terpenoid content
  misc_feature: Functional homolog of the protein sequence given in SEQ ID NO 13002
  misc_feature: GREAT-hit functional homolog of the protein sequence given in SEQ ID NO 13150
  misc_feature: Useful for making plants with altered terpenoid content
  misc_feature: Functional homolog of the protein sequence given in SEQ ID NO 13150
MIASICRRQLLRLRQIPSAAGINPSRPNPSDALLSHACSSAALVGVPVSKPCPTTISYLISCGLPPAAASACKRRIRSTAKADAVRALFRTYGFTDADITEVVRRKAWILTLDPDRILRPKLDLFASLRIKPRRLATAPNLLDRSLDKHLLPRIQFLRGIIGSDGDVGSAIYRAPRALQVDLDKRMRPVVDALRRLGLPDKSISKLLTIEMSVLTLSVDRITQIFDDVKVLGLGVTDTGFVYGIRLFCNLSRETWLRKVALYRSFGVSEGDLQKAIKRQPTILHLSDENIKKKLRFFLDDLKFELSEVMERPVLIDYSLEKTIIPRCAVISVLMRERKIDPNIKLPSALLGSAKGFSKRYVLRHAQDVPDVVKAYEGKIAFEGFRDGDVLVPLKP

SEQ ID NO: 9203 - DNA, 2262 bp, Sorghum bicolor
  misc_feature: Ceres ANNOT ID no. 6099294
  misc_feature: Encodes the peptide sequence at SEQ ID NO 9204
atgggagtaatatatcctcttatgtttcttttcctgctattgcttcatggaactagtgctgctttgaaggatccagtacagaaatggcagactctaagtggtgcccctccattagtcatagctcgtggtgggtactctgggctgttccctgattcaagccaattcgggtaccagtttgccctgtcgaatagtctgcctgaagttgttcttttctgtgatttacaactttcaagtgacaacgttggattctgcaagactggcttggcacttgatgactcaacgctaatagctaaggtcttccctaagaatgacaagacatacaaagtgaatggagacggcctgcacggatggttttcagtcgacttcacttcaaatcagctaatggacaatgtcacattgatccagaatgttctgtcccgcccaagcatatttgatggcaccatgggaattagccttattgatgatgtcgtagaactccaccctcctcaactttggattaatatacagtatggacagttcttcctagatcacaaattaaatatcgaagagtacatatcatctaaagcaaaagaatttggtgtcaattatgtctcctcacctgaagttggattcttgaaaagccttagtgggaagcttgggaaaagcaatgtgaagcttgtttttcggtttctcgatcaacaactcattgagccttccacaaaacaaccttatggaaccattctgaaggacttaaaatctgtcaaggcttttgcctcaggaattctcgtccccaagacttacatttggcctgtgaacaaggatcagtacttgcagccagctactactttggtgaaagatgctcatggcctagacttggaggtttatgcatttaagtttggcaatgatttcatttcaagttacaactacagctatgatcctagtgctgagtacttgcagtttattgatagttctgacttctctgttgatggtgtcctcactgacttcccatccacagcttcagcagccattgcttgcttagcacatactaaggacagctctcttcctcctcctggaaatgataccagaccactgatcatcacccacaatggtgcgtgtggcttattccctggctgcaccgaccttgcataccagcaagcagtggaagacggtgcagatataattgactgttcagtacagatgtcaaaggatgcagtgcccttttgcttggactccccggatcttacaaaagggacgacagcagcaacagtgttctcgacaaaagctgctactgtaaatgaaatacagaatgggtctggcatcttcgcatttgatcttctatcgagtgagatccaaactctaaagcctgatcttgttggcccatacaatcaagaaggactgaaaagaaatccagcagcaaagaacagtgggaaacttatgactttagttgatttcctggccttctcaaagagcaacaacatctctggtgtactagtcgatgttcgtaatgccccataccttgcaaccagaggcattgacattgtggatgctgtctccagcgcacttatcaatgccagctatgacaaagagaccaggcagcaggtgctcatcgcatcggacgattccgccgtgctcagagcattcaagaagttcccagcattcaagcgcgtcctccagatcggcaacgcaatcagcgatgtgtccaaggcatccgtggaggagatggccaagttcgcgagcgctgtgtccatcactcggggctcagttgtccaggcgcagggatcattcctcttgcggttcactgatgtgatcgacaagatgcatgccgcaaacctatcggtgtatgtcgggctgctcaggaacgagttcatgaaccttgggttcgacttctgggctaacccaatggttgagatcgtgacgtactcatctctgatggctgatgggattgtgaccgaattccctgcaacggcagcagagtacttcaggagcccatgcagtgacttcagtaagaacctgacctacacgatcatgcctgcaaagcctgggtctttgctcaaactgacagaccccagtgcactgcctccggcgcaggggccagcgccagtgctgaaacctgccgatgttgtggacccaccgctgccaccagtgaccatcagtacccctggagcttcagcatcttcgaatggttccagcactaccagtggtgcaagggtgtccactgcaagctctggtctttgcttgttggcaatcggactttctgtgttattggtaacgagctctaagtaa

SEQ ID NO: 9204 - protein, 753 aa, Sorghum bicolor
  misc_feature: Ceres ANNOT ID no. 6099294
  misc_feature (361)..(648): Pfam Id: GDPD Pfam Desc: Glycerophosphoryl diester phosphodiesterase family
  misc_feature (1)..(749): NCBI GI: 46390048 NCBI Desc: glycerophosphoryl diester phosphodiesterase 2 precursor-like protein [oryza sativa (japonica cultivar-group)]
  misc_feature (1)..(749): NCBI GI: 46390048 NCBI Desc: glycerophosphoryl diester phosphodiesterase 2 precursor-like protein [oryza sativa (japonica cultivar-group)]
  misc_feature (1)..(675): NCBI GI: 46390047 NCBI Desc: glycerophosphoryl diester phosphodiesterase 2 precursor-like protein [oryza sativa (japonica cultivar-group)]
  misc_feature (25)..(447): NCBI GI: 140067076 NCBI Desc: glycerophosphoryl diester phosphodiesterase [medicago truncatula]
  misc_feature (8)..(749): NCBI GI: 18416801 NCBI Desc: glycerophosphoryl diester phosphodiesterase family protein [arabidopsis thaliana]
  misc_feature: Useful for making plants with altered cell wall content and/or composition
  misc_feature: Functional homolog of the protein sequence encoded by LOCUS at5g58170
  misc_feature: Useful for making plants with altered cell wall content and/or composition
  misc_feature: Functional homolog of the protein sequence given in SEQ ID NO 14038
MGVIYPLMFLFLLLLHGTSAALKDPVQKWQTLSGAPPLVIARGGYSGLFPDSSQFGYQFALSNSLPEVVLFCDLQLSSDNVGFCKTGLALDDSTLIAKVFPKNDKTYKVNGDGLHGWFSVDFTSNQLMDNVTLIQNVLSRPSIFDGTMGISLIDDVVELHPPQLWINIQYGQFFLDHKLNIEEYISSKAKEFGVNYVSSPEVGFLKSLSGKLGKSNVKLVFRFLDQQLIEPSTKQPYGTILKDLKSVKAFASGILVPKTYIWPVNKDQYLQPATTLVKDAHGLDLEVYAFKFGNDFISSYNYSYDPSAEYLQFIDSSDFSVDGVLTDFPSTASAAIACLAHTKDSSLPPPGNDTRPLIITHNGACGLFPGCTDLAYQQAVEDGADIIDCSVQMSKDAVPFCLDSPDLTKGTTAATVFSTKAATVNEIQNGSGIFAFDLLSSEIQTLKPDLVGPYNQEGLKRNPAAKNSGKLMTLVDFLAFSKSNNISGVLVDVRNAPYLATRGIDIVDAVSSALINASYDKETRQQVLIASDDSAVLRAFKKFPAFKRVLQIGNAISDVSKASVEEMAKFASAVSITRGSVVQAQGSFLLRFTDVIDKMHAANLSVYVGLLRNEFMNLGFDFWANPMVEIVTYSSLMADGIVTEFPATAAEYFRSPCSDFSKNLTYTIMPAKPGSLLKLTDPSALPPAQGPAPVLKPADVVDPPLPPVTISTPGASASSNGSSTTSGARVSTASSGLCLLAIGLSVLLVTSSK

SEQ ID NO: 9205 - DNA, 1194 bp, Sorghum bicolor
  misc_feature: Ceres ANNOT ID no. 6099301
  misc_feature: Encodes the peptide sequence at SEQ ID NO 9206
atggcttcctctctttccgggagaggaggaggaagatggctgctattcccgatcatggcggcggcagcggcggctgtgctagctgtggcggcgccggcgtcagcgtgctacacgcgcgtgttcagcttcggcgactcgttggcggacacgggcaactaccgcttcttctacaccaacggctccgatcccgtgctccggctcccctacggcgagaccttcttccaccgcgccaccggccgcttcaccgacggccgcatcgtcctcgacttcatcgctgatgcgctggggcttccgttcgtgccgccgtacctgagcgggcggcggcggcgcgccgaggatttcttgcacggggccaacttcgcggtgggcggcgccacggcgctcggcccggacttcttccgggacaggggttttgacgtcggcgacgtagtgcacctcgacatggagatgaagtggttccgggacatgctcaacctcttctgccccggcaacctctcacgttgttcggacatgatgaaccaatcccttttcatagttggagaaattggaggcaatgactataatctacctcttatcagaaggattcccttcaagaatgttatcactttcgctccagctgttatcgccaaaatctcttcaactatcacagagttgatcaggctaggagccaaggctctggtggttccaggaaatctcccgattggatgcctcccaatgtatctgttgatattccagagtaaagaagattacgatctagggacaggctgcattagacggttgaacgagtttgcatggtaccacaacaagcttctcatcaaggaattggagaagttgcgtaagctccatcccggcgtgaccatcatctatgctgattactatggagccgctatggaggtttttgttcacccacaacgatatggaattgaatatcccttgatggcttgctgtggtggagaaggacgctatggtgtgtccccgggtgtaagatgtggacgtggagaatacaaattatgtgaaaacccagagacgcatggatcatgggatggcctgcatccgtcagaaagtgtatacagggcgattgcgacgagccttctacgtggctctcgtacacagccaccaatcgccaccgccgccagttcgtgcacacacagcttagtgagacaggaacatctatcgaatacaagtcctttttga

SEQ ID NO: 9206 - protein, 397 aa, Sorghum bicolor
  misc_feature: Ceres ANNOT ID no. 6099301
  misc_feature (40)..(364): Pfam Id: Lipase_GDSL Pfam Desc: GDSL-like Lipase/Acylhydrolase
  misc_feature (1)..(336): NCBI GI: 55297543 NCBI Desc: lipase-like [oryza sativa (japonica cultivar-group)]
  misc_feature (36)..(360): NCBI GI: 54290849 NCBI Desc: lanatoside 15'-o-acetylesterase-like [oryza sativa (japonica cultivar-group)]
  misc_feature (1)..(166): NCBI GI: 55297548 NCBI Desc: lipase-like [oryza sativa (japonica cultivar-group)]
  misc_feature (27)..(393): NCBI GI: 10764858 NCBI Desc: f1k23.17 [arabidopsis thaliana]
  misc_feature (14)..(372): NCBI GI: 9758938 NCBI Desc: gdsl-motif lipase/hydrolase-like protein [arabidopsis thaliana]
MASSLSGRGGGRWLLFPIMAAAAAAVLAVAAPASACYTRVFSFGDSLADTGNYRFFYTNGSDPVLRLPYGETFFHRATGRFTDGRIVLDFIADALGLPFVPPYLSGRRRRAEDFLHGANFAVGGATALGPDFFRDRGFDVGDVVHLDMEMKWFRDMLNLFCPGNLSRCSDMMNQSLFIVGEIGGNDYNLPLIRRIPFKNVITFAPAVIAKISSTITELIRLGAKALVVPGNLPIGCLPMYLLIFQSKEDYDLGTGCIRRLNEFAWYHNKLLIKELEKLRKLHPGVTIIYADYYGAAMEVFVHPQRYGIEYPLMACCGGEGRYGVSPGVRCGRGEYKLCENPETHGSWDGLHPSESVYRAIATSLLRGSRTQPPIATAASSCTHSLVRQEHLSNTSPF

SEQ ID NO: 9207 - DNA, 1122 bp, Sorghum bicolor
  misc_feature: Ceres ANNOT ID no. 6099311
  misc_feature: Encodes the peptide sequence at SEQ ID NO 9208
atggccgccgccggtggccgaacccttggccggagcagcttctcccgcgccacgtccaacccggtggcctcctcatccggcgccgctggcgtcaggattggcccgaacggtgccgctttcgtctcctcgggcatccccgacctcgacaggattttgggtggtggattccttctcggctcagttgtaatgatcatggaggacgctgatgcaccacaccacctactgcttcttcggtgcttcatgtctcagggtgttgtgcacaaacagcccctgctcttttcaggagctatgaaggagccgcggttgttccttggtacactacctgctccagtttcatcttcaaaggaggatggacgacacagagcaatgggggctgcggcaagtagtgatggacgagcaaatgatgagggtttgaggatagcttggcagtacaagaaatactttggggatgactctcgtgctgaacataaagacaataagcaggaatttagcaatgattttgatttgaggaagcccttggaaaggcatttacttaatgggcagaatattgaatgtgtaagcattcaagatgctgacactctgagcagcctccaggattgttgttctgctttcttatccaagcttccaagaaaagatggtgggagtttaactgctgggagaattgctatacaatcactctgtgcaccgcaatgtagatactttgagaaggactgggacatggtctcatttatcagatcactgaaggccatggtgcgctcatctaactctgttgctgttataacatttccgagtacagttctgtcaaattcgttctgtaagagatggcagcacctggcagatacacttctgtccatcaaagcaattccagatgaggacaaagacttggcaaaactgctcacaggatatcaagatatggttggttttttgcatgtccacaaggtggcacaaactaatagtcaggtccctgtgatcttagaggcatccacactttctctgaagctacgaaagaggaggttgctggtgctggaacggttgaaccaggctccagttgatgggtcaaccgggccttcatctgctgcatcaagtagttgctcatcacaaggttcacagcttgatttctaa

SEQ ID NO: 9208 - protein, 373 aa, Sorghum bicolor
  misc_feature: Ceres ANNOT ID no. 6099311
  misc_feature (12)..(373): Pfam Id: PAXNEB Pfam Desc: PAXNEB protein
  misc_feature (2)..(373): NCBI GI: 51535593 NCBI Desc: paxneb protein-like [oryza sativa (japonica cultivar-group)]
  misc_feature (1)..(373): NCBI GI: 66841022 NCBI Desc: elongator component [arabidopsis thaliana]
  misc_feature (5)..(210): NCBI GI: 102139747 NCBI Desc: paxneb-related protein [musa acuminata]
  misc_feature (1)..(213): NCBI GI: 33589728 NCBI Desc: at3g11220/f11b9_116 [arabidopsis thaliana]
  misc_feature (1)..(145): NCBI GI: 10129788 NCBI Desc: paxneb protein [mus musculus]
MAAAGGRTLGRSSFSRATSNPVASSSGAAGVRIGPNGAAFVSSGIPDLDRILGGGFLLGSVVMIMEDADAPHHLLLLRCFMSQGVVHKQPLLFSGAMKEPRLFLGTLPAPVSSSKEDGRHRAMGAAASSDGRANDEGLRIAWQYKKYFGDDSRAEHKDNKQEFSNDFDLRKPLERHLLNGQNIECVSIQDADTLSSLQDCCSAFLSKLPRKDGGSLTAGRIAIQSLCAPQCRYFEKDWDMVSFIRSLKAMVRSSNSVAVITFPSTVLSNSFCKRWQHLADTLLSIKAIPDEDKDLAKLLTGYQDMVGFLHVHKVAQTNSQVPVILEASTLSLKLRKRRLLVLERLNQAPVDGSTGPSSAASSSCSSQGSQLDF

SEQ ID NO: 9209 - DNA, 2115 bp, Sorghum bicolor
  misc_feature: Ceres ANNOT ID no. 6099327
  misc_feature: Encodes the peptide sequence at SEQ ID NO 9210
atggcgacgtcgtcggcgggggcgcgcaggaaggcccccagccccccgaagcaccgccacgacggcacctcgccgctgccgctcggcatggactggagccctcccccgaagagatgggagggaaggaacaccatatggccacataaccctcaaacaggttggagttactgtgtgatgatgccttcttggatcactcaaacacctgaaactggtgtgaccgctgatagctttttgaaatctgtcgttttttacaggatacatgttggtatacaatctccagaaggctttagctctagccatggaattctcagaaggtttagtgactttctgaagctatcttctgatcttaagagtgcgtttcccagaaaagacgtcccatcggctcctccgaagcatgccttcttaagaataaattcaagcaggttgcttctagaagagagaaggcatgcattggaggagtggatgcagaagttactttctgacattgacttgtcaagaagtgctcctgttgctgcttttcttgagcttgaagctgctgcacgttcatatttccaagaacggaatgggcgtccttctgaagtaggttcttctgcaaagagcagcagtattgactcttctccacattctgatggacctgcttctggttctcttgctgagtccaatcaaataaatcaagctcttactcgtggtagcagtctgacaggagcaactggtaatggtgtgcttggagaagctatcttagatcagtctgatgagcatgttagtagtgccttgaatcacaggaaagggaaccttgtattggaacatgatggtagaaatggttcagtagtgtcttataggggagttgtttcagaagaggaccgtgattctaatcccggccatgctcggaaggactctgctgaaagtattgggagtgatttgagttctttaagaggaagtgaattatctgttccaggggctagtagttcactttgggatggtgctgcggtggatggacatattagtcaaacagaacatcttactggtttggatatgcatcttttgtatgatatggatgcacaagtcatccttccaaatgatcaaaaacagaagttgactagacttttgatcacaatgcaacgaagaatagggacagcaaaaactgatatggaggatctcatagcacgactaaatcaggaagcagctgttaaagaatatcttactacaaaggttaaagatttggaggttgaattggaagccacaaagcaaaaaggtagagagacactacaacaagctatccaggctgaaaaagagaggtttacccagatgcagtgggatatggatgagctccgcaggaagtactctgagatggagtcaaacctgaagactgaacaaaatgagaaaactcgtgcggagtcagagaaaacaactgccagtggtgaaaatgaaacactacttgaagaattagaaattaaacaaaaagaagttgagagtttgaaacagtgtcttgtagaagctgaggcaaagtctaaagcagataagaaagttcttgtcaaagaggtcaagtctcttagaaactcccaaacagagatgaagaaagtgttgaatcagtatcttgaggagaagactgatttagagagagttattaatagagagaaacagaggtcagcacgtacaaagttatcccgattgaaaattcttcatgagtgtcgactgctgcgggagcgtctacaggaatgcagtgctaaatttctagcagaagaacaagataactttactattgatccgtcatccttgcctgatgcattagatcttctagcgacatcagacaatagaatacgcctacttgttgccgaggctcaacttctagcacgagatgatgaacaaggctcttctgatgatggtgacaattctgatagtagatcctcattaactatgagcagtgaagatgcaaaagttaccgatgaagatacaacaaaaatgctttctgatctgctcattgacaatgcgcagctgaggctacgcctcaatgctgtcatccgcaatgctgtaaatacggccgtgaagccagagaaagaaggtagtggcgaggttctccccaaaaagacagtccttaactggttgttagacagatga

SEQ ID NO: 9210 - protein, 704 aa, Sorghum bicolor
  misc_feature: Ceres ANNOT ID no. 6099327
  misc_feature (65)..(177): Pfam Id: PX Pfam Desc: PX domain
  misc_feature (1)..(704): NCBI GI: 51535467 NCBI Desc: phox (px) domain-containing protein-like [oryza sativa (japonica cultivar-group)]
  misc_feature (242)..(678): NCBI GI: 92873306 NCBI Desc: phox-like [medicago truncatula]
  misc_feature (192)..(690): NCBI GI: 42567325 NCBI Desc: phox (px) domain-containing protein [arabidopsis thaliana]
  misc_feature (142)..(650): NCBI GI: 61678343 NCBI Desc: cg15792-pc, isoform c [drosophila melanogaster]
  misc_feature (142)..(650): NCBI GI: 157953 NCBI Desc: non-muscle myosin heavy chain
MATSSAGARRKAPSPPKHRHDGTSPLPLGMDWSPPPKRWEGRNTIWPHNPQTGWSYCVMMPSWITQTPETGVTADSFLKSVVFYRIHVGIQSPEGFSSSHGILRRFSDFLKLSSDLKSAFPRKDVPSAPPKHAFLRINSSRLLLEERRHALEEWMQKLLSDIDLSRSAPVAAFLELEAAARSYFQERNGRPSEVGSSAKSSSIDSSPHSDGPASGSLAESNQINQALTRGSSLTGATGNGVLGEAILDQSDEHVSSALNHRKGNLVLEHDGRNGSVVSYRGVVSEEDRDSNPGHARKDSAESIGSDLSSLRGSELSVPGASSSLWDGAAVDGHISQTEHLTGLDMHLLYDMDAQVILPNDQKQKLTRLLITMQRRIGTAKTDMEDLIARLNQEAAVKEYLTTKVKDLEVELEATKQKGRETLQQAIQAEKERFTQMQWDMDELRRKYSEMESNLKTEQNEKTRAESEKTTASGENETLLEELEIKQKEVESLKQCLVEAEAKSKADKKVLVKEVKSLRNSQTEMKKVLNQYLEEKTDLERVINREKQRSARTKLSRLKILHECRLLRERLQECSAKFLAEEQDNFTIDPSSLPDALDLLATSDNRIRLLVAEAQLLARDDEQGSSDDGDNSDSRSSLTMSSEDAKVTDEDTTKMLSDLLIDNAQLRLRLNAVIRNAVNTAVKPEKEGSGEVLPKKTVLNWLLDR

SEQ ID NO: 9211 - DNA, 1200 bp, Sorghum bicolor
  misc_feature: Ceres ANNOT ID no. 6099335
  misc_feature: Encodes the peptide sequence at SEQ ID NO 9212
atgccggagctgccggaggtggaggcggcgcggcgggcgctgcaggcgcactgcgtggggaggcgcatcgcgcgctgcgccgtggcggacgacgacaaggtggtcgtggccgccgccggacgcgcggccttcgagcgcgccatggtcggccggaccatcgtcgccgcgcgccggaggggcaagaacctctggctccagctcgacgcgccgcccttcccgtccttccagttcgggatggcaggcgcgatatatatcaaaggcgttcctgtgacaaattataagagatccgttgtcaattccgaagaggagtggccatccaaatactctaaattctttgctgagcttgatgatggtttggagttctctttcactgataaacggcgctttgcaagagttcgtttgtttgaagatcctgaaactgtacccccaatttctgagctgggtccagatgctctgtttgagccaatgtctgttgacgatttcttggactccctgggtagaaagaagattgggataaaagctcttttacttgatcagagctttatatcaggcattggtaattggattgcagacgaggtgctttaccagtcaaggatccatccattacagattgcttcgaatctacctagggagagttgtgaagcactgcaccgaagtatccaagaggttgtgaaatatgctgttgaagttgatgctgacatggaccgctttccaaaggaatggttatttcatcatcgttggggcaagaagcctggcaaagtcaatggaaagaaaattgaattcatcacagctggtggcaggactactgcctacgtgccgcaattgcaaaaactgattggaatccagtccagcaaaatggtatccgctaacctggaacaactagctgagaacgttgataccaaggattcagggactgagggagaagatgcagatattttgaagccaaaaaagcgagtcgcaacatccagggctgccaggggacaacaaaacaaagatactgtgggcgccagttcgagaaaagcaaggggaaatgctggtgccactaagaaaccagatgccgatgttgagcctgctgaaccagaaacagttgtcaccgaaagcaacggtgagcaaattttggaccaacccaacagtaatgctgtcaataaatcagatcaggttacaagaagatcatcaaggaaagtgaaaccccgtaagtaa

SEQ ID NO: 9212 - protein, 399 aa, Sorghum bicolor
  misc_feature: Ceres ANNOT ID no. 6099335
  misc_feature (147)..(239): Pfam Id: H2TH Pfam Desc: Formamidopyrimidine-DNA glycosylase H2TH domain
  misc_feature (2)..(133): Pfam Id: Fapy_DNA_glyco Pfam Desc: Formamidopyrimidine-DNA glycosylase N-terminal domain
  misc_feature (1)..(269): NCBI GI: 67988064 NCBI Desc: dna-formamidopyrimidine glycosylase [kineococcus radiotolerans srs30216]
  misc_feature (1)..(278): NCBI GI: 116492457 NCBI Desc: formamidopyrimidine-dna glycosylase [pediococcus pentosaceus atcc 25745]
  misc_feature (1)..(276): NCBI GI: 83758055 NCBI Desc: formamidopyrimidine-dna glycosylase [salinibacter ruber]
  misc_feature (1)..(276): NCBI GI: 118466096 NCBI Desc: formamidopyrimidine-dna glycosylase h2th domain family protein [mycobacterium avium 104]
  misc_feature (1)..(229): NCBI GI: 29611717 NCBI Desc: formamidopyrimidine-dna glycosylase (fapy-dna glycosylase)
MPELPEVEAARRALQAHCVGRRIARCAVADDDKVVVAAAGRAAFERAMVGRTIVAARRRGKNLWLQLDAPPFPSFQFGMAGAIYIKGVPVTNYKRSVVNSEEEWPSKYSKFFAELDDGLEFSFTDKRRFARVRLFEDPETVPPISELGPDALFEPMSVDDFLDSLGRKKIGIKALLLDQSFISGIGNWIADEVLYQSRIHPLQIASNLPRESCEALHRSIQEVVKYAVEVDADMDRFPKEWLFHHRWGKKPGKVNGKKIEFITAGGRTTAYVPQLQKLIGIQSSKMVSANLEQLAENVDTKDSGTEGEDADILKPKKRVATSRAARGQQNKDTVGASSRKARGNAGATKKPDADVEPAEPETVVTESNGEQILDQPNSNAVNKSDQVTRRSSRKVKPRK

SEQ ID NO: 9213 - DNA, 1134 bp, Sorghum bicolor
  misc_feature: Ceres ANNOT ID no. 6099336
  misc_feature: Encodes the peptide sequence at SEQ ID NO 9214
atggagagtgaggagggcgccacggtagtgtgtgcccacgcccaccaagaagaagcggcggcggcggcggaggcggcggcggccatgaaggaagcaggaggagggggaaagaggaggaggaagcagcagaggaagcagggagggggcggcggagggaggaagaagtacgcgctggtgagctaccacgagctgccggagtacatgaaggagaacgagttcatcctcaactactaccgctccgagtggcccatcctcaatgccgtgctcagcctcttctcctggcacaacgagaccatcaacatctggacgcaccttcttgggtttatgctgttcttcggcctcaccctggtgcatctcggccagtacttcccccaggtggctgatctgattggacacctctcctggccaatctcaaaggttgctgaaaatgtctccagcaatattggagatgtcctatcaggcgcggccatgttcatccagacgaacccgacgctggtctcctacggcgcggcggtgacgtcgcagacgacgcggtggcccttcttcgtgttcctcgccggcgccatgttctgcctgctgagcagcagcgcgtgccacctgctgtcgtgccactcgcacagcctgaacctgttcctgatccgcctcgactacacgggcatcgcggtgatgatcgtggtgtccttcttcccgcccatctactacatcttccagtgcgagccgcactggcaggtggtgtacctgtcggcgatcacggcggcgggggtgggcacggtgtacgcgctcatgtcccctcgcctcagcgcggcgcggtaccgcgcccaccgcgcgctgctcttcgtcgggatgggcctgtcgggcgtggtgcccgccgtgcacgcggccgccgtgaactggcacgagcccgcccggaacgtcacgctggcctacgagggcgccatggccgtgtcctacctcgtcggcaccgcgttctacctcacccgggtgcccgagcggtggaggcccggcgcgttcgacctggcggggcatagccaccagatcttccacgcgctcgtcatcgccggcgcgctcgcgcactacggcgccgccatcgtgttcctcaaggcccgcgacgagatggggtgcccggccagctaa

SEQ ID NO: 9214 - protein, 377 aa, Sorghum bicolor
  misc_feature: Ceres ANNOT ID no. 6099336
  misc_feature (92)..(359): Pfam Id: HlyIII Pfam Desc: Haemolysin-III related
  misc_feature (51)..(374): NCBI GI: 92895989 NCBI Desc: hly-iii related proteins [medicago truncatula]
  misc_feature (178)..(370): NCBI GI: 115469268 NCBI Desc: os06g0652200 [oryza sativa (japonica cultivar-group)]
  misc_feature (181)..(362): NCBI GI: 40805092 NCBI Desc: adiponectin receptor 1 [sus scrofa]
  misc_feature (181)..(362): NCBI GI: 124111425 NCBI Desc: adiponectin receptor 1 [anas platyrhynchos]
  misc_feature (181)..(362): NCBI GI: 67782277 NCBI Desc: adiponectin receptor 1 [gallus gallus]
  misc_feature: Useful for making plants with altered carbohydrate content
  misc_feature: Functional homolog of the protein sequence given in SEQ ID NO 13987
  misc_feature: The sequence is a functional homolog of SEQ ID NO. 326 in the 11/188,298 US application
MESEEGATVVCAHAHQEEAAAAAEAAAAMKEAGGGGKRRRKQQRKQGGGGGGRKKYALVSYHELPEYMKENEFILNYYRSEWPILNAVLSLFSWHNETINIWTHLLGFMLFFGLTLVHLGQYFPQVADLIGHLSWPISKVAENVSSNIGDVLSGAAMFIQTNPTLVSYGAAVTSQTTRWPFFVFLAGAMFCLLSSSACHLLSCHSHSLNLFLIRLDYTGIAVMIVVSFFPPIYYIFQCEPHWQVVYLSAITAAGVGTVYALMSPRLSAARYRAHRALLFVGMGLSGVVPAVHAAAVNWHEPARNVTLAYEGAMAVSYLVGTAFYLTRVPERWRPGAFDLAGHSHQIFHALVIAGALAHYGAAIVFLKARDEMGCPAS

SEQ ID NO: 9215 - DNA, 2943 bp, Sorghum bicolor
  misc_feature: Ceres ANNOT ID no. 6099338
  misc_feature: Encodes the peptide sequence at SEQ ID NO 9216
atgtacggcaacgacaactggatcaacagctacctcgacgccatcctcgatgccggcaagggcgcagcggcagcgggtgccggcgccgccgccgccgccaggggccggggcggaggcggcggcggggaccggccctcgctgctcctccgcgagcgcggccacttctcccccgcgcgatacttcgtcgaggaggtcatcaccggctacgacgagaccgacctctacaagacctggctccgggcgaacgcgatgcggagcccgcaggagaagaacacgcggctggagaacatgacctggaggatctggaacctcgccaggaagaagaaggagtttgagaaagaagaagccaatcgcttgtccaaacgccgtctagagactgagaagccacggaatgatgctactgcagaaatgtctgaagatctttttgaaggagtgaagggagaagacgctggtgatccatctgttgcctacggtgacagcacaactgggaacacacctaggatcagttcatttgacaagctatacatagtcttaatcagtcttcatggcctgatacgtggagagaatatggagcttggccgtgattcagatactggtggccaggtcaaatatgtcgtggaacttgctaaagcattaagttcttgtcctggagtttaccgggttgatctattgacaagacaaatcttagccccaaattttgatcgtggctatggtgaaccagatgagatgctggcttcgacaagtttcaagaactttaaatgcgaacgaggagaaaacagtggtgcacatatcatcagaataccatttggccccaaagacaagcatctagctaaagaaaatatctggcctttcattcaagaatttgttgatggtgcgctagctcatattgtgcgcatgtcaaaaactataggcaaagaaactggcagtgtgtgtccagtgtggcctgctgtgattcatggccattattccagtgcaggagttgctgctgctctactatctggagcacttaatgttcccatggtgtttaccggtcattttcttgggaaagataagctcgaagggcttctcaagcaagggagacagacaagagaacaaataaacgtgacatacaaaataatgcgccgaattgaggcagaggagttgtcacttgatgcatctgaaatagttatcgcaagcacaaggcaagaaatagaagaacaatggaacttgtacgatggttttgaagtcatgcttgcgaggaagctccgtgcgttagtcaagcgtggcgctcactgttatggtcgttatatgcctcgtatggttataattcctccaggagttgaatttggccaattgattcatgattttgatatctatggagatgaagataacccatctccagcctctgaggatccatctatttggtttgagataatgcggttcttcacaaatcctaggaaacctatgattctggctattgcccgtccatatgctgaaaagaatattgcaacgcttgtgaaggcatttggtgaatgccatccgttgagggaacttgctaaccttacattgataatgggcaaccgtgaggctatttccaaaatgaacaaagtcagtgcagctgttttgacatcggtgcttacattgattgatgaatacgatttatatggtcaagtggcatacccaaagcatcacaagcactctgaagttcctgatatttatcgtttagcagcaagaacaaagggtgcttttgtaaatgttgcctactttgaacaatttggtgtcaccttgatagaggctgccatgcacgggttgcctgttattgcaacaaaacatggggctcctgttgaaattcatcaggttctggaaaatggtctccttgttgatccccatgatcagcatgcaattgcagatgccctctataagatgctttctgaaaagcagttttggtcaagatgtcgagataatggattgaaaaatatacaccaattttcttggcctgaacattgcaagaattacttgtcaaggatattaactctgggtccaagacatcctgctttcgcatgcaaagaagaccagaaggtgcctgtgaagtgcaggaagcatatatttgttattgctgtagactctgttaacaaggaagatttaattcaaattatcagaaattctgttgaggccacacgcactggaactatgtcaggttctacaggttttgtgttgtcgacttcactgacaatagcagagctacagtctgtaatagtacgcacaggcatgctccctactgactttgatgcctttatatgcaatagtgggagtgatatatattatccatcacaatctagtgatgtgccaagcaattcccgtgttacatttgcattggaccataactaccgatcacatatcgagtatcgttggggaggagaaggtttaaggaagtacttagttaagtgggcttcttcagtagtagaaagaagggggagaacagaaaagcaaatcatctttgaagattcagaacactcttcaacatattgtcttgcatttagagtggttaatccaaatcatttgcctcctttgaaggagctgcaaaagttgatgagaatccagtcactgcgttgtcatgctctgtataaccatggcgccaccaggctatctgtaattccaattcatgcatcgcgatctcaggctctaaggtatttgtctattcgctggggcatagagttgccagatgctgtggtcattgttggtgaaactggtgattctgattacgaggaactgtttggaggtcttcacaagacagtcatccttaagggtggattcaacactcctgcgaataggatccatacagtcagaaggtaccctttacaggatgttgttgctcttgatagctcaaatatcattggaattgagggattcagcactggtgacatcaggtctgctatgcaacagcttggtatacccacacaatga

SEQ ID NO: 9216 - protein, 980 aa, Sorghum bicolor
  misc_feature: Ceres ANNOT ID no. 6099338
  misc_feature (469)..(652): Pfam Id: Glycos_transf_1 Pfam Desc: Glycosyl transferases group 1
  misc_feature (692)..(977): Pfam Id: S6PP Pfam Desc: Sucrose-6F-phosphate phosphohydrolase
  misc_feature (41)..(980): NCBI GI: 1854378 NCBI Desc: sucrose-phosphate synthase [saccharum officinarum]
  misc_feature (41)..(980): NCBI GI: 33330168 NCBI Desc: sucrose-phosphate synthase 9 [triticum aestivum]
  misc_feature (1)..(684): NCBI GI: 38305300 NCBI Desc: sucrose-phosphate synthase [bambusa oldhamii]
  misc_feature (1)..(684): NCBI GI: 89000527 NCBI Desc: sucrose phosphate synthase [lolium perenne]
  misc_feature (1)..(684): NCBI GI: 23268299 NCBI Desc: sucrose phosphate synthase [oncidium cv. 'goldiana']
  misc_feature (1)..(684): SWISSPROT Homolog: EC 2.4.1.14 Sucrose-phosphate synthase 1
  misc_feature: Useful for making plants with altered cell wall content and/or composition
  misc_feature: Functional homolog of the protein sequence encoded by LOCUS at5g20280
  misc_feature: Useful for making plants with altered cell wall content and/or composition
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
MYGNDNWINSYLDAILDAGKGAAAAGAGAAAAARGRGGGGGGDRPSLLLRERGHFSPARYFVEEVITGYDETDLYKTWLRANAMRSPQEKNTRLENMTWRIWNLARKKKEFEKEEANRLSKRRLETEKPRNDATAEMSEDLFEGVKGEDAGDPSVAYGDSTTGNTPRISSFDKLYIVLISLHGLIRGENMELGRDSDTGGQVKYVVELAKALSSCPGVYRVDLLTRQILAPNFDRGYGEPDEMLASTSFKNFKCERGENSGAHIIRIPFGPKDKHLAKENIWPFIQEFVDGALAHIVRMSKTIGKETGSVCPVWPAVIHGHYSSAGVAAALLSGALNVPMVFTGHFLGKDKLEGLLKQGRQTREQINVTYKIMRRIEAEELSLDASEIVIASTRQEIEEQWNLYDGFEVMLARKLRALVKRGAHCYGRYMPRMVIIPPGVEFGQLIHDFDIYGDEDNPSPASEDPSIWFEIMRFFTNPRKPMILAIARPYAEKNIATLVKAFGECHPLRELANLTLIMGNREAISKMNKVSAAVLTSVLTLIDEYDLYGQVAYPKHHKHSEVPDIYRLAARTKGAFVNVAYFEQFGVTLIEAAMHGLPVIATKHGAPVEIHQVLENGLLVDPHDQHAIADALYKMLSEKQFWSRCRDNGLKNIHQFSWPEHCKNYLSRILTLGPRHPAFACKEDQKVPVKCRKHIFVIAVDSVNKEDLIQIIRNSVEATRTGTMSGSTGFVLSTSLTIAELQSVIVRTGMLPTDFDAFICNSGSDIYYPSQSSDVPSNSRVTFALDHNYRSHIEYRWGGEGLRKYLVKWASSVVERRGRTEKQIIFEDSEHSSTYCLAFRVVNPNHLPPLKELQKLMRIQSLRCHALYNHGATRLSVIPIHASRSQALRYLSIRWGIELPDAVVIVGETGDSDYEELFGGLHKTVILKGGFNTPANRIHTVRRYPLQDVVALDSSNIIGIEGFSTGDIRSAMQQLGIPTQ

SEQ ID NO: 9217 - DNA, 1431 bp, Sorghum bicolor
  misc_feature: Ceres ANNOT ID no. 6099348
  misc_feature: Encodes the peptide sequence at SEQ ID NO 9218
atgaggggttggggcttgctcgtgttatcgctacatgttctttcatgcctggttagtggtgttgcctctggtcgaacaagctcttacgtgcgcacagagttcccatctacagatatacctctagatagtgaatggtttgccattccaaagggatataatgctccacagcaggttcatatcacccaaggtgactatgatggaaaggcagttatagtatcttgggttactccggaagaacctgggccaagtgaagtgttttatggcaaggagaaacaatatgaccagaaatcagaaggaacaacaacaaattatacgttttacgattacaaatctggatacatacaccattgccttgttgatggccttgagtataacactaaatattattacaagattggtagcggagattcagctcgagaattctggtttgaaacacctccagcaattgatccagatgcatcatacacatttggcatcataggtgatctggggcaaacatttaattctctctcaactcttcaacattatgagaaaactggaggtcaaactgttctttttgttggggacttgtcgtatgctgatagatatgaacataatgatggcattcgttgggattcttggggtcgatttgttgagcgcagtactgcataccagccatggatttggaatactggaaaccatgaaatagagtacaggcctgatctgggagaaacttctacattcaagccatatttgcataggtatatgactccatatttggcatcaaagagcagttctcctatgtggtatgctgtcaggcgtgcatctgctcatatcatcgtgttgtctagctactctccatttgtaaaatacactcctcaatggtggtggctgaagaacgaattcaagcgtgtggacagggaaaagacaccttggcttatcgttctcatgcattctcccatgtacaacagcaatgaggcacattatatggagggcgagagtatgagggctgcttttgagaaatggtttgtgaagtacaaggtcgacttggtatttgcagggcatgttcatgcttatgagagatcataccgcatttctaatgtcaactacaacataacatcgggaaatcgatatccagtgccaaacaaatctgctcccgtttacataacagttggtgatggaggcaaccaggaaggacttgcttcaaggttttatgacccccagccagactactcagcgttcagggaggccagttatggtcattcacttttacaactgaaaaacaggactcatgctgtctatcagtggaacagaaatcatgatgggaatcctgttccagcagacaccgtggtgtttcataaccagtattggacaagcagcacgcgccgcagaaggctgaagaagaaccatttccatctcgagaaccttgaagatctgatttccctattctaa

SEQ ID NO: 9218 - protein, 476 aa, Sorghum bicolor
  misc_feature: Ceres ANNOT ID no. 6099348
  misc_feature (155)..(352): Pfam Id: Metallophos Pfam Desc: Calcineurin-like phosphoesterase
  misc_feature (3)..(476): NCBI GI: 19879917 NCBI Desc: acid phosphatase [oryza sativa]
  misc_feature (7)..(475): NCBI GI: 37359277 NCBI Desc: purple acid phosphatase-like protein [glycine max]
  misc_feature (8)..(476): NCBI GI: 14349285 NCBI Desc: pep phosphatase [allium cepa]
  misc_feature (7)..(475): NCBI GI: 21464654 NCBI Desc: acid phosphatase [lupinus luteus]
  misc_feature (8)..(450): NCBI GI: 40217508 NCBI Desc: acid phosphatase [phaseolus vulgaris]
  misc_feature (5)..(450): SWISSPROT Homolog: EC 3.1.3.2 Purple acid phosphatase precursor
MRGWGLLVLSLHVLSCLVSGVASGRTSSYVRTEFPSTDIPLDSEWFAIPKGYNAPQQVHITQGDYDGKAVIVSWVTPEEPGPSEVFYGKEKQYDQKSEGTTTNYTFYDYKSGYIHHCLVDGLEYNTKYYYKIGSGDSAREFWFETPPAIDPDASYTFGIIGDLGQTFNSLSTLQHYEKTGGQTVLFVGDLSYADRYEHNDGIRWDSWGRFVERSTAYQPWIWNTGNHEIEYRPDLGETSTFKPYLHRYMTPYLASKSSSPMWYAVRRASAHIIVLSSYSPFVKYTPQWWWLKNEFKRVDREKTPWLIVLMHSPMYNSNEAHYMEGESMRAAFEKWFVKYKVDLVFAGHVHAYERSYRISNVNYNITSGNRYPVPNKSAPVYITVGDGGNQEGLASRFYDPQPDYSAFREASYGHSLLQLKNRTHAVYQWNRNHDGNPVPADTVVFHNQYWTSSTRRRRLKKNHFHLENLEDLISLF

SEQ ID NO: 9219 - DNA, 2331 bp, Sorghum bicolor
  misc_feature: Ceres ANNOT ID no. 6099352
  misc_feature: Encodes the peptide sequence at SEQ ID NO 9220
atggccgcgtcgtcggcgttcctgcccgagctgggcacgcaggtggtggtgcccgtcgcggccgtggtcggcatcgccttcgcggtgctgcagtgggtgctcgtctccaaggtgaagctcacccccgagccgccgcgccgcggggacggctccgccgggaagagcggcggcgccggcgccagcgagttcctcatcgaggaggaggaagggctcaacgagcacaacgtcgtcgtcaagtgcgccgagatccagaacgccatctccgaaggagcaacttctttccttttcactgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgcaacatatgcaaatgccaggacaactcttgaggctaggaagggtgttggaaaggcattcattactgctttccgctctggtgctgtgatgggcttcctgcttgctgctagtggcctttttgttctttatattgcaatcaacttgtttggaatttattacggtgatgactgggagggtctttatgaagctatcactggttatggtcttggtggttcttctatggctctttttggtcgtgttggtggtgggatatacaccaaagctgctgatgttggtgctgatcttgttgggaaagtcgaaaggaacatccctgaagatgatccgagaaacccagctgtcattgcagacaatgttggtgacaatgtcggagatattgctggaatggggtcagatctctttggctcctatgctgagtcttcgtgtgctgctcttgtcgttgcctcaatctcttcttttgggatcaatcatgaattcacccctatgttgtacccactcctcattagctctgtgggtatcatagcttgcttgataaccactctttttgcaacggatttctttgagatcaaggctgtagatgaaattgagccggctctcaaaaagcagcttataatttccactgctgtgatgactgttggcattgcacttgtcagttggttagggcttccatatacattcacaatctacaactttggtgtgcagaagacggtgtataactggcaattattcctatgcgtggcagttggtctgtgggcaggactagttattggatttgttacggagtattacacgagcaatgcatacagtcctgtacaggatgttgctgactcctgcagaactggagctgctactaatgtcatctttggccttgctctgggatataaatctgtcattatccctatttttgctattgcttttagtattttcctcagctttagccttgccgccatgtatggtgttgctgtggctgctcttggaatgctcagcacaatcgccaccggccttgccattgatgcctatggccctatcagtgacaatgctggaggaattgctgaaatggctggcatgagccacagaatccccaccagaatccgtgagagaactgatgcccttgatgctgctggaaacactactgctgccattgggaagggttttgcaataggttcagcagccttggtgtctcttgccctctttggggcttttgtcagccgtgctgccatctcgactgttgatgttctgtcacctaaagttttcattggactgattgttggtgccatgcttccatactggttctcagcgatgacaatgaagagtgttggcagtgcagcactcaagatggttgaggaagtccgcaggcagttcaacaccattcctgggctcatggagggcactaccaagcctgactatgcgacgtgcgtcaagatctctactgatgcatctatcaaggagatgatcccccctggtgcacttgtcatgctcacacctcttattgttgggatcttgtttggtgttgaaactctctctggagttcttgctggtgctcttgtttctggtgtccagattgccatctctgcatccaacactggaggtgcctgggacaatgcaaagaaatacattgaggctggtgcatctgagcatgcaagaactttgggcccgaaaggttcagacccacacaaggctgctgtcatcggtgacaccatcggtgatcccctcaaggacacctcaggcccctcgttgaacatcctcatcaagctcatggccgtcgagtcccttgtctttgctcccttctttgccacccatggaggcatcctcttcaaatggctttag

SEQ ID NO: 9220 - protein, 776 aa, Sorghum bicolor
  misc_feature: Ceres ANNOT ID no. 6099352
  misc_feature (10)..(762): Pfam Id: H_PPase Pfam Desc: Inorganic H+ pyrophosphatase
  misc_feature (3)..(775): NCBI GI: 51535512 NCBI Desc: inorganic diphosphatase, h+-translocating, vacuolar membrane [oryza sativa (japonica cultivar-group)]
  misc_feature (5)..(775): NCBI GI: 1747294 NCBI Desc: vacuolar h+-pyrophosphatase [oryza sativa (japonica cultivar-group)]
  misc_feature (3)..(774): NCBI GI: 38488590 NCBI Desc: vacuolar proton pyrophosphatase [oryza sativa (japonica cultivar-group)]
  misc_feature (5)..(775): NCBI GI: 3298474 NCBI Desc: ovp1 [oryza sativa]
  misc_feature (3)..(776): NCBI GI: 57161868 NCBI Desc: vacuolar h+-translocating inorganic pyrophosphatase [zea mays]
  misc_feature (5)..(774): SWISSPROT Homolog: EC 3.6.1.1 Pyrophosphate-energized vacuolar membrane proton pump
  misc_feature: Useful for making plants with modulated water use efficiency
  misc_feature: Functional homolog of the protein sequence given in SEQ ID NO 13830
MAASSAFLPELGTQVVVPVAAVVGIAFAVLQWVLVSKVKLTPEPPRRGDGSAGKSGGAGASEFLIEEEEGLNEHNVVVKCAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIYNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIPTRIRERTDALDAAGNTTAAIGKGFAIGSAALVSLALFGAFVSRAAISTVDVLSPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 9221 - DNA, 1923 bp, Sorghum bicolor
  misc_feature: Ceres ANNOT ID no. 6099360
  misc_feature: Encodes the peptide sequence at SEQ ID NO 9222
atggcgtcggagatcgaggtgctcgaggacaccaccacctcctcgacctccctcgtcgcggccgcggccgcggccgcggccccttccgccgcggagggcgcgggggcgccggcggaggacgagtcgctgaaaaacgacgtgtacaccgcggcggcgtacggcgatctggagaagctgcagcggctggtggagggggagggccgcccggtcaccgagcccgacggcgggggctaccacgcgctccagtgggccgcgctcaacaaccgcgtcgccgccgcgcagtacatcctcgagcatggagcagacataaatgctgtggatcacactggacaaacagcacttcactggagtgctgtacgtggtcatattcaagttgctgaactacttctgaaagaaggagctaaggtggatgctgctgatttatatgggtatcaggcgacacatgttgcagcacagtatggtcagactgcattcatttaccacattgttgcgaaatggaatgctgatccagatatccctgataatgatggaaggagccctttacactgggctgcttataagggatttgcagactccatacggcttcttttgtttttggatgcttataggggacggcaagacaaagaaggttgtactcctttacattgggctgctattcgggggaaccttgaggcatgcactgtcttagttcaggttggcaaaaaggatgatttgatggtgaaagacaaaactggcttaactccagcacagcttgctgccgataagaatcatcggcaagttgcatttttcctcgacaatgctaggagggtacacgacagaggatgtggtgcaaacaccagatttgggaaattgtcaaaattagggcttgctcctcttctttggtgcaccattattggcatgcttattatttacatgcactctgttatatcaggacaatatgccacaactatgacagcaccatttgggatgttcgcatggtcaggagtttttcttgcaacagctggcttggtcatgttctataaatgtagcaggaaagatccaggttacatcaacataaatacaaggggctcacaaaatcaaagggacgatgaaccgttgctgaagatggagttagaaaatcctgcacttctttctggcaactggtcacaactttgtataacctgcaaaatagtcagacctgttcgttcaaaacattgttctacatgtgatcgttgtgtggagcagtttgaccaccactgcccttgggtatctaattgcataggaaagaagaacaaatgggaattcttcatgttcctcactctagaagtttttgcaatgatcattaccggctctgctgccattataagaattgtaagggatccagattctccatcatcctttggtgcttggattcattattctgcgttccagcatcctggggtggtttcatttctcgcactggattgtttccttttctttggtgttgcagtgcttacagttgttcaagcatcacagattgcaaggaacattacaacaaatgagatggcaaattccatgagatatgcatatctcagaggcccaggtggcagattcaggaacccatatgatcatgggattcgcaaaaactgctctgacttcttgttcaatggatacaatgaggacactgaacggctagaccaggcattgcacactgatgaggaaatgggaatgatacagatgacaagtgcagtttcacagaatggtgacaatcatttacatcatgctaatggcaccgaccatagttgcgctgattcacaagcaaactcaaaacctcatagccaagtgggttcatctcagtgttgtgatcacagtaagaagactgataggacaccgttgggcctaggattgggccttgggcgaaacagtgcgtcccggcagtatgttcggtctcttatcccattgtga

SEQ ID NO: 9222 - protein, 640 aa, Sorghum bicolor
  misc_feature: Ceres ANNOT ID no. 6099360
  misc_feature (76)..(108): Pfam Id: Ank Pfam Desc: Ankyrin repeat
  misc_feature (109)..(141): Pfam Id: Ank Pfam Desc: Ankyrin repeat
  misc_feature (176)..(208): Pfam Id: Ank Pfam Desc: Ankyrin repeat
  misc_feature (209)..(243): Pfam Id: Ank Pfam Desc: Ankyrin repeat
  misc_feature (374)..(438): Pfam Id: zf-DHHC Pfam Desc: DHHC zinc finger domain
  misc_feature (1)..(640): NCBI GI: 51535518 NCBI Desc: ankyrin repeat-containing protein-like [oryza sativa (japonica cultivar-group)]
  misc_feature (1)..(627): NCBI GI: 79517230 NCBI Desc: tip1 (tip growth defective 1); metal ion binding [arabidopsis thaliana]
  misc_feature (1)..(619): NCBI GI: 144923720 NCBI Desc: zinc finger, dhhc-type [medicago truncatula]
  misc_feature (46)..(547): NCBI GI: 92877825 NCBI Desc: zinc finger, dhhc-type [medicago truncatula]
  misc_feature (77)..(549): NCBI GI: 115485857 NCBI Desc: os11g0549700 [oryza sativa (japonica cultivar-group)]
  misc_feature: The sequence is a functional homolog of SEQ ID NO 1838 in the 10/374,780US patent application
  misc_feature: The sequence is a functional homolog of SEQ ID NO 1841 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO 1841 in the 20060162006 US patent application
MASEIEVLEDTTTSSTSLVAAAAAAAAPSAAEGAGAPAEDESLKNDVYTAAAYGDLEKLQRLVEGEGRPVTEPDGGGYHALQWAALNNRVAAAQYILEHGADINAVDHTGQTALHWSAVRGHIQVAELLLKEGAKVDAADLYGYQATHVAAQYGQTAFIYHIVAKWNADPDIPDNDGRSPLHWAAYKGFADSIRLLLFLDAYRGRQDKEGCTPLHWAAIRGNLEACTVLVQVGKKDDLMVKDKTGLTPAQLAADKNHRQVAFFLDNARRVHDRGCGANTRFGKLSKLGLAPLLWCTIIGMLIIYMHSVISGQYATTMTAPFGMFAWSGVFLATAGLVMFYKCSRKDPGYININTRGSQNQRDDEPLLKMELENPALLSGNWSQLCITCKIVRPVRSKHCSTCDRCVEQFDHHCPWVSNCIGKKNKWEFFMFLTLEVFAMIITGSAAIIRIVRDPDSPSSFGAWIHYSAFQHPGVVSFLALDCFLFFGVAVLTVVQASQIARNITTNEMANSMRYAYLRGPGGRFRNPYDHGIRKNCSDFLFNGYNEDTERLDQALHTDEEMGMIQMTSAVSQNGDNHLHHANGTDHSCADSQANSKPHSQVGSSQCCDHSKKTDRTPLGLGLGLGRNSASRQYVRSLIPL

SEQ ID NO: 9223 - DNA, 2517 bp, Sorghum bicolor
  misc_feature: Ceres ANNOT ID no. 6099361
  misc_feature: Encodes the peptide sequence at SEQ ID NO 9224
atggggatcttcgagccgttccgtgcaatcggctacatcacggcgggcggcgtgcccttctccgtgcagcgcctcggcaccgagaccttcgtcactgtcagcgtcggcaaggccttccaagtctataactgtgctaagctgaatttggttctttctggcccccaactgcccaagaagatccgtgctattgcatgctacaaggattatacatttgctgcttacggaagtgatattgcagttttcaaaaggactgatcaggtggctacttggagtagacatgaagaaaaggtcaacatgctatacctgtttggagaatatgttctaagtgcagatgctaaaggtaatgtattcatgtgggccttcagaggagcagaaccaaacactgaaccagttggaattgctgttggatgttctgatggatcagttcatgttcataatgtaagatatgatgaagaattgatgtctttcaaccatcagattcgtggtgctgtgactgcactgtcatttcgaacagatgggcaaccccttctggcatctggaggttcttcaggcgttatcagcatatggaatcttgagaagaaacggctgcattctgtgattagggaggcccatgatggttctatagtttcacttcacttttttgcgaacgaacctattctgatgagttcagctgctgataattcaatcaaaatgtggatattcgatagtaatgatggagatgctcgtctgttacgatttcgaagtggtcacagtgctccacctaggtgcataagattctatgggaatggaaaatgcatattatctgctggtcaagatcgtgcatttcgtcttttctcagttatccaggatcaacaaagtagagagctttctcagcggcatgtggccaaaagagcaaaaaggctaagagaggaagagatcaagctaaaaccagttgttacatttgactgcgctgagatacgtgcacgtgactggtgtaatgttgtcacatgccacatggatactccgcaggcatatgtatggcgtcttcagaactttgttatcggtgaacatgttttgacaccatcggcaagcactgtgacaccgattaaggcttgtgtaataagtgcatgtggtaattttactatcttgggcactgaaggtggttggatcgaaaaatttaaccttcaatcagggtttagtcgtggtagttacattgacactttgttggcaatgcaatgtgcacatgatggtgaagttgttgggttagcttgcgatgccacaaatggctctctgattagtgctggataccatggtgatattaaggtatgggattttaaaacttgcaagctgaaatccagattggatgttggtaaatctgtcactaaaattgcatttcaccggccaaatggtcttcttgctaccatagcaggtgacatggtacttatattgtttgatacggtgtccatgaaaatggttcgtagatttgaaggacatacagaccgtatcactgatttgtgcttcagtgaggatggaaaatggctcatctcgtctagcatggatgggactcttaggatttgggacatcagtttagcaaggcagatagatgcaatgcatgttgatgtatctataacatctgtctctatgtctcctaatatggatgtgttggcaaccactcatgttgatcaaaatggtgtctacctctgggttaatcaatctttattctcggcctcaacaaatactgaaaattatggcagtggtaaacatgtacggaatgtgtgtttgccagctgtttcatctatagagagatccgaggaagaacaagttcagaaatcaggagagtcatataagtccagtattaaaccttttgtcataatggatcatcaaatacccaatctagtcaccctatccttacttccaaagagccaatggcaaagtttgacaaatcttgacattataaaggttcgcaataaaccaattgagccacctaagaaacctgagaaggcacctttcttcttgccttcagttccatctctttctggggagatattgtttgagccccctgctagcacaaaagaaacagacatcagtaccactaaaaatacaaatcataagatgtctgagctctcctctcatttcagtcagctgttgcaatcttgtggtgaaacaaagaactattcagcttttaccgactacctaaaaggcctgtcaccatcatctttagatatggaactgcgaatgctacaaataatagatgatgaagagtctgaaggtctggagcaaagacctgagcttcagtccatttcattgctgttggattatttcattcgtgaacttgccttgaggaataacttcgagtttgtccaggctgttctgaaattgtttttgaagatacatggtgaaacaatacgacggcactcgatgcttcagaataaggtgaagaagcttcttgaggtccagagcttagtttggcagaagattgataagatctttcagggtgcacgatgcatggttacattcctcagtaactcacaattttag

SEQ ID NO: 9224 - protein, 838 aa, Sorghum bicolor
  misc_feature: Ceres ANNOT ID no. 6099361
  misc_feature (594)..(835): Pfam Id: Utp21 Pfam Desc: Utp21 specific WD40 associated putative domain
  misc_feature (241)..(279): Pfam Id: WD40 Pfam Desc: WD domain, G-beta repeat
  misc_feature (482)..(520): Pfam Id: WD40 Pfam Desc: WD domain, G-beta repeat
  misc_feature (133)..(819): NCBI GI: 28839728 NCBI Desc: mgc53182 protein [xenopus laevis]
  misc_feature (133)..(740): NCBI GI: 19075378 NCBI Desc: beta transducin [schizosaccharomyces pombe]
  misc_feature (133)..(825): NCBI GI: 116128605 NCBI Desc: ensangp00000012199 [anopheles gambiae str. pest]
  misc_feature (133)..(790): NCBI GI: 21281677 NCBI Desc: wd repeat domain 36 [homo sapiens]
  misc_feature (134)..(821): NCBI GI: 108874609 NCBI Desc: wd-repeat protein [aedes aegypti]
  misc_feature: The sequence is a functional homolog of SEQ ID NO. 502 in the 11/188,298 US application
  misc_feature: The sequence is a functional homolog of SEQ ID NO. 485 in the 11/188,298 US application
MGIFEPFRAIGYITAGGVPFSVQRLGTETFVTVSVGKAFQVYNCAKLNLVLSGPQLPKKIRAIACYKDYTFAAYGSDIAVFKRTDQVATWSRHEEKVNMLYLFGEYVLSADAKGNVFMWAFRGAEPNTEPVGIAVGCSDGSVHVHNVRYDEELMSFNHQIRGAVTALSFRTDGQPLLASGGSSGVISIWNLEKKRLHSVIREAHDGSIVSLHFFANEPILMSSAADNSIKMWIFDSNDGDARLLRFRSGHSAPPRCIRFYGNGKCILSAGQDRAFRLFSVIQDQQSRELSQRHVAKRAKRLREEEIKLKPVVTFDCAEIRARDWCNVVTCHMDTPQAYVWRLQNFVIGEHVLTPSASTVTPIKACVISACGNFTILGTEGGWIEKFNLQSGFSRGSYIDTLLAMQCAHDGEVVGLACDATNGSLISAGYHGDIKVWDFKTCKLKSRLDVGKSVTKIAFHRPNGLLATIAGDMVLILFDTVSMKMVRRFEGHTDRITDLCFSEDGKWLISSSMDGTLRIWDISLARQIDAMHVDVSITSVSMSPNMDVLATTHVDQNGVYLWVNQSLFSASTNTENYGSGKHVRNVCLPAVSSIERSEEEQVQKSGESYKSSIKPFVIMDHQIPNLVTLSLLPKSQWQSLTNLDIIKVRNKPIEPPKKPEKAPFFLPSVPSLSGEILFEPPASTKETDISTTKNTNHKMSELSSHFSQLLQSCGETKNYSAFTDYLKGLSPSSLDMELRMLQIIDDEESEGLEQRPELQSISLLLDYFIRELALRNNFEFVQAVLKLFLKIHGETIRRHSMLQNKVKKLLEVQSLVWQKIDKIFQGARCMVTFLSNSQF

SEQ ID NO: 9225 - DNA, 1455 bp, Sorghum bicolor
  misc_feature: Ceres ANNOT ID no. 6099362
  misc_feature: Encodes the peptide sequence at SEQ ID NO 9226
atgaacacgaattactcggcgctcccattgacctccccctccatcgagctccaggccaaatctaacgcctccgccaatgccaacgtcaacggccacgctaagatctccaagcaagattcgttcttgggcgaggtggaggacggcggcggcggggccggtgagcacgacgacctgccgctcatcggcgacgggcccgccgggccgccagaggggtccggcgtgcccgccgccgtgttcaacctcgcgacctccatcatcggggccggcattatggcgctcccggccaccatgaaggtgcttggagtcgccgctgggctcgtctcgatcctggtcatgggggtcctatccgagatcaccgtcgagctgctcgtgaggttctcggcctactgccgcgcgctgtcgtacggcgaggtcgtgcacagggcgatgggccggccagcgagcgtcgtggcgcagatgtgcgtcatcatcaacaacgcaggcgtcctggtggtgtatctgattatcatcggagacgtgatgtcagggtcactgaagcacatcggcgtcatggatcaactgattggccatggcgagtgggataaccggaagctgctgatcttggtggttcttgtcatcttccttgcgccattgtgcgcgcttgagaagattgactcactgagtttatcatctgctgcgtcagttgcccttgctgttgtgtttgtggttgtgtcctgcatcattgctttgatcaagatcgctgagggcaagatcagtatgccgaggatggggccagatttcagctcgcgagcagcaatgctagacctgctcgtcgtgatacccatcatgactaatgccttcatctgccatttcaatgtgcagccgatctacaatgaactcaaggagaagacgccacggaacatgtacaaggttgggaggatcagcactgtgctatgtgtagtggtgtatgccctgactgccctctcagggtatctcttgttcggtgaggacaccgagtccgatgtgctcaccaacttcgacaaggatctcgggatcagattcagctctttgctcaactacattgtcaggattgggtatgtcatccacctggtcctcgtcttcccagttgtccacttctcgctcaggcagacagtggacgcactgatctttggggagctggcgacccctagcaggaagaaaacactcacactgacagtggtgcttctagcgctcatctaccttggctcaacaatgataccgaacatctggatggccttcaagttcactggagctaccacagggttagcgttgggtttcatgttcccggctctggtggcattgaggctggacaaggaagggagtcgcttgggacatggggagaggctcctgtcacttgggttgctggggctatcaatagttgttagcgtcatcggagtcgttggaaatgtatacaccttgaagagtaagtctgaatga

SEQ ID NO: 9226 - protein, 484 aa, Sorghum bicolor
  misc_feature: Ceres ANNOT ID no. 6099362
  misc_feature (70)..(481): Pfam Id: Aa_trans Pfam Desc: Transmembrane amino acid transporter protein
  misc_feature (1)..(483): NCBI GI: 51535520 NCBI Desc: amino acid transporter-like protein [oryza sativa (japonica cultivar-group)]
  misc_feature (1)..(356): NCBI GI: 24461850 NCBI Desc: ctv.3 [poncirus trifoliata]
  misc_feature (67)..(482): NCBI GI: 9758059 NCBI Desc: amino acid transporter-like protein [arabidopsis thaliana]
  misc_feature (67)..(482): NCBI GI: 15241555 NCBI Desc: amino acid transporter family protein [arabidopsis thaliana]
  misc_feature (52)..(483): NCBI GI: 92881108 NCBI Desc: amino acid/polyamine transporter ii [medicago truncatula]
MNTNYSALPLTSPSIELQAKSNASANANVNGHAKISKQDSFLGEVEDGGGGAGEHDDLPLIGDGPAGPPEGSGVPAAVFNLATSIIGAGIMALPATMKVLGVAAGLVSILVMGVLSEITVELLVRFSAYCRALSYGEVVHRAMGRPASVVAQMCVIINNAGVLVVYLIIIGDVMSGSLKHIGVMDQLIGHGEWDNRKLLILVVLVIFLAPLCALEKIDSLSLSSAASVALAVVFVVVSCIIALIKIAEGKISMPRMGPDFSSRAAMLDLLVVIPIMTNAFICHFNVQPIYNELKEKTPRNMYKVGRISTVLCVVVYALTALSGYLLFGEDTESDVLTNFDKDLGIRFSSLLNYIVRIGYVIHLVLVFPVVHFSLRQTVDALIFGELATPSRKKTLTLTVVLLALIYLGSTMIPNIWMAFKFTGATTGLALGFMFPALVALRLDKEGSRLGHGERLLSLGLLGLSIVVSVIGVVGNVYTLKSKSE

SEQ ID NO: 9227 - DNA, 2517 bp, Sorghum bicolor; identical to SEQ ID NO: 9223
  misc_feature: Ceres ANNOT ID no. 6099363
  misc_feature: Encodes the peptide sequence at SEQ ID NO 9228

SEQ ID NO: 9228 - protein, 838 aa, Sorghum bicolor; identical to SEQ ID NO: 9224
  misc_feature: Ceres ANNOT ID no. 6099363
  misc_feature (594)..(835): Pfam Id: Utp21 Pfam Desc: Utp21 specific WD40 associated putative domain
  misc_feature (241)..(279): Pfam Id: WD40 Pfam Desc: WD domain, G-beta repeat
  misc_feature (482)..(520): Pfam Id: WD40 Pfam Desc: WD domain, G-beta repeat
  misc_feature (133)..(819): NCBI GI: 28839728 NCBI Desc: mgc53182 protein [xenopus laevis]
  misc_feature (133)..(740): NCBI GI: 19075378 NCBI Desc: beta transducin [schizosaccharomyces pombe]
  misc_feature (133)..(825): NCBI GI: 116128605 NCBI Desc: ensangp00000012199 [anopheles gambiae str. pest]
  misc_feature (133)..(790): NCBI GI: 21281677 NCBI Desc: wd repeat domain 36 [homo sapiens]
  misc_feature (134)..(821): NCBI GI: 108874609 NCBI Desc: wd-repeat protein [aedes aegypti]
  misc_feature: The sequence is a functional homolog of SEQ ID NO. 502 in the 11/188,298 US application
  misc_feature: The sequence is a functional homolog of SEQ ID NO. 485 in the 11/188,298 US application

SEQ ID NO: 9229 - DNA, 1455 bp, Sorghum bicolor; identical to SEQ ID NO: 9225
  misc_feature: Ceres ANNOT ID no. 6099364
  misc_feature: Encodes the peptide sequence at SEQ ID NO 9230

SEQ ID NO: 9230 - protein, 484 aa, Sorghum bicolor; identical to SEQ ID NO: 9226
  misc_feature: Ceres ANNOT ID no. 6099364
  misc_feature (70)..(481): Pfam Id: Aa_trans Pfam Desc: Transmembrane amino acid transporter protein
  misc_feature (1)..(483): NCBI GI: 51535520 NCBI Desc: amino acid transporter-like protein [oryza sativa (japonica cultivar-group)]
  misc_feature (1)..(356): NCBI GI: 24461850 NCBI Desc: ctv.3 [poncirus trifoliata]
  misc_feature (67)..(482): NCBI GI: 9758059 NCBI Desc: amino acid transporter-like protein [arabidopsis thaliana]
  misc_feature (67)..(482): NCBI GI: 15241555 NCBI Desc: amino acid transporter family protein [arabidopsis thaliana]
  misc_feature (52)..(483): NCBI GI: 92881108 NCBI Desc: amino acid/polyamine transporter ii [medicago truncatula]

SEQ ID NO: 9231 - DNA, 5415 bp, Sorghum bicolor
  misc_feature: Ceres ANNOT ID no. 6099377
  misc_feature: Encodes the peptide sequence at SEQ ID NO 9232
atgagcgacggcgagctccatgaagaggagaatccgaccaacagtgccgcagatgacgatgacgacgaggattatgaggagcctggtggaggaaatcacttcttggggtttatgtttggcaatgtagatgattctggtgacttagatgctgactatcttgatgaggatgcaaaggaacacctttttgcactggcagataagcttggtccatctctcaaagacattgacctaatcaagtcttctccagcaccaactgatccttctgaacaagactatgatgagaaggcagaagatgctgttgattatgaagatattgatgaagaatatgatggacctgaagttgaagcagctacagaggaagacaatgtgctgtcaaaaaaggattacttctcttcatctacagtgtatgcatcggtcaatagtacagtttcagtgtttgacgatgagaattacgatgaggaagaagaaccacccagtgaaaaagaagaacctcctggtgatagtgctgcccaaaatttatcttcagtttctatcgagcaggcagatatggcaacctcaagcgataaccttgccacggaaaagcttggcttgttatcacatccagaagaaagcatggactttgaatatgaagatttggagaatgaaaagggcactggggaaggtcatcttgcgcctgaaagtgcgacttccctccctgttttatgcatagaggatgggaatgcgatcctgaggttctctgaaatttttggtatccaagagcctgtaagaaaagtgaaaacagatcaccacaaacgtccagtgaataaagagcttcatatcacaaatgttgctgacaatgttgaagaagatgaggaactaattctccggagcactatccaaaatttctcaacattgaagcacaaccagatgaatgaagattttgttgagagtgacagtgatgagtctatttctgatgtcactttaaggctaaaggattcatgtctttcagaacaaccaatgaaagatgcgcataaggatattcgtactgtccagcgatctccaatttgtcctgatttttatccacttgagcatgatgattgggaaaatgatatcatttggaacaattcaccagcaactgatcagcagccttatgcaaaaatctgtgaatctgaagagagtgtggacacccatggtgaagaccagggtaaggattatggtcaggtctccaggtgttgggatgtacggagtaaaagcaatgggtccccagtaattgaagagacttttggttgtacagaaatgcctgctccagctaactactgttcccctgggaaaagtttccctccactgacaaatgaagataacttagatcacataacgccaaataacttagatgatgcagttaaaattgacaccacgatgcgtttaaataaccttagtttactgaatagggaattattagaaggatcatggttggacaacataatttgggatcctaatgaggttaccccaaagcctaaactgatctttgaccttaaagatgatcatatgctttttgagatcctagatgaaaagaatgtgggtcatatcaggtctcatgctcgtgctatgattgttagtcagtcaaccaagacttcaacaccaacagttgataattttgacaatcaagcaaagacattgagtggaagattcaacatctccaatgacaagttttattcaaataggaagactccacagcaagctaaatctcatactaaaaaacgtgctttaatgggcataaaggtggtgcattctgctccagctcataagctgcaaaccatgaagccagtattgagcaataaggaaattgcaaactttcatagaccaagagctaagtggtacccacatgaaaataaaattgctgctcagttacaaggaactgcttgtagccatgggaggatggctgttttacttatgtcattgggaggaaaaggagtcaagattttggtaaatgctgaggacactccggtctctatcaaattaaaagcatcaaagaagtttgaattgaagccttccgagaagatcacattgttctgttctgggaaagagcttcaggatgacatctcactagcgatgcaaaatgtgcgaccaaactccattgtgcatgttgttcgcactgaagtgtatctatggccaaaagcacagaaattacctggtgaggacaagcctctacgccctcctggggctttcaggaaaaaaactgacttgtctgtcaaggatggacatgtttttttaatggaatattgtgaagagagacctttgcttctctcgaatgctggaatgggagcccgtctctgtacatattaccagaaaacttcccctactgatcaggcagctgcatcactgcgaaacaacagtgatggactgggcacagtgcttgcaattgatccttctgacaaatccccttttctaggagatatacattctgggtcccaccaatcttgtcttgaaacaaacatgtacagatcacctgtatttcctcataaggttgcaccaactgattacttgttagttcgttcagccaaaggggcgctttccctccgtcgcattgacaagctatatgctgttggccaacaagaacctcatatggaagtcttttcaccagggactaagaatgcgcagacttatcttctgaaccgagttcttgcatatgtttatcgtgagtttcgtgccagagagaggcctgatggtattcctcagattcgagctgatgagttacccatacaaagtcctctgacagaagctatagtgaaaaaacgattgaagcattgtgcagatttgaagaaaggaccaaaggggcattttttctggacacagagacctgatttccgagttccatcagaggaagaactgaggagattattgacgccagaaagtgtttgctgttatgagagtatgcaagctggtctttatcgtctcaagcgcttaggaattctgaagcttactcagcctgttggactggcttctgccatgaatcagcttcctgatgaggctattgagcttgctgctgcatcacatatcgagagggaactgcaaatcactagctggaatcttacaagtaattttgttgcttgtactaatcaggacagagaaaatatagaaagattagaaatcactggtgttggagatccatctggtcgtgggttaggattcagctatgtgcgagtagcaccaaaagcacctgcctccaattcagtgctcaagaagaagtcagctgctgcaaagggtaccactgtaactgggactgatgctgatctccgcaggttgagcatggatgcagcccgtgagttgctgctgaaattcggcgtacctgaagagcaaattgataaattaacaaggtggcatcggattgctatggtgaggaagctatcaagtgaacaagctgcatcgggaataactattgacgaaattcctgttagcaagtttgcacgtggacaaaggatgtcttttctgcaacttcagcagcaaactagggagaaatgtcaggaaatttgggacagacaagtccagtcactttcagctatagatggcgatgacaatggcagtgacacagaagctaacagtgatctagactcatttgctggggatcttgagaacttgctagacgcagaagaatttgatgatgaggatactagtacagcagacttgagaattgacaaagcagatggaatgagaggacttaaaatgagaaggtgctctacacatgcccaaattaacgaggaaattgaagatgatgaaacagaagcctctctggcaaagaaactacttgaagatgatggtaatgatgtgaagaggaaaaagcagcctgagttgacaaattgtggcacctctagtgccaataaaatgaagcagagtaagagtggacaaatgatcaaatcatctggttatgctggtgcattaaccccaaaggagagcacaccaagagaaggaaaagaggttgaaaattcttttgctgagggtggtttgccctcaaaactaaaaccaaagatggcactcgatgtaaatgagatccttctagttaaaaagaaaagtgttctaggaaaggatggacctaaggagaagaaacagggtgcaaggggggatactcttgtatgtggagcctgtggtcaggttgggcatatgcggactaacaaactgtgccccaagtatggggaggatccagaaatgtcagaaatggatgctaattcagttaagcccaaccctacggatataaaccatttgcaagcaaagatacctaaaagattaataacaaaagtttcctctgaagttactgaaactgaagggccagaaggtatcgaaaagacaaaatctgtcccagtaaaatttaaagtaggggcaccggataaatccttggagaggaacatgccactctccgtttcactcgtttctgataaacgtgtcatggatgttacagacagtagatctactggaaaggtaaataagatagtgatacctaataagatgaaatctgatgatttccctcctgacactccaaagccatctgttgtatttcggcctcccgctgaagaaaaggatgtacctcgcaaaaagatcaccatcaagcagcctaaaggcatagaccagcaaagacatgttgaacctaggagtggtcaggagcccaccagaaagataagaaaaattgtagaattatcgagttttgaggataaaagtagagaggatgatcattggtttggtggggaacccagccagatgaattcctcacatgagaggaggcttggtctggatggaaaaagaagcaaagccatagtgcaaaatgacagatcctggagagattttgaggagcaaagagaaatgccacaaccaaggctctttgatgctacgatatatgcatcaagggaggaagatcatctaaagtcaaaaaagaaaaacaagaaaaagaaaaaacatgaattcaaagatgatgacttacttgatcacaggccatacagaaatgacagaagggtacctgaaagacatcgagcagtaaaacgatctagtccagctcatgtgattggatatgcatcatctgctaagcgtcgcagaggaggagaggttgagctttccaacatattggaaaagatagttgatcacttgcggggtttgagtggatcactgctatttttaaaaccagtgacaaagaaagatgctcctgattaccttgactacgtacagcgcccaatggatcttggtaccatcagggacaaggtgagaaagatggtgtacagaaaccgtgatgaattcaggcacgatgtagcacagatacaactgaacgcacatctatacaatgatggtcgccatcctcacatccctccgcttgctgacgagctcatggaggtctgtgatcatctgcttgacgaaagcgcagatctgctcaccgaggcggaagatgctattgaatag

SEQ ID NO: 9232 - protein, 1804 aa, Sorghum bicolor
  misc_feature: Ceres ANNOT ID no. 6099377
  misc_feature (1692)..(1774): Pfam Id: Bromodomain Pfam Desc: Bromodomain
  misc_feature (1)..(1804): NCBI GI: 75116324 NCBI Desc: transcription initiation factor tfiid subunit 1 (tafii250)
  misc_feature (324)..(1487): NCBI GI: 15223289 NCBI Desc: hac13 protein (hac13) [arabidopsis thaliana]
  misc_feature (324)..(1033): NCBI GI: 6714281 NCBI Desc: f6n18.13 [arabidopsis thaliana]
  misc_feature (463)..(1602): NCBI GI: 79406683 NCBI Desc: haf2 (histone acetyltransferase of the tafii250 family); dna binding [arabidopsis thaliana]
  misc_feature (905)..(1206): NCBI GI: 124486596 NCBI Desc: taf1 rna polymerase ii, tata box binding protein (tbp)-associated factor [mus musculus]
MSDGELHEEENPTNSAADDDDDEDYEEPGGGNHFLGFMFGNVDDSGDLDADYLDEDAKEHLFALADKLGPSLKDIDLIKSSPAPTDPSEQDYDEKAEDAVDYEDIDEEYDGPEVEAATEEDNVLSKKDYFSSSTVYASVNSTVSVFDDENYDEEEEPPSEKEEPPGDSAAQNLSSVSIEQADMATSSDNLATEKLGLLSHPEESMDFEYEDLENEKGTGEGHLAPESATSLPVLCIEDGNAILRFSEIFGIQEPVRKVKTDHHKRPVNKELHITNVADNVEEDEELILRSTIQNFSTLKHNQMNEDFVESDSDESISDVTLRLKDSCLSEQPMKDAHKDIRTVQRSPICPDFYPLEHDDWENDIIWNNSPATDQQPYAKICESEESVDTHGEDQGKDYGQVSRCWDVRSKSNGSPVIEETFGCTEMPAPANYCSPGKSFPPLTNEDNLDHITPNNLDDAVKIDTTMRLNNLSLLNRELLEGSWLDNIIWDPNEVTPKPKLIFDLKDDHMLFEILDEKNVGHIRSHARAMIVSQSTKTSTPTVDNFDNQAKTLSGRFNISNDKFYSNRKTPQQAKSHTKKRALMGIKVVHSAPAHKLQTMKPVLSNKEIANFHRPRAKWYPHENKIAAQLQGTACSHGRMAVLLMSLGGKGVKILVNAEDTPVSIKLKASKKFELKPSEKITLFCSGKELQDDISLAMQNVRPNSIVHVVRTEVYLWPKAQKLPGEDKPLRPPGAFRKKTDLSVKDGHVFLMEYCEERPLLLSNAGMGARLCTYYQKTSPTDQAAASLRNNSDGLGTVLAIDPSDKSPFLGDIHSGSHQSCLETNMYRSPVFPHKVAPTDYLLVRSAKGALSLRRIDKLYAVGQQEPHMEVFSPGTKNAQTYLLNRVLAYVYREFRARERPDGIPQIRADELPIQSPLTEAIVKKRLKHCADLKKGPKGHFFWTQRPDFRVPSEEELRRLLTPESVCCYESMQAGLYRLKRLGILKLTQPVGLASAMNQLPDEAIELAAASHIERELQITSWNLTSNFVACTNQDRENIERLEITGVGDPSGRGLGFSYVRVAPKAPASNSVLKKKSAAAKGTTVTGTDADLRRLSMDAARELLLKFGVPEEQIDKLTRWHRIAMVRKLSSEQAASGITIDEIPVSKFARGQRMSFLQLQQQTREKCQEIWDRQVQSLSAIDGDDNGSDTEANSDLDSFAGDLENLLDAEEFDDEDTSTADLRIDKADGMRGLKMRRCSTHAQINEEIEDDETEASLAKKLLEDDGNDVKRKKQPELTNCGTSSANKMKQSKSGQMIKSSGYAGALTPKESTPREGKEVENSFAEGGLPSKLKPKMALDVNEILLVKKKSVLGKDGPKEKKQGARGDTLVCGACGQVGHMRTNKLCPKYGEDPEMSEMDANSVKPNPTDINHLQAKIPKRLITKVSSEVTETEGPEGIEKTKSVPVKFKVGAPDKSLERNMPLSVSLVSDKRVMDVTDSRSTGKVNKIVIPNKMKSDDFPPDTPKPSVVFRPPAEEKDVPRKKITIKQPKGIDQQRHVEPRSGQEPTRKIRKIVELSSFEDKSREDDHWFGGEPSQMNSSHERRLGLDGKRSKAIVQNDRSWRDFEEQREMPQPRLFDATIYASREEDHLKSKKKNKKKKKHEFKDDDLLDHRPYRNDRRVPERHRAVKRSSPAHVIGYASSAKRRRGGEVELSNILEKIVDHLRGLSGSLLFLKPVTKKDAPDYLDYVQRPMDLGTIRDKVRKMVYRNRDEFRHDVAQIQLNAHLYNDGRHPHIPPLADELMEVCDHLLDESADLLTEAEDAIE

SEQ ID NO: 9233 - DNA, 945 bp, Sorghum bicolor
  misc_feature: Ceres ANNOT ID no. 6099385
  misc_feature: Encodes the peptide sequence at SEQ ID NO 9234
atggcgttcaactaccacgaccacgcgctggcgatggaccccgccgcggttggggccgcggccgcgaaccctagctttgtctccgggggtggtggtggtggtggcgtggccggtggggggcccggctgggagagggagaaggcggccatcgcggcgcacccgctgtacgagcgcctgctcgaggcgcacgtcgcctgcctccgcgtcgccacccccgtcgaccagctcccgcgcatcgacgcccagatagcggccaggcccccgcccatggcggccgccgcagcggcggcggcggcgggcggagcgcactcgggaggcgaggagctcgacctcttcatgacgcattatgtgctgctactctgttcattcaaggagcaactccagcagcatgtgcgtgttcatgcgatggaagcagtcatggcttgctgggagcttgaacaaactttacaaagccttacaggggcatctcctggtgagggcactggggcaactatgtctgatgatgaagacaatcaggtagacagtgagagcaacatgtttgatggaaatgaggggtcagatggaatgggatttggaccattaatgttgactgagggtgagagatccttagttgagcgtgtccggcaggagctaaagcatgagcttaagcaggggtacagagacaaacttgtggatattcgggaagagatattgcggaagcgaagagctgggaaactccctggcgacactgcttctaccttaaaagcttggtggcaagctcattctaagtggccatacccaactgaggaagacaaggctcgactggtgcaggaaacagggctacaactgaagcagatcaataactggtttatcaaccagcgtaagcggaactggcacaacaatccggcgtcatcctcgtcggacaaaagcaagagaaaaaggtacgatcacaagaaactagactaa

SEQ ID NO: 9234 - protein, 314 aa, Sorghum bicolor
  misc_feature: Ceres ANNOT ID no. 6099385
  misc_feature (99)..(154): Pfam Id: KNOX2 Pfam Desc: KNOX2 domain
  misc_feature (44)..(88): Pfam Id: KNOX1 Pfam Desc: KNOX1 domain
  misc_feature (210)..(231): Pfam Id: ELK Pfam Desc: ELK domain
  misc_feature (1)..(308): NCBI GI: 115469202 NCBI Desc: os06g0646600 [oryza sativa (japonica cultivar-group)]
  misc_feature (1)..(311): NCBI GI: 33333542 NCBI Desc: knotted 7 [hordeum vulgare]
  misc_feature (1)..(307): NCBI GI: 126153888 NCBI Desc: knox family class 2 homeodomain protein [zea mays]
  misc_feature (9)..(307): NCBI GI: 1805617 NCBI Desc: osh45 [oryza sativa (japonica cultivar-group)]
  misc_feature (9)..(306): NCBI GI: 1805618 NCBI Desc: osh45 [oryza sativa (japonica cultivar-group)]
  misc_feature: The sequence is a functional homolog of SEQ ID NO 1996 in the 10/374,780US patent application
  misc_feature: The sequence is a functional homolog of SEQ ID NO 490 in the 11/435,388US patent application
  misc_feature: The sequence is a functional homolog of SEQ ID NO 594 in the 11/479,226US patent application
  misc_feature: The sequence is a functional homolog of SEQ ID NO 604 in the 11/435,388US patent application
  misc_feature: The sequence is a functional homolog of SEQ ID NO 708 in the 10/374,780US patent application
  misc_feature: The sequence is a functional homolog of SEQ ID NO 709 in the 10/374,780US patent application
  misc_feature: The sequence is a functional homolog of SEQ ID NO 710 in the 10/374,780US patent application
  misc_feature: The sequence is a functional homolog of SEQ ID NO 711 in the 10/374,780US patent application
  misc_feature: The sequence is a functional homolog of SEQ ID NO 712 in the 10/374,780US patent application
  misc_feature: The sequence is a functional homolog of SEQ ID NO 713 in the 10/374,780US patent application
  misc_feature: The sequence is a functional homolog of SEQ ID NO 76 in the 10/374,780US patent application
  misc_feature: The sequence is a functional homolog of SEQ ID NO 882 in the 10/225,066US patent application
  misc_feature: The sequence is a functional homolog of SEQ ID NO 902 in the 10/225,066US patent application
  misc_feature: Useful for making plants with altered Lignin content
  misc_feature: Useful for making plants with altered sterol content
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13435
  misc_feature: GREAT-hit functional homolog of the protein sequence given in SEQ ID NO 13436
  misc_feature: The sequence is a functional homolog of SEQ ID NO 882 in the 20050160493 US patent application
  misc_feature: The sequence is a functional homolog of SEQ ID NO 902 in the 20050160493 US patent application
  misc_feature: The sequence is a functional homolog of SEQ ID NO 708 in the 20060162006 US patent application
  misc_feature: The sequence is a functional homolog of SEQ ID NO 709 in the 20060162006 US patent application
  misc_feature: The sequence is a functional homolog of SEQ ID NO 710 in the 20060162006 US patent application
  misc_feature: The sequence is a functional homolog of SEQ ID NO 711 in the 20060162006 US patent application
  misc_feature: The sequence is a functional homolog of SEQ ID NO 712 in the 20060162006 US patent application
  misc_feature: The sequence is a functional homolog of SEQ ID NO 713 in the 20060162006 US patent application
  misc_feature: The sequence is a functional homolog of SEQ ID NO 710 in the 10/374,780 US patent application
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time
  misc_feature: Functional homolog of the protein sequence given in SEQ ID NO 13436
  misc_feature: The sequence is a functional homolog of SEQ ID NO 711 in the 10/374,780 US patent application
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 713 in the 10/374,780 US patent application
  misc_feature: The sequence is a functional homolog of SEQ ID NO 712 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: Useful for making plants with altered carbohydrate content
  misc_feature: Functional homolog of the protein sequence given in SEQ ID NO 13967
  misc_feature: The sequence is a functional homolog of SEQ ID NO 708 in the 10/374,780 US patent application
  misc_feature: The sequence is a functional homolog of SEQ ID NO 709 in the 10/374,780 US patent application
  misc_feature: The sequence is a functional homolog of SEQ ID NO. 499 in the 11/188,298 US application
  misc_feature: The sequence is a functional homolog of SEQ ID NO. 320 in the 11/188,298 US application
MAFNYHDHALAMDPAAVGAAAANPSFVSGGGGGGGVAGGGPGWEREKAAIAAHPLYERLLEAHVACLRVATPVDQLPRIDAQIAARPPPMAAAAAAAAAGGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKRNWHNNPASSSSDKSKRKRYDHKKLD

SEQ ID NO: 9235 - DNA, 2871 bp, Sorghum bicolor
  misc_feature: Ceres ANNOT ID no. 6099392
  misc_feature: Encodes the peptide sequence at SEQ ID NO 9236
atggcggccgcctcgtcggcgtcgctggaagacctcaagaacgagaacgtcgacctcttgcaacaggagagcgtcccgatccaggaggtgttcaccgtcctcaagtcctcgccgcacggcctcacctccaccgatggcgccagccggctccagatcttcggacccaacaagctcgaggagaagaaggagagtaaactgctcaagttcctggggttcatgtggaacccgctctcctgggtcatggaggccgccgccgtcatggccatcgtcctcgccaacggaggggggagaccgccggactggcaagacttcgtcgggatcgtcacgctgctcttcatcaactccacgatcagcttcatcgaggagaacaacgccggcaatgccgccgccgcgctcatggccagcctcgccccccagaccaaggtgctgagggacggcaagtggtcggagcaggacgcggcgatcctggtgccaggcgacatcatcagcatcaagctcggcgacatcatcccggcggacgcgaggctgatggagggcgacccgctcaagatcgaccagtcggcgctcacgggcgagtcgctccccgtcaacaagatgcccggcgacagcatctactccggctccacctgcaagcagggcgagatcgaggccgtcgtcatcgccaccggcgtccacaccttcttcgggaaggccgcccacctcgtcgacagcaccaacaacgtcggccacttccagaaggtgctcacggcgatcgggaacttctgcatctgctccatcgcagtcgggatgctgatcgagatcatcgtcatgtacccgatccagcaccggcagtaccgcgacggaatcgacaacctgctcgtgctgctcatcggcgggatccccatcgccatgcccaccgtgctgtcggtgaccatggccatcggttcgcaccggctgtcgcagcagggcgccatcaccaagcggatgacggccatcgaggagatggccggcatggacgtgctctgcagcgacaagaccggcacgctcaccctgaacaagctcaccgtcgacaagaacatgatcgagccgtttgtcaaggatctggacaaggacgccgtagtcctgtacgccgctcgagcatcaagaactgagaaccaggacgccatcgacgcgtccatcgtcggaatgctcgccgacccaagggaggcccgtgccggcatccaggaggtgcacttcatgccgttcaaccccgtcgacaagcgcactgccatcacctatatcgactccgacgggtcatggcaccgcatcagcaaaggtgcccctgagcagatcatcgagctgtgccggctccgggaggatcttagccggcgggtgcacgccatcatcgccaagttcgcggaccgtgggctgcgttcgctggccgtggcgcggcagaggatcccggagtgcaacaaggacgcgccgggcactccgtggcagttcctggccgtgctcccgctgttcgacccgccgaggcacgacagcgccgagaccatccggcgcgcgctcaaccttggcgtgaacgtgaagatgatcaccggcgaccagctggccatcggcaaggagaccgggcggcggctcggcatgggcaccaacatgtacccgtccagctccctgctcaaggacggcgacacgggcgggctccccgtggacgagctgatcgagaaggcggacgggttcgcgggggtgttcccggagcacaagtacgagatcgtgcggcggctgcaggagcggaagcacatctgcgggatgacgggcgatggcgtgaacgacgcgccggcgctgaagaaggcggacatcgggatcgcggtggcggacgcgacggacgcggcgaggggcgcgtcggacatcgtgctcacggagcccggcctgagcgtcatcatcagcgccgtgctgacgagccgcgccatcttccagcggatgaagaactacaccatctacgccgtgtccatcaccatccgggtggtgctgggcttcatgctcctggcgctcatctggcggttcgacttcgcgcccttcatggtgctcatcatcgccgtgctcaacgacggcaccatcatgaccatctccaaggaccgggtgaagccgtccccgatgcccgacgcctggcgcctccaggagatcttcgccaccggcgtcgtcctcggcacctaccaagccctcgccaccgtcctcttcttctgggccgtccgcgacaccaacttcttcacaaatacgttcggggtgcaccacatcggggacagcacggaggagctgatggcggcggtgtacctgcaggtgagcatcatcagccaggcgctcatcttcgtgacccgtgctcggagctggttcttcgtggagcgcccgggcctgctgctggtggccgccttcctggcggcgcagctggtggcgacgctgatcgccgtgtacgcgcagtggccgttcgccaagatcaagggcatcggctggggctggggcgccgtcatctggctcttcagcatcgtcactttcttcccgctggacgtgttcaagttcgccatccgctacttcctcagcggcaagcagtggaacaacgtgttcgacaacaagacggcgttcgccaacgagctggactacggcaagagcaagcgcgaggcgcagtgggcgatcgcgcagcggtccctgcacgggctgcagcagcccgaggcgtcgggcctcttcaacaccgacaacagcaacgacttcattgagctctctgagatcgccgagcaggccaagcgccgagcagagatcgccaggctaagggagctgcacacgctgaaagggcatgtggagtcggtggtgaagctcaaggggctggacatcgacaccatccaacataactacaccgtgtga

SEQ ID NO: 9236 - protein, 956 aa, Sorghum bicolor
  misc_feature: Ceres ANNOT ID no. 6099392
  misc_feature (106)..(327): Pfam Id: E1-E2_ATPase Pfam Desc: E1-E2 ATPase
  misc_feature (10)..(93): Pfam Id: Cation_ATPase_N Pfam Desc: Cation transporter/ATPase, N-terminus
  misc_feature (331)..(614): Pfam Id: Hydrolase Pfam Desc: haloacid dehalogenase-like hydrolase
  misc_feature (6)..(956): NCBI GI: 20302437 NCBI Desc: plasma membrane h+ atpase [oryza sativa (japonica cultivar-group)]
  misc_feature (1)..(956): NCBI GI: 6759597 NCBI Desc: plasma membrane h+ atpase [prunus persica]
  misc_feature (4)..(956): NCBI GI: 435001 NCBI Desc: h(+)-transporting atpase [solanum tuberosum]
  misc_feature (4)..(956): NCBI GI: 1621440 NCBI Desc: plasma membrane h+-atpase [lycopersicon esculentum]
  misc_feature (1)..(956): NCBI GI: 31580853 NCBI Desc: plasma membrane h+-atpase [sesbania rostrata]
  misc_feature (4)..(956): SWISSPROT Homolog: EC 3.6.3.6 Plasma membrane ATPase 4
MAAASSASLEDLKNENVDLLQQESVPIQEVFTVLKSSPHGLTSTDGASRLQIFGPNKLEEKKESKLLKFLGFMWNPLSWVMEAAAVMAIVLANGGGRPPDWQDFVGIVTLLFINSTISFIEENNAGNAAAALMASLAPQTKVLRDGKWSEQDAAILVPGDIISIKLGDIIPADARLMEGDPLKIDQSALTGESLPVNKMPGDSIYSGSTCKQGEIEAVVIATGVHTFFGKAAHLVDSTNNVGHFQKVLTAIGNFCICSIAVGMLIEIIVMYPIQHRQYRDGIDNLLVLLIGGIPIAMPTVLSVTMAIGSHRLSQQGAITKRMTAIEEMAGMDVLCSDKTGTLTLNKLTVDKNMIEPFVKDLDKDAVVLYAARASRTENQDAIDASIVGMLADPREARAGIQEVHFMPFNPVDKRTAITYIDSDGSWHRISKGAPEQIIELCRLREDLSRRVHAIIAKFADRGLRSLAVARQRIPECNKDAPGTPWQFLAVLPLFDPPRHDSAETIRRALNLGVNVKMITGDQLAIGKETGRRLGMGTNMYPSSSLLKDGDTGGLPVDELIEKADGFAGVFPEHKYEIVRRLQERKHICGMTGDGVNDAPALKKADIGIAVADATDAARGASDIVLTEPGLSVIISAVLTSRAIFQRMKNYTIYAVSITIRVVLGFMLLALIWRFDFAPFMVLIIAVLNDGTIMTISKDRVKPSPMPDAWRLQEIFATGVVLGTYQALATVLFFWAVRDTNFFTNTFGVHHIGDSTEELMAAVYLQVSIISQALIFVTRARSWFFVERPGLLLVAAFLAAQLVATLIAVYAQWPFAKIKGIGWGWGAVIWLFSIVTFFPLDVFKFAIRYFLSGKQWNNVFDNKTAFANELDYGKSKREAQWAIAQRSLHGLQQPEASGLFNTDNSNDFIELSEIAEQAKRRAEIARLRELHTLKGHVESVVKLKGLDIDTIQHNYTV

SEQ ID NO: 9237 - DNA, 1677 bp, Sorghum bicolor
  misc_feature: Ceres ANNOT ID no. 6099405
  misc_feature: Encodes the peptide sequence at SEQ ID NO 9238
atggcggcaccacgaccacgaggtgcctggtcatcgtcgtcagcccctcctctgcccgcctgcttcctgccacttctgctactcctggcgtccttctcggcagcaccaaccgcagcagcagcgcggccgtcctccacccccaagaagccagctgctgctttcccggctgccgtcgctcctctgcacctgcaagctctgaagcgccaccagcgggcaagcagcagcatcagggccggcggcgagctcttcgtcgccgcggccgccgatggcacggccaacggcaccgcggcgaagaagcccttcacggttcactacttcgcgcaggagctggaccacttcaccttcacgcccaacgcgtccatggtcttccgccagaagtacctcctcaacgacaccttctggcggaggcccagcgccggcgacggcgacggcgccgggccgctgttcgtgtacaccggcaacgagggcgacatcgagtggttcgccaccaacacgggattcatgttcgacatcgcgcccaagttcggcgccctcctcgtcttcatcgagcaccggttctacggggagtcgaagccgttcgggaacgactcgtacaagtcggccgagacgctgggctacctgacgtccacgcaggcgctcgctgacttcgccatcctcatcaggagcctgaagaagaacctctccgccgaggccgctcccgtcgtcgtcttcggcggctcatacggcggaatgttggcttcttggttcaggctcaagtacccccacgtcaccattggggccgtagcgtcctccgcgccaatcctgcagttcgactacataacaccctggagcagcttctacgacggtgtctcgcaggacttcaagtctgaaagcctgaactgcttcagtgtcatcaagggaacctgggatgtcctggatgagaggggttccacagacaaagggctcctggacctcagcaaacttttcagagcctgcaagacagtgaagtacgcttattcaatccgaaactggctgtggacagcattctcttacactgccatggtggactatccgaccccagccaatttcctggagaatctgcctgcctacccagtcaaggagatgtgcaagatcatcgatgggtttcccacaggcgcagacatcctggagaaggcattcgcagcggcaagcttgtactacaactacacaggagaccagacttgcaataagatagaggatggagacgacccgcatggcctcgatggctggcaatggcaggcctgcacagagatgatcatgccaatgacggtctccaacgagagcatgttcccaccatcctccttcagctatgatgaaaggtccgatgaatgtttccagagctggggggttcgaccgagaccgcattggatcacaactgaatatggtggatataaaattgataaggtgctcaagaggtttgggagcaacatcatcttctctaatggaatgcgagacccatggagtcgaggcggggttctcaagaacatctcatccagtatcattgcccttgtcacagagaaaggtgctcatcatttagacttcagatcttcaacaaagggtgatccagactgggttatagaacaaaggagacaagaagttgacatcattcagggatggattgatcagtatcatcaggacatggcggaaacatcttcctga

SEQ ID NO: 9238 - protein, 558 aa, Sorghum bicolor
  misc_feature: Ceres ANNOT ID no. 6099405
  misc_feature (108)..(538): Pfam Id: Peptidase_S28 Pfam Desc: Serine carboxypeptidase S28
  misc_feature (100)..(555): NCBI GI: 22655366 NCBI Desc: at2g24280/f27d4.19 [arabidopsis thaliana]
  misc_feature (101)..(549): NCBI GI: 22328106 NCBI Desc: serine carboxypeptidase s28 family protein [arabidopsis thaliana]
  misc_feature (101)..(549): NCBI GI: 10177334 NCBI Desc: lysosomal pro-x carboxypeptidase [arabidopsis thaliana]
  misc_feature (101)..(514): NCBI GI: 18700101 NCBI Desc: at5g65760/mpa24_11 [arabidopsis thaliana]
  misc_feature (101)..(419): NCBI GI: 2827710 NCBI Desc: lysosomal pro-x carboxypeptidase - like protein [arabidopsis thaliana]
MAAPRPRGAWSSSSAPPLPACFLPLLLLLASFSAAPTAAAARPSSTPKKPAAAFPAAVAPLHLQALKRHQRASSSIRAGGELFVAAAADGTANGTAAKKPFTVHYFAQELDHFTFTPNASMVFRQKYLLNDTFWRRPSAGDGDGAGPLFVYTGNEGDIEWFATNTGFMFDIAPKFGALLVFIEHRFYGESKPFGNDSYKSAETLGYLTSTQALADFAILIRSLKKNLSAEAAPVVVFGGSYGGMLASWFRLKYPHVTIGAVASSAPILQFDYITPWSSFYDGVSQDFKSESLNCFSVIKGTWDVLDERGSTDKGLLDLSKLFRACKTVKYAYSIRNWLWTAFSYTAMVDYPTPANFLENLPAYPVKEMCKIIDGFPTGADILEKAFAAASLYYNYTGDQTCNKIEDGDDPHGLDGWQWQACTEMIMPMTVSNESMFPPSSFSYDERSDECFQSWGVRPRPHWITTEYGGYKIDKVLKRFGSNIIFSNGMRDPWSRGGVLKNISSSIIALVTEKGAHHLDFRSSTKGDPDWVIEQRRQEVDIIQGWIDQYHQDMAETSS

SEQ ID NO: 9239 - DNA, 1611 bp, Sorghum bicolor
  misc_feature: Ceres ANNOT ID no. 6099407
  misc_feature: Encodes the peptide sequence at SEQ ID NO 9240
atggcggcaccttctgtgctcgccttcttgccgcttctgctcctggcagccttctcagcagcatcaacctcagcgcaccgcatccccaatcctttcccgccaatcattcccctgcatcttcaggctcttcggcagcagcagcagcagcagcgagtgagcagctcggacgccaagctcgtcaccgcggccgccgccgatgctggcaccaacagcacggcgcagccgttcacgacacactacttcccgcaggagctggaccacttcaccttcacgcccaacgcgtcaatggtcttccgtcagaagtaccttgtcaacgacaccttctggcggaggcccagcggcggcaacggcaccgccggcgccgggccgctgttcgtgtacaccggcaacgagggcgacatcgagtggttcgccaccaacaccggcttcatgttcgacatcgcgcccaagttcggcgccctcctcgtcttcattgagcatcggttctacggggagtcactgccgtttggaaatgactcctacaactcagcggagacactgggttacttgacgtcaactcaggctctcgccgatttcgccatcctcatcaccagtcttaagcagaacctctcagctaagaccgcccccgtagtggttttcggcggctcctatggcggcatgctggcttcttggttcaggctcaagtatccccatgtcgcaattggggccctggcatcgtctgcaccaatcctgcagttcgactacataacaccatggagcagcttcagtgatgccatctcacaagactacaagtctgagagcttgaactgcttcagtgtgatcaaggcaacctgggatgtgctcgatgagaggggagccaatgacagagggctcctggagctcagtaaactgttcagagcctgcaagaccttgaagtacgctgattcaattgcaggctggctacagacagcattcgtctacactgccatggtggactatccaacaccggccaatttcctgaagaatttgcctgcctaccccgtcaaggagatgtgcaagatcatcgacgggttccccgcaaacgcggacatcctggaaaaggtgttcgcagcggcgagcttgtattataacttcacaggagaccagacttgcaaccagatagagtatgacgacgacagctccagttctcttggcctcagtggctgggggtggcaggcttgcacagagatgatcatgccgatgtcggactcaaacgagagcatgttcccaccggataccttcagttacgaggacacgtccaatacctgtttccagttgtacggggttcggcccaggccacattggatcaccactgaatatggtggatataaaattgataaggtgctgaagaggtttgggagcaacatcatcttctccaacggattgcgagacccatggagtcgaggcggggtgctcaaggacatctcatccagcatcgtcgcacttgtcacagagaaaggggctcatcatttggacctgagatctgcaaccaaggatgatccagactgggttatagaacaaaggagacaagaagttgagatcatacacggatggatagatcagtatcatcaagacatggcgcaagcatcctaa

SEQ ID NO: 9240 - protein, 536 aa, Sorghum bicolor
  misc_feature: Ceres ANNOT ID no. 6099407
  misc_feature (83)..(517): Pfam Id: Peptidase_S28 Pfam Desc: Serine carboxypeptidase S28
  misc_feature (75)..(534): NCBI GI: 22655366 NCBI Desc: at2g24280/f27d4.19 [arabidopsis thaliana]
  misc_feature (76)..(528): NCBI GI: 22328106 NCBI Desc: serine carboxypeptidase s28 family protein [arabidopsis thaliana]
  misc_feature (76)..(528): NCBI GI: 10177334 NCBI Desc: lysosomal pro-x carboxypeptidase [arabidopsis thaliana]
  misc_feature (76)..(493): NCBI GI: 18700101 NCBI Desc: at5g65760/mpa24_11 [arabidopsis thaliana]
  misc_feature (71)..(532): NCBI GI: 20072291 NCBI Desc: 2510048k03rik protein [mus musculus]
MAAPSVLAFLPLLLLAAFSAASTSAHRIPNPFPPIIPLHLQALRQQQQQQRVSSSDAKLVTAAAADAGTNSTAQPFTTHYFPQELDHFTFTPNASMVFRQKYLVNDTFWRRPSGGNGTAGAGPLFVYTGNEGDIEWFATNTGFMFDIAPKFGALLVFIEHRFYGESLPFGNDSYNSAETLGYLTSTQALADFAILITSLKQNLSAKTAPVVVFGGSYGGMLASWFRLKYPHVAIGALASSAPILQFDYITPWSSFSDAISQDYKSESLNCFSVIKATWDVLDERGANDRGLLELSKLFRACKTLKYADSIAGWLQTAFVYTAMVDYPTPANFLKNLPAYPVKEMCKIIDGFPANADILEKVFAAASLYYNFTGDQTCNQIEYDDDSSSSLGLSGWGWQACTEMIMPMSDSNESMFPPDTFSYEDTSNTCFQLYGVRPRPHWITTEYGGYKIDKVLKRFGSNIIFSNGLRDPWSRGGVLKDISSSIVALVTEKGAHHLDLRSATKDDPDWVIEQRRQEVEIIHGWIDQYHQDMAQAS

SEQ ID NO: 9241 - DNA, 1974 bp, Sorghum bicolor
  misc_feature: Ceres ANNOT ID no. 6099427
  misc_feature: Encodes the peptide sequence at SEQ ID NO 9242
atggaggacgaggagatggagaagaaggtgcagcagtacctgcagcgcaaggggttccgcctcaccgagcttgcgctgcaggaggagcgcaaccgcctctccacctccgccatctctgacgttgcgcttgcacggtctgacaatgatccagcaaggtaccatgatggatatagcagattaagaacatgggcatatagttctcttgatcaatataagcacgaattacttcgcgtcctttacccagtttttatccatagcttcatggatctagtggcggagggacatatgcaagaagctcggtcatttttccatacatttcgggaagatcatgaggtgatgcattcaagggatcttcagaagctagaaggcgtcctctctccttcacacttggaggaaatggaactggcccgatcttttaggaaaaataaatttaaaattaaattatgcgagtattcgtatgaattgcttctccagtatctccagaaaacacaagctcttgttgtgcttggagtaatcaatgagcacataacttttgaagtatctcctgggcagccctcattaatctctgatgatgctgatgttgttgctctgattgggacaagtaaggacttggcaaaacagataaatcagaaggaagtacattgggggttgcttgaagattctgttgaagagcgaatggagaaggcactagcagaatctgataaaatagaagctgaaagcaaggatgctgatgcagaagataacaagaaaagaaacgcagaaggtggaaagcaaggtgcttctcttaagaaggccaaaaaggacaaacttgtaggtgcgactggaaaaaacgtcagaactgaaacaagcatggtttctgtggcacctcgagtgaaaccggagctaactctcccagcaacgcctgttgaagttgaacaatcgattcttgaggacctgcgaaaccgtgcacaactgaatagcgtggcattgccatctgtcagcttctacacattcgttaatacacataatggattaaactgctcatcaatatcacacgacggatcgctggttgttggtgggttttctgattcgtcagtgaaggtctgggatatgtcaaagattggccaaccaacaaaaatgtcaagttcacagagtgagaatggatcttcccagggtgagcgcatatcaacattagatgaggggaaaagaacttatacactatttcaaggccattctggaccagtttattctgcggcctttagcccgtttggggatttcctcttgtcatcatcttcagactcgacaataagactatggagcaccaagctgaatgcgaatcttgtctgttacaaaggacacaactacccagtttgggatgtccaattcagtccagttggccattactttgctagtgcttcacatgacaggactgctagaatttggtcaatggataaaatccagcctttgcgaataatggctgggcatctttctgatgtcgattgtgtccagtggcatgtaaactgtaactacattgccaccggctcaagtgataaaactgtaagactctgggatgttcagacgggtgaatgtataaggatgtttattggtcataggagtatggttttatcactggcaatgtcacctgatggacgatatatggcctctggagatgaagatggaacaatcatgatatgggatctctcaactggccgttgtgtttcaccactactaggacacagctcttgtgtgtggacacttgctttcagttgtgaaggagcattgcttgcatcgggatcggctgactgtaccgtaaagctctgggatgtcgcttccagcacaaaaaccctgaagacagaggacaccaaaggcagctcagctaaccgactgagactgcttaaagctctcccgacaaaagcaactcctgtttatagcctgcggttttctcggaggaaccttctatttgcctctggtgctctctcgctaagctcgtcgtaa

SEQ ID NO: 9242 - protein, 657 aa, Sorghum bicolor
  misc_feature: Ceres ANNOT ID no. 6099427
  misc_feature (395)..(433): Pfam Id: WD40 Pfam Desc: WD domain, G-beta repeat
  misc_feature (437)..(475): Pfam Id: WD40 Pfam Desc: WD domain, G-beta repeat
  misc_feature (479)..(517): Pfam Id: WD40 Pfam Desc: WD domain, G-beta repeat
  misc_feature (521)..(559): Pfam Id: WD40 Pfam Desc: WD domain, G-beta repeat
  misc_feature (563)..(601): Pfam Id: WD40 Pfam Desc: WD domain, G-beta repeat
  misc_feature (34)..(179): Pfam Id: TFIID_90kDa Pfam Desc: WD40 associated region in TFIID subunit
  misc_feature (1)..(653): NCBI GI: 79520288 NCBI Desc: nucleotide binding / transcription regulator [arabidopsis thaliana]
  misc_feature (364)..(656): NCBI GI: 115471097 NCBI Desc: os07g0205200 [oryza sativa (japonica cultivar-group)]
  misc_feature (38)..(653): NCBI GI: 110665722 NCBI Desc: tbp-associated factor 5 [mus musculus]
  misc_feature (232)..(606): NCBI GI: 44983257 NCBI Desc: ael246cp [eremothecium gossypii]
  misc_feature (232)..(606): NCBI GI: 45190361 NCBI Desc: ael246cp [eremothecium gossypii]
  misc_feature: The sequence is a functional homolog of SEQ ID NO. 502 in the 11/188,298 US application
  misc_feature: The sequence is a functional homolog of SEQ ID NO. 485 in the 11/188,298 US application
MEDEEMEKKVQQYLQRKGFRLTELALQEERNRLSTSAISDVALARSDNDPARYHDGYSRLRTWAYSSLDQYKHELLRVLYPVFIHSFMDLVAEGHMQEARSFFHTFREDHEVMHSRDLQKLEGVLSPSHLEEMELARSFRKNKFKIKLCEYSYELLLQYLQKTQALVVLGVINEHITFEVSPGQPSLISDDADVVALIGTSKDLAKQINQKEVHWGLLEDSVEERMEKALAESDKIEAESKDADAEDNKKRNAEGGKQGASLKKAKKDKLVGATGKNVRTETSMVSVAPRVKPELTLPATPVEVEQSILEDLRNRAQLNSVALPSVSFYTFVNTHNGLNCSSISHDGSLVVGGFSDSSVKVWDMSKIGQPTKMSSSQSENGSSQGERISTLDEGKRTYTLFQGHSGPVYSAAFSPFGDFLLSSSSDSTIRLWSTKLNANLVCYKGHNYPVWDVQFSPVGHYFASASHDRTARIWSMDKIQPLRIMAGHLSDVDCVQWHVNCNYIATGSSDKTVRLWDVQTGECIRMFIGHRSMVLSLAMSPDGRYMASGDEDGTIMIWDLSTGRCVSPLLGHSSCVWTLAFSCEGALLASGSADCTVKLWDVASSTKTLKTEDTKGSSANRLRLLKALPTKATPVYSLRFSRRNLLFASGALSLSSS

SEQ ID NO: 9243 - DNA, 2691 bp, Sorghum bicolor
  misc_feature: Ceres ANNOT ID no. 6099432
  misc_feature: Encodes the peptide sequence at SEQ ID NO 9244
atggcgcccgcggccctccgcctcctcctcgccatcctctgcctcgcctcgcgtctcgccgccagggcggctgcggcggggtgcggatcgaacacgagcctagcggggtacaaggcggacctgcgcatgtcgcagcaccagctccgcggccgcgtggaggtgctcgacggctgctcgttccgcgtcgccgcgctcgacctcctcccgggctccacctccgcgcggtggtggcgcgcggacgggaccgacctcgacgccctgtcgcgcggcgagcccgcggccgccgagccgctggaccgcaccttccggtccgagtccctcgtgttccgcctcctcccgggcctctcctggccgcacgtccccgtcctcgcggctttcgaccccgtcacttcctccctcttcggcttcgtgcgcctctccggcggcggcaacgcctccgattcatcctcctcgtccgcggcggcggcggcggcggcacccaccatgctcgactcctgcgcccagctctcccggcgcttccgcgtgcggtggacgctccacgaggcgaacaattccatcgacatcgccctcgaagcggcggtcggatcagagtactacatggcgttcgggtgggcgaagcccggcgcggccaagccgtccgtgatcggcgccgacctcgccgtcgccggcttcaccgaggacggcctccccttcgccgaggactactacgtcaccaagtacagcgagtgcctgctgcgcaaggacggcctcgtcgagggcgtctgcccggacacgatctacgaccgcgacaacaccacggggctcgtcaacaacacgcggctggtctacggccaccgccgcgacggcgtctccttcgtgcgcttctcgcgcccgctggtgtccgaggacaagaggtacgacgtctccgtggacggcaccaggaacatgacggtggtctgggcgatcgggctgctgcggccgccggactcgctccggccgtactacctgccgctgatgagtcgccgcagcgggtctccggggacgccgttcaccttcgccaagctcaacttgtcggaccacgcgagcaacgggtgcgtcgggccgctggacgctgaggacaaggaggatcaggcgaggatcacgacggagcgcaacacgccgctggctgtgacgattggaccggcgctgcattaccccaatccgcccaaccccgacaaggtgctctacatcaacaagaaggaggcgcctctgctcaaggtggagcgcggcgtgccggtcaccttctccatcgaggccgggcacgacgcgccactctacatcacgtctgaccccgtcggaggcaatgccactttcaggaacgcgtcagagatcatctacgccggtggacccaaggcagagggcgtgccggctacaccaacagagctcgtctggctgcctgatcggaacacgccggacctagtgtactaccaatccttgtacgatcccaagatgggctggaaaattcaggtcgtcgatggaggcctcagcgacatgtacaacaacagcgtgctactggatgatcagcaggtgacattcttctggactctctctggtgactccattaacattgctgcgcggggtgagaagaagagtggataccttgcaattggattcggtagcgcaatggtcaatagctatgcttatgtcgggtgggtcgatggcaatggcaaggggcatgtcaaatcttactggatcgacgggaaggacgggatgagtgtgcatgaaacacatgaaaatgttacgcacaagcgatgccgatcggaaaatggtgcggtcgtatttgagttcacccgtccattggcaccttcatgcagtggaaaggtggagtgcaagaacataatcgatccgacgactcctctgaaggtcatctgggccatgggtgctcagtggtcaccgggccccttaagtttgaagaacatgcactcggacacaagcaatcgtcctatcaggattcttctgctgagcggcttggctgaagcagtggaggatctccgcccggtgcttgctgttcatgggtttatgatgtttgtggcatgggctattctgctgccagggggaatcatggctgcgagatacctgagacatctgaaaggcgagctctggttccaggctcacacctatctgcagtactcaagcatagctgtcatgttcttgggtgttctgttcgcagtcgctgagctccgaggattttcttttaaatccagacatgctcgaatgggcgcagtagcattgacatttgcatctatgcagccaataaatgcctatcttcgaccgcatagaacagagaatggagaatctctgcctggaaacagagtggcttgggaatatctgcatgttctgaccgggagatctgctgcgctcgctggtatcgtggcgctctttactggcttgcagcatcttgggcacagatatggcagtaagaccatcaagggacttacatgtgggctaatcttatgggttgtaagcgttattttggtaaccgcttaccttgagtatatggcgattaagcgaagaacggcaggtgctgatggtccttcaggaaaatgggtgcttggcagcactgaggaagatgatacagtcgatctattgcaatctgacagggtagtcagtaaaatggagtttaattcgtcacctgaaccactggaagtacagcttgagccacttaacagatga

SEQ ID NO: 9244 - protein, 896 aa, Sorghum bicolor
  misc_feature: Ceres ANNOT ID no. 6099432
  misc_feature (514)..(631): Pfam Id: DOMON Pfam Desc: DOMON domain
  misc_feature (46)..(466): NCBI GI: 24649429 NCBI Desc: cg12492-pa [drosophila melanogaster]
  misc_feature (46)..(466): NCBI GI: 125774785 NCBI Desc: ga11661-pa [drosophila pseudoobscura]
  misc_feature (186)..(466): NCBI GI: 46560038 NCBI Desc: cg12492 [drosophila buzzatii]
  misc_feature (46)..(466): NCBI GI: 116132691 NCBI Desc: ensangp00000003319 [anopheles gambiae str. pest]
  misc_feature (74)..(318): NCBI GI: 23170926 NCBI Desc: cg32922-pb, isoform b [drosophila melanogaster]
MAPAALRLLLAILCLASRLAARAAAAGCGSNTSLAGYKADLRMSQHQLRGRVEVLDGCSFRVAALDLLPGSTSARWWRADGTDLDALSRGEPAAAEPLDRTFRSESLVFRLLPGLSWPHVPVLAAFDPVTSSLFGFVRLSGGGNASDSSSSSAAAAAAAPTMLDSCAQLSRRFRVRWTLHEANNSIDIALEAAVGSEYYMAFGWAKPGAAKPSVIGADLAVAGFTEDGLPFAEDYYVTKYSECLLRKDGLVEGVCPDTIYDRDNTTGLVNNTRLVYGHRRDGVSFVRFSRPLVSEDKRYDVSVDGTRNMTVVWAIGLLRPPDSLRPYYLPLMSRRSGSPGTPFTFAKLNLSDHASNGCVGPLDAEDKEDQARITTERNTPLAVTIGPALHYPNPPNPDKVLYINKKEAPLLKVERGVPVTFSIEAGHDAPLYITSDPVGGNATFRNASEIIYAGGPKAEGVPATPTELVWLPDRNTPDLVYYQSLYDPKMGWKIQVVDGGLSDMYNNSVLLDDQQVTFFWTLSGDSINIAARGEKKSGYLAIGFGSAMVNSYAYVGWVDGNGKGHVKSYWIDGKDGMSVHETHENVTHKRCRSENGAVVFEFTRPLAPSCSGKVECKNIIDPTTPLKVIWAMGAQWSPGPLSLKNMHSDTSNRPIRILLLSGLAEAVEDLRPVLAVHGFMMFVAWAILLPGGIMAARYLRHLKGELWFQAHTYLQYSSIAVMFLGVLFAVAELRGFSFKSRHARMGAVALTFASMQPINAYLRPHRTENGESLPGNRVAWEYLHVLTGRSAALAGIVALFTGLQHLGHRYGSKTIKGLTCGLILWVVSVILVTAYLEYMAIKRRTAGADGPSGKWVLGSTEEDDTVDLLQSDRVVSKMEFNSSPEPLEVQLEPLNR

SEQ ID NO: 9245 - DNA, 1239 bp, Sorghum bicolor
  misc_feature: Ceres ANNOT ID no. 6099435
  misc_feature: Encodes the peptide sequence at SEQ ID NO 9246
atggccggggcaccgagggtccggtccctgaacatcgcggttccggaggcagaggcgaggccggtgctggtgccggggggcaacaaggccaggtcgggcccggcgaacgcccggaaaccgtcgccgaagcccctgaggaaggcggtggggacgccagagaagcctgcggctgccgcacccaaggcggaggagggcgcaaagaggaatgcagtcggcgggggcggaggtggcgcgcccaagggtgcgtcccctatgccgtcgccgcggcgcacaccccctgggccgccgttgaggaggagcgacgcgccgctgttgcatccgggcttgccgctcagcgcgtcgtcttgctcctcggatgcctccgcggagtcggtccgcgtccgggctttcactgggaaagtggagaagggccggtcggggccgatggctgcgtcgaagcaaggcaaaactatgggtaagacggcagagagcaagcccgtcgtggtggagtttgttgctccggtgacaccagaggttgtggaagggaagaggaggtgcgcttgggcgactccaactactgatccttgctatgtcactttccatgatgaggagtggggggttcctgtgcacaatgacaggagattgtttgagctacttgtactatctggtgcattggctgagcttacatggcctgaaattctcaagaggaggcaacttttcagggaaattttcatggagtttgaccctgctgctatctctaaaataaatgagaagaagcttgtggcacctggaagcactgcccattctcttttgtcagagcaaaagctccgagtggtccttgagaatgctcgccagatactaaagattgttgatgaatttggatcctttgatcggtactgctggggttttctgaaccacaagcctatagtgagcaagttccgatatccaagacaagttcctgtcaagagcccaaaggcagatataatcagcaaagacatgatgagaaggggattccgaggtgtgggcccaacggtcatatattccttcatgcaggctgcaggtctaacaaatgatcacctggtcagttgcttccggttcgaacaatgcaatgccattccaactctttgcacaagtgacattgacagggtaaacatgaaggcagatccaaaaaaagatgagatgacaacgaagatttattgtgaagagattaccacaaacccagagatgccaaggacgattgatgctcttattgtttcgtag

SEQ ID NO: 9246 - protein, 412 aa, Sorghum bicolor
  misc_feature: Ceres ANNOT ID no. 6099435
  misc_feature (181)..(361): Pfam Id: Adenine_glyco Pfam Desc: Methyladenine glycosylase
  misc_feature (1)..(410): NCBI GI: 51534979 NCBI Desc: methyladenine glycosylase protein-like [oryza sativa (japonica cultivar-group)]
  misc_feature (1)..(406): NCBI GI: 115469240 NCBI Desc: os06g0649800 [oryza sativa (japonica cultivar-group)]
  misc_feature (26)..(412): NCBI GI: 90265145 NCBI Desc: h0711g06.19 [oryza sativa (indica cultivar-group)]
  misc_feature (26)..(364): NCBI GI: 92895786 NCBI Desc: protein prenyltransferase, alpha subunit [medicago truncatula]
  misc_feature (88)..(362): NCBI GI: 6503296 NCBI Desc: contains similarity to gi1168217 dna-3-methyladenine glycosidase (tag) protein from haemophilus influenzae. [arabidopsis thaliana]
MAGAPRVRSLNIAVPEAEARPVLVPGGNKARSGPANARKPSPKPLRKAVGTPEKPAAAAPKAEEGAKRNAVGGGGGGAPKGASPMPSPRRTPPGPPLRRSDAPLLHPGLPLSASSCSSDASAESVRVRAFTGKVEKGRSGPMAASKQGKTMGKTAESKPVVVEFVAPVTPEVVEGKRRCAWATPTTDPCYVTFHDEEWGVPVHNDRRLFELLVLSGALAELTWPEILKRRQLFREIFMEFDPAAISKINEKKLVAPGSTAHSLLSEQKLRVVLENARQILKIVDEFGSFDRYCWGFLNHKPIVSKFRYPRQVPVKSPKADIISKDMMRRGFRGVGPTVIYSFMQAAGLTNDHLVSCFRFEQCNAIPTLCTSDIDRVNMKADPKKDEMTTKIYCEEITTNPEMPRTIDALIVS

SEQ ID NO: 9247 - DNA, 1578 bp, Sorghum bicolor
  misc_feature: Ceres ANNOT ID no. 6099437
  misc_feature: Encodes the peptide sequence at SEQ ID NO 9248
atggctccttccccgcaccgccggcggctcctcctcatcctccccgtactcgtcgctgccgccgtgctatggggggcgctggcagcggacgccggcgcggacacctgcaaggcgtggttggtgcagtccatccccaccgacatgccgcacctgcgccgcgtccccggggtcctctccaccggagatgtacttcagtggctctcggggaatgcaacgaatagtctggacatccttgcacagtactggcagttcttagctcagccaaacaatccgaaatctggggattatggattctccgagagtgacatgaagagatttggggctgacgagggccgcctggtttacaaggcattggaaaatgctgcagatcgtaagatcaaaatcaggcaagttttgagtatgatactggaactgattgtccaacactctggattcgctcctgattttgacaaagagagcgccgatctggctgcaggaagaccaaatattgagaatgcaaccgttctttttgaggattggtggggatctggtgttgtgcatgcaaaggtctggatatcagataaaaaggatgtgtacatagggtcagcaaacaacgattggaaatcccttactcaggtcaaggagcttgggatttattttgctaattgcccacagatagcaaaaactgtggaagtatattttcaaaatctatggacgctttcaaccctcaactcaacttcttacaccaaacaagcctgggataaggagtggcaagtttctagaaaggttccatgctggtctcatttcctacagccaaaagaaagatgcaggtcacccataccactttcagttgacatcccatatgtagatggatatccagctcttgcaaatcctgaaatgattgatgtttcatttgaaacccctgggtacaagaaatctactcaagagcactacttgagctacctttcctttgcaccacctgaggtgacatttggcaaattccaagcagatgagcagggttgggttgacaccattaattctgttaagttagggggaattgtacgaatgaataccatggattggcttgggcagtcacagtatgctactcaaacagtctactggtcttctctgtcatctgcaatctcagaggtagtattctcaaagaatgcaaccgtgaggctaattgttgcctactgggcacatttcatcccaaacactgaaaagtacctgaagagccttctatactccaacatcctctgcgcatcttcgacatataaccattgcggtggcaaggtcgagatcaaatactacatggttcctgggtacaacgagaccggacctgcattgtcccaaggtggcactatgacggggaaccgttatcctggcttcaccagggtgaaccatggcaagtacgctgtcagcgacgtgagggcgaacatcggcaccagcaacctcatctgggattacttctacaccacggctggagtcagcttcggaacatacaaccccaacattgttacacagctgcaggatatctttgatgcagattggtattctccttataccgtgcttgttgaaccgctggatgagtctgtgtag

SEQ ID NO: 9248 - protein, 525 aa, Sorghum bicolor
  misc_feature: Ceres ANNOT ID no. 6099437
  misc_feature (175)..(202): Pfam Id: PLDc Pfam Desc: Phospholipase D Active site motif
  misc_feature (106)..(253): NCBI GI: 60468139 NCBI Desc: phospholipase d3 (pld3) [dictyostelium discoideum]
  misc_feature (82)..(251): NCBI GI: 60465549 NCBI Desc: phospholipase d3 (pld3) [dictyostelium discoideum]
  misc_feature (106)..(251): NCBI GI: 832928 NCBI Desc: orf
  misc_feature (36)..(253): NCBI GI: 24585591 NCBI Desc: cg9248-pa, isoform a [drosophila melanogaster]
  misc_feature (36)..(318): NCBI GI: 125987469 NCBI Desc: ga21643-pa [drosophila pseudoobscura]
MAPSPHRRRLLLILPVLVAAAVLWGALAADAGADTCKAWLVQSIPTDMPHLRRVPGVLSTGDVLQWLSGNATNSLDILAQYWQFLAQPNNPKSGDYGFSESDMKRFGADEGRLVYKALENAADRKIKIRQVLSMILELIVQHSGFAPDFDKESADLAAGRPNIENATVLFEDWWGSGVVHAKVWISDKKDVYIGSANNDWKSLTQVKELGIYFANCPQIAKTVEVYFQNLWTLSTLNSTSYTKQAWDKEWQVSRKVPCWSHFLQPKERCRSPIPLSVDIPYVDGYPALANPEMIDVSFETPGYKKSTQEHYLSYLSFAPPEVTFGKFQADEQGWVDTINSVKLGGIVRMNTMDWLGQSQYATQTVYWSSLSSAISEVVFSKNATVRLIVAYWAHFIPNTEKYLKSLLYSNILCASSTYNHCGGKVEIKYYMVPGYNETGPALSQGGTMTGNRYPGFTRVNHGKYAVSDVRANIGTSNLIWDYFYTTAGVSFGTYNPNIVTQLQDIFDADWYSPYTVLVEPLDESV

SEQ ID NO: 9249 - DNA, 1167 bp, Sorghum bicolor
  misc_feature: Ceres ANNOT ID no. 6099464
  misc_feature: Encodes the peptide sequence at SEQ ID NO 9250
atggccaccaccacgacggtgacgacgacgacgacgacgacggtgagcgcgcgcgggggctgctgcgccctcgcggcggccgcggacgtcgtgccgctgccggcgtcgcgagaggaggagcagcagcagcggccggcgaaagcggcggaggaggcgcagctgctgccgcggctggtgcggttcgaggagctgccggactacctgcgggacaacgagttcatccacgcccactaccgctgcgagtggtccgtccgcgacgcgctccgcagcgccttcgcctggcacaacgagacgctcaacgtctggagccatcttggaggcttcttcctgttcctctacctcgccgtcgccgagccaacggcgaaggtaaccgccgccgccggagccagcgccgcccagggcatcgtgacgttcgtgctggcgtcagccaactcctcgtggtcttcgtgggagaccagcagcaactcgagcttgacgttgagcaatggtttaacgacggccgtgttcgggagcagcgacggccacggccatggccacgcggtgccgaggtggccgcggacggtgttcctggcgggcgcgatgacgtgcctagccgtgagcgcggcggcgcacctgctggcgtgccactcgcggcgcttcagccgcctcttctggcagctggactacgccgggatcgccgtcatgatcgtggcctccttcttcccgccggtctactacgcgttcctcggcctggcgcgcacccagctcgtctacctgtccgccatcacgctgctgggcctgctggtggtggcgctgctgctggcgcccgcgcggtcgtcgccgcgcctgcgccacctccgcgcggggctcttcgtgtccatggcgttctccggggtgctgccggcgctgcacgcgctgtggctcaactgggcacaccgcgagtgccacctcgcgctggcgctcgagctcgccatggggctcgtgtacgccgccggcgccgggttctacgtcacccgcgtgccggagaggtggagaccgggaaagttcgactgcgttgggcatagccaccagatcttccacgtgctcgtgctcgccggcgcgctcacgcactacgccgccaccgccatcctcatcgactggcgagaggcgatggccgccgctgccggtggggcgtcggcgctcttgtga

SEQ ID NO: 9250 - protein, 388 aa, Sorghum bicolor
  misc_feature: Ceres ANNOT ID no. 6099464
  misc_feature (92)..(364): Pfam Id: HlyIII Pfam Desc: Haemolysin-III related
  misc_feature (176)..(388): NCBI GI: 115469268 NCBI Desc: os06g0652200 [oryza sativa (japonica cultivar-group)]
  misc_feature (181)..(375): NCBI GI: 92895989 NCBI Desc: hly-iii related proteins [medicago truncatula]
  misc_feature (188)..(374): NCBI GI: 117935909 NCBI Desc: adiponectin receptor [bombyx mori]
  misc_feature (189)..(364): NCBI GI: 116128547 NCBI Desc: ensangp00000012224 [anopheles gambiae str. pest]
  misc_feature (189)..(364): NCBI GI: 108868805 NCBI Desc: adiponectin receptor [aedes aegypti]
  misc_feature: The sequence is a functional homolog of SEQ ID NO. 326 in the 11/188,298 US application
MATTTTVTTTTTTTVSARGGCCALAAAADVVPLPASREEEQQQRPAKAAEEAQLLPRLVRFEELPDYLRDNEFIHAHYRCEWSVRDALRSAFAWHNETLNVWSHLGGFFLFLYLAVAEPTAKVTAAAGASAAQGIVTFVLASANSSWSSWETSSNSSLTLSNGLTTAVFGSSDGHGHGHAVPRWPRTVFLAGAMTCLAVSAAAHLLACHSRRFSRLFWQLDYAGIAVMIVASFFPPVYYAFLGLARTQLVYLSAITLLGLLVVALLLAPARSSPRLRHLRAGLFVSMAFSGVLPALHALWLNWAHRECHLALALELAMGLVYAAGAGFYVTRVPERWRPGKFDCVGHSHQIFHVLVLAGALTHYAATAILIDWREAMAAAAGGASALL

SEQ ID NO: 9251 - DNA, 987 bp, Sorghum bicolor
  misc_feature: Ceres ANNOT ID no. 6099470
  misc_feature: Encodes the peptide sequence at SEQ ID NO 9252
atgggcaccgtcactgccgcagatccgcacccgtccttcctcgccgataaggacgccaaggtcttcgtcgccggccaccggggcctggtcgggtccgccatcgtgcgccgcctcctctcgctcggcttcacctccgtcgtcgtccgcacccacgccgagctcgacctcacccgccaggccgacgtcgaggccttcttcgccgccgagcgcccgcgctacgtggtcctcgcggccgccaaggtcggcggcatccacgccaactccacctaccccgccgacttcatcgccgccaacctccagatccagaccaacgtcgtggacgccgcgctgcgctgcgtttccgtccgcaagctcctcttcctcggctcctcctgcatctacccaaagttcgcgccgcagcccatcacggagggcgcgctcctctccggcccgctcgagcccaccaacgagtggtacgccgtcgccaagatcgccggcatcaagatgtgccaggcctaccgcatccagcacggcctcgacgccgtctccgccatgcccaccaacctctacggcccgcacgacaacttccaccccgagaactcgcacgtcctgcccgcgctcatccgtcgcttccacgaggccaaggccaccaacgcccctgaggtcgtcgtctggggatcaggctcgccgctgcgcgagttcctccacgtcgatgacctcgcggacggcgtcatcttcttgatggaacactactccggcctggagcatgtcaatgtggggagtgggagtgaggtcaccatcaaagagctcgccgagctagtcaaggaggtggtcggcttccaggggaaccttgtgtgggactccagcaagccggacggcacacccaggaagctcatggatagctccaagatacaggggatggggtggaagcccaagatcgccctcaaggaaggcctcatcgaaacctacaaatggtacgtcgagaatgtcatctcgaacaagaagtag

SEQ ID NO: 9252 - protein, 328 aa, Sorghum bicolor
  misc_feature: Ceres ANNOT ID no. 6099470
  misc_feature (21)..(253): Pfam Id: Epimerase Pfam Desc: NAD dependent epimerase/dehydratase family
  misc_feature (1)..(328): NCBI GI: 75253966 NCBI Desc: probable gdp-l-fucose synthase 1 (gdp-4-keto-6-deoxy-d-mannose-3, 5-epimerase-4-reductase 1)
  misc_feature (12)..(323): NCBI GI: 30698929 NCBI Desc: gdp-4-keto-6-deoxy-d-mannose-3,5-epimerase-4-reductase (ger1) [arabidopsis thaliana]
  misc_feature (14)..(323): NCBI GI: 6016479 NCBI Desc: gdp-4-keto-6-deoxy-d-mannose-3,5-epimerase-4-reductase [arabidopsis thaliana]
  misc_feature (16)..(323): NCBI GI: 117926593 NCBI Desc: nad-dependent epimerase/dehydratase [magnetococcus sp. mc-1]
  misc_feature (16)..(326): NCBI GI: 134299254 NCBI Desc: nad-dependent epimerase/dehydratase [desulfotomaculum reducens mi-1]
  misc_feature (14)..(323): SWISSPROT Homolog: EC 1.1.1.271 GDP-L-fucose synthase 1
  misc_feature: Useful for making plants with altered cell wall content and/or composition
  misc_feature: GREAT-hit functional homolog of the protein sequence encoded by LOCUS at1g17890
  misc_feature: GREAT-hit functional homolog of the protein sequence encoded by LOCUS at1g73250
  misc_feature: Useful for making plants with altered carbohydrate content
  misc_feature: Functional homolog of the protein sequence given in SEQ ID NO 14040
  misc_feature: Useful for making plants with altered cell wall content and/or composition
  misc_feature: Functional homolog of the protein sequence given in SEQ ID NO 14041
MGTVTAADPHPSFLADKDAKVFVAGHRGLVGSAIVRRLLSLGFTSVVVRTHAELDLTRQADVEAFFAAERPRYVVLAAAKVGGIHANSTYPADFIAANLQIQTNVVDAALRCVSVRKLLFLGSSCIYPKFAPQPITEGALLSGPLEPTNEWYAVAKIAGIKMCQAYRIQHGLDAVSAMPTNLYGPHDNFHPENSHVLPALIRRFHEAKATNAPEVVVWGSGSPLREFLHVDDLADGVIFLMEHYSGLEHVNVGSGSEVTIKELAELVKEVVGFQGNLVWDSSKPDGTPRKLMDSSKIQGMGWKPKIALKEGLIETYKWYVENVISNKK

SEQ ID NO: 9253 - DNA, 2880 bp, Sorghum bicolor
  misc_feature: Ceres ANNOT ID no. 6099494
  misc_feature: Encodes the peptide sequence at SEQ ID NO 9254
atgggggacaactacgtagctgaacctgaggacgaggttccacaatcaatgtggcctgagaatataggagacaaacatcagaggcagttcagaatggaaaactttaggaaggaccaagatgctttcaaggatgtgaagtttgatgaaaagcctgttcatgtggattaccagcggcttattgaaatggcaaattctgagaaaggtatttctcagatgcaatactttatgaagcactgggaatataagagagccaatgctgctcggcttctggaggaagagctcggtcttctctgccaacaaaggaaagagattgagcaaaataagcaacaaatcttggaagaacaacgttttcaggatgagagttattatgctgtaaagcggcatgtaccgatactggatgaagtttatgaagatgaatggaagcgacctagcaaaaagaatgacgatctttctcgtagtagagagactaaaatagatgcagattatgacagtgtttcctactggaaagagcgggcaactaagttagaggaaaaacttgaggaaagcatccaaagggagcgttctttagttgagaaattggaggaaaatataaagaacctgcagtcacacacaccagctgaggaattctctggaatgctaaaacgcgctgattacttcttgcatttggttctacaaagtgctcctattgttattgctcatcaggatgctgatttacggtaccgtttcatatttaaccactatccaacacttgctgatgaggatgttattggtaagacagactatgagatattgtcaggtgagggtatagaagagatgaatagtgtcaagcgagaagttatggccacgggaatagcaactaaaagagaatttgcgtttaatacaccaatgtttggggcaaagacatttgtgacatacattgagccagttttcagcaaaggtggggaaacgattggcgtgaattatgttgcaatggacataacagatcaggtcaaaagaagagagaaaatggcagacataagggtgagggaagctgtccaaaatgccaaggaaaccgaacttagcaaatctcttcacataacagaggaaacaatgcgagcaaaacaaatgctagctaccatgtcccatgagatcagatctcctctttcaggtgttcttagcatggctgaaattcttgcaactaccaaactggataaagaacaacatcagttgcttgaagttatgttatcctctggagatcttgtattgcagctgatcaatgacatccttgatctttccaaagtggagtcaggggccatgaaactagaatctacgacatttagaccaagggaagtagttaaacatgtactccaaactgccgcggcttctctaaagaaggaattgacccttgaagggtgcataggtgatgatgttccagtggaggttattggtgatgtgctaaggattcggcaaattctgaccaacttgatcagcaatgcagtcaagtttacacatgaagggaaagttggaataattcttcaggtcgtgcatgacaagcaaccaggatgcaaaatagagggcgggaaaattcataagcgagcatattctgggacagcaattactgctgtagaaactgctgttgtctctccaagaaattgtgataaagataatttgcattgctcgaaacatgaagatgcttttcagaatggtgttccaacatgtgaaaatttcaaggaggatattgagggagaggaagtcgtttggcttcgctgtgatgtatatgacactggaataggaataccagagaagtccttaccattgctgttcaagaggtatatgcaagctagcaccgatcatgcgaggaagtatggtgggacagggcttggccttgcaatctgcaagcagttggtggagttgatgggtggtacactgactgtggtcagcaaagagaatgaaggatcaacatttacatttgtgctgccttgtaaaatccctgtaaaagaggagcatagtgatgatcctgatgaagtgcacagttctcagaatgattctgcaaacagcgatatagaaggttctttcttttttaagccacaaatgcgagcttctcttctgtctcctggagtttcaataatgaacaacacaaagttatttggtgccaagcttatgtgctatgatccgccggacaaattgttctcaaatggtttctcatcaacggaacctaattttacaaatacctctactgctcaccaacctaatggtgatactgttaggagcacagctgaagaagaacatgataatgcaatggtccttgaactgaatagtcaagctgaacgggtttccagttcccgaggagacttggtatctgtttcaggtgctgctccatgcaaagttcttgaagaacagtcattccacaagaaatcaaagtgttctccaaccagcaacaaagcaaagatcctcctagttgaagataacaaggtcaacataatagtggcaaaatcaatgctggagcagctgggccatgcaatagatatcgtaaataatgggatgcaagcaatccgtgcagtacagcagcaccaatatgatcttattctgatggatgttcacatgccagaaatggatggcctacaagccactaaacatatccgttcttttgagaataccggctgttgggacgtttctgtaaagcctgaagacaatcagatgataactgactcaactatttcatcagattctgcacatgcaaaaaagcaagggcagagggttcctataattgcgatgacagcaaattcattcgcagagagttccgaggaatgccttgctgcaggcatggattcctacatatctaagcctgtgaactttcagaatataaaagaatgcctgcagcggtatttaatgtctcaatga

SEQ ID NO: 9254 - protein, 959 aa, Sorghum bicolor
  misc_feature: Ceres ANNOT ID no. 6099494
  misc_feature (476)..(655): Pfam Id: HATPase_c Pfam Desc: Histidine kinase-, DNA gyrase B-, and HSP90-like ATPase
  misc_feature (808)..(953): Pfam Id: Response_reg Pfam Desc: Response regulator receiver domain
  misc_feature (365)..(430): Pfam Id: HisKA Pfam Desc: His Kinase A (phosphoacceptor) domain
  misc_feature (1)..(959): NCBI GI: 115469290 NCBI Desc: os06g0654300 [oryza sativa (japonica cultivar-group)]
  misc_feature (1)..(510): NCBI GI: 10129650 NCBI Desc: histidine kinase-like protein [arabidopsis thaliana]
  misc_feature (1)..(510): NCBI GI: 74058448 NCBI Desc: cytokinin independent 2 [arabidopsis thaliana]
  misc_feature (382)..(660): NCBI GI: 124257897 NCBI Desc: histidine kinase [hordeum vulgare subsp. vulgare]
  misc_feature (341)..(517): NCBI GI: 114566147 NCBI Desc: signal transduction histidine kinase-like protein [syntrophomonas wolfei subsp. wolfei str. goettingen]
  misc_feature: The sequence is a functional homolog of SEQ ID NO. 378 in the 11/188,298 US application
MGDNYVAEPEDEVPQSMWPENIGDKHQRQFRMENFRKDQDAFKDVKFDEKPVHVDYQRLIEMANSEKGISQMQYFMKHWEYKRANAARLLEEELGLLCQQRKEIEQNKQQILEEQRFQDESYYAVKRHVPILDEVYEDEWKRPSKKNDDLSRSRETKIDADYDSVSYWKERATKLEEKLEESIQRERSLVEKLEENIKNLQSHTPAEEFSGMLKRADYFLHLVLQSAPIVIAHQDADLRYRFIFNHYPTLADEDVIGKTDYEILSGEGIEEMNSVKREVMATGIATKREFAFNTPMFGAKTFVTYIEPVFSKGGETIGVNYVAMDITDQVKRREKMADIRVREAVQNAKETELSKSLHITEETMRAKQMLATMSHEIRSPLSGVLSMAEILATTKLDKEQHQLLEVMLSSGDLVLQLINDILDLSKVESGAMKLESTTFRPREVVKHVLQTAAASLKKELTLEGCIGDDVPVEVIGDVLRIRQILTNLISNAVKFTHEGKVGIILQVVHDKQPGCKIEGGKIHKRAYSGTAITAVETAVVSPRNCDKDNLHCSKHEDAFQNGVPTCENFKEDIEGEEVVWLRCDVYDTGIGIPEKSLPLLFKRYMQASTDHARKYGGTGLGLAICKQLVELMGGTLTVVSKENEGSTFTFVLPCKIPVKEEHSDDPDEVHSSQNDSANSDIEGSFFFKPQMRASLLSPGVSIMNNTKLFGAKLMCYDPPDKLFSNGFSSTEPNFTNTSTAHQPNGDTVRSTAEEEHDNAMVLELNSQAERVSSSRGDLVSVSGAAPCKVLEEQSFHKKSKCSPTSNKAKILLVEDNKVNIIVAKSMLEQLGHAIDIVNNGMQAIRAVQQHQYDLILMDVHMPEMDGLQATKHIRSFENTGCWDVSVKPEDNQMITDSTISSDSAHAKKQGQRVPIIAMTANSFAESSEECLAAGMDSYISKPVNFQNIKECLQRYLMSQ

SEQ ID NO: 9255 - DNA, 1842 bp, Sorghum bicolor
  misc_feature: Ceres ANNOT ID no. 6099499
  misc_feature: Encodes the peptide sequence at SEQ ID NO 9256
atggccttggcgacgccgctccggctccgccacctcctcccagcggcagcggcggcgccggccagggccccggatcccgccggcccgtcgtccctggcgagccaccgcgccctctcgctctgccggggccgccttctccgcgcaggcctctccaccacgccccgttccggactggtggccgtggccgcggcggcctcggcggcgggcggccggccgacggtactggtcacggagaatctgggcaccgcggggctggacctgctgcgcgcgttcgccaacgtggactgctcctacgagctcacggcggaggagctccgcgccaaggtgtcgctcgtggacgcgctggtggtgcgcagcgggacgcaggtgacgcgggaggtgttcgaggccgcgcgcggcaggctccgcgtcgtcgggcgggccggtgtcggcgtcgacaatgtcgacctccaggcggccaccgaggcgggatgcctcgtcgtcaacgcgcccaccgccaacaccgtcgccgccgcagagcacgccgtcgcgctcctcgccgccatggcgcgcaatgtcgcgcaggccgatgcgtcgctcaaggccggcaaatggcaacgaagcaaatatgttggtgttaccttggtgggcaagacactagctgttatgggttttggaaaggttggtccagaagtagctcgacgtgcaaaaggacttgggatggatgtcattgttcatgatccatatgctgctgttgatagagcccgggcaattggagtagatatggtatcatttgatgaggccatctccacagcagacttcatatcactgcatatgcctctaactccatcgactgcaaagcttttcaatgatgaaacttttgcaaaaatgaggaaaggtgttagaattatcaatgttgcacggggtggagttgttgatgaagaagcattgctgagagcacttgacaatggaacagttgcccaggctgcacttgatgtatttactgaggagccaccgccaagagacagcaagttagtgcagcatgagaatgtcactgtcacaccacaccttggggctagcacaacagaagcgcaggaaggcgtagcccttgaaattgcagaggctgttatcggtgcactgagaggagatctggctgccacggctgtgaatgccccaacggtccctgctgaggttttatcagagttatcttcatatgttgtccttgctgagaagctgggccggcttgttgtgcaacttgtagctggtggcagcgggattaaaggtatcaaggttgttttctcatcagccagagaccccgatgacttggacacaagaattcttcgtgccatggtcaccaaaggcatcatagaacctatttcaagtgctttcgtcaacattgtcaatgcggattatgtcgccaagcaaagaggtcttaggatcgttgaggagagaattttccttgatggttcacctgagatccccctagactccatccaggtccacctcaccaatgtggagtccaagtttgccggagccttatctgatgcaggtgacatcagagtggagggcaaggttagggatggcgcgccgcacctcacgctcgtcgggtcttttagagttgacgttagccttgtgggcaacctaatactgtgctgccaagttgatcaaccaggcatcattgggaaagtggggtcaatcttgggaaaaatgaacgttaacgtgagttttatgagtgtcggtaggactgctccggggaagcaggcgataatggccattggagttgatgaggagcctgagaaggaagctctcaaattgattggtgacacaccgtctgttgaggagtttgtctttcttaagctatag

SEQ ID NO: 9256 - protein, 613 aa, Sorghum bicolor
  misc_feature: Ceres ANNOT ID no. 6099499
  misc_feature (176)..(351): Pfam Id: 2-Hacid_dh_C Pfam Desc: D-isomer specific 2-hydroxyacid dehydrogenase, NAD bindingdomain
  misc_feature (74)..(383): Pfam Id: 2-Hacid_dh Pfam Desc: D-isomer specific 2-hydroxyacid dehydrogenase, catalyticdomain
  misc_feature (539)..(604): Pfam Id: ACT Pfam Desc: ACT domain
  misc_feature (1)..(613): NCBI GI: 115469298 NCBI Desc: os06g0655100 [oryza sativa (japonica cultivar-group)]
  misc_feature (20)..(613): NCBI GI: 90399366 NCBI Desc: h0212b02.14 [oryza sativa (indica cultivar-group)]
  misc_feature (20)..(613): NCBI GI: 32488924 NCBI Desc: osjnbb0059k02.15 [oryza sativa (japonica cultivar-group)]
  misc_feature (71)..(613): NCBI GI: 21554130 NCBI Desc: phosphoglycerate dehydrogenase-like protein [arabidopsis thaliana]
  misc_feature (49)..(613): NCBI GI: 21536501 NCBI Desc: phosphoglycerate dehydrogenase-like protein [arabidopsis thaliana]
  misc_feature (71)..(613): SWISSPROT Homolog: EC 1.1.1.95 D-3-phosphoglycerate dehydrogenase, chloroplast precursor
MALATPLRLRHLLPAAAAAPARAPDPAGPSSLASHRALSLCRGRLLRAGLSTTPRSGLVAVAAAASAAGGRPTVLVTENLGTAGLDLLRAFANVDCSYELTAEELRAKVSLVDALVVRSGTQVTREVFEAARGRLRVVGRAGVGVDNVDLQAATEAGCLVVNAPTANTVAAAEHAVALLAAMARNVAQADASLKAGKWQRSKYVGVTLVGKTLAVMGFGKVGPEVARRAKGLGMDVIVHDPYAAVDRARAIGVDMVSFDEAISTADFISLHMPLTPSTAKLFNDETFAKMRKGVRIINVARGGVVDEEALLRALDNGTVAQAALDVFTEEPPPRDSKLVQHENVTVTPHLGASTTEAQEGVALEIAEAVIGALRGDLAATAVNAPTVPAEVLSELSSYVVLAEKLGRLVVQLVAGGSGIKGIKVVFSSARDPDDLDTRILRAMVTKGIIEPISSAFVNIVNADYVAKQRGLRIVEERIFLDGSPEIPLDSIQVHLTNVESKFAGALSDAGDIRVEGKVRDGAPHLTLVGSFRVDVSLVGNLILCCQVDQPGIIGKVGSILGKMNVNVSFMSVGRTAPGKQAIMAIGVDEEPEKEALKLIGDTPSVEEFVFLKL

SEQ ID NO: 9257 - DNA, 408 bp, Sorghum bicolor
  misc_feature: Ceres ANNOT ID no. 6099536
  misc_feature: Encodes the peptide sequence at SEQ ID NO 9258
  misc_feature: Down-regulated in shoot tissues in response to methyl jasmonate treatment
  misc_feature: Down-regulated in shoot tissues in response to salicylic acid treatment
atggtggagttgctgggccggcggatcggggtggcggcggcagctgccgcgttcatcgccctcgcggcgttcggatccgcctcgtcctcgcccaaatccttcgtgaagtccaccgtctccgcccacgacgttgtcatcttctccaagtcatactgcccgtactgcaaaagagcaaaggccgtgtttaaggagcttcagttgaagaaagagccatatgtcgtggagcttgatcagcgagaggatggttcggagattcaggatgccttacgtgacatagttggcaggcgtactgttcctcaagtttttgtccatggaaagcacttgggaggctctgacgatactgttgacgcttatgaaagtggaaaactggctaaacttctgaacattggagtcaaggatgatctttga

SEQ ID NO: 9258 - protein, 135 aa, Sorghum bicolor
  misc_feature: Ceres ANNOT ID no. 6099536
  misc_feature (44)..(108): Pfam Id: Glutaredoxin Pfam Desc: Glutaredoxin
  misc_feature (1)..(135): NCBI GI: 119370643 NCBI Desc: glutaredoxin-c8 precursor (glutaredoxin-c4 homolog)
  misc_feature (11)..(134): NCBI GI: 19548658 NCBI Desc: glutaredoxin [populus tremula x populus tremuloides]
  misc_feature (14)..(133): NCBI GI: 21536938 NCBI Desc: glutaredoxin [arabidopsis thaliana]
  misc_feature (59)..(135): NCBI GI: 115469332 NCBI Desc: os06g0659500 [oryza sativa (japonica cultivar-group)]
  misc_feature (9)..(127): NCBI GI: 75323542 NCBI Desc: monothiol glutaredoxin-s6 precursor
  misc_feature: Down-regulated in shoot tissues in response to methyl jasmonate treatment
  misc_feature: Down-regulated in shoot tissues in response to salicylic acid treatment
  misc_feature: The sequence is a functional homolog of SEQ ID NO. 382 in the 11/188,298 US application
MVELLGRRIGVAAAAAAFIALAAFGSASSSPKSFVKSTVSAHDVVIFSKSYCPYCKRAKAVFKELQLKKEPYVVELDQREDGSEIQDALRDIVGRRTVPQVFVHGKHLGGSDDTVDAYESGKLAKLLNIGVKDDL

SEQ ID NO: 9259 - DNA, 1152 bp, Sorghum bicolor
  misc_feature: Ceres ANNOT ID no. 6099537
  misc_feature: Encodes the peptide sequence at SEQ ID NO 9260
atgatttcgccgcggatgccgacgaatctcctcccggcgcggacgatctcccctgtctcaaatggctgcgcagcgacggcgagcccctcttctccctcggtggctgcacggccacggcgaccctcttcaggccttcaatctgtgactggcagagggaagtttcccttggcagccatcactctagatgattaccttccaatgcgaagtaccgaagtgaagaaccggacatcaacagatgacatcacaagtctgagactaatcacagcagtcaaaaccccctatttgcctgatggaagattcgatctggaagcatatgattctctcataaacatgcagatagagggtggtgctgaaggtgtaatagttggaggaacaacaggagagggtcatctcatgagctgggatgaacatatcatgctcattgggcatacagtgaactgctttggctctagaattaaagtgataggcaacacaggaagtaactcaaccagagaagctgttcacgcaacagaacagggatttgctgttggcatgcatgcagctctccacatcaatccgtactatgggaagacctcaactgaaggaatgatttctcattttgaggctgttctcccaatgggcccgaccatcatctacaatgtgccatccaggagtgcccaggatatctcccctgaagttattgtagcaatttcaggctatacaaacatggcaggtgtcaaggaatgcgttgggcatgagaggattcagcagtatgctgacaaaggtataacaatttggagcggtaatgatgatgaatgccacgattctaggtggaaatatggtgctactggagtcatttctgttactagcaaccttgttcctgggctcatgcacagcctcatgtacaaaggcgagaatgctatgctgaacgagaaactattgcccctgatgaaatggttgttctgccaaccaaatccaattgctgtcaacactgctctggctcagctcggggtggcaaggcccgtcttcagactgccatatgttccgcttcctcttgaaaagaggatcgagtttgtccggattgttgaggctattggacgtgaaaattttgtgggagaaaaggaggctcaggttctcgatgatgatgatttcgtgttgatcagtaggtactag

SEQ ID NO: 9260 - protein, 383 aa, Sorghum bicolor
  misc_feature: Ceres ANNOT ID no. 6099537
  misc_feature (82)..(359): Pfam Id: DHDPS Pfam Desc: Dihydrodipicolinate synthetase family
  misc_feature (1)..(383): NCBI GI: 1432156 NCBI Desc: dihydrodipicolinate synthase [coix lacryma-jobi]
  misc_feature (7)..(383): NCBI GI: 118241 NCBI Desc: dihydrodipicolinate synthase, chloroplast precursor (dhdps)
  misc_feature (7)..(383): NCBI GI: 1638871 NCBI Desc: dihydrodipicolinate [zea mays]
  misc_feature (7)..(383): NCBI GI: 228215 NCBI Desc: dihydrodipicolinate synthase
  misc_feature (7)..(370): NCBI GI: 1588589 NCBI Desc: dihydrodipicolinate synthase
  misc_feature (1)..(383): SWISSPROT Homolog: EC 4.2.1.52 Dihydrodipicolinate synthase, chloroplast precursor
MISPRMPTNLLPARTISPVSNGCAATASPSSPSVAARPRRPSSGLQSVTGRGKFPLAAITLDDYLPMRSTEVKNRTSTDDITSLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSTEGMISHFEAVLPMGPTIIYNVPSRSAQDISPEVIVAISGYTNMAGVKECVGHERIQQYADKGITIWSGNDDECHDSRWKYGATGVISVTSNLVPGLMHSLMYKGENAMLNEKLLPLMKWLFCQPNPIAVNTALAQLGVARPVFRLPYVPLPLEKRIEFVRIVEAIGRENFVGEKEAQVLDDDDFVLISRY

SEQ ID NO: 9261 - DNA, 297 bp, Sorghum bicolor
  misc_feature: Ceres ANNOT ID no. 6099538
  misc_feature: Encodes the peptide sequence at SEQ ID NO 9262
atggcgtacgtggaccacgccttctccatcaccgaggacgacgacctggtcggcggcgcggtgggaggcccgcgtggcgcgccagtcaaggaaatcgcctttgccgccgcgctcctcgccttcggcgtcgtcggtgtcgtcgccggatccttcatggccgcgcaccaagtcggcggcgaccgcgcccacgttctgggtgtggtaatgttcatcccagggttctactacacaagaatagcatattatgcttacaaagggtacaagggtttctccttttccaacatacctcctatttga

SEQ ID NO: 9262 - protein, 98 aa, Sorghum bicolor
  misc_feature: Ceres ANNOT ID no. 6099538
  misc_feature (24)..(96): NCBI GI: 49904255 NCBI Desc: mgc89669 protein [xenopus tropicalis]
  misc_feature (24)..(96): NCBI GI: 89268887 NCBI Desc: novel protein [xenopus tropicalis]
  misc_feature (13)..(96): NCBI GI: 51258427 NCBI Desc: mgc84111 protein [xenopus laevis]
  misc_feature (24)..(96): NCBI GI: 56204074 NCBI Desc: gd:c20orf30 [homo sapiens]
  misc_feature (24)..(96): NCBI GI: 58331124 NCBI Desc: chromosome 20 open reading frame 30 isoform 2 [homo sapiens]
MAYVDHAFSITEDDDLVGGAVGGPRGAPVKEIAFAAALLAFGVVGVVAGSFMAAHQVGGDRAHVLGVVMFIPGFYYTRIAYYAYKGYKGFSFSNIPPI

SEQ ID NO: 9263 - DNA, 714 bp, Sorghum bicolor
  misc_feature: Ceres ANNOT ID no. 6099550
  misc_feature: Encodes the peptide sequence at SEQ ID NO 9264
atgggtcacggccacggcggcggctgccgctgctgcgagctctgcggcgcgccggcggccgtgcactgcgcggcggacgcggccttcctctgcgccgcctgcgacgccaaggtgcacggcgccaacttcctcgcgtcgcgccaccaccgcacgcgcctccacctcgcgggaacgccggacgaggaggagtacgagtccgccgcggcgagctcctgcgtgtccacggccgactcggcgtcgtcgtccgcggcgccgcggcggaggaggcgccccgcaccggccgggagcgggagcgggagcccgaggctcaggcccccgtgcgaggcggtgctcgaggcgtgggccaagcgggcaggcctcgcggcgggagcggcggcacgccggcgcgccgcgcgtgcggtccgggcctgcgcccacgacctcgcctccgcgcgcgtcccgccgcgcgtcgccatggccgcggcgctgtggcgggaggtggcggggcgcggcggtgggatcatcggtgccggcggcggcggcggctgcggccacgacgaggcgctgcggcggctggaggcgtgcgcgcacgtgccggcgaggctcgtggtggcggtggccacgtccctggcgcgcgcacgcgcgcgcaggcggaggagggccgccacggacgccgtggagggttgggacgagtgcgcgtgggccgggcccaagtccagcccggcacgttcttga

SEQ ID NO: 9264 - protein, 237 aa, Sorghum bicolor
  misc_feature: Ceres ANNOT ID no. 6099550
  misc_feature (7)..(53): Pfam Id: zf-B_box Pfam Desc: B-box zinc finger
  misc_feature (2)..(111): NCBI GI: 11094211 NCBI Desc: allele:hd1 [oryza sativa]
  misc_feature (2)..(123): NCBI GI: 11094207 NCBI Desc: allele:hd1 [oryza sativa (indica cultivar-group)]
  misc_feature (2)..(111): NCBI GI: 78058608 NCBI Desc: hd1 [oryza sativa (indica cultivar-group)]
  misc_feature (2)..(111): NCBI GI: 11094213 NCBI Desc: allele:hd1 [oryza sativa]
  misc_feature (2)..(111): NCBI GI: 11094209 NCBI Desc: allele:hd1 [oryza sativa]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 32 in the 10/666,642US patent application
  misc_feature: The sequence is a functional homolog of SEQ ID NO 328 in the 10/666,642US patent application
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 32 in the 20070033671 US patent application
  misc_feature: The sequence is a functional homolog of SEQ ID NO 328 in the 20070033671 US patent application
MGHGHGGGCRCCELCGAPAAVHCAADAAFLCAACDAKVHGANFLASRHHRTRLHLAGTPDEEEYESAAASSCVSTADSASSSAAPRRRRRPAPAGSGSGSPRLRPPCEAVLEAWAKRAGLAAGAAARRRAARAVRACAHDLASARVPPRVAMAAALWREVAGRGGGIIGAGGGGGCGHDEALRRLEACAHVPARLVVAVATSLARARARRRRRAATDAVEGWDECAWAGPKSSPARS

SEQ ID NO: 9265 - DNA, 1743 bp, Sorghum bicolor
  misc_feature: Ceres ANNOT ID no. 6099556
  misc_feature: Encodes the peptide sequence at SEQ ID NO 9266
atgggttccgggacgtggcgcaaggcctacggcgcgctcaaggactccaccagggtcggcctcgccaacttcaacagcgagtacaaggatctggacatcgccattgtgaaggcgacgaaccacgtggagtgcccgcccaaggagcgccacttcaggaggatactctacgcgacctcggggcatcgcccgcgagccgacgtcgcctactcgatatgcgcgctggcgaggaggttgtccaagaccaagaactggatagtcgcactgaaaacgttgatagtgatacacagactgctcagagaaggtgatggcacattcaaggaggatttcctcacctattcattcagagggaacattctgcagatcccactgttcaaggatgactccagcccactagcttgggactgctccgcttgggttcgcacgtacgcgctctacctggacgaacgggtcgagtgcttcagggttctcaagtacgacgtcgaattagatcgtctgctcaagttaccccaggcttctggcaaggcacacagcaggacaagaaccctgccgctcggggaacttttggatcagttgccagcattgcagaaactgcttctcaggcttatttcctgccagcctgaaggtgcggcctgcacaaattaccttgtacaatatgcgttagctcttgttttgaaggaaagtttcaaaatatactgttcaatcaatgatggcatcatcaatcttgttgatatgtattttgagatgccaaaatatgatgcaatcaaggcccttgaaatttataaacgagctggtcagcaggcagaaaaactttctaatttctatgaccactgcaaacatcttgagctggccaggactttccagtttcccactctgaggcagccgccgccttcatttcttgtgacaatggaagagtatatcagagaagcaccccgtgccgatactgagagtaagagttcggaaaaccatgaagagaatcaacctagtgataatgaagaagcagctccacaggaagccgagaaaccagtggaagatgaaaaacaagaatctgcagagcctgaaacagagccacaacctgctgctgggcctccggaagaaccagtggaacctcagccacgggcgactactggggatctattaaacttggatgaagaagtaaaccccatgattgcagaccttgaagaaagcaatgcactggctcttgctattgtggcaccaggtaatgaaaacaagatgtcaaattctcgagacttgtttgcccttgacaaggctggatgggaattggctctggttactgcaccaagtaaccacacaaatcaacaagtggacaatcaattggctgggggatttgacaagctattgctagacagtctttacgaagacgaggcaaggagacagcaaatagccagtgtgacctacactggaagtcttgcagcaaacccgtttgccaccagtgatccatttgccacgtcaaacagctttgcgccaccgtcaaatgtgcagttagctatgatggcagagcagcagcaatattaccaggcacagcagcagcagtactatcaggtaccgcagcagcagcagcagcagcagcagatgacgatgttgccgccccaaacatatcagcagcagtctcagtattctgccccttcttctcaatctggattatccaatccttttggtgatccattcagtagccttgtcacgatggctaatccaccgaagcaaagcaattcaaatttagtctga

SEQ ID NO: 9266 - protein, 580 aa, Sorghum bicolor
  misc_feature: Ceres ANNOT ID no. 6099556
  misc_feature (28)..(309): Pfam Id: ANTH Pfam Desc: ANTH domain
  misc_feature (28)..(156): Pfam Id: ENTH Pfam Desc: ENTH domain
  misc_feature (1)..(580): NCBI GI: 52077380 NCBI Desc: phosphoprotein-like [oryza sativa (japonica cultivar-group)]
  misc_feature (4)..(580): NCBI GI: 50251206 NCBI Desc: synaptosomal-associated protein 91-like [oryza sativa (japonica cultivar-group)]
  misc_feature (1)..(580): NCBI GI: 92877485 NCBI Desc: carbamoyl-phosphate synthase l chain, atp-binding; anth [medicago truncatula]
  misc_feature (5)..(559): NCBI GI: 56785152 NCBI Desc: clathrin assembly protein ap180 short form-like [oryza sativa (japonica cultivar-group)]
  misc_feature (1)..(537): NCBI GI: 144925059 NCBI Desc: anth [medicago truncatula]
MGSGTWRKAYGALKDSTRVGLANFNSEYKDLDIAIVKATNHVECPPKERHFRRILYATSGHRPRADVAYSICALARRLSKTKNWIVALKTLIVIHRLLREGDGTFKEDFLTYSFRGNILQIPLFKDDSSPLAWDCSAWVRTYALYLDERVECFRVLKYDVELDRLLKLPQASGKAHSRTRTLPLGELLDQLPALQKLLLRLISCQPEGAACTNYLVQYALALVLKESFKIYCSINDGIINLVDMYFEMPKYDAIKALEIYKRAGQQAEKLSNFYDHCKHLELARTFQFPTLRQPPPSFLVTMEEYIREAPRADTESKSSENHEENQPSDNEEAAPQEAEKPVEDEKQESAEPETEPQPAAGPPEEPVEPQPRATTGDLLNLDEEVNPMIADLEESNALALAIVAPGNENKMSNSRDLFALDKAGWELALVTAPSNHTNQQVDNQLAGGFDKLLLDSLYEDEARRQQIASVTYTGSLAANPFATSDPFATSNSFAPPSNVQLAMMAEQQQYYQAQQQQYYQVPQQQQQQQQMTMLPPQTYQQQSQYSAPSSQSGLSNPFGDPFSSLVTMANPPKQSNSNLV

SEQ ID NO: 9267 - DNA, 249 bp, Sorghum bicolor
  misc_feature: Ceres ANNOT ID no. 6099558
  misc_feature: Encodes the peptide sequence at SEQ ID NO 9268
atgtcggcgtacgacgaggtggagatcgaggacatggagtggaacgcggagctgaaggcgtacacgtacccgtgcccctgcggcgacctgttccagatcacgctcgacgacctccgcctcggggaggagattgcgcgctgcccctcgtgctccctcttcctcaccgtcgtatacaacgccgaggacttcgccgacgccaaggagccgacgacccagaagccgtccccgagcccagtcgccgtcgcctga

SEQ ID NO: 9268 - protein, 82 aa, Sorghum bicolor
  misc_feature: Ceres ANNOT ID no. 6099558
  misc_feature (5)..(59): Pfam Id: zf-CSL Pfam Desc: CSL zinc finger
  misc_feature (3)..(74): NCBI GI: 140049647 NCBI Desc: zinc finger, dhp-type [medicago truncatula]
  misc_feature (1)..(82): NCBI GI: 21648335 NCBI Desc: kti11p [saccharomyces cerevisiae]
  misc_feature (1)..(82): NCBI GI: 62738697 NCBI Desc: chain a, the solution structure of kti11p
  misc_feature (1)..(82): NCBI GI: 74605613 NCBI Desc: diphthamide biosynthesis protein 3
  misc_feature (1)..(82): NCBI GI: 74610927 NCBI Desc: diphthamide biosynthesis protein 3
MSAYDEVEIEDMEWNAELKAYTYPCPCGDLFQITLDDLRLGEEIARCPSCSLFLTVVYNAEDFADAKEPTTQKPSPSPVAVA

SEQ ID NO: 9269 - DNA, 2094 bp, Sorghum bicolor
  misc_feature: Ceres ANNOT ID no. 6099560
  misc_feature: Encodes the peptide sequence at SEQ ID NO 9270
atgccgggctcttcggcgaggccgagcttctcggccttccgcggtgcccggtggcgcgccgatctcggcgtcatccccggctccgccgccgtctccaccgacgatctccgccgcgccgccgccgactcccgccggagatatgctaatctgcggcgaaggctgctaatagatccccatctttccaaggatgaagaaggtgcccctgacttgattgtggagaatccactatcgcagagcccagggagcacttggggccaatatttcaggaatgcagagcttgagaaaatgcttaaccaagatctgtcccgcctataccctgaattgggggacttcttccaaacaagcacatgtcagtctatgcttggacgtgtattgttagtatggagcctcagatacccagagtttggttacagacaaggaatgcatgaactcttagctcctcttctctatgtacttcacgctgatgtgcagcacttcagacaagtcagggaccttcatgaagagcttttgggtgatgattttgatggccaaacttttccagatcgttcaaagctgaacagaagtgacagaaaaaacaatgttgagggtagaacagctaaatttagaagtttgtctgaccttgatcctgatactagagatcttttcttgatcaatgatgcatatggagcagagggtgagttgggtattattttatcagaaaagtttatggagcatgatgcttactctatgtttgagaatttgatgaacggtgcgcaaggagtggttgctatcactgacttctattctctgagtcctgccccagaatcaagcacgggtttaacacctgtaagagaggcatcatctgcaatatatcacttgcttgctagtgttgattcctctcttcatagtcaccttgtggagttaggagttgaacctcagtactttgcattacgatggctccgcgtcctatttggtcgtgagttttcacttgacagtcttctgtttatttgggatgagatcttatcttctcctaaccattcttattgtactgaaatcatgagtagggctgattatcagtttaaagtgttatgttctccccgtggtgcgctgattttatcgatggcagtatcaatgatgcttcatctcagatcctccttgttaggtagtgaacatgcgacttcttgcctagtgaggttgttaaattttccagaagatattgacttaaataacttaattgagaaagccaagttactgcaatcttttgcccttgaagcaaatcttccttcatctccaatgagaggaaattccctcttgactacacccaactattgggaagagacatggaagattctccagccatcaatggaccaaaagggtggtggtgtcttcaagatgaagggaaggggcttcttgagaagaagcttgtctaacactgagtcgaatgtttccagaagcaaggctgctaattttgaaaacaaagatatgacttcaactacgcagtccactactgatgaacttcacaatgctgatgtagttcctgcagagctgataaatagtgaaattagagatcctcttggagcagctagtgggtatttatcgaggagcagcagtaccactttgtcatgtggaactgaatacgatcatgatacccatcatctggaagaaacatgtggtccctgtgatgacagagtggttaatgaacctgatccactctttgtgcacgatggtagaactgatgaagcagcaacaacagatcgaacatctggaatagtggatacttatccagttcaagagtgtagactgtgttctgctgatgggaagctgaaaataaaagatgaccaaaattccactagtgataaaggtggccaaaaagaaacattggcaatatgttcaataacaaatgtggctgataaagagttgagcagaacattaagatctcttggtgaatctatggttgagaacatacaggatatcgagatgctgtttcaaccaaattcactctcgacttcagtggagaaacttgagaaagcaattcctagaagcacagagcaagctaaggcagtagcagctctaaaagaactcaggaagatcagtgaccttttacgtcaaatctaa

SEQ ID NO: 9270 - protein, 697 aa, Sorghum bicolor
  misc_feature: Ceres ANNOT ID no. 6099560
  misc_feature (10)..(423): NCBI GI: 140067275 NCBI Desc: rabgap/tbc [medicago truncatula]
  misc_feature (120)..(428): NCBI GI: 42573083 NCBI Desc: microtubule-associated protein [arabidopsis thaliana]
  misc_feature (141)..(428): NCBI GI: 5032258 NCBI Desc: microtubule-associated protein [arabidopsis thaliana]
  misc_feature (10)..(258): NCBI GI: 23308465 NCBI Desc: at5g57210/mjb24_2 [arabidopsis thaliana]
  misc_feature (282)..(440): NCBI GI: 92877490 NCBI Desc: rabgap/tbc [medicago truncatula]
MPGSSARPSFSAFRGARWRADLGVIPGSAAVSTDDLRRAAADSRRRYANLRRRLLIDPHLSKDEEGAPDLIVENPLSQSPGSTWGQYFRNAELEKMLNQDLSRLYPELGDFFQTSTCQSMLGRVLLVWSLRYPEFGYRQGMHELLAPLLYVLHADVQHFRQVRDLHEELLGDDFDGQTFPDRSKLNRSDRKNNVEGRTAKFRSLSDLDPDTRDLFLINDAYGAEGELGIILSEKFMEHDAYSMFENLMNGAQGVVAITDFYSLSPAPESSTGLTPVREASSAIYHLLASVDSSLHSHLVELGVEPQYFALRWLRVLFGREFSLDSLLFIWDEILSSPNHSYCTEIMSRADYQFKVLCSPRGALILSMAVSMMLHLRSSLLGSEHATSCLVRLLNFPEDIDLNNLIEKAKLLQSFALEANLPSSPMRGNSLLTTPNYWEETWKILQPSMDQKGGGVFKMKGRGFLRRSLSNTESNVSRSKAANFENKDMTSTTQSTTDELHNADVVPAELINSEIRDPLGAASGYLSRSSSTTLSCGTEYDHDTHHLEETCGPCDDRVVNEPDPLFVHDGRTDEAATTDRTSGIVDTYPVQECRLCSADGKLKIKDDQNSTSDKGGQKETLAICSITNVADKELSRTLRSLGESMVENIQDIEMLFQPNSLSTSVEKLEKAIPRSTEQAKAVAALKELRKISDLLRQI

SEQ ID NO: 9271 - DNA, 1866 bp, Sorghum bicolor
  misc_feature: Ceres ANNOT ID no. 6099564
  misc_feature: Encodes the peptide sequence at SEQ ID NO 9272
  misc_feature: Up-regulated in shoot tissues in response to methyl jasmonate treatment
  misc_feature: Up-regulated in shoot tissues in response to salicylic acid treatment
atggcgttcggcgagcgcgtcaccaccttcgaggacagcgagaaggagagcgagtacggctacgtccgcaaggtctccggacctgtcgttgtggctgatggaatgggtggtgctgccatgtatgaacttgttcgtgttggacatgataacctcatcggggaaattattcgtcttgagggtgactcagctacaattcaagtttatgaggaaacagctgggctgatggttaatgacccagtgttgagaacaagaaagcctctctcagttgaattggggcctggcattcttgggaatatatttgatggaattcagcgccctctaaaaacaattgcgatcaaatctggggacgtgtacataccacgtggtgtatcagtccctgcccttgacaaagatcagctgtgggaatttcagccaaagaagctaggcgtaggagatgccatcacgggtggagatctatatgctactgtatttgagaatacactgatgcaacaccatgttgcccttcctcctggttctatggggaaaataagctacattgcccctgctggtcagtacagtttgcaggatacagtactggaattggaatttcagggaatcaaaaagcaatttactatgctccagacatggcctgtacgttcaccaaggcctgtttcgtcaaagcttgctgctgacacacctctcttaacaggacagcgtgtgctcgatgcattgtttccctcagtgcttggagggacatgtgctattcctggagcatttggatgtggaaaaactgtcattagtcaagcactttcaaagtattccaattctgaagctgtggtttacgtgggttgtggggaacgagggaatgagatggctgaggtccttatggacttcccacaattgacaatgacattgcctgatggacgtgaagagtctgtcatgaaaagaacaactcttgtggctaacacctccaacatgcctgttgctgctcgtgaagcatccatttatacaggaattacgatagctgagtatttccgtgacatgggatataatgtcagtatgatggctgattctacttcccgatgggctgaagcattgcgtgaaatttcaggacgtttggctgaaatgcctgcagatagtggttaccctgcatatttggctgcacggttggcatcgttttatgaacgtgctgggaaggtgaaatgccttggcagtccagatcggactggcagtgtcacaattgtcggtgctgtctctcctcctggtggtgatttctcagatcctgttacctctgcaacccttagtattgtacaggtcttctggggattggataagaagctggctcaaagaaagcatttcccatctgtgaattggctcatttcatattcaaaatactccaaggctctggaatccttctacgaaaagtttgatccggacttcattgatattaggacaaaagcacgtgaagtattacagagagaggatgatctaaatgaaattgtccagcttgttggcaaagatgcactggcagaaagtgacaagattactctggagactgcaaagctccttagggaagattacttggcgcagaatgcattcacaccatatgacaagttttgcccgttctacaaatctgtttggatgatgcgcaatattattcatttcaacacattagcgaaccaggctgtggaaagagctgctagtgctgatgggcaaaagataacctacagtgttataaagcatcgcctcggtgatcttttctatcgcctagtttcacaaaagttcgaggatccagctgaaggtgaagaagctctagtcggaaaattcaagaaactgtatgacgaccttacagccggattccgcaacctagaagacgaagcacggtga

SEQ ID NO: 9272 - protein, 621 aa, Sorghum bicolor
  misc_feature: Ceres ANNOT ID no. 6099564
  misc_feature (229)..(456): Pfam Id: ATP-synt_ab Pfam Desc: ATP synthase alpha/beta family, nucleotide-binding domain
  misc_feature (474)..(618): Pfam Id: ATP-synt_ab_C Pfam Desc: ATP synthase alpha/beta chain, C terminal domain
  misc_feature (22)..(84): Pfam Id: ATP-synt_ab_N Pfam Desc: ATP synthase alpha/beta family, beta-barrel domain
  misc_feature (1)..(621): NCBI GI: 11527563 NCBI Desc: vacuolar proton-atpase [hordeum vulgare subsp. vulgare]
  misc_feature (3)..(621): NCBI GI: 137460 NCBI Desc: vacuolar atp synthase catalytic subunit a (v-atpase a subunit) (vacuolar proton pump alpha subunit) (v-atpase 69 kda subunit)
  misc_feature (1)..(621): NCBI GI: 90025017 NCBI Desc: vacuolar proton-atpase subunit a [triticum aestivum]
  misc_feature (3)..(621): NCBI GI: 401322 NCBI Desc: vacuolar atp synthase catalytic subunit a (v-atpase a subunit) (vacuolar proton pump alpha subunit) (v-atpase 69 kda subunit)
  misc_feature (3)..(621): NCBI GI: 3169287 NCBI Desc: vacuolar h+-atpase catalytic subunit [gossypium hirsutum]
  misc_feature (3)..(621): SWISSPROT Homolog: EC 3.6.3.14 Vacuolar ATP synthase catalytic subunit A
  misc_feature (18)..(560): SWISSPROT Homolog: EC 3.6.3.15 V-type sodium ATP synthase subunit A
  misc_feature: Up-regulated in shoot tissues in response to methyl jasmonate treatment
  misc_feature: Up-regulated in shoot tissues in response to salicylic acid treatment
MAFGERVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDQLWEFQPKKLGVGDAITGGDLYATVFENTLMQHHVALPPGSMGKISYIAPAGQYSLQDTVLELEFQGIKKQFTMLQTWPVRSPRPVSSKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRTGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAASADGQKITYSVIKHRLGDLFYRLVSQKFEDPAEGEEALVGKFKKLYDDLTAGFRNLEDEAR

SEQ ID NO: 9273 - DNA, 1191 bp, Sorghum bicolor
  misc_feature: Ceres ANNOT ID no. 6099581
  misc_feature: Encodes the peptide sequence at SEQ ID NO 9274
atgccgttatcatctctctccctcctccgccaccacccgccgcgccctctcccgccaacttcaaatcgtcagccgccaccgccacaaccccgcctactcctccctccgttcacagggcgccgcgccttcgtctgccagccgctcgccgcggccacggacgacatggctgctgcggccgcggcggcgtcgccccccacgctgctcgagcacatgggccaggcgggcacggccgctgacctcactgtcctcgtggcgcatatccagagcgcatgcaagcgcatcgcggctctcgtagcgtcccccggcaacgccgaactgtcgcggtctaataaggcggggcgtgggaccgtggcggccgggcgtgacgcgcctaagccgctcgacgaattgtcgaatgatatcatcttgtcatcgctccaaagttctggaaaggttgcagtgctagcatccgaagaaaatgatcttcccatttggatatctaatgacggtccatatgttgttgttactgatccgcttgatggttctcgcaacattgaggtctccatacctactggaacaatatttgggatctacaataggctggtggagctggaccatctccctttggaggagagagctcagctcaattcactgcaaagtggaactcgccttgttgctgctgggtatgtcctgtactcatctgccaccatcttgtgtatcagcttcggtgcaggtacccatgccttcacattggattggtcgaccggagaattcatccttacacatccttccatccaaataccccctagagggcagatatattcggtgaatgacgctaggtattttgactggcctgagggcttaaggaagtacattgacacaatcagacaaggcaagggacagcatccgaagaagtactcagctcgctacgtgtgctcactggttgctgatttccaccggacgctcatatatggtggggttgctatgaacccaagggatcatctgcggctggtttatgaggcaaatcctctcagtttccttgctgagcaggctgggggtagagggtcagatggaaagaacagaatcctcaacattcagcctgtgaagttgcaccagaggctgcccttgttcttagggagcatagatgacatgcttgagctggaaagctatggagatgtgcagcagaaggttaatcctggatatgaagtttaa

SEQ ID NO: 9274 - protein, 396 aa, Sorghum bicolor
  misc_feature: Ceres ANNOT ID no. 6099581
  misc_feature (61)..(387): Pfam Id: FBPase Pfam Desc: Fructose-1-6-bisphosphatase
  misc_feature (46)..(396): NCBI GI: 140071747 NCBI Desc: inositol phosphatase/fructose-1,6-bisphosphatase; inositol monophosphatase [medicago truncatula]
  misc_feature (3)..(396): NCBI GI: 21553970 NCBI Desc: fructose-bisphosphatase-like protein [arabidopsis thaliana]
  misc_feature (36)..(381): NCBI GI: 32307574 NCBI Desc: fructose-1,6 bisphosphatase [bigelowiella natans]
  misc_feature (50)..(383): NCBI GI: 67243 NCBI Desc: fructose-bisphosphatase (ec 3.1.3.11), chloroplast - spinach
  misc_feature (50)..(383): NCBI GI: 2529374 NCBI Desc: fructose 1,6-bisphosphatase [spinacia oleracea]
  misc_feature: The sequence is a functional homolog of SEQ ID NO. 285 in the 11/188,298 US application
  misc_feature: The sequence is a functional homolog of SEQ ID NO. 474 in the 11/188,298 US application
MPLSSLSLLRHHPPRPLPPTSNRQPPPPQPRLLLPPFTGRRAFVCQPLAAATDDMAAAAAAASPPTLLEHMGQAGTAADLTVLVAHIQSACKRIAALVASPGNAELSRSNKAGRGTVAAGRDAPKPLDELSNDIILSSLQSSGKVAVLASEENDLPIWISNDGPYVVVTDPLDGSRNIEVSIPTGTIFGIYNRLVELDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILNIQPVKLHQRLPLFLGSIDDMLELESYGDVQQKVNPGYEV

SEQ ID NO: 9275 - DNA, 825 bp, Sorghum bicolor
  misc_feature: Ceres ANNOT ID no. 6099590
  misc_feature: Encodes the peptide sequence at SEQ ID NO 9276
atgtctctactttcaaagttacgcttgatcaccgtggatgttactggtacactgattgcttacaaaggacaccttggggattactactgtatggcagctaagtctgctgggatgccatgccctgactataaccgtatgcatgagggcttcaagcttgcatacactgagatggccagacagtacccttgctttggatttgcggctaagatgccgaacattgaatggtggaggacatgtgttaagaattcatttgttaaggctggctatgattatgatgaggagacatttgagaaaatcttcaggcgcatttattctgcttttggctcctctgcaccatactcggcatttcctgatgcacagcccttcatgcggtgggcgcgggaaaagggactcattgttggtgttgtcagcaatgcagagtatcgctacaaagatgtaatcttaccagctttagggttgaatcagggctccgaatgggacttcggggtgttctcaggcatggtaggtgttgagaagccagacccaagaatttacaagatagcgttggagatggcaggaaacgtagctccagaagaagcgctccacataggtgacagcatgcggaaggactacaccccagctaggagcatcgggatgcatgcgctgctcctggaccggttcaagactgccgacgccgagagctggaggcagtcaggcgcgacggtgctccctgatctggttgccactcaagagtggctcaccaagaatcagaatgaggaacaggagaaaacagtggcatcacgagtgctgaacagaatgtctgaaaagctaaagatgggggcttga

SEQ ID NO: 9276 - protein, 274 aa, Sorghum bicolor
  misc_feature: Ceres ANNOT ID no. 6099590
  misc_feature (7)..(220): Pfam Id: Hydrolase Pfam Desc: haloacid dehalogenase-like hydrolase
  misc_feature (1)..(250): NCBI GI: 106879171 NCBI Desc: at5g44730 [arabidopsis thaliana]
  misc_feature (1)..(86): NCBI GI: 115444523 NCBI Desc: os02g0173600 [oryza sativa (japonica cultivar-group)]
  misc_feature (8)..(219): NCBI GI: 86605887 NCBI Desc: haloacid dehalogenase, ia family protein [cyanobacteria bacterium yellowstone a-prime]
  misc_feature (6)..(217): NCBI GI: 119607781 NCBI Desc: haloacid dehalogenase-like hydrolase domain containing 3, isoform cra_a [homo sapiens]
  misc_feature (6)..(217): NCBI GI: 13654294 NCBI Desc: haloacid dehalogenase-like hydrolase domain containing 3 [homo sapiens]
MSLLSKLRLITVDVTGTLIAYKGHLGDYYCMAAKSAGMPCPDYNRMHEGFKLAYTEMARQYPCFGFAAKMPNIEWWRTCVKNSFVKAGYDYDEETFEKIFRRIYSAFGSSAPYSAFPDAQPFMRWAREKGLIVGVVSNAEYRYKDVILPALGLNQGSEWDFGVFSGMVGVEKPDPRIYKIALEMAGNVAPEEALHIGDSMRKDYTPARSIGMHALLLDRFKTADAESWRQSGATVLPDLVATQEWLTKNQNEEQEKTVASRVLNRMSEKLKMGA

SEQ ID NO: 9277 - DNA, 3024 bp, Sorghum bicolor
  misc_feature: Ceres ANNOT ID no. 6099595
  misc_feature: Encodes the peptide sequence at SEQ ID NO 9278
atggcccacctgcagctctcggcggtcgccggcgccggcgcccggccggcggcggcgggcggtcgcggcgacgagatggaggatgtcgcgctgctcgactcgtacgacgaggagatggggctgccgccgctgggtgcatcgggcgcggaggagggcgccgcggcggaggcgcacgtgcgcgtcaccggcatgacgtgctccgcctgcaccagcgccgtcgaggccgccgtctccgcgcgcagcggcgtgcggcgcgtcgccgtgtcgctgctccagaaccgcgcccacgtcgtgttcgaccccgcgctgtccaaggtagaagatatcattgaagcgattgaagatgccggatttgaagcagaaattatccctgaatctgctgtctctcagcctaaatcacagaagactttatcagcacaattcaggatagggggaatgacatgtgccaattgtgtaaactcggttgagggtatcttaaaaaagctacctggtgttaaaggagcagtcgttgccttggcaacctcattaggggaagttgagtatgttccttctgccattagcaaagatgaaatcgttcaggccatcgaggatgctggttttgaagcagcattcttgcagagtagcgaacaagataaggttttgctgggactgactggcttgcacacagagagggatgttgaagtcttaaatgatattcttaagaaattggatggtttgcgacaatttggtgtaaatattgtcctctcggaagttgagatcgtatttgatccagaagctgttggtctgagatcaattgtggatacaattgagatggcaagcaatgggaggttcaaagctgatgttcagaatccatacactcgaggggcttcaaatgatgcacaggaggcctccaaaatgcttaaccttctccgctctagcttgttccttagcattcctgtatttttcatacgtatggtttgccccagtatacctttccttagtacactactaagcatgcactgtggaccatttctcatgggggatttgctgaagtggatattggtaagcattgtacaatttgttgtcggcaaacggttctatgttgcggcttatagggctgtgaggcatggatctacaaacatggatgtgctagtggttcttggtaccactgcatcatatgcatactctgtctgtgcactactatacggagcatttactggatttcatcctcccgtatattttgagacaagtgcaatgataattacatttgtgctgcttgggaagtatcttgaggtgcttgcaaaagggaagacatcagatgctattaagaagcttgtagaactggtcccttctactgctattttggttctgaaagacaaagaaggaaaacatgttggggagagggagattgatgcacggttggtccaacctggtgatgtcttaaaagtgcttcctggttcaaaggttccggctgatggtgttgtcgtttggggaacaagtcatgtgaatgaaagtatgataactggcgaatcagcacccatccctaaagaagtatcaagtgttgtaattggggggacaataaacttacatggtatccttcatatacaagcaacaaaagtgggatctggtacagttttgagtcagataatctctctggttgaaactgctcagatgtccaaagctcctattcagaaattcgctgattatgtggctagcatttttgttccaattgtcatcacattgtcaatagtgacattttctgcgtggtttttgtgtggatggttgggtgcgtatccaaattcatgggttgctgaaaatagcaattgctttgtcttctctctcatgtttgccatatctgttgtggtgattgcttgtccttgtgctcttggtttggcaacaccaactgctgtgatggtggcaactggaattggggctaatcatggagtacttgtaaaaggcggagatgctttagagagagctcaaaacgtaaagtatgtggtttttgataaaacagggacactaacacaaggaaaggctgttgtaacagctgcaaaggttttctcgggaatggacctaggagatttcctcacactggttgcatcagcagaggcaagcagtgagcatcctcttgccaaagctgttttggactatgcattccatttccatttctttggcaagcttccttcatcaaaagatggcattgagcaacaaaaagacaaggtattgtctcagtggctgcttgaagctgaagacttctctgcagtacctggcaaaggagttcagtgctccatcaacgggaagcatgttttggttggaaaccgttctttgatgactgaaaacggtgtgaccattcccccagaagcagaaactttcttgatcgacctggaatcgaatgcaaaaacaggcatacttgtggcatatgatggcgattttgtgggtttgatgggcataaccgatcccctgaaaagagaggctgctgttgtagtggaaggactaaaaaagttgggtgttcatccagtgatgctaacaggggataactggaggaccgcgcaagctgttgcaaaagaggttggtattgaggacgtgagagcagaggtcatgccagccggaaaagctgacgttgttcgcgccctccagaaggacgggagcaccgtggccatggttggggacggcatcaacgactccccagccctggcagcagccgacgtcgggatggccattggcgggggaacagacattgccatcgaggctgcggactacgtgctggtgcggaacaacctggaagacgtgatcaccgcgatcgacctgtccaggaagacgttcagccggatccggtggaactacttcttcgcgatggcctacaacgtcgtggccatccccatcgccgctggcgcgctgttcccgttcaccgggctgcagatgccgccgtggctcgccggcgcctgcatggccttctcgtccgtaagtgttgtgtgctcgtcgctattgttgaggaggtacagaaaacccaggctgacgactgtgctgcagataactgtagagtga

SEQ ID NO: 9278 - protein, 1007 aa, Sorghum bicolor
  misc_feature: Ceres ANNOT ID no. 6099595
  misc_feature (412)..(652): Pfam Id: E1-E2_ATPase Pfam Desc: E1-E2 ATPase
  misc_feature (58)..(122): Pfam Id: HMA Pfam Desc: Heavy-metal-associated domain
  misc_feature (140)..(204): Pfam Id: HMA Pfam Desc: Heavy-metal-associated domain
  misc_feature (656)..(904): Pfam Id: Hydrolase Pfam Desc: haloacid dehalogenase-like hydrolase
  misc_feature (1)..(1007): NCBI GI: 115444507 NCBI Desc: os02g0172600 [oryza sativa (japonica cultivar-group)]
  misc_feature (4)..(1007): NCBI GI: 140043928 NCBI Desc: copper ion-binding; heavy metal translocating p-type atpase [medicago truncatula]
  misc_feature (4)..(1007): NCBI GI: 14194135 NCBI Desc: at5g44790/k23l20_14 [arabidopsis thaliana]
  misc_feature (4)..(1007): NCBI GI: 6850337 NCBI Desc: atp dependent copper transporter (ran1) [arabidopsis thaliana]
  misc_feature (4)..(1007): NCBI GI: 15636781 NCBI Desc: copper-transporting p-type atpase [brassica napus]
  misc_feature (4)..(1007): SWISSPROT Homolog: EC 3.6.3.4 Copper-transporting ATPase RAN1
MAHLQLSAVAGAGARPAAAGGRGDEMEDVALLDSYDEEMGLPPLGASGAEEGAAAEAHVRVTGMTCSACTSAVEAAVSARSGVRRVAVSLLQNRAHVVFDPALSKVEDIIEAIEDAGFEAEIIPESAVSQPKSQKTLSAQFRIGGMTCANCVNSVEGILKKLPGVKGAVVALATSLGEVEYVPSAISKDEIVQAIEDAGFEAAFLQSSEQDKVLLGLTGLHTERDVEVLNDILKKLDGLRQFGVNIVLSEVEIVFDPEAVGLRSIVDTIEMASNGRFKADVQNPYTRGASNDAQEASKMLNLLRSSLFLSIPVFFIRMVCPSIPFLSTLLSMHCGPFLMGDLLKWILVSIVQFVVGKRFYVAAYRAVRHGSTNMDVLVVLGTTASYAYSVCALLYGAFTGFHPPVYFETSAMIITFVLLGKYLEVLAKGKTSDAIKKLVELVPSTAILVLKDKEGKHVGEREIDARLVQPGDVLKVLPGSKVPADGVVVWGTSHVNESMITGESAPIPKEVSSVVIGGTINLHGILHIQATKVGSGTVLSQIISLVETAQMSKAPIQKFADYVASIFVPIVITLSIVTFSAWFLCGWLGAYPNSWVAENSNCFVFSLMFAISVVVIACPCALGLATPTAVMVATGIGANHGVLVKGGDALERAQNVKYVVFDKTGTLTQGKAVVTAAKVFSGMDLGDFLTLVASAEASSEHPLAKAVLDYAFHFHFFGKLPSSKDGIEQQKDKVLSQWLLEAEDFSAVPGKGVQCSINGKHVLVGNRSLMTENGVTIPPEAETFLIDLESNAKTGILVAYDGDFVGLMGITDPLKREAAVVVEGLKKLGVHPVMLTGDNWRTAQAVAKEVGIEDVRAEVMPAGKADVVRALQKDGSTVAMVGDGINDSPALAAADVGMAIGGGTDIAIEAADYVLVRNNLEDVITAIDLSRKTFSRIRWNYFFAMAYNVVAIPIAAGALFPFTGLQMPPWLAGACMAFSSVSVVCSSLLLRRYRKPRLTTVLQITVE

SEQ ID NO: 9279 - DNA, 744 bp, Sorghum bicolor
  misc_feature: Ceres ANNOT ID no. 6099601
  misc_feature: Encodes the peptide sequence at SEQ ID NO 9280
atggggatgaggcccgggtgggtaggcgggctggtggaggagagcttcttcgtgggctgcgcggcgcacgagaaccggaagaagaacgagaagaacatcttctgcctcggctgctgcgccagcatctgcccgcactgcgcccccgcgcaccgccaccacctcctcatccaggtgcggaggtacgtgtacaatgacgtggtgcgccttgacgacctcgagaggctcatcgactgctccttcgtccagccctacacgatcaacagtgccaaggtggtcttcctcaagccccggccgcagtccaggcccttcaagggctctggcaacgtctgcttgacctgtgaccgcatcctccaggagccattccacttctgctgcctctcctgcaaggtggaccatgtgatgatgcagggcgggggggacctgtccaacatcctgtacgtgccgggaggcggcggtggcgggccgccggacctggtgggctgcggcttcccgcgcttcgagaacctccgcttcgacgacgacccggcggcgcagtacggcggacaggtcacgcccaactccatcctcgaggaccccatgcagcacggcggcagctccagcggcggctcagccaggaacgctcggcgtggcgacgacgtcccgacgaggaagaagagcggcggcggcggtgggttcttcccccagatcgtcctctcgctcggcaaccggcggaagggcgcgccccatagggcgccgctcgcgtaa

SEQ ID NO: 9280 - protein, 247 aa, Sorghum bicolor
  misc_feature: Ceres ANNOT ID no. 6099601
  misc_feature (20)..(130): Pfam Id: PLATZ Pfam Desc: PLATZ transcription factor
  misc_feature (1)..(146): NCBI GI: 145336287 NCBI Desc: zinc ion binding [arabidopsis thaliana]
  misc_feature (1)..(146): NCBI GI: 16117799 NCBI Desc: zinc-binding protein [pisum sativum]
  misc_feature (1)..(130): NCBI GI: 9755373 NCBI Desc: f17f8.4 [arabidopsis thaliana]
  misc_feature (5)..(220): NCBI GI: 115460222 NCBI Desc: os04g0591100 [oryza sativa (japonica cultivar-group)]
  misc_feature (5)..(130): NCBI GI: 92869570 NCBI Desc: zinc finger, b-box [medicago truncatula]
  misc_feature: The sequence is a functional homolog of SEQ ID NO 666 in the 10/666,642US patent application
  misc_feature: Useful for making plants with modulated growth and phenotype characteristics
  misc_feature: The sequence is a functional homolog of SEQ ID NO 666 in the 20070033671 US patent application
  misc_feature: The sequence is a functional homolog of SEQ ID NO 666 in the 10/666,642 US patent application
MGMRPGWVGGLVEESFFVGCAAHENRKKNEKNIFCLGCCASICPHCAPAHRHHLLIQVRRYVYNDVVRLDDLERLIDCSFVQPYTINSAKVVFLKPRPQSRPFKGSGNVCLTCDRILQEPFHFCCLSCKVDHVMMQGGGDLSNILYVPGGGGGGPPDLVGCGFPRFENLRFDDDPAAQYGGQVTPNSILEDPMQHGGSSSGGSARNARRGDDVPTRKKSGGGGGFFPQIVLSLGNRRKGAPHRAPLA

SEQ ID NO: 9281 - DNA, 540 bp, Sorghum bicolor
  misc_feature: Ceres ANNOT ID no. 6099613
  misc_feature: Encodes the peptide sequence at SEQ ID NO 9282
atgtccaactgcagcaacctcacggccgcgcgcgcacccgcgcccggggcgccgcgcgcgccgccgtcgccgctggactacgacgtggtggtgatcctggcggcgatgctgtgcgcgctggtgtgcgcgctggggctcaactcgatgctgcagtgcgtggtgcggtgcacccgccgcgccgtgtccgaccccgccgcgtgggtcgcgcaccgccgcgccaacgccgggctcaaacgcgaggaggtcgtcgcgctgcccgtggccacctacgtcgcctcgccgtcgccgtctccggtcgcggggcgctctccggcacagctgcagcagcgtcacgcgcccgcggggtgcgccatctgcctgtcggacttcgctgacggcgagaggatccgggtgctccctgtgtgcggccaccggttccacgtcgtgtgcatcgacaggtggctcgtctcgcactgctcctgcccgacgtgccgccgccgcctctcctccgactccgccgtcggtggtcacgaccgcctgcaagttctgacggctgtatga

SEQ ID NO: 9282 - protein, 179 aa, Sorghum bicolor
  misc_feature: Ceres ANNOT ID no. 6099613
  misc_feature (116)..(157): Pfam Id: zf-C3HC4 Pfam Desc: Zinc finger, C3HC4 type (RING finger)
  misc_feature (1)..(178): NCBI GI: 52076527 NCBI Desc: ring zinc finger protein-like [oryza sativa (japonica cultivar-group)]
  misc_feature (1)..(167): NCBI GI: 140043932 NCBI Desc: zinc finger, ring-type [medicago truncatula]
  misc_feature (20)..(161): NCBI GI: 32488364 NCBI Desc: osjnbb0108j11.16 [oryza sativa (japonica cultivar-group)]
  misc_feature (20)..(161): NCBI GI: 66865956 NCBI Desc: ring finger family protein [arabidopsis thaliana]
  misc_feature (26)..(161): NCBI GI: 32487554 NCBI Desc: osjnba0013k16.6 [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MSNCSNLTAARAPAPGAPRAPPSPLDYDVVVILAAMLCALVCALGLNSMLQCVVRCTRRAVSDPAAWVAHRRANAGLKREEVVALPVATYVASPSPSPVAGRSPAQLQQRHAPAGCAICLSDFADGERIRVLPVCGHRFHVVCIDRWLVSHCSCPTCRRRLSSDSAVGGHDRLQVLTAV

SEQ ID NO: 9283 - DNA, 768 bp, Sorghum bicolor
  misc_feature: Ceres ANNOT ID no. 6099621
  misc_feature: Encodes the peptide sequence at SEQ ID NO 9284
atggaaccatcctctcagcctcagcctgcaatgggtgttgctcctggtggatctcaggtgtatcctgcctctgcctatccgcctgcagcaacagtagctgctcctgcagttgcatctgctggtttacagtcagcgcaaccattccaagccaaccctgctcatacgagtgcccagcaccagattgtctaccaacaagctcaacaattccaccaacagctccagcagcagcaacagcagcagcttcagcagttctgggctgaacgcatggctgaaattgaggcaacaactgatttcaagaaccacaacttgccacttgcgaggataaagaagatcatgaaggctgatgaagatgttcgcatgatctcagctgaagctcctgtggtttttgctaaagcatgtgagatattcatactggagctgacactgaggtcgtggatgcacactgaggagaacaagcgccgcaccttgcagaagaatgacattgcagcagccatcactaggactgacatttatgacttcttggttgacattgttcccagggatgagatgaaggaggatggagttgggcttcctagggctgggctgccacccatgggagccccagctgatgcatatccatactactacatgcaacaacagcaggtgcctggtcctggaatggtttatggtgcccagcaaaaccacccagtgacgtatttgtggcaggagcctcaggaacagcagggacaagctcctgaagagcagcagtctctgcatgaaagtggctga

SEQ ID NO: 9284 - protein, 255 aa, Sorghum bicolor
  misc_feature: Ceres ANNOT ID no. 6099621
  misc_feature (101)..(165): Pfam Id: CBFD_NFYB_HMF Pfam Desc: Histone-like transcription factor (CBF/NF-Y) and archaealhistone
  misc_feature (95)..(168): Pfam Id: Histone Pfam Desc: Core histone H2A/H2B/H3/H4
  misc_feature (1)..(254): NCBI GI: 115444499 NCBI Desc: os02g0170500 [oryza sativa (japonica cultivar-group)]
  misc_feature (1)..(243): NCBI GI: 46250703 NCBI Desc: ccaat-box binding factor hap5 homolog [daucus carota]
  misc_feature (9)..(247): NCBI GI: 140047231 NCBI Desc: histone-fold/tfiid-taf/nf-y [medicago truncatula]
  misc_feature (11)..(246): NCBI GI: 87240537 NCBI Desc: at1g08970/f7g19_16 [medicago truncatula]
  misc_feature (65)..(247): NCBI GI: 46250701 NCBI Desc: ccaat-box binding factor hap5 homolog [daucus carota]
  misc_feature: The sequence is a functional homolog of SEQ ID NO 102 in the 10/225,068US patent application
  misc_feature: The sequence is a functional homolog of SEQ ID NO 1105 in the 10/374,780US patent application
  misc_feature: The sequence is a functional homolog of SEQ ID NO 1106 in the 10/374,780US patent application
  misc_feature: The sequence is a functional homolog of SEQ ID NO 1107 in the 10/374,780US patent application
  misc_feature: The sequence is a functional homolog of SEQ ID NO 1108 in the 10/374,780US patent application
  misc_feature: The sequence is a functional homolog of SEQ ID NO 1109 in the 10/374,780US patent application
  misc_feature: The sequence is a functional homolog of SEQ ID NO 1110 in the 10/374,780US patent application
  misc_feature: The sequence is a functional homolog of SEQ ID NO 118 in the 10/412,699US patent application
  misc_feature: The sequence is a functional homolog of SEQ ID NO 1188 in the 10/412,699US patent application
  misc_feature: The sequence is a functional homolog of SEQ ID NO 1189 in the 10/412,699US patent application
  misc_feature: The sequence is a functional homolog of SEQ ID NO 1190 in the 10/412,699US patent application
  misc_feature: The sequence is a functional homolog of SEQ ID NO 188 in the 10/225,068US patent application
  misc_feature: The sequence is a functional homolog of SEQ ID NO 2256 in the 10/374,780US patent application
  misc_feature: The sequence is a functional homolog of SEQ ID NO 230 in the 10/714,887US patent application
  misc_feature: The sequence is a functional homolog of SEQ ID NO 230 in the 11/435,388US patent application
  misc_feature: The sequence is a functional homolog of SEQ ID NO 284 in the 11/479,226US patent application
  misc_feature: The sequence is a functional homolog of SEQ ID NO 310 in the 10/412,699US patent application
  misc_feature: The sequence is a functional homolog of SEQ ID NO 712 in the 11/479,226US patent application
  misc_feature: The sequence is a functional homolog of SEQ ID NO 727 in the 11/479,226US patent application
  misc_feature: The sequence is a functional homolog of SEQ ID NO 772 in the 10/225,066US patent application
  misc_feature: The sequence is a functional homolog of SEQ ID NO 835 in the 10/374,780US patent application
  misc_feature: The sequence is a functional homolog of SEQ ID NO 836 in the 10/374,780US patent application
  misc_feature: The sequence is a functional homolog of SEQ ID NO 837 in the 10/374,780US patent application
  misc_feature: The sequence is a functional homolog of SEQ ID NO 910 in the 11/435,388US patent application
  misc_feature: The sequence is a functional homolog of SEQ ID NO 94 in the 10/374,780US patent application
  misc_feature: Useful for making plants with modulated growth and phenotype characteristics
  misc_feature: The sequence is a functional homolog of SEQ ID NO 118 in the 20040045049 US patent application
  misc_feature: The sequence is a functional homolog of SEQ ID NO 118 in the 20040045049 US patent application
  misc_feature: The sequence is a functional homolog of SEQ ID NO 1188 in the 20040045049 US patent application
  misc_feature: The sequence is a functional homolog of SEQ ID NO 1189 in the 20040045049 US patent application
  misc_feature: The sequence is a functional homolog of SEQ ID NO 1190 in the 20040045049 US patent application
  misc_feature: The sequence is a functional homolog of SEQ ID NO 310 in the 20040045049 US patent application
  misc_feature: The sequence is a functional homolog of SEQ ID NO 1105 in the 20060162006 US patent application
  misc_feature: The sequence is a functional homolog of SEQ ID NO 1106 in the 20060162006 US patent application
  misc_feature: The sequence is a functional homolog of SEQ ID NO 1107 in the 20060162006 US patent application
  misc_feature: The sequence is a functional homolog of SEQ ID NO 1108 in the 20060162006 US patent application
  misc_feature: The sequence is a functional homolog of SEQ ID NO 1109 in the 20060162006 US patent application
  misc_feature: The sequence is a functional homolog of SEQ ID NO 1110 in the 20060162006 US patent application
  misc_feature: The sequence is a functional homolog of SEQ ID NO 712 in the 20070022495 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 712 in the 11/479,226 US patent application
  misc_feature: The sequence is a functional homolog of SEQ ID NO 1109 in the 10/374,780 US patent application
  misc_feature: The sequence is a functional homolog of SEQ ID NO 1108 in the 10/374,780 US patent application
  misc_feature: The sequence is a functional homolog of SEQ ID NO 1004 in the 10/225,066 US patent application
  misc_feature: The sequence is a functional homolog of SEQ ID NO 340 in the 10/374,780 US patent application
  misc_feature: The sequence is a functional homolog of SEQ ID NO 450 in the 11/435,388 US patent application
MEPSSQPQPAMGVAPGGSQVYPASAYPPAATVAAPAVASAGLQSAQPFQANPAHTSAQHQIVYQQAQQFHQQLQQQQQQQLQQFWAERMAEIEATTDFKNHNLPLARIKKIMKADEDVRMISAEAPVVFAKACEIFILELTLRSWMHTEENKRRTLQKNDIAAAITRTDIYDFLVDIVPRDEMKEDGVGLPRAGLPPMGAPADAYPYYYMQQQQVPGPGMVYGAQQNHPVTYLWQEPQEQQGQAPEEQQSLHESG

SEQ ID NO: 9285 - DNA, 2034 bp, Sorghum bicolor
  misc_feature: Ceres ANNOT ID no. 6099648
  misc_feature: Encodes the peptide sequence at SEQ ID NO 9286
atggcgccgccatccatgagtcttgcagcgaagggggcgcttcccttctcagcgcttacttcaagtggtgttacacaaaggccggtgtcagtgaccgcttccttggagcacaaaaccagcgatgccagaaggaagtttctaaaacttgcgcttgggaacctcggagttggactgcccaccttgttgggcgctaagagagctctcgctgatgagcaaggcatctcgtcctcgaggatgtcttattcgaggttccttgagtatcttgacaaggatagagtgaagaaggttgatttgtttgagaacgggacgattgctatcgtggaggccatttctcctgagcttggcaaccgcgtgcagagagtccgtgtgcagctgcctggtctaagccaggagcttcttcagaagttgagggagaagaacattgattttgctgctcacagcaaccaggaggactctggttctcttctgttcaaccttattggaaatttggcattcccacttatcctcatcggtggtctatttttactctcaagaagggcacaaggtggccttggtggacccaatggtcctggatttccccttggttttggtcaatctagggccaagtttcagatggaaccaaacactggcgttacatttgatgatgttgctggtgtcgatgaagcgaagcaagacttcatggaagtggttgagttcttgaagaaacccgaaaggttcactgctgttggtgctcgcattcccaaaggtgttctgcttgtcggtcctcctgggactggtaaaactttgcttgccaaggcaattgcaggagaggctggcgtgccgtttttctcaatttcaggttctgagtttgtggagatgtttgttggtgttggtgcttccagagttcgtgaccttttcaagaaggccaaggagaatgctccttgcatagtatttgttgatgaaattgatgctgttggaaggcaaagaggtacaggtattggtggtggaaatgatgaaagggagcagactctcaatcagcttctgactgagatggatggttttgagggcaacactggaattattgttattgctgccactaaccgagctgacatcttggattctgctttactcagacctgggcgctttgacagacaggtgtctgtcgatgttcctgatgtccgtgggaggacagagattctaaaagtgcatggtagcaacaagaagtttgattctgatgtttctcttgatgtcatagcaatgagaacacctgggttcagtggagcagacttggcaaaccttctgaatgaagcagccattctggctggacgacgagggaggacagcaatttcttcaaaagagattgatgattctattgacagaattgtggctggtatggaagggactgtgatgacggacgggaagagcaaaagtcttgttgcttaccatgaagttgggcatgcaatttgcggaactttgacacccggccatgatcctgtccaaaaggttacattagttccaaggggtcaagctcgtggtcttacatggtttatcccgatggatgacccaacactcatctccaggcagcaactttttgccagaattgttggtggccttggtggtagagctgctgaggaggtcatatttggagagcctgaggtgaccactggagctgctggtgacttgcagcaaattactggcttagccaagcagatggtcgtaacttttggtatgtctcaaattggtccatggtccctgatggagggtggagcacagagtggggatgtcatcatgagaatgatggcaaggaactccatgtcagagaagcttgcggaggacattgattcggctgtgaagcagttgtcagatgaggcctacgagattgctctgaggcacattagaaacaacagggaggccattgacaaaatcgttgagttgctcattgagaaggagacactgaccggagacgagttccgggcgattctttccgagtttgtggagatccctgttgagaaccgggttcccccagccacaccggcggccgccctccctgcctaa

SEQ ID NO: 9286 - protein, 677 aa, Sorghum bicolor
  misc_feature: Ceres ANNOT ID no. 6099648
  misc_feature (443)..(653): Pfam Id: Peptidase_M41 Pfam Desc: Peptidase family M41
  misc_feature (249)..(436): Pfam Id: AAA Pfam Desc: ATPase family associated with various cellular activities(AAA)
  misc_feature (77)..(223): Pfam Id: FtsH_ext Pfam Desc: FtsH Extracellular
  misc_feature (246)..(377): Pfam Id: AAA_2 Pfam Desc: ATPase family associated with various cellular activities(AAA)
  misc_feature (17)..(674): NCBI GI: 4325041 NCBI Desc: ftsh-like protein pftf precursor [nicotiana tabacum]
  misc_feature (17)..(674): NCBI GI: 3808101 NCBI Desc: chloroplast protease [capsicum annuum]
  misc_feature (86)..(677): NCBI GI: 115469444 NCBI Desc: os06g0669400 [oryza sativa (japonica cultivar-group)]
  misc_feature (21)..(677): NCBI GI: 3201633 NCBI Desc: ftsh protease (var2) [arabidopsis thaliana]
  misc_feature (25)..(657): NCBI GI: 6692685 NCBI Desc: f12k11.22 [arabidopsis thaliana]
  misc_feature: The sequence is a functional homolog of SEQ ID NO. 462 in the 11/188,298 US application
  misc_feature: The sequence is a functional homolog of SEQ ID NO. 471 in the 11/188,298 US application
MAPPSMSLAAKGALPFSALTSSGVTQRPVSVTASLEHKTSDARRKFLKLALGNLGVGLPTLLGAKRALADEQGISSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGSNKKFDSDVSLDVIAMRTPGFSGADLANLLNEAAILAGRRGRTAISSKEIDDSIDRIVAGMEGTVMTDGKSKSLVAYHEVGHAICGTLTPGHDPVQKVTLVPRGQARGLTWFIPMDDPTLISRQQLFARIVGGLGGRAAEEVIFGEPEVTTGAAGDLQQITGLAKQMVVTFGMSQIGPWSLMEGGAQSGDVIMRMMARNSMSEKLAEDIDSAVKQLSDEAYEIALRHIRNNREAIDKIVELLIEKETLTGDEFRAILSEFVEIPVENRVPPATPAAALPA

SEQ ID NO: 9287 - DNA, 648 bp, Sorghum bicolor
  misc_feature: Ceres ANNOT ID no. 6099649
  misc_feature: Encodes the peptide sequence at SEQ ID NO 9288
atgccatcggtttatctttacatccctaacattattgggtattttaggatcatcataaatttcattgcatttgcggtttgctattccaacaaggctctctttgctctcctatacttcttcagctttgtccttgatggtgtggatggttggttcgcacggaagttcaatcaagcatcaacatttggagctgtgttggacatggttacagatagggttagcactgcttgtttgttggcccttctctcccagttttacagacctggtttagtcttcttgatattgcttgggttggatattacgagccactggtttcaaatgtacagttctttcttgtcaggtaagactagccacaaggatgtaaaacacacaggcaattggcttctgaaattatattatggatacaggccattcatggccttctgctgtgtttcttgcgaggttttatatattatcctctttctctttgctgatgagaagtcaacaagcttgcttagtgtatgcaaaggtgtcctgaaccaaaatcctgttgttgtcttggtgtttatttccactctagttggctgggcagtgaaacaagtcaccaacgtcatccagatgaaaactgctgcggatgcatgtgttgtgtatgatctgaagcgcagcaaatga

SEQ ID NO: 9288 - protein, 215 aa, Sorghum bicolor
  misc_feature: Ceres ANNOT ID no. 6099649
  misc_feature (35)..(157): Pfam Id: CDP-OH_P_transf Pfam Desc: CDP-alcohol phosphatidyltransferase
  misc_feature (1)..(215): NCBI GI: 34577127 NCBI Desc: phosphatidylinositol synthase [zea mays]
  misc_feature (2)..(215): NCBI GI: 41053023 NCBI Desc: phosphatidylinositol synthase [oryza sativa (japonica cultivar-group)]
  misc_feature (2)..(215): NCBI GI: 13661020 NCBI Desc: phosphatidylinositol synthase [oryza sativa]
  misc_feature (3)..(215): NCBI GI: 21592927 NCBI Desc: phosphatidylinositol synthase pis1 [arabidopsis thaliana]
  misc_feature (3)..(215): NCBI GI: 71153053 NCBI Desc: cdp-diacylglycerol--inositol 3-phosphatidyltransferase 1 (phosphatidylinositol synthase 1) (ptdins synthase 1) (pi synthase 1) (atpis1)
  misc_feature (3)..(215): SWISSPROT Homolog: EC 2.7.8.11 CDP-diacylglycerol--inositol 3-phosphatidyltransferase 1
  misc_feature: The plant produces a reduced number of seeds.
  misc_feature: Useful for biocontainment applications
  misc_feature: GREAT-hit functional homolog of the protein sequence given in SEQ ID NO 13111
  misc_feature: Useful for biocontainment applications
  misc_feature: Functional homolog of the protein sequence given in SEQ ID NO 13111
MPSVYLYIPNIIGYFRIIINFIAFAVCYSNKALFALLYFFSFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSVCKGVLNQNPVVVLVFISTLVGWAVKQVTNVIQMKTAADACVVYDLKRSK

SEQ ID NO: 9289 - DNA, 2478 bp, Sorghum bicolor
  misc_feature: Ceres ANNOT ID no. 6099659
  misc_feature: Encodes the peptide sequence at SEQ ID NO 9290
atggggcagagcaaggcggagttcttggaacagttcggtggggactacggttatccggacgcgcccaggggcatcgacgagctgcgggccgctgagttcaagcggctggaagggatggtttacctggaccatgctggtgcgacactctactcagaggcacagatggcggatgttgctagagatcttatgtctaatgtctacgggaatcctcatagtcagaatgattcaagcatggctacaagcgacattgttacttctgtgcggcatcaggtcctaaaatacttcaatgcatctccaagggattacaaatgtatatttacatcaggggcaacagcagctctgaaacttgttggtgaatgttttccatggagtagagacagttgctatatgtacacaatggaaaatcataatagtgtgcttgggataagagaatatgcactgagcaaaggagctactgtatcagcagttgatgttgaagaggttgttgatccatcaaataatcatgagagtgataggttttttaaggtttcaaaacactcaaaccaaagaagaggtgatgatttgcttttgcacaattatcagaatgggagcctgacagctatttcaggaaacaatttaaatctatttgcattcccttcagagtgcaatttctcaggacataagttcaacctcaacttggtcaagctcatcaaggaaggaaaatttatggatttctcatcacaacagcggggccagtggatggttctgatagatgctgcaaaaggatgtacaactgaaccaccaaacttatccctgtatcctgctgactttgttgtctgttcattttacaagatatttggctatccaactggtcttggtgccttaattgtaaaaaatgaggctgctagtttactgaacaagacatacttcagtggaggaacggtagctgcttcaattgctgacatcgactttgttcagaaaagaaaaggcattgagcaagctcttgaggatggaacaatctcattcttgagcatatcttctcttcaatatggctttaagataatcgatatactaactatctcagctattgcacggcatactgcgtctcttgctacttatgtgagaaataaaatgctggaattgaagcataacaatgagaaaaatgtttgcataatctatggacaagcttctaaggcaaattatctaaaaatgggtcctacaatcacattcaatttgaaaagagaagatggcacctggtttggatatcgtgaggtggagaaacttgcctcattgtcaggaattcatttgcgtacgggctgcttctgtaaccctggtgcatgtgctaagtatgttggtttgtcgcactcagatctagtttccaattttgaggctgggcatgtttgttgggatgataatgacataataaatggaaaaccaactggtgctgtgaggatatcatttggctatatgtcaacatatgaagatgcagaggaatttctgaagttcctgcagtcatcttttgtgtccaaacctgtgggattgaaaaatggctacatggtgaatacggatacttttaatttagtagatgattggcgccagcaagctatttcagatattcgcttaaaatccataactatctatcctgtgaaatcttgccaaggatttagtgtgcagagctggccactgacaactggtggtttaaaatatgatagagaatggcttctccaaggatcaggcggtgaagttttgacacaaaagaaggttcctgaattgagctctatctgcacattgattgacttggagcttgggaaactcttcttagagtcgccaaaatgcaaggataaattgcaaatctgtcttctagagaatctgactcttctgagtgcagaagtagatgtttatggtcaaaggtatgaggtgcaaagttatggcgacaaggtaaactcctggttcagtggagctattggacgtccttgtacatttgtgagatgctcaagttccaagtaccgttcctgcacaattaatggcaggagagatcgcctctgtagggatactcgaagcaaacttagttttgtgaacgaaggacagttgcttcttgtttctgaagatagtatatctgatctcaacagtcgattaagttcaagtaatggaaatggtaagcaaggggtgttggttgatgcaatgagatttcgtccaaatattgttgtctatgggtccacaccatacaatgaggataactggaaaaggcttcacataggggatgcctatttcacttccatggggggatgcaaccgttgtcagatgatcaacctgtatcagagctcagggcaggtgatcaagtcaaaggaaccgctggcaactttagcatcatatagacgaaaacagggaaagattttgtttggcgtcctgttgaactatgaagacggcatggaaggagaagatgatgccattgtagagagatggctcaaagtggggcaagaggtgtatccttctacataa

SEQ ID NO: 9290 - protein, 825 aa, Sorghum bicolor
  misc_feature: Ceres ANNOT ID no. 6099659
  misc_feature (668)..(823): Pfam Id: MOSC Pfam Desc: MOSC domain
  misc_feature (531)..(651): Pfam Id: MOSC_N Pfam Desc: MOSC N-terminal beta barrel domain
  misc_feature (40)..(492): Pfam Id: Aminotran_5 Pfam Desc: Aminotransferase class-V
  misc_feature (1)..(825): NCBI GI: 112031467 NCBI Desc: molybdenum cofactor sulfurase-like protein 3 [oryza sativa (japonica cultivar-group)]
  misc_feature (142)..(825): NCBI GI: 75114852 NCBI Desc: molybdenum cofactor sulfurase (moco sulfurase) (mos)
  misc_feature (1)..(490): NCBI GI: 115469454 NCBI Desc: os06g0670000 [oryza sativa (japonica cultivar-group)]
  misc_feature (5)..(824): NCBI GI: 22128583 NCBI Desc: molybdenum cofactor sulfurase [lycopersicon esculentum]
  misc_feature (8)..(823): NCBI GI: 15407262 NCBI Desc: molybdenum cofactor sulfurase [arabidopsis thaliana]
  misc_feature: Useful for making plants with modulated drought sensitivity
  misc_feature: GREAT-hit functional homolog of the protein sequence given in SEQ ID NO 13355
  misc_feature: Useful for making plants with modulated drought sensitivity
  misc_feature: Functional homolog of the protein sequence given in SEQ ID NO 14039
MGQSKAEFLEQFGGDYGYPDAPRGIDELRAAEFKRLEGMVYLDHAGATLYSEAQMADVARDLMSNVYGNPHSQNDSSMATSDIVTSVRHQVLKYFNASPRDYKCIFTSGATAALKLVGECFPWSRDSCYMYTMENHNSVLGIREYALSKGATVSAVDVEEVVDPSNNHESDRFFKVSKHSNQRRGDDLLLHNYQNGSLTAISGNNLNLFAFPSECNFSGHKFNLNLVKLIKEGKFMDFSSQQRGQWMVLIDAAKGCTTEPPNLSLYPADFVVCSFYKIFGYPTGLGALIVKNEAASLLNKTYFSGGTVAASIADIDFVQKRKGIEQALEDGTISFLSISSLQYGFKIIDILTISAIARHTASLATYVRNKMLELKHNNEKNVCIIYGQASKANYLKMGPTITFNLKREDGTWFGYREVEKLASLSGIHLRTGCFCNPGACAKYVGLSHSDLVSNFEAGHVCWDDNDIINGKPTGAVRISFGYMSTYEDAEEFLKFLQSSFVSKPVGLKNGYMVNTDTFNLVDDWRQQAISDIRLKSITIYPVKSCQGFSVQSWPLTTGGLKYDREWLLQGSGGEVLTQKKVPELSSICTLIDLELGKLFLESPKCKDKLQICLLENLTLLSAEVDVYGQRYEVQSYGDKVNSWFSGAIGRPCTFVRCSSSKYRSCTINGRRDRLCRDTRSKLSFVNEGQLLLVSEDSISDLNSRLSSSNGNGKQGVLVDAMRFRPNIVVYGSTPYNEDNWKRLHIGDAYFTSMGGCNRCQMINLYQSSGQVIKSKEPLATLASYRRKQGKILFGVLLNYEDGMEGEDDAIVERWLKVGQEVYPST

SEQ ID NO: 9291 - DNA, 1680 bp, Sorghum bicolor
  misc_feature: Ceres ANNOT ID no. 6099662
  misc_feature: Encodes the peptide sequence at SEQ ID NO 9292
atgtcggtgctcatcgtcaccagcgtgggcgacatcgaggtggatctccacaccgaccggtgccccctcaccaccaagaacttcctcaagctctgcaaaatgaagtactacaatgggtgtttgttccacaaggtggagaaggatttcttggcacaaactggcgatccaactggaactggcaccgctggcgattctgtatacaaatatctctatggtgatcaagctcgattttttgatgatgagatccgtccagagttaaggcattcaaaaactggaactgttgctatggccagtgctggtgaaaactgcaatgcctcgcagttctacattaccttgcgggatgatgtggattaccttgatgataaacatactgtgtttgggatggttgctgaaggttttgatacgctgacaaaaataaatgaagcttatgttgatgataaaggaagaccattcaaggacataagaattaagcatacatatgtcttggatgatccttttgatgatcctcctcagcttgctgaacttattcctgagaattctcctacgggaaagccacgtgatgaggttgcagaagagcgtttagaggatacttgggttcctttggaccaaacagtggaccctgaacaacttgaggagatgatccgctctaaagaggcacacacaaatgcagtaattcttgagagtttggcagatattccagatgctgagattaaaccgccagaaaatgtcttatttgtttgtaaactcaacccagtaacacaggatgaagatttatatacaatattttctcgttttggaactgtgacatctgctgaaataattcgtgactacaagactggagatagtttatgctatgcttttattgaattcgatacaaaggaggcttgtgagcgtgcatatttcaagatggacaattgtctgattgatgaccgaaggatccatgttgattttagtcagagtgtttcgaagctgtggggtcagttcagacaaagcaaaagaaatgcaaagaaagatgggtgttttaagtgtggcgcccctgatcacttagccagagactgcgatcaagatggcgagcagaaaaacaaaggcccaaattatgttctaaaagatgaaaacacgcagcgtggtggaaatcaccgtcgaagctatgatctagtctttgacgaagatgaagatgaagctgattattctgataagagagatcacgaaaatggccacagaagaaagaatcgaagaatagatgatcaaaaatcagagctgccgcctcgcggtgatcgtgaaagaaatagccacgagagaacacgcagtgatgagaaaggaagcaggcatgggaaagatgataggaaccaagggggtcggaaacatgatggctaccacagttacagtagatccagtgatagaagctctggtagatatgatgatcgtgattatagcaagcactctaatagaagcagaagtggggaggtagaggaaggcagacgaagcgataaatctgatggcgagcggcgccatagagatgatgcctacgagaagagcgaacaccaccggagagatgaaatcagccacaggaaaaggagcccagatagtagacatagaagagaagaccgagcacaccatgtgaaaaaacagcagtctgatgataggtcctacaaggagagaaggcacagagatggtagataa

SEQ ID NO: 9292 - protein, 559 aa, Sorghum bicolor
  misc_feature: Ceres ANNOT ID no. 6099662
  misc_feature (2)..(162): Pfam Id: Pro_isomerase Pfam Desc: Cyclophilin type peptidyl-prolyl cis-trans isomerase/CLD
  misc_feature (244)..(315): Pfam Id: RRM_1 Pfam Desc: RNA recognition motif. (a.k.a. RRM, RBD, or RNP domain)
  misc_feature (338)..(355): Pfam Id: zf-CCHC Pfam Desc: Zinc knuckle
  misc_feature (1)..(559): NCBI GI: 52076982 NCBI Desc: peptidylprolyl isomerase-like [oryza sativa (japonica cultivar-group)]
  misc_feature (1)..(497): NCBI GI: 119568184 NCBI Desc: peptidylprolyl isomerase (cyclophilin)-like 4, isoform cra_a [homo sapiens]
  misc_feature (1)..(325): NCBI GI: 39849934 NCBI Desc: ppil4 protein [homo sapiens]
  misc_feature (1)..(442): NCBI GI: 109892837 NCBI Desc: peptidyl-prolyl cis-trans isomerase-like 4 (ppiase) (rotamase)
  misc_feature (1)..(325): NCBI GI: 89268185 NCBI Desc: peptidylprolyl isomerase (cyclophilin)-like 4 [xenopus tropicalis]
  misc_feature (1)..(442): SWISSPROT Homolog: EC 5.2.1.8 Peptidyl-prolyl cis-trans isomerase-like 4
  misc_feature: The sequence is a functional homolog of SEQ ID NO. 339 in the 11/188,298 US application
MSVLIVTSVGDIEVDLHTDRCPLTTKNFLKLCKMKYYNGCLFHKVEKDFLAQTGDPTGTGTAGDSVYKYLYGDQARFFDDEIRPELRHSKTGTVAMASAGENCNASQFYITLRDDVDYLDDKHTVFGMVAEGFDTLTKINEAYVDDKGRPFKDIRIKHTYVLDDPFDDPPQLAELIPENSPTGKPRDEVAEERLEDTWVPLDQTVDPEQLEEMIRSKEAHTNAVILESLADIPDAEIKPPENVLFVCKLNPVTQDEDLYTIFSRFGTVTSAEIIRDYKTGDSLCYAFIEFDTKEACERAYFKMDNCLIDDRRIHVDFSQSVSKLWGQFRQSKRNAKKDGCFKCGAPDHLARDCDQDGEQKNKGPNYVLKDENTQRGGNHRRSYDLVFDEDEDEADYSDKRDHENGHRRKNRRIDDQKSELPPRGDRERNSHERTRSDEKGSRHGKDDRNQGGRKHDGYHSYSRSSDRSSGRYDDRDYSKHSNRSRSGEVEEGRRSDKSDGERRHRDDAYEKSEHHRRDEISHRKRSPDSRHRREDRAHHVKKQQSDDRSYKERRHRDGR

SEQ ID NO: 9293 - DNA, 321 bp, Sorghum bicolor
  misc_feature: Ceres ANNOT ID no. 6099711
  misc_feature: Encodes the peptide sequence at SEQ ID NO 9294
atggatgagcgaggggaggctgccggcgcagtccatggccgccgcgacgacttccgtctccagcctcttctcctcgacaccgcgcgcgtgctcatgctgttgggcgtggccaccatcttctctgcaggcttcgacagccccgccgccagtgcgacgccgacgcaggccttggttggtctcctcctctggctgctcggcgtgtgcctcctcgtcctcgtgccagtggcagcaggacggttcctgcaactgcaagccgcattggccgtcgccgccgccatggccgtcgccgtcctcaagcacctccttgctctgtccaactaa

SEQ ID NO: 9294 - protein, 106 aa, Sorghum bicolor
  misc_feature: Ceres ANNOT ID no. 6099711
  misc_feature (19)..(88): NCBI GI: 66735946 NCBI Desc: xa27 [oryza sativa (indica cultivar-group)]
  misc_feature (19)..(88): NCBI GI: 66735946 NCBI Desc: xa27 [oryza sativa (indica cultivar-group)]
  misc_feature: Useful for making plants with modulated biotic stress sensitivity
  misc_feature: Functional homolog of the protein sequence given in SEQ ID NO 13413
MDERGEAAGAVHGRRDDFRLQPLLLDTARVLMLLGVATIFSAGFDSPAASATPTQALVGLLLWLLGVCLLVLVPVAAGRFLQLQAALAVAAAMAVAVLKHLLALSN

SEQ ID NO: 9295 - DNA, 885 bp, Sorghum bicolor
  misc_feature: Ceres ANNOT ID no. 6099734
  misc_feature: Encodes the peptide sequence at SEQ ID NO 9296
atggccatcaactcgctgagcatggtggaggccaggctgccgccggggttcaggttccacccgcgggacgacgagctcgtgctcgactacctcgccaagaagctcgccggcggcgccggagtcggcggaggcccgctggtggtgagcatctacggctgccccgccatggtcgacgtcgatctcaacaagtgcgagccctgggaccttcccgaaatcgcgtgcattggtggaaaagagtggtatttctacagccttagagatagaaagtatgccaccggccagcgtacaaacagagcaactgattcaggatattggaaggccacggggaaaagaccgtccaataagccggaaaagggtagagccccaaaggggaagaagaccgagtgggttatgcatgaatttcgcatggaagggcaaggtgatcccatgaaattacctttcaaggaggactgggtcttgtgtagagttttctacaagagtagggcaacagttgcaaagccacccacagagagtagcagcagcttcaatattgatgctgccacaacttcattgcctcccctcattgacaacaactacaatatttcctttgatcagcctggctcatcagtgcaaaacctagagggttatgagcaagtgccctgcttctccagtaacccctctcagctatcgtcatcgataaacgctccgctgtcgtctgccgccaccatggctgatccggagcaacacatggggaagtcaataatcaaggatgttctcatgagccagttcagcaggttcgaagcaggcaacgtcaagagggaggcgcctcaaagcaatttttctcaggatgggtttgagtacttagctgagagtggattcacacagatgtggaattctttcaattaa

SEQ ID NO: 9296 - protein, 294 aa, Sorghum bicolor
  misc_feature: Ceres ANNOT ID no. 6099734
  misc_feature (13)..(137): Pfam Id: NAM Pfam Desc: No apical meristem (NAM) protein
  misc_feature (4)..(138): NCBI GI: 34558777 NCBI Desc: salicylic acid-induced protein 19 [capsicum annuum]
  misc_feature (3)..(216): NCBI GI: 15148912 NCBI Desc: nac domain protein nac1 [phaseolus vulgaris]
  misc_feature (1)..(230): NCBI GI: 138753444 NCBI Desc: nac transcription factor [hordeum vulgare subsp. vulgare]
  misc_feature (1)..(235): NCBI GI: 21554126 NCBI Desc: nac1 [arabidopsis thaliana]
  misc_feature (10)..(139): NCBI GI: 6066595 NCBI Desc: nam [petunia x hybrida]
  misc_feature: Useful for making plants with altered Lignin content
  misc_feature: Functional homolog of the protein sequence given in SEQ ID NO 12985
  misc_feature: Useful for making plants with altered lignin content
  misc_feature: Functional homolog of the protein sequence given in SEQ ID NO 12985
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAINSLSMVEARLPPGFRFHPRDDELVLDYLAKKLAGGAGVGGGPLVVSIYGCPAMVDVDLNKCEPWDLPEIACIGGKEWYFYSLRDRKYATGQRTNRATDSGYWKATGKRPSNKPEKGRAPKGKKTEWVMHEFRMEGQGDPMKLPFKEDWVLCRVFYKSRATVAKPPTESSSSFNIDAATTSLPPLIDNNYNISFDQPGSSVQNLEGYEQVPCFSSNPSQLSSSINAPLSSAATMADPEQHMGKSIIKDVLMSQFSRFEAGNVKREAPQSNFSQDGFEYLAESGFTQMWNSFN

SEQ ID NO: 9297 - DNA, 1221 bp, Sorghum bicolor
  misc_feature: Ceres ANNOT ID no. 6099777
  misc_feature: Encodes the peptide sequence at SEQ ID NO 9298
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
atgtcggcggccgggacgctctccggcggcgccgccggtctatccggcctcctccgcctccgccgccgggccgcccccgcccccgcgatcgccgcgccgtcgctccaccccgctgggaccatcaagtgcaccgccgtgcccgatgccgccccgattgtctggggccgccagctccgaccggcgctcctcctccccgcggcactgctcccgtcgtcgcagcccgccaagaagcacaatctgcgcccggccgccgcagccgccgagtccgcaggggaggccaagggtttcctggagaaatacccggccctggtcaccggttttttcttcttcatgtggtacttcctcaacgtcatattcaacatcctcaacaagaagatctacaactacttcccctatccatactttgtgtccttgatccatctagtagtgggtgtcgcatactgcctcgtcggctggagtgtcggtctccccaagcgagcgcctatcaatgccaatctcctgaagctgctctttccagtggcattgtgccatggtattggtcacgtcactagcaatgtgtccttcgctgctgttgcagtctcatttgcccacactatcaaagctctggagcccttcttcagcgcagctgctactcagtttatccttgggcagcaagttcccctctctctgtggatgtctcttgcccctgttgtcattggtgtttcaatggcatcccttactgagctttcgttcaactggactggcttcatcaatgccatgatatcaaacatctcattcacttacaggagcatttattccaagaaagctatgactgacatggatagcaccaacgtgtatgcttacatctcaataattgctctcattgtttgcattccacctgcaataatttttgaagggccccagctaatgtcgcatggatttagtgatgccattgcaaaagtaggtttgacaaagtttgttagtgacctagtcttggttggactgttctaccatctgtataaccagattgctacaaacaccttggagcgagtggctcctctgacacatgctgtcggcaatgtgttgaaacgtgtttttgtcattggtttctcaatcgttgtttttggcaacaaaatttccacacaaactggaattggcacgtccattgccatagcgggtgttgctttgtactcttacattaaggctaagattgaagaggagaaaaggaaaaagagcgcatga

SEQ ID NO: 9298 - protein, 406 aa, Sorghum bicolor
  misc_feature: Ceres ANNOT ID no. 6099777
  misc_feature (248)..(392): Pfam Id: TPT Pfam Desc: Triose-phosphate Transporter family
  misc_feature (1)..(406): NCBI GI: 405635 NCBI Desc: triose phosphate/phosphate translocator [zea mays]
  misc_feature (1)..(406): NCBI GI: 13195734 NCBI Desc: triose phosphate translocator [triticum aestivum]
  misc_feature (1)..(406): NCBI GI: 13518113 NCBI Desc: triose phosphate/phosphate translocator [oryza sativa]
  misc_feature (11)..(406): NCBI GI: 9295273 NCBI Desc: triose phosphate/phosphate translocator precursor [mesembryanthemum crystallinum]
  misc_feature (7)..(406): NCBI GI: 406281 NCBI Desc: triose phosphate/phosphate translocator [flaveria trinervia]
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: The sequence is a functional homolog of SEQ ID NO. 360 in the 11/188,298 US application
MSAAGTLSGGAAGLSGLLRLRRRAAPAPAIAAPSLHPAGTIKCTAVPDAAPIVWGRQLRPALLLPAALLPSSQPAKKHNLRPAAAAAESAGEAKGFLEKYPALVTGFFFFMWYFLNVIFNILNKKIYNYFPYPYFVSLIHLVVGVAYCLVGWSVGLPKRAPINANLLKLLFPVALCHGIGHVTSNVSFAAVAVSFAHTIKALEPFFSAAATQFILGQQVPLSLWMSLAPVVIGVSMASLTELSFNWTGFINAMISNISFTYRSIYSKKAMTDMDSTNVYAYISIIALIVCIPPAIIFEGPQLMSHGFSDAIAKVGLTKFVSDLVLVGLFYHLYNQIATNTLERVAPLTHAVGNVLKRVFVIGFSIVVFGNKISTQTGIGTSIAIAGVALYSYIKAKIEEEKRKKSA

SEQ ID NO: 9299 - DNA, 1452 bp, Sorghum bicolor
  misc_feature: Ceres ANNOT ID no. 6099784
  misc_feature: Encodes the peptide sequence at SEQ ID NO 9300
atgcttggggtgtcgacgctgcggagccctagcaggagcagcagcaaggcggatcagcactgcggcggcggcttcgtcggcgaccaccatgtggtgttcccgacgtccggcggcgggtccgactgctgcgacggcttcgccatgctgcgatgtgcccttcttcgacgccgacgggatatcctcccggacctggaggtcgaccccacggagctcctcgcagagttctcgtccaccccgccgccggacgacctgctgctggtccatgtcgatgacgaggcggccaacaacaacccgccggtggtgccggacgacgacgtgaagcaacatcacctagcggtggtgacgacagcagcagcacaagaggagaagcaaacatgtggtggtgatgagaaacatgtggccgccagcaagcagacgacgacggaggaggattattctgctgcttgtgccggggccaccgtgtccgacaccaagtcgtcggcgtcggcggcagagagccacagcaagaagaaggcggcagcagggaataagaactcgcacggcaagcgcaaggttgactggacgccggagttgcaccggaggttcgtgcaggcggtggagcagctgggcatcgacaaggccgtgccgtcccggatcctcgagatcatgggcatggactgcctcacaagacacaacattgccagccacctccagaagtaccggtcgcacagaaagcacctgatggcgcgggagccggaggccgccacctgggcacagaagcggcacatgtacgcggcggcggcgggcggcggagcgccgaggacagacgcaccacacgccagccggccatgggtggtgccgaccatcgggttcccgccgccggcacccccgcccttctgccggccgctgcacgtgtggggccacccgccccacgccgccgcggctgaagctgccgctgcggtggctgcgcctccgactccgatgctgcccgtgtggccgcggcacctggcgccgccacggccgctgccgccgtgggcgcacccgcacccgccggcggtggacccggcgttctggcaccagcagtacaacgcggccaggaaatggggtccacaggcagccgcagtgacgcaagggacgccgtgcgtgccgccgcccgccgccatgctgccgaggtttccggtgccggggatggtgccgcaccccatgtacagaccgacgatggtccctccgccgccgccaccgccgccgccgcagccaagcaccaagctcgccgaactgcagcttgagctcgacacgcacccgtccaaggagagcatcgacgcagccatcggagatgttttagtgaagccatggctgccgcttcccctggggctcaagccgccgtcgctcgacagcgtcatgtccgagctgcacaagcaaggcgtaccaagcataccaccggcggccaccgccaccgccatcgccaccggatga

SEQ ID NO: 9300 - protein, 483 aa, Sorghum bicolor
  misc_feature: Ceres ANNOT ID no. 6099784
  misc_feature (184)..(234): Pfam Id: Myb_DNA-binding Pfam Desc: Myb-like DNA-binding domain
  misc_feature (59)..(474): NCBI GI: 118722731 NCBI Desc: golden 2-like protein [triticum aestivum]
  misc_feature (1)..(474): NCBI GI: 62632221 NCBI Desc: golden2-like transcription factor [zea mays]
  misc_feature (127)..(474): NCBI GI: 55669163 NCBI Desc: golden 2-like protein 1 [physcomitrella patens]
  misc_feature (127)..(474): NCBI GI: 55669165 NCBI Desc: golden 2-like protein 2 [physcomitrella patens]
  misc_feature (87)..(355): NCBI GI: 92887685 NCBI Desc: homeodomain-related [medicago truncatula]
  misc_feature: The sequence is a functional homolog of SEQ ID NO 1233 in the 10/666,642US patent application
  misc_feature: The sequence is a functional homolog of SEQ ID NO 1992 in the 11/479,226US patent application
  misc_feature: The sequence is a functional homolog of SEQ ID NO 935 in the 10/666,642US patent application
  misc_feature: The sequence is a functional homolog of SEQ ID NO 937 in the 10/666,642US patent application
  misc_feature: Useful for making plants with modulated growth and phenotype characteristics
  misc_feature: The sequence is a functional homolog of SEQ ID NO 1992 in the 20070022495 US patent application
  misc_feature: The sequence is a functional homolog of SEQ ID NO 1233 in the 20070033671 US patent application
  misc_feature: The sequence is a functional homolog of SEQ ID NO 935 in the 20070033671 US patent application
  misc_feature: The sequence is a functional homolog of SEQ ID NO 937 in the 20070033671 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MLGVSTLRSPSRSSSKADQHCGGGFVGDHHVVFPTSGGGSDCCDGFAMLRCALLRRRRDILPDLEVDPTELLAEFSSTPPPDDLLLVHVDDEAANNNPPVVPDDDVKQHHLAVVTTAAAQEEKQTCGGDEKHVAASKQTTTEEDYSAACAGATVSDTKSSASAAESHSKKKAAAGNKNSHGKRKVDWTPELHRRFVQAVEQLGIDKAVPSRILEIMGMDCLTRHNIASHLQKYRSHRKHLMAREPEAATWAQKRHMYAAAAGGGAPRTDAPHASRPWVVPTIGFPPPAPPPFCRPLHVWGHPPHAAAAEAAAAVAAPPTPMLPVWPRHLAPPRPLPPWAHPHPPAVDPAFWHQQYNAARKWGPQAAAVTQGTPCVPPPAAMLPRFPVPGMVPHPMYRPTMVPPPPPPPPPQPSTKLAELQLELDTHPSKESIDAAIGDVLVKPWLPLPLGLKPPSLDSVMSELHKQGVPSIPPAATATAIATG

SEQ ID NO: 9301 - DNA, 1359 bp, Sorghum bicolor
  misc_feature: Ceres ANNOT ID no. 6099785
  misc_feature: Encodes the peptide sequence at SEQ ID NO 9302
atgagggtgaaggtgatttcgcgctccaccgacgagttcacgcgtgagcgcagccaggacctgcagaaagtattccgcaactatgatccagcgcttcgtagtcaagagaaagctgttgaatacactcgggcacttaatgctgcaaagttagagaagatatttgctaagccatttatcggagctatgaatgggcatattgatgcggtatcgtgcatggcaaaaaaccccaatcatttgaaagcgatattttccggttcgatggatggagatattcgcctttgggatattgctgcgaggaagacagtttgccagttccctggacaccagggtgctgtaagaggtttaacaacatccacggagggtgatcttcttgtatcatgtggcgttgactgcactgttcggctctggaaagttccgatgcttaaaatggtggacaccagcgaccataatggagataattcccagccatcagcagtctacacctggaagcatgcattctggggtgctgaccaccagtgggatggtaatctttttgcaactgttggtgcccaagttgatatatgggatcctgacaggtcagagccaataaatagctttgagtggggtaaagatacagttctttctgtgcgctttgatcctggagattgtaatattttgattacatcgggcagtgatcggagtctaacactctatgacctgcgcatgtcatctccagctagaaaactaataatgaagacaaggtgcaattcagtatgctggaaccccagagagcccatgaacttcactgctgcaaatgaagacacaaactgttattcgtttgatgctagaaggctggacgaagccaaaattgttcacaaaggacatgtttcagcagtgatggatattgactactctccaacagggcgtgaatttgttactggttcctatgatagaacagtaaggatttttaattatcttggagatcacagcagagagatttaccacaccaagaggatgcaaagggtgttttgtgtgaagtacacctacgacgggacctatctagtctctggcagtgatgatacaaatcttcggctgtggaaatccaaagcttcggaacaacttggagtacttcttccacgggagcgcaaaaagcaagagtaccaggatgctttgaaggagcgatacaagcatctcccagaagtgaagcggattgtaaggcatagacacctgccgaagccaatctacaaggcagccaacctacggcgcacgatgattgaagctgaaaaccgcaaagaggaaagaaggcgaaagcacagcgctccggggagcatgcctgtgcagcccttcaggaagcgaagaatcatcaaagaagttgagtag

SEQ ID NO: 9302 - protein, 452 aa, Sorghum bicolor
  misc_feature: Ceres ANNOT ID no. 6099785
  misc_feature (361)..(448): Pfam Id: Sof1 Pfam Desc: Sof1-like domain
  misc_feature (56)..(95): Pfam Id: WD40 Pfam Desc: WD domain, G-beta repeat
  misc_feature (99)..(137): Pfam Id: WD40 Pfam Desc: WD domain, G-beta repeat
  misc_feature (193)..(232): Pfam Id: WD40 Pfam Desc: WD domain, G-beta repeat
  misc_feature (279)..(317): Pfam Id: WD40 Pfam Desc: WD domain, G-beta repeat
  misc_feature (1)..(452): NCBI GI: 115435566 NCBI Desc: os01g0238900 [oryza sativa (japonica cultivar-group)]
  misc_feature (1)..(452): NCBI GI: 23505961 NCBI Desc: at4g28450/f20o9_130 [arabidopsis thaliana]
  misc_feature (1)..(452): NCBI GI: 17065094 NCBI Desc: sof1 protein-like protein [arabidopsis thaliana]
  misc_feature (24)..(452): NCBI GI: 30687972 NCBI Desc: transducin family protein / wd-40 repeat family protein [arabidopsis thaliana]
  misc_feature (1)..(452): NCBI GI: 38348458 NCBI Desc: gene model 83 [mus musculus]
  misc_feature: The sequence is a functional homolog of SEQ ID NO. 485 in the 11/188,298 US application
  misc_feature: The sequence is a functional homolog of SEQ ID NO. 502 in the 11/188,298 US application
MRVKVISRSTDEFTRERSQDLQKVFRNYDPALRSQEKAVEYTRALNAAKLEKIFAKPFIGAMNGHIDAVSCMAKNPNHLKAIFSGSMDGDIRLWDIAARKTVCQFPGHQGAVRGLTTSTEGDLLVSCGVDCTVRLWKVPMLKMVDTSDHNGDNSQPSAVYTWKHAFWGADHQWDGNLFATVGAQVDIWDPDRSEPINSFEWGKDTVLSVRFDPGDCNILITSGSDRSLTLYDLRMSSPARKLIMKTRCNSVCWNPREPMNFTAANEDTNCYSFDARRLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKQEYQDALKERYKHLPEVKRIVRHRHLPKPIYKAANLRRTMIEAENRKEERRRKHSAPGSMPVQPFRKRRIIKEVE

SEQ ID NO: 9303 - DNA, 912 bp, Sorghum bicolor
  misc_feature: Ceres ANNOT ID no. 6099792
  misc_feature: Encodes the peptide sequence at SEQ ID NO 9304
atgggctgcgcttcactgcccacgaggccctccccgacggcgttcccgccgccgttgcccgccgccgcccacgcccgcctttctcgttctcacatccgcacctgcaccaccacaggcaaaccgaggagggctttttccatcagagcagctcacagtggtgtcagtgatgtatctgtagagagccttcttcccctttctgataatgaagctccagtcaccggcgctgcttacagcttcacaggagcaacgacatcactcaccaacaggcggatcctaacatcctccaagaaggttactcttgtcaggcatggcctcagcacatggaatgcagaaagccgtgtccagggaagctcaaatctgtctgtgttaacagaaactggcaccaagcaggcagagaaatgtcgcgatgctcttgcaaacatcaagttcgatgtttgcttctctagtcctatttcacgagcaaagacaaccgctgaaattatctggaaagataaggaggaaccccttgtgtttctcgattcattgaaagaggcacatctcttcttcttagagggcatgaccaatgcggatgctaagaagcaatatccggagttgtacaccagatggagggaggaccctgcacattttcatgtcgatggcatatacccgctcagggaggtgtggagaacagcaagccaagcatgggagcaaatcttgctcactccgggagaaaacttcctggtggtcacacacaaatccattttgcgcgcgctcatctgcacagcactaggtctcgctcctgagaggtttcgtgccattgatgtaaacaacggtggcatgtgtgtcttcacggtcaacaagcaaggagaagctatgcttcaagccctcaacatgacagcacacttgtatagtgatcacacctatcagtactag

SEQ ID NO: 9304 - protein, 303 aa, Sorghum bicolor
  misc_feature: Ceres ANNOT ID no. 6099792
  misc_feature (97)..(251): Pfam Id: PGAM Pfam Desc: Phosphoglycerate mutase family
  misc_feature (1)..(303): NCBI GI: 56784099 NCBI Desc: phosphoglycerate mutase -like [oryza sativa (japonica cultivar-group)]
  misc_feature (100)..(231): NCBI GI: 86608499 NCBI Desc: phosphoglycerate mutase family protein [cyanobacteria bacterium yellowstone b-prime]
  misc_feature (97)..(294): NCBI GI: 37520340 NCBI Desc: phosphoglycerate mutase [gloeobacter violaceus pcc 7421]
  misc_feature (97)..(295): NCBI GI: 126695879 NCBI Desc: possible alpha-ribazole-5'-p phosphatase [prochlorococcus marinus str. mit 9301]
  misc_feature (97)..(295): NCBI GI: 88807677 NCBI Desc: possible alpha-ribazole-5'-p phosphatase [synechococcus sp. wh 7805]
MGCASLPTRPSPTAFPPPLPAAAHARLSRSHIRTCTTTGKPRRAFSIRAAHSGVSDVSVESLLPLSDNEAPVTGAAYSFTGATTSLTNRRILTSSKKVTLVRHGLSTWNAESRVQGSSNLSVLTETGTKQAEKCRDALANIKFDVCFSSPISRAKTTAEIIWKDKEEPLVFLDSLKEAHLFFLEGMTNADAKKQYPELYTRWREDPAHFHVDGIYPLREVWRTASQAWEQILLTPGENFLVVTHKSILRALICTALGLAPERFRAIDVNNGGMCVFTVNKQGEAMLQALNMTAHLYSDHTYQY

SEQ ID NO: 9305 - DNA, 2064 bp, Sorghum bicolor
  misc_feature: Ceres ANNOT ID no. 6099805
  misc_feature: Encodes the peptide sequence at SEQ ID NO 9306
  misc_feature: Down-regulated in root tissues in response to salicylic acid treatment
atggcgcaaggacgggacccggagctgttcgcggagctgtggcgcgcctgcgcggggccgctcgtggagctgccccagaccgatgagagggtcttctacttcctccagggtcacctggagcagctgcaagagccgacggacccggcgctgctggccgaccaaatcaagatgttccaggtgcccaacaagatcctctgcaaggtcgtcaacgtggagctcaaggccgagacagaaacggacgagatgtacgcccagatcactctgcagcccgagccagatcaaatggatctgcccacattacctgacccacccctgccggagacgtcaaggcctgtggtgcactccttctgcaagatcctcacaccatccgacaccagtactcatggcggtttctctgttcttcggcgtcatgcaaacgaatgcctcccaccactggatatgtcgatgccgaccccgacccaagagcttatcacaaaggacctacatggatctgaatggaggttcaagcacatctacaggggccaaccccgtaggcaccttctgactactggatggagcacgtttgtcacatcaaagaagctgattgctggtgacgcgtttgtctacctgaggagtgagacaggagagcagcgtgtcggagtgaggcgccttgtgcagaagcaaagcacaatgccagcatctgttatatcaagccaaagcatgcatcttggggtgcttgctagtgcatcacatgctattaagactaattccatattcctagtgtattatagaccaaggttaagccaaagccaatacatcgtcagtctgaacaagtaccttgaatctagtaaaattggatttaatgtgggcatgaggtttaagatgagttttgaaggggaagatgtccccgtaaagaagttttctggaactgttgttgataaaggagatctctctccacattggcaaggttctgactggaagacgttgaaggtcaaatgggacgaagccacaaactttaatggccctgagagggtttcctcttgggaaattgaaccatttgatgcatccgcacctgccatcaacatacccgtgcaaccatcaatgaaaaacaaaaggcctagggagacagctgaaagcctggatattcatgcgctggaacctgctcaagaattctggctctctggaaggcctgaacagcataagacaagtataagctccaacgaacccaattgtatatctgtacatcaagtcgcttggacaagtgaacgcccaggatacagtgccatgagtagttcaatttgtcagaattctgcagtaattgggagctggttcaaggacttcaattcctcaagcaaaggggcctccccttccttgccagagatttctcagaaactgtttcaagtcaccagcaacgacgcaagggttcctccttggcctgggctctctgcttatcaagctgaggagctctcttccaagttgtcctgcaacactgctctgtgcagctaccagactgaggaggttgctccaaaattttctattgctgtcgaagaaaagaaggaacccggcatgttccgcctgtttggtgtcaatttggttaaccatactaggagtagcggcattgctgacaagatgactgtgggagtaggggaaacatcgatgcgaggtgctggttcttttgaagactctggtcagctatcggcgctttcaagagtcacgaaagatcatacacacttggtgaatgaaagcccccgagaaatccaaagccatcagagttgcagtggaagaaatcgtattaaggttcaaatgcatggacatgctgtgggcaaagctgtggatttaggaaatctggatgggtatgtacagttgatgggtgagcttgaagagatgtttgagataaaagaccttggctccaaagaggaatggaaggttactttcactaacgatgagaatgatacgatggaagtcggagctgttctttgggagttttgccagatggtgaggaagatcgtgatccatcccattggacatgggagccatatggaggcttggccttgcccggggcaggatgggaagagggacttttag

SEQ ID NO: 9306 - protein, 687 aa, Sorghum bicolor
  misc_feature: Ceres ANNOT ID no. 6099805
  misc_feature (242)..(323): Pfam Id: Auxin_resp Pfam Desc: Auxin response factor
  misc_feature (115)..(220): Pfam Id: B3 Pfam Desc: B3 DNA binding domain
  misc_feature (6)..(687): NCBI GI: 19352053 NCBI Desc: auxin response factor 16 [oryza sativa]
  misc_feature (6)..(464): NCBI GI: 110739362 NCBI Desc: arf1 family auxin responsive transcription factor like protein [arabidopsis thaliana]
  misc_feature (6)..(464): NCBI GI: 42569975 NCBI Desc: transcriptional factor b3 family protein / auxin-responsive factor aux/iaa-related [arabidopsis thaliana]
  misc_feature (1)..(464): NCBI GI: 12744967 NCBI Desc: auxin response factor 9 [arabidopsis thaliana]
  misc_feature (1)..(464): NCBI GI: 79325241 NCBI Desc: arf9 (auxin response factor 9) [arabidopsis thaliana]
  misc_feature: The sequence is a functional homolog of SEQ ID NO 1350 in the 10/666,642US patent application
  misc_feature: The sequence is a functional homolog of SEQ ID NO 202 in the 11/375,241US patent application
  misc_feature: The sequence is a functional homolog of SEQ ID NO 30 in the 10/412,699US patent application
  misc_feature: The sequence is a functional homolog of SEQ ID NO 300 in the 10/412,699US patent application
  misc_feature: The sequence is a functional homolog of SEQ ID NO 420 in the 11/435,388US patent application
  misc_feature: The sequence is a functional homolog of SEQ ID NO 468 in the 10/225,066US patent application
  misc_feature: The sequence is a functional homolog of SEQ ID NO 8 in the 10/374,780US patent application
  misc_feature: Useful for making plants with modulated growth and phenotype characteristics
  misc_feature: The sequence is a functional homolog of SEQ ID NO 30 in the 20040045049 US patent application
  misc_feature: The sequence is a functional homolog of SEQ ID NO 300 in the 20040045049 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: Functional homolog of the protein sequence given in SEQ ID NO 13377
  misc_feature: The sequence is a functional homolog of SEQ ID NO 298 in the 10/412,699 US patent application
  misc_feature: Down-regulated in root tissues in response to salicylic acid treatment
MAQGRDPELFAELWRACAGPLVELPQTDERVFYFLQGHLEQLQEPTDPALLADQIKMFQVPNKILCKVVNVELKAETETDEMYAQITLQPEPDQMDLPTLPDPPLPETSRPVVHSFCKILTPSDTSTHGGFSVLRRHANECLPPLDMSMPTPTQELITKDLHGSEWRFKHIYRGQPRRHLLTTGWSTFVTSKKLIAGDAFVYLRSETGEQRVGVRRLVQKQSTMPASVISSQSMHLGVLASASHAIKTNSIFLVYYRPRLSQSQYIVSLNKYLESSKIGFNVGMRFKMSFEGEDVPVKKFSGTVVDKGDLSPHWQGSDWKTLKVKWDEATNFNGPERVSSWEIEPFDASAPAINIPVQPSMKNKRPRETAESLDIHALEPAQEFWLSGRPEQHKTSISSNEPNCISVHQVAWTSERPGYSAMSSSICQNSAVIGSWFKDFNSSSKGASPSLPEISQKLFQVTSNDARVPPWPGLSAYQAEELSSKLSCNTALCSYQTEEVAPKFSIAVEEKKEPGMFRLFGVNLVNHTRSSGIADKMTVGVGETSMRGAGSFEDSGQLSALSRVTKDHTHLVNESPREIQSHQSCSGRNRIKVQMHGHAVGKAVDLGNLDGYVQLMGELEEMFEIKDLGSKEEWKVTFTNDENDTMEVGAVLWEFCQMVRKIVIHPIGHGSHMEAWPCPGQDGKRDF

SEQ ID NO: 9307 - DNA, 1221 bp, Sorghum bicolor
  misc_feature: Ceres ANNOT ID no. 6099809
  misc_feature: Encodes the peptide sequence at SEQ ID NO 9308
atggggtgcgcgagctccaaggctggcgacgacgtcgcggtggccgacgtctaccgcccgccgcccaccagcgtctccctcttcgacatcaccgccgtcgaggagccttggctcatcgccaagcagagcaaagccgctgatgatgacgacgacgacgaggatgaagagacgacgaccgatgacgaagaagaggacgacgacgagaagctgcagcccgccgccaagaccgtcgtgccgctcccgctcctcgacaagctcgagggctacgagctcgccccggcgtcgtggtccgaggtcagcaaggccctggaggacatgaagcccgtcctcgactccaagccgccgtctgctcctgttgctctcaagaagaagacaaagaacaagaccaagaagacgacgaagaagcagcagcagccacaacagtcgacgacgacgacgacgacggcggcgccgccgcccgtggtgcctgctgccacggacggcgacgctactggcaagaaggcgccgtcgccgtcgtccctcggcgaccttccagacatcagcagcagcaagcccgcgccgccggagctcgcgggacggcgcgtcgtgaaggacaacccgttcctgatgcgcgaccgcgagagcaagggcgacggcagtaccgtggcgccgcggtggaagcggcgggacccgttcgagggatgccccgagcggcggcctccgggcgcgacgggcggcggcgtggtgctgtacacgacgacgctccgcggcgtgcgtcgcacgttcgaggactgcgagcgcacgcgggaggcggtggaggcgtgcgcggcggcggcgggcgtggcggccgtggacgagcgcgacgtgtcgctgcacggggagtacctccgcgagctgcgggagctggtgcccgccggcgacggcgagggcgagggcgctgccgccgcgccgccgcggctcttcgtgatgggccgatacgtgggcggcgccgacgagtgcgaaaggctggccgagtcagggaagctgcgggagatgatgcggtgggtcaaggcccgtggcgaggcgtgcgcggccaaggacggccgcggctgcgagggctgcggcggcgcaaggttcgtgccgtgctgggagtgcggcggcagctgcaaggtggtggcggcggacggagggacgccgaccaccacggagaggtgcggcaagtgcaacgagaacgggctcatgatgtgccccatctgccactga

SEQ ID NO: 9308 - protein, 406 aa, Sorghum bicolor
  misc_feature: Ceres ANNOT ID no. 6099809
  misc_feature (242)..(320): Pfam Id: Glutaredoxin Pfam Desc: Glutaredoxin
  misc_feature (191)..(405): NCBI GI: 53370707 NCBI Desc: glutaredoxin domain containing protein [oryza sativa (japonica cultivar-group)]
  misc_feature (241)..(405): NCBI GI: 60543345 NCBI Desc: at1g32760 [arabidopsis thaliana]
  misc_feature (233)..(405): NCBI GI: 115448683 NCBI Desc: os02g0748800 [oryza sativa (japonica cultivar-group)]
  misc_feature (233)..(405): NCBI GI: 115467206 NCBI Desc: os06g0226100 [oryza sativa (japonica cultivar-group)]
  misc_feature (241)..(405): NCBI GI: 87240364 NCBI Desc: glutaredoxin [medicago truncatula]
MGCASSKAGDDVAVADVYRPPPTSVSLFDITAVEEPWLIAKQSKAADDDDDDEDEETTTDDEEEDDDEKLQPAAKTVVPLPLLDKLEGYELAPASWSEVSKALEDMKPVLDSKPPSAPVALKKKTKNKTKKTTKKQQQPQQSTTTTTTAAPPPVVPAATDGDATGKKAPSPSSLGDLPDISSSKPAPPELAGRRVVKDNPFLMRDRESKGDGSTVAPRWKRRDPFEGCPERRPPGATGGGVVLYTTTLRGVRRTFEDCERTREAVEACAAAAGVAAVDERDVSLHGEYLRELRELVPAGDGEGEGAAAAPPRLFVMGRYVGGADECERLAESGKLREMMRWVKARGEACAAKDGRGCEGCGGARFVPCWECGGSCKVVAADGGTPTTTERCGKCNENGLMMCPICH

SEQ ID NO: 9309 - DNA, 1869 bp, Sorghum bicolor
  misc_feature: Ceres ANNOT ID no. 6099813
  misc_feature: Encodes the peptide sequence at SEQ ID NO 9310
  misc_feature: Down-regulated in root tissues in response to aminocyclopropane carboxylic treatment
atggtaatgaagatggagcttgaggacgatggtgccatgggagggagaggaactggtggtatgtggacagaggaggaccgagctcttggcgctgcggtgcttggagcagatgcctttgcatatttaacgaaaggaggtggtgccatatccgagggccttgtcgctgcgtctttgccggatgacttgcagaacaaactccaggagcttgtcgaatccgagagccctggcactggttggaactatgccatcttctggcagctctcgcgcacaaagtctggtgatctcgtccttggatggggggatggcagctgccgtgagccccgagatggagaggtgggagctgctgcttctgcaggcagcgatgataccaagcagaggatgcgcaaacgtgtgctgcagcggttgcacattgcatttggggttgctgatgaggaggattatgcccctggtattgatcaggtcacagatacagagatgttctttctggcatctatgtactttgcttttccccgtcgcactggtggccctggccaagcatttgcagcaggcatccccctctgggttcccaatagtgagcgcaaggtattcccggccaactactgttaccgggggttccttgcaaatgcggcaggatttaggactatcgttttggtgccatttgagagcggtgtgcttgaactgggctcaatgcagcacatagctgagagttctgatactatccagtccatacgctctgtatttgcagggacaagtggtaataagactgcagtacagagacacgagggaaatggtcctgctcctcctgaaaggtcgcccagtttggcgaagatttttgggaaggatttgaaccttggccggccttcagttgggccggcggttggtgtatctaaggtagatgaaaggacatgggagcagaggagtgctgctggtgggacctcattgctaccgaatgtacagaaaggattgcagaatttcacctggagtcaggctcgtgggttgaattctcatcagcagaagtttggcaatggcgtgttgattgtgagcaacgaggctgcacaccgcaacaacggagcagtggacagccctagcgcagcacagtttcagcttcaaaaggcgcctcagcttcagaaactgcagcttcagaaattgccggttgttcagaaaacaccgcagctagtgaaccagcagccgatgcagccacaggtacctaggcaaattgactttagcgcggggagcagttccaagcctggtgtgttggttacaagggcagcagcagtcctggatggggagagtgcagaggtggatggcttgtgcaaagaggaagggccaccacctgttatagaggaccgacggccaaggaagaggggaagaaaacctgcaaacgggagggaagaaccacttaatcatgtcgaggctgagcgccagaggagggagaagctcaaccagcggttctatgcacttagagctgttgtgccgaacatatcgaaaatggacaaggcgtccctactgggcgatgcgataacgtacatcactgacctccagaagaagctcaaagagatggagtcagagagagaaaggctcttggagtccggtatggtggacccaagggagcgggcgcctaggccggaggtggacatccaggtggtgcaggacgaggttcttgttcgagtgatgtctccaatggataaccatccagtcaggaaggtattccaagcctttgaagaggcagaagtccgcgtaggcgagtcaaaggtgacgggcaacaacaacgggacagtggtgcattctttcatcatcaagtgtcctggcgctgagcagcaaacgagggagaaggtgatagcggcaatgtctcgcgcgatgagcagttga

SEQ ID NO: 9310 - protein, 622 aa, Sorghum bicolor
  misc_feature: Ceres ANNOT ID no. 6099813
  misc_feature (465)..(514): Pfam Id: HLH Pfam Desc: Helix-loop-helix DNA-binding domain
  misc_feature (1)..(622): NCBI GI: 115435532 NCBI Desc: os01g0235700 [oryza sativa (japonica cultivar-group)]
  misc_feature (297)..(610): NCBI GI: 51572284 NCBI Desc: bhlh transcription factor [oryza sativa (japonica cultivar-group)]
  misc_feature (300)..(592): NCBI GI: 51702428 NCBI Desc: bhlh transcription factor [triticum aestivum]
  misc_feature (405)..(622): NCBI GI: 20453066 NCBI Desc: at2g46510/f13a10.4 [arabidopsis thaliana]
  misc_feature (378)..(621): NCBI GI: 56784918 NCBI Desc: bhlh protein-like [oryza sativa (japonica cultivar-group)]
  misc_feature: The sequence is a functional homolog of SEQ ID NO 1108 in the 10/225,066US patent application
  misc_feature: The sequence is a functional homolog of SEQ ID NO 1177 in the 11/479,226US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 2 in the 10/374,780US patent application
  misc_feature: The sequence is a functional homolog of SEQ ID NO 42 in the 11/375,241US patent application
  misc_feature: The sequence is a functional homolog of SEQ ID NO 464 in the 11/435,388US patent application
  misc_feature: The sequence is a functional homolog of SEQ ID NO 528 in the 10/412,699US patent application
  misc_feature: The sequence is a functional homolog of SEQ ID NO 943 in the 10/374,780US patent application
  misc_feature: The sequence is a functional homolog of SEQ ID NO 955 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 528 in the 20040045049 US patent application
  misc_feature: The sequence is a functional homolog of SEQ ID NO 955 in the 20060162006 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: Down-regulated in root tissues in response to aminocyclopropane carboxylic treatment
  misc_feature: The sequence is a functional homolog of SEQ ID NO. 483 in the 11/188,298 US application
  misc_feature: The sequence is a functional homolog of SEQ ID NO. 414 in the 11/188,298 US application
MVMKMELEDDGAMGGRGTGGMWTEEDRALGAAVLGADAFAYLTKGGGAISEGLVAASLPDDLQNKLQELVESESPGTGWNYAIFWQLSRTKSGDLVLGWGDGSCREPRDGEVGAAASAGSDDTKQRMRKRVLQRLHIAFGVADEEDYAPGIDQVTDTEMFFLASMYFAFPRRTGGPGQAFAAGIPLWVPNSERKVFPANYCYRGFLANAAGFRTIVLVPFESGVLELGSMQHIAESSDTIQSIRSVFAGTSGNKTAVQRHEGNGPAPPERSPSLAKIFGKDLNLGRPSVGPAVGVSKVDERTWEQRSAAGGTSLLPNVQKGLQNFTWSQARGLNSHQQKFGNGVLIVSNEAAHRNNGAVDSPSAAQFQLQKAPQLQKLQLQKLPVVQKTPQLVNQQPMQPQVPRQIDFSAGSSSKPGVLVTRAAAVLDGESAEVDGLCKEEGPPPVIEDRRPRKRGRKPANGREEPLNHVEAERQRREKLNQRFYALRAVVPNISKMDKASLLGDAITYITDLQKKLKEMESERERLLESGMVDPRERAPRPEVDIQVVQDEVLVRVMSPMDNHPVRKVFQAFEEAEVRVGESKVTGNNNGTVVHSFIIKCPGAEQQTREKVIAAMSRAMSS

SEQ ID NO: 9311 - DNA, 657 bp, Sorghum bicolor
  misc_feature: Ceres ANNOT ID no. 6099820
  misc_feature: Encodes the peptide sequence at SEQ ID NO 9312
atggtgaagctcactatgatagcacgtgtcactgatggccttccattgtcagagggattagatgatggtcgggatctgaaggatgctgacttctacaagcagcaagcaaaactgttgttcaagaacttgtcaaaagggcagcatgaggcatcaaggatgtcaattgagactggaccataccttttccactacatcattgaaggccgtgtgtgctatttgactctgtgtgatcgttcttatcccaagaaacttgcattccaatatcttgaagatctcaaaaacgaatttgagaaagtcaatggcagtcaaattgaaactgctgcaaggccatatgcatttattaaatttgatgcattcatacagaagaccaagaaactttatttggattccagaacacagaggaaccttgccaagctgaatgatgagctctacgaggtgcaccagatcatgactcgcaatgttcaagaagttctcggtgtcggtgaaaaactagaccaggtgagtgagatgtcaagtaggttgacctctgatactagaatctatgcagacaaggcgaaagatctcaatcgccaggccttaatacgtaagtatgcccccgttgctattgtgattgggatagtactgatgctcttttggctgaagaacaagatatggtga

SEQ ID NO: 9312 - protein, 218 aa, Sorghum bicolor
  misc_feature: Ceres ANNOT ID no. 6099820
  misc_feature (132)..(218): Pfam Id: Synaptobrevin Pfam Desc: Synaptobrevin
  misc_feature (1)..(194): NCBI GI: 115455839 NCBI Desc: os03g0791500 [oryza sativa (japonica cultivar-group)]
  misc_feature (1)..(218): NCBI GI: 92881269 NCBI Desc: synaptobrevin [medicago truncatula]
  misc_feature (1)..(121): NCBI GI: 115475818 NCBI Desc: os08g0307300 [oryza sativa (japonica cultivar-group)]
  misc_feature (1)..(212): NCBI GI: 12655033 NCBI Desc: vesicle trafficking protein sec22b [homo sapiens]
  misc_feature (1)..(212): NCBI GI: 117616920 NCBI Desc: sec22 [synthetic construct]
MVKLTMIARVTDGLPLSEGLDDGRDLKDADFYKQQAKLLFKNLSKGQHEASRMSIETGPYLFHYIIEGRVCYLTLCDRSYPKKLAFQYLEDLKNEFEKVNGSQIETAARPYAFIKFDAFIQKTKKLYLDSRTQRNLAKLNDELYEVHQIMTRNVQEVLGVGEKLDQVSEMSSRLTSDTRIYADKAKDLNRQALIRKYAPVAIVIGIVLMLFWLKNKIW

SEQ ID NO: 9313 - DNA, 1617 bp, Sorghum bicolor
  misc_feature: Ceres ANNOT ID no. 6099825
  misc_feature: Encodes the peptide sequence at SEQ ID NO 9314
atgagctccaagtcatcatacaacaaactgtccgctgcaaatgacaagatggattccaatgcctggggccacgggaatactcggtcaaatggcgccctggggcggaatcaatccggcgtctcagttgatccgtccgctggctctgaaccagcagtgcagtcgcatgtcatcccttctgataagagatcacaccgcaacaagtctgatgatccagccgacaaagcgatcccaagtccagcggtggtgtctggaacaggtgccatgctggaggaagcagcagccagaggtgacaagaccgttcctcagtgcacctttgacacctctactagtagtgacagcttggatggctctggaactggtcatatcaagcggcatactgggagcgatcgcaggtgggaggccatccagttggccagcagcaggggctcccctctcagtctagtacactttaggcttctgaagcgccttggctatggagacattggcagtgtttacctcgtggagcttagggggacagacaccttctttgccatgaaggtgatggacaaggaggcgctcatcagtaggaacaagatgatccgtgcagagacggagagacagatacttggccttctagatcacccctttctacccaccctgtacactcattttgagaccgaaaagttttactgccttgtcatggagtactgctgcggtggcaacctgcattcgcttcggcagaagcaacctaacaggcatttcaatgagcaagcagccagattttatgcctctgaggtgttgcttgcgcttgagtacctccacatgctaggcattgtctacagagacctgaaaccagaaaatgttctggtcagagatggaggacacatcatgctgtctgactttgacctatctctgaggtgttcagtcagcccgatgctagtcaaatcctcatcaatcaatgctggtgccaatggcattgagaaaggcgtagtccatgctgatggtgtcaaccaaggctgcatacagtcatcagcattcttcccgcgcatactccccaagaagaaccgcaagaccaaatcagacttcagcatcaacggatcgctcctggagttcaatgctgagccgacagatgcgcggtcgatgtcatttgttggaacacacgagtaccttgcaccagagatcatcagaggagagggacatggaagcgcggtggattggtggacctttggcatcttcttatatgagctgctccatggcatgacaccgttcaaggggaatagcaaccgtgccacgctgtgcaacgtagtggaccagccactgcggttccctgacaccccacctgtgagcaatgtcgctcgcgacctcatccgtgggcttctggtgaaggaccctcagaagagaattgcaaccaagaggggtgccactgagatcaagcagcacccattctttgaaggggtgaactgggcacttgtgaggggtgctcacccaccttctgtccctgaccctgtagacttcgggcagtttagatctaaggggaagaaggcggcagagattgcagttgcgactgctccaagtagattaccttatggtgctgcttcagctaaaccaaagaaaggcaattttgttgagtatttttag

SEQ ID NO: 9314 - protein, 538 aa, Sorghum bicolor
  misc_feature: Ceres ANNOT ID no. 6099825
  misc_feature (150)..(476): Pfam Id: Pkinase Pfam Desc: Protein kinase domain
  misc_feature (150)..(476): Pfam Id: Pkinase_Tyr Pfam Desc: Protein tyrosine kinase
  misc_feature (6)..(538): NCBI GI: 115435510 NCBI Desc: os01g0233800 [oryza sativa (japonica cultivar-group)]
  misc_feature (104)..(508): NCBI GI: 7672777 NCBI Desc: viroid symptom modulation protein [lycopersicon esculentum]
  misc_feature (104)..(508): NCBI GI: 1360141 NCBI Desc: protein kinase [solanum berthaultii]
  misc_feature (77)..(508): NCBI GI: 3152560 NCBI Desc: strong similarity to ser/thr protein kinases, especially gbx97980 from solanum berthaultii, gbx90990 from solanum tuberosum and gbd10909 from a. thaliana. [arabidopsis
  misc_feature (77)..(508): NCBI GI: 3152560 (continued) thaliana]
  misc_feature (54)..(538): NCBI GI: 4966365 NCBI Desc: similar to gbj04556 g11a protein from oryza sativa and contains a pf00069 eukaryotic protein kinase domain. [arabidopsis thaliana]
  misc_feature (108)..(496): SWISSPROT Homolog: EC 2.7.11.1 Protein kinase PVPK-1
  misc_feature: Useful for making plants with modulated biomass
  misc_feature: Functional homolog of the protein sequence given in SEQ ID NO 14042
  misc_feature: The sequence is a functional homolog of SEQ ID NO. 441 in the 11/188,298 US application
  misc_feature: The sequence is a functional homolog of SEQ ID NO. 399 in the 11/188,298 US application
  misc_feature: The sequence is a functional homolog of SEQ ID NO. 340 in the 11/188,298 US application
  misc_feature: The sequence is a functional homolog of SEQ ID NO. 332 in the 11/188,298 US application
  misc_feature: The sequence is a functional homolog of SEQ ID NO. 464 in the 11/188,298 US application
  misc_feature: The sequence is a functional homolog of SEQ ID NO. 310 in the 11/188,298 US application
  misc_feature: The sequence is a functional homolog of SEQ ID NO. 498 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 495 in the 11/188,298 US application
  misc_feature: The sequence is a functional homolog of SEQ ID NO. 520 in the 11/188,298 US application
  misc_feature: The sequence is a functional homolog of SEQ ID NO. 323 in the 11/188,298 US application
MSSKSSYNKLSAANDKMDSNAWGHGNTRSNGALGRNQSGVSVDPSAGSEPAVQSHVIPSDKRSHRNKSDDPADKAIPSPAVVSGTGAMLEEAAARGDKTVPQCTFDTSTSSDSLDGSGTGHIKRHTGSDRRWEAIQLASSRGSPLSLVHFRLLKRLGYGDIGSVYLVELRGTDTFFAMKVMDKEALISRNKMIRAETERQILGLLDHPFLPTLYTHFETEKFYCLVMEYCCGGNLHSLRQKQPNRHFNEQAARFYASEVLLALEYLHMLGIVYRDLKPENVLVRDGGHIMLSDFDLSLRCSVSPMLVKSSSINAGANGIEKGVVHADGVNQGCIQSSAFFPRILPKKNRKTKSDFSINGSLLEFNAEPTDARSMSFVGTHEYLAPEIIRGEGHGSAVDWWTFGIFLYELLHGMTPFKGNSNRATLCNVVDQPLRFPDTPPVSNVARDLIRGLLVKDPQKRIATKRGATEIKQHPFFEGVNWALVRGAHPPSVPDPVDFGQFRSKGKKAAEIAVATAPSRLPYGAASAKPKKGNFVEYF

SEQ ID NO: 9315 - DNA, 1296 bp, Sorghum bicolor
  misc_feature: Ceres ANNOT ID no. 6099850
  misc_feature: Encodes the peptide sequence at SEQ ID NO 9316
atggaccgcatcgtcggcggcaagttcaagctcggccggaagatcggctgcggctccttcggcgagatctacctcgccacgcacgtggacacctacgagatcgtcgccgtgaagatcgagagcagcaagacgaaacatccccagttgttctacgaggcaaagatctacaacaccctccaaggaggaagtggcattgccaatgtcaagtggtgcggcgtggatggggaagagaatgttctcgtcattgacttgctgggaccgagtttggaggacctgttttgttattgcggacggaaattcacgctgaagactgtcctgatgttggctgaacagatgattacaagaatagagtttatgcattccaaaggctacttacacagagacattaaacctgacaactttctgatgggtcttggtcggaaagcaaatcaggtatatataattgattttggtctcgcaaaaagataccgcgattccactacgaatcgccatattccttacagagataataagagcttgactggtacagcgcgctatgcaagttgcaacacccaccttggaattgaacaaagccgcagggatgatttgatatctctaggctatgtgtttctgtattttctccgaggaagcctcccttggcagggactaaaagctgcaacaaagacacagaagtatgacaagatatgtgagaaaaagctagcaactcctatcgagatcttatgcaaatcctgtccggtcgagttttcatcttacttccattactgccaatcattgtcatttgatcagcgacctgactatccatttgtgaagcgacttttccgtgacttgtttaacagccaaggttatgagtttgattatgtcttcgactggacagttttgaaatacagacaaggccaaaaacaaaagcaaagtcctggagcacctattgctcgaccaattcatgcacatgtacagaaacaagcaggtgtaaatggtgttttccatcataatgaagcccaggagcatgtagagacaagtcgtccagcagggcaagctgcgcagtcgcaaggcaaacaggcaatcaacaatgatcggaatcccaacgtgcggcataccatgaaccttgcacaagacatggctgctggaaaagcgcagctgacaacatctgtggctcttcctagttcccagtggaaaaattatagcgattcaagatctaaaggacaatttgatgccgttcaccacaatcagggtactgtaaacataactagctcatctaacatgcttcctacattccagcacaatgccccagcaaagtga

SEQ ID NO: 9316 - protein, 431 aa, Sorghum bicolor
  misc_feature: Ceres ANNOT ID no. 6099850
  misc_feature (9)..(276): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(369): NCBI GI: 144924812 NCBI Desc: protein kinase [medicago truncatula]
  misc_feature (1)..(347): NCBI GI: 62319989 NCBI Desc: protein kinase - like protein [arabidopsis thaliana]
  misc_feature (1)..(400): NCBI GI: 51971353 NCBI Desc: protein kinase - like protein [arabidopsis thaliana]
  misc_feature (1)..(302): NCBI GI: 7269741 NCBI Desc: protein kinase-like protein [arabidopsis thaliana]
  misc_feature (1)..(302): NCBI GI: 7269743 NCBI Desc: protein kinase-like protein [arabidopsis thaliana]
  misc_feature (1)..(396): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 399 in the 11/188,298 US application
  misc_feature: The sequence is a functional homolog of SEQ ID NO. 441 in the 11/188,298 US application
  misc_feature: The sequence is a functional homolog of SEQ ID NO. 332 in the 11/188,298 US application
  misc_feature: The sequence is a functional homolog of SEQ ID NO. 340 in the 11/188,298 US application
  misc_feature: The sequence is a functional homolog of SEQ ID NO. 323 in the 11/188,298 US application
  misc_feature: The sequence is a functional homolog of SEQ ID NO. 312 in the 11/188,298 US application
  misc_feature: The sequence is a functional homolog of SEQ ID NO. 310 in the 11/188,298 US application
  misc_feature: The sequence is a functional homolog of SEQ ID NO. 464 in the 11/188,298 US application
  misc_feature: The sequence is a functional homolog of SEQ ID NO. 520 in the 11/188,298 US application
  misc_feature: The sequence is a functional homolog of SEQ ID NO. 358 in the 11/188,298 US application
  misc_feature: The sequence is a functional homolog of SEQ ID NO. 495 in the 11/188,298 US application
  misc_feature: The sequence is a functional homolog of SEQ ID NO. 498 in the 11/188,298 US application
  misc_feature: The sequence is a functional homolog of SEQ ID NO. 311 in the 11/188,298 US application
  misc_feature: The sequence is a functional homolog of SEQ ID NO. 366 in the 11/188,298 US application
MDRIVGGKFKLGRKIGCGSFGEIYLATHVDTYEIVAVKIESSKTKHPQLFYEAKIYNTLQGGSGIANVKWCGVDGEENVLVIDLLGPSLEDLFCYCGRKFTLKTVLMLAEQMITRIEFMHSKGYLHRDIKPDNFLMGLGRKANQVYIIDFGLAKRYRDSTTNRHIPYRDNKSLTGTARYASCNTHLGIEQSRRDDLISLGYVFLYFLRGSLPWQGLKAATKTQKYDKICEKKLATPIEILCKSCPVEFSSYFHYCQSLSFDQRPDYPFVKRLFRDLFNSQGYEFDYVFDWTVLKYRQGQKQKQSPGAPIARPIHAHVQKQAGVNGVFHHNEAQEHVETSRPAGQAAQSQGKQAINNDRNPNVRHTMNLAQDMAAGKAQLTTSVALPSSQWKNYSDSRSKGQFDAVHHNQGTVNITSSSNMLPTFQHNAPAK

SEQ ID NO: 9317 - DNA, 948 bp, Sorghum bicolor
  misc_feature: Ceres ANNOT ID no. 6099889
  misc_feature: Encodes the peptide sequence at SEQ ID NO 9318
atggagtccctgggcgtgctgctgctccaccccgtgaacgcgtacctggagcaggagctggaccgccgctgccgcctgtaccgcttctgggagtcgccccgggaggagttcctccgcgcgcacgcgggcgccgttcgcgccgtcgtcggcaacgccaactacggcgccgacgccgcgctcatcgacgcgctcccggcgctcgagatcgtcgcatccttctccgtcggcatcgaccgcgtcgacctcgccaagtgccgcgagcgcgggatccgggtcaccaacacccccgacgtccttaccgacgacgtcgccgacctcgccgttggactcgccatcgccgtcctccgcaggatcccgcaggccgaccgctacgtccgcgccgggctatggaagtccaggggcgactacaccctcaccacgcggttcagcgggaaacgagtgggcatcatcgggctgggcaggatcgggcaggcggtggcgaggcgcgtggaagccttcgactgcccggtgagctactaccagcggacggagcaggcgtcggtgtacccaaactacacctactacccgtcggtggtggagctggcgtccaacagcgacgtgctggtggtggcgtgcccgctgaacgcgtcgacccggcacatcgtgagccgcgaggtgatggaggcgctgggcccgaagggcgtgctgatcaacatcgggcgcggcccccacgtcgacgagccggagatggtggcggcgctggcggacggccggctcggcggcgccgggctggacgtgttcgaggacgagccgaacgtgcccgaggcgctgctggcgatggacaacgtcgtgctcgtgccgcacgtcgggagcggcacctacgagacgcgcaaggccatggcggacctggtgctcgggaacctcgaggcccacgtgctcagcaagccgctgctgacgccggtggtctga

SEQ ID NO: 9318 - protein, 315 aa, Sorghum bicolor
  misc_feature: Ceres ANNOT ID no. 6099889
  misc_feature (108)..(283): Pfam Id: 2-Hacid_dh_C Pfam Desc: D-isomer specific 2-hydroxyacid dehydrogenase, NAD bindingdomain
  misc_feature (6)..(315): Pfam Id: 2-Hacid_dh Pfam Desc: D-isomer specific 2-hydroxyacid dehydrogenase, catalyticdomain
  misc_feature (1)..(315): NCBI GI: 62816284 NCBI Desc: hydroxyphenylpyruvate reductase (hppr) [solenostemon scutellarioides]
  misc_feature (6)..(315): NCBI GI: 17938380 NCBI Desc: 2-hydroxyacid dehydrogenase [agrobacterium tumefaciens str. c58]
  misc_feature (2)..(314): NCBI GI: 46203111 NCBI Desc: cog1052: lactate dehydrogenase and related dehydrogenases [magnetospirillum magnetotacticum ms-1]
  misc_feature (6)..(315): NCBI GI: 115456830 NCBI Desc: os04g0107200 [oryza sativa (japonica cultivar-group)]
  misc_feature (6)..(315): NCBI GI: 116310894 NCBI Desc: b0616e02-h0507e05.10 [oryza sativa (indica cultivar-group)]
MESLGVLLLHPVNAYLEQELDRRCRLYRFWESPREEFLRAHAGAVRAVVGNANYGADAALIDALPALEIVASFSVGIDRVDLAKCRERGIRVTNTPDVLTDDVADLAVGLAIAVLRRIPQADRYVRAGLWKSRGDYTLTTRFSGKRVGIIGLGRIGQAVARRVEAFDCPVSYYQRTEQASVYPNYTYYPSVVELASNSDVLVVACPLNASTRHIVSREVMEALGPKGVLINIGRGPHVDEPEMVAALADGRLGGAGLDVFEDEPNVPEALLAMDNVVLVPHVGSGTYETRKAMADLVLGNLEAHVLSKPLLTPVV

SEQ ID NO: 9319 - DNA, 1059 bp, Sorghum bicolor
  misc_feature: Ceres ANNOT ID no. 6099892
  misc_feature: Encodes the peptide sequence at SEQ ID NO 9320
atgaagcgcggggcgtcggagtcgtcggacgcgacgagccagtcgaccacgacgccgccgcggacgcccaataccccgaacaacatgcgtcggccggcgtactacgtgcagagcccgtcccacgatggcggcggcgacaagtcgtcgtcggcgacgacggcgaacacgacgccggtgtaccacagcccgctcgagtcgccgtcgcacgcttcctccacgggccgccactccagggtctcctcctccgccacccgcttctcgggcacgctgctcggccggtcctcctcgcccgccaccagcaggaccgccgccggcgctggcgccgggcggaagctgcacggcggcggctccggccacaagaagaagaagaagtggcacgaggtgagcggcgtcattgacgaggaggcggcggacgactacgacgaggacgaccaggagcagcaggaggacgaggaggaggatgagctcccggtgtgcctcggagtggtcttctgcgcagtggtcgtcgtgttcgccgtcgtctgcctcatcgtctggggagtcgctcgccgctacaaacccaacgtcgtcgtcaagagcctgacggtgcacaacttctacgccggggaaggcacggacagcaccggtgtgccgacgaagctggtgacgctcaactgctcgctggccatgtccgtccacaacccttccaccatgttcggcatccacgtctcctccagctccatccggctcatgtactcggagatcgccatcgccaccggtcagctccacaagttttaccagccgaagaagagccaccgcgccgccgccgcgatcctacacggcgagaagacgccgctgtacggagccggcgccacgctcgtggtgactaaaaacgccggagccggaggcaataaggtgccgctgacgctggagctggcggtgaggacgagagggcacgtgatcgggaggcttgtgagggtgaagcacgccgtgcaagtgaggtgccccgtcgccatcgaccccggcagctccaggccggtcaggttccgtcggagcgattgcagttacaggcgacgatga

SEQ ID NO: 9320 - protein, 352 aa, Sorghum bicolor
  misc_feature: Ceres ANNOT ID no. 6099892
  misc_feature (179)..(328): Pfam Id: Hin1 Pfam Desc: Harpin-induced protein 1 (Hin1)
  misc_feature (64)..(348): NCBI GI: 115466592 NCBI Desc: os06g0163300 [oryza sativa (japonica cultivar-group)]
  misc_feature (11)..(348): NCBI GI: 116309975 NCBI Desc: osigba0160i14.1 [oryza sativa (indica cultivar-group)]
  misc_feature (11)..(348): NCBI GI: 32488073 NCBI Desc: osjnba0084a10.1 [oryza sativa (japonica cultivar-group)]
  misc_feature (11)..(348): NCBI GI: 115458438 NCBI Desc: os04g0430600 [oryza sativa (japonica cultivar-group)]
  misc_feature (50)..(349): NCBI GI: 115461492 NCBI Desc: os04g0689500 [oryza sativa (japonica cultivar-group)]
MKRGASESSDATSQSTTTPPRTPNTPNNMRRPAYYVQSPSHDGGGDKSSSATTANTTPVYHSPLESPSHASSTGRHSRVSSSATRFSGTLLGRSSSPATSRTAAGAGAGRKLHGGGSGHKKKKKWHEVSGVIDEEAADDYDEDDQEQQEDEEEDELPVCLGVVFCAVVVVFAVVCLIVWGVARRYKPNVVVKSLTVHNFYAGEGTDSTGVPTKLVTLNCSLAMSVHNPSTMFGIHVSSSSIRLMYSEIAIATGQLHKFYQPKKSHRAAAAILHGEKTPLYGAGATLVVTKNAGAGGNKVPLTLELAVRTRGHVIGRLVRVKHAVQVRCPVAIDPGSSRPVRFRRSDCSYRRR

SEQ ID NO: 9321 - DNA, 663 bp, Sorghum bicolor
  misc_feature: Ceres ANNOT ID no. 6099893
  misc_feature: Encodes the peptide sequence at SEQ ID NO 9322
atgcggcagctatggcggtggtaccagcagtgcctggccacgcacccggtgcgcacgcaggtcgtcagctccggcatcctctggggcctcggcgacatcggcgcccaggccgtcacccactactccgcccgccccgaccgccgcagcagccctcctgaggataaagataataaagacaataaagagtttaaagttgattggaagagggtgggcgtcacaagctccttcggatttgcttttgttggtccagttggacattactggtatgaatacctggaccgcttcatccggcggagatttcagcctaatacgttcaaatttgttgcctcaaaagttgccgcagatggtttcctctttggaccattagacctcctcctgttcttctcatatgttggtcttggtcaaggaaggagcgtagagcaggtgaaggaagatgtgaaaagagacttcattccggctctggtgttaggtggaaccatctggcctgctgtgcaaatcgcaaacttccgcttcatccccgtgcggtatcagctcctgtatgtgaacttgttctgcctcttggacagttgcttcttgtcatggattgagcagcagggagacgcttcctggaagcagtggttcacatcgttccagaaaatcgaagaccagaagagtaaggtttga

SEQ ID NO: 9322 - protein, 220 aa, Sorghum bicolor
  misc_feature: Ceres ANNOT ID no. 6099893
  misc_feature (131)..(201): Pfam Id: Mpv17_PMP22 Pfam Desc: Mpv17 / PMP22 family
  misc_feature (1)..(220): NCBI GI: 115435436 NCBI Desc: os01g0228300 [oryza sativa (japonica cultivar-group)]
  misc_feature (1)..(216): NCBI GI: 38454114 NCBI Desc: at3g24570 [arabidopsis thaliana]
  misc_feature (5)..(220): NCBI GI: 144924724 NCBI Desc: mpv17/pmp22 [medicago truncatula]
  misc_feature (77)..(194): NCBI GI: 51858973 NCBI Desc: loc446961 protein [xenopus laevis]
  misc_feature (77)..(194): NCBI GI: 97176436 NCBI Desc: protein mpv17
MRQLWRWYQQCLATHPVRTQVVSSGILWGLGDIGAQAVTHYSARPDRRSSPPEDKDNKDNKEFKVDWKRVGVTSSFGFAFVGPVGHYWYEYLDRFIRRRFQPNTFKFVASKVAADGFLFGPLDLLLFFSYVGLGQGRSVEQVKEDVKRDFIPALVLGGTIWPAVQIANFRFIPVRYQLLYVNLFCLLDSCFLSWIEQQGDASWKQWFTSFQKIEDQKSKV

SEQ ID NO: 9323 - DNA, 873 bp, Sorghum bicolor
  misc_feature: Ceres ANNOT ID no. 6099895
  misc_feature: Encodes the peptide sequence at SEQ ID NO 9324
atgcaggccgcaaggaggctagcgtgttggagcctccaacgacgcctactccttccctctcaggctcaggccccaagcatcccaacggcggcagccttcctccactcccacgtgcgcgaagaggaaaagagcaaattggttggcaacgttttcagcagcgtggcttccagctacgacctcatgaacgatttcatgagcgtgggactgcatcggctgtggaaggacaggcttgtttccaagctgaatccctttccggggatgaagcatctcgatgtggctggtggaacaggcgatgttgcttttcgtgtactggaaagaattaagagcgtgggtcacagagctatgcagggtactcttactgaaaacgaagaagacacccacatttatgtctgtgacattaatccaaatatgctaaatgttgggaagaagcgtgctgcagaaagagggtatagcgaagaacattgtcttagctggatacaaggagatgcagaagctctgagttttgaggatggatctatggatggttacactattgcatttgggatcagaaatgtgacgcacattgagaaagctctatcagaagcttacagggttctaaagcgagggggcaggttcctatgcttggagttgagtcatgtggatgtccctgtttttaaagagatctatgatgtttactcattttctgtgattccgactattggagagctggttgctggtgatcggcagtcgtatcagtacttggttgagagcatccgtcgatttccaaatcaggaaaagtttgctcagatgattcaggaagccggattccagagggtggaatatgagaacctcgtaggtggtgtagttgccattcattctgggctgaaactgtaa

SEQ ID NO: 9324 - protein, 290 aa, Sorghum bicolor
  misc_feature: Ceres ANNOT ID no. 6099895
  misc_feature (36)..(289): Pfam Id: Ubie_methyltran Pfam Desc: ubiE/COQ5 methyltransferase family
  misc_feature (90)..(207): Pfam Id: Methyltransf_11 Pfam Desc: Methyltransferase domain
  misc_feature (90)..(205): Pfam Id: Methyltransf_12 Pfam Desc: Methyltransferase domain
  misc_feature (30)..(290): NCBI GI: 92874818 NCBI Desc: sam (and some other nucleotide) binding motif [medicago truncatula]
  misc_feature (125)..(290): NCBI GI: 57525205 NCBI Desc: similar to mgc4767 protein [gallus gallus]
  misc_feature (38)..(290): NCBI GI: 38196988 NCBI Desc: mgc4767 protein [homo sapiens]
  misc_feature (38)..(290): NCBI GI: 52218926 NCBI Desc: zgc:92445 [danio rerio]
  misc_feature (38)..(290): NCBI GI: 125982397 NCBI Desc: ga15370-pa [drosophila pseudoobscura]
MQAARRLACWSLQRRLLLPSQAQAPSIPTAAAFLHSHVREEEKSKLVGNVFSSVASSYDLMNDFMSVGLHRLWKDRLVSKLNPFPGMKHLDVAGGTGDVAFRVLERIKSVGHRAMQGTLTENEEDTHIYVCDINPNMLNVGKKRAAERGYSEEHCLSWIQGDAEALSFEDGSMDGYTIAFGIRNVTHIEKALSEAYRVLKRGGRFLCLELSHVDVPVFKEIYDVYSFSVIPTIGELVAGDRQSYQYLVESIRRFPNQEKFAQMIQEAGFQRVEYENLVGGVVAIHSGLKL

SEQ ID NO: 9325 - DNA, 501 bp, Sorghum bicolor
  misc_feature: Ceres ANNOT ID no. 6099899
  misc_feature: Encodes the peptide sequence at SEQ ID NO 9326
atgacgcagcagtcgatggtggcgctggtcgccgccggcgtcctcctcctcgccggcgtggcgtcggcggagaaggcgggcgggttcgtggtgacgggtcgcgtgtactgcgacccctgccgcgccgggttcgagacgaacgtgtccaagagcgtggcgggcgcgacggtggaggtggtgtgccggcacttcgaggcgagcaaggagacgctcaaggcggaggcgacgacggacgacttcgggtggtacaagctggagatcgaccaggaccaccaggaggagatctgcgaggtggtgctcaagaagagccccgacccggcgtgcgccgagatcgaggagcagcgcgcccgcgcccgcgtcccgctcacctccaacaacggcatcaagcagaagggcacccggtacgccaaccccatcgccttcttccgcaaggacccgctcaaggagtgcggcgcaatcctccagaagtacgacctcaaggacgcatccgacacgccatga

SEQ ID NO: 9326 - protein, 166 aa, Sorghum bicolor
  misc_feature: Ceres ANNOT ID no. 6099899
  misc_feature (31)..(152): Pfam Id: Pollen_Ole_e_I Pfam Desc: Pollen proteins Ole e I family
  misc_feature (24)..(166): NCBI GI: 23452313 NCBI Desc: pollen allergen phl p 11 [phleum pratense]
  misc_feature (24)..(157): NCBI GI: 47605808 NCBI Desc: major pollen allergen lol p 11 (lol p xi)
  misc_feature (10)..(161): NCBI GI: 116309466 NCBI Desc: h0209h04.4 [oryza sativa (indica cultivar-group)]
  misc_feature (4)..(161): NCBI GI: 62720370 NCBI Desc: pollen allergen cro s 1 [crocus sativus]
  misc_feature (4)..(161): NCBI GI: 22074346 NCBI Desc: che a 1 allergen precursor [chenopodium album]
MTQQSMVALVAAGVLLLAGVASAEKAGGFVVTGRVYCDPCRAGFETNVSKSVAGATVEVVCRHFEASKETLKAEATTDDFGWYKLEIDQDHQEEICEVVLKKSPDPACAEIEEQRARARVPLTSNNGIKQKGTRYANPIAFFRKDPLKECGAILQKYDLKDASDTP

SEQ ID NO: 9327 - DNA, 1539 bp, Sorghum bicolor
  misc_feature: Ceres ANNOT ID no. 6099909
  misc_feature: Encodes the peptide sequence at SEQ ID NO 9328
atggccgccgccgccgccgccgcggtagcccacctctccgtccacggccgcctccgccgctctccggagcatcgcccgtccacctcctcttcctccgcacccgcgcaccggccgtccctgctgcggtgccgcgcgttcaagcaggagaccgacggcggcggtggcgaccgcgacagcgacccgtccgagcccgacgcgcggaagcgcaggaagggcccgctgtacaagctcaaggcggcgatccagggcctcgcgggctcccgctccgccgccgcggaggtctacgggggagagcaccagtaccagcgcgccgtcgagaaggcggaggagatcttcttctcggttgctactcagctaggcagatatgctatcactatgatgagcagtggtgttgtacttggggttggatttcagctgtcaggtggagacagccaaatgaacgaactaatttggtatagctggcttggtggggtgattatcggtacaatgataggtgcaaacagtgtcctggaggaacactgcaaagctggacctcgcaatgtcgtcataactggaagcacaagagggttaggaaaagcacttgctcgtgagtttcttctttctggagaccatgttgtaattacttcacgaagtcctgaatctgtccttcagactataacagaacttgaagagaacatacaggaagggttatcagttgccaaaaagaaagagaggaaaattttatcccatgccaaggttgttggtacagcttgtgatgtctgtaaacctgaagatgtgaagaaattagtgaattttgctattaatgagcttggctcagttgacatttggataaataatgctggcacaaataaaggttttaggccactggtaaccttttcagatgatgacattactcagatcgtctcaacaaacctagttggctctctactgtgcactagagaagccatgaatgtcatgcaataccaagagaaaggaggccatatatttaacatggatggagcaggttctggaggatcaagcacaccactgacagctgtctatggttcaactaaatgtggactaaggcagttccaaggatcacttctgaaggaaagcagaagatcaaaagttggagtgcacactgcctcacctggtatggtcctcacagaccttcttttaagtggttcatccatcagaaataaacaaatgttcaatttaatatgtgagcttccagaaacagtagccagaacattggttccaaggatgagagttgtaaaaggaagtggaaaggcaatcaactacttaacaccaccgaggatcttgcttgctttggttactgcatgggttcgacggggccgatggtttgatgatgaggggagagcggtgtatgcagctgaagctgacagaattcgcaactgggctgaaagtcgagcacggttctctttcaccgatgccatggagatgtacacggaaaacacatgggtttctgtattctcactctccgtggtttgtgcgttcataattctttccagctcaggtggacctcttccaggcacatga

SEQ ID NO: 9328 - protein, 512 aa, Sorghum bicolor
  misc_feature: Ceres ANNOT ID no. 6099909
  misc_feature (179)..(366): Pfam Id: adh_short Pfam Desc: short chain dehydrogenase
  misc_feature (63)..(512): NCBI GI: 16323186 NCBI Desc: at4g13250/f17n18_140 [arabidopsis thaliana]
  misc_feature (157)..(418): NCBI GI: 115454395 NCBI Desc: os03g0654600 [oryza sativa (japonica cultivar-group)]
  misc_feature (181)..(425): NCBI GI: 68552796 NCBI Desc: short-chain dehydrogenase/reductase sdr [prosthecochloris aestuarii dsm 271]
  misc_feature (181)..(453): NCBI GI: 21673969 NCBI Desc: oxidoreductase, short-chain dehydrogenase/reductase family [chlorobium tepidum tls]
  misc_feature (169)..(443): NCBI GI: 110340198 NCBI Desc: short-chain dehydrogenase/reductase sdr [chlorobium ferrooxidans dsm 13031]
  misc_feature: The sequence is a functional homolog of SEQ ID NO. 389 in the 11/188,298 US application
  misc_feature: The sequence is a functional homolog of SEQ ID NO. 453 in the 11/188,298 US application
MAAAAAAAVAHLSVHGRLRRSPEHRPSTSSSSAPAHRPSLLRCRAFKQETDGGGGDRDSDPSEPDARKRRKGPLYKLKAAIQGLAGSRSAAAEVYGGEHQYQRAVEKAEEIFFSVATQLGRYAITMMSSGVVLGVGFQLSGGDSQMNELIWYSWLGGVIIGTMIGANSVLEEHCKAGPRNVVITGSTRGLGKALAREFLLSGDHVVITSRSPESVLQTITELEENIQEGLSVAKKKERKILSHAKVVGTACDVCKPEDVKKLVNFAINELGSVDIWINNAGTNKGFRPLVTFSDDDITQIVSTNLVGSLLCTREAMNVMQYQEKGGHIFNMDGAGSGGSSTPLTAVYGSTKCGLRQFQGSLLKESRRSKVGVHTASPGMVLTDLLLSGSSIRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 9329 - DNA, 2523 bp, Sorghum bicolor
  misc_feature: Ceres ANNOT ID no. 6099915
  misc_feature: Encodes the peptide sequence at SEQ ID NO 9330
  misc_feature: Down-regulated in shoot tissues in response to salicylic acid treatment
atggaggggaagagcgtggtgatgtcggcgctcgggatcgggatcggggtcggcgtcggcctgggcctcgcgtccgcgccctgggccggcgcctccgcctcctccagggccgcgggggtcaccgtcgaacgggtggagcaggacctccgccgcctcctcgtcgacggcagcaacagcaaggtcaccttcgacgagttcccctactacctcagtgagcaaacacgtgttgtgctgacaagcgctgcgtacgttcacttgaagcaagcagagatttcaaagtacaccaggaatcttgctccagccagtcgcgcaatcctgctgtcaggtcctgcagagctctaccagcagatgcttgccagagcgcttgcccactattttcaagcgaagttgctgttgctagatcctactgattttcttataaagatccatagcaaatatggcactggtggcagtacagagaagacgtttaaaagatcaatctccgagacgacgcttgaacgtgtgtcgggattgcttggatctctttcaattatttcacaaaaggaacagcccaaaggaactatacgtagacaaagcagcatgacggatgtcaaattaaggagctctgaaagtatgaccaacttaccaaagctcagaagaaatgcatctacttcctctgatatgagtagcatggcttcgcaaggaccttcaactaatacagctcctcttagacgcacaagcagttggaattttgatgagaaaattttagtgcaagcgttgtacaaggttctgcattcagtgtcaaagaagtacccagttgtactctatataagagatgttgagaagtttcttcacaagtccccaaaaatgtatctcctgtttgaaaaactactagacaagcttgaagggccagtgttagtcctcggatcaaggattgtagatatggacagtgatgaggagttagatgacagattgactgttctgttcccatataatatagaaatcaagccacctgaaaacgaaaaccaccttgtaagttggaactcccaattagaagaagacatgaagatgattcagtttcaagataaccgaaatcatattatggaagtccttgcagaaaatgatcttgaatgtgatgatttaggctcgatttgcctatctgatactatgtgccttagtaagtatatagaagagattgtggtgtctgcggtttcatatcacttgatgaataacagagatccagagtaccgaaatgggaaattagttctatccacaaagagcttgtcccacgcattggaaatttttcaaggcaacaagatgggcgataaggacagcatgaaattggaagctgctgaaaaggcaattgctccagccactgcaaaatcagaaacaaaacctgcaacgttgctgccaccagttcgacctccggctggtgctgctgctgctgctccctccagtgcccctgctcctagagttgagagcaaaacagaaccggagaagaaggataatccacctccagttgcaaaagcactggaagtgccaccagataatgagtttgaaaagcgcattagaccagaagtgatacctgctaatgaaattggagtttcatttgatgatattggtgccttggatgatatcaaagaatcccttcatgagcttgtcatgctgcctcttagacgacctgacctcttcaaaggcggtcttcttaagccctgcagaggtatattactttttggtcctccaggaaccggcaagactatgcttgccaaggccatagcaaatgaagctcaagcaagttttataaatgtctctatgtcgactatcacatcaaagtggtttggtgaagacgaaaagaatgttcgagcattgttcacattagctgctaaagtatcaccaaccatcatctttgtcgatgaagttgatagcatgcttgggcagcggaacagagctggagagcacgaggcaatgagaaagatcaagaatgaatttatgacacactgggatggactcttgtcaagaccagatcagagaattcttgttcttgctgcgactaaccggccttttgatcttgatgaggctatcatccgtaggttcgagcgaagaatcatggtaggtctgccatccatggaaagtcgggaactcataatgcggcgacttttgtcaaaggagaaagttgatgaagggctggactataaggagctagcaaccatgacagaaggatatagtggaagtgatctcaagaacctgtgcacgacggcagcatatcgccctgtgagggagctaatccagagggaaagaaagaaggagctggagaagatgaagcgtgaaaaaggaaaaactccatcggatcttccagagaagaaagaaaaggaggagaccatcattctaaggccgctgaacatgacagatctgaaggaagcgaagaaccaggtggctgcaagtttcgctgcggaaggcgccataatgagcgagctgaggcaatggaacgagttgtatggtgaaggaggctccagaaagaagcagcaattgacatacttcctctga

SEQ ID NO: 9330 - protein, 840 aa, Sorghum bicolor
  misc_feature: Ceres ANNOT ID no. 6099915
  misc_feature (567)..(752): Pfam Id: AAA Pfam Desc: ATPase family associated with various cellular activities(AAA)
  misc_feature (1)..(840): NCBI GI: 30696968 NCBI Desc: aaa-type atpase family protein [arabidopsis thaliana]
  misc_feature (6)..(840): NCBI GI: 30102500 NCBI Desc: at1g64110/f22c12_22 [arabidopsis thaliana]
  misc_feature (1)..(840): NCBI GI: 92870453 NCBI Desc: aaa atpase, central region; dead/deah box helicase, n-terminal [medicago truncatula]
  misc_feature (1)..(840): NCBI GI: 145334803 NCBI Desc: atp binding / nucleoside-triphosphatase/ nucleotide binding [arabidopsis thaliana]
  misc_feature (186)..(762): NCBI GI: 6692099 NCBI Desc: f22c12.12 [arabidopsis thaliana]
  misc_feature: Down-regulated in shoot tissues in response to salicylic acid treatment
  misc_feature: The sequence is a functional homolog of SEQ ID NO. 471 in the 11/188,298 US application
  misc_feature: The sequence is a functional homolog of SEQ ID NO. 462 in the 11/188,298 US application
MEGKSVVMSALGIGIGVGVGLGLASAPWAGASASSRAAGVTVERVEQDLRRLLVDGSNSKVTFDEFPYYLSEQTRVVLTSAAYVHLKQAEISKYTRNLAPASRAILLSGPAELYQQMLARALAHYFQAKLLLLDPTDFLIKIHSKYGTGGSTEKTFKRSISETTLERVSGLLGSLSIISQKEQPKGTIRRQSSMTDVKLRSSESMTNLPKLRRNASTSSDMSSMASQGPSTNTAPLRRTSSWNFDEKILVQALYKVLHSVSKKYPVVLYIRDVEKFLHKSPKMYLLFEKLLDKLEGPVLVLGSRIVDMDSDEELDDRLTVLFPYNIEIKPPENENHLVSWNSQLEEDMKMIQFQDNRNHIMEVLAENDLECDDLGSICLSDTMCLSKYIEEIVVSAVSYHLMNNRDPEYRNGKLVLSTKSLSHALEIFQGNKMGDKDSMKLEAAEKAIAPATAKSETKPATLLPPVRPPAGAAAAAPSSAPAPRVESKTEPEKKDNPPPVAKALEVPPDNEFEKRIRPEVIPANEIGVSFDDIGALDDIKESLHELVMLPLRRPDLFKGGLLKPCRGILLFGPPGTGKTMLAKAIANEAQASFINVSMSTITSKWFGEDEKNVRALFTLAAKVSPTIIFVDEVDSMLGQRNRAGEHEAMRKIKNEFMTHWDGLLSRPDQRILVLAATNRPFDLDEAIIRRFERRIMVGLPSMESRELIMRRLLSKEKVDEGLDYKELATMTEGYSGSDLKNLCTTAAYRPVRELIQRERKKELEKMKREKGKTPSDLPEKKEKEETIILRPLNMTDLKEAKNQVAASFAAEGAIMSELRQWNELYGEGGSRKKQQLTYFL

SEQ ID NO: 9331 - DNA, 1062 bp, Sorghum bicolor
  misc_feature: Ceres ANNOT ID no. 6099924
  misc_feature: Encodes the peptide sequence at SEQ ID NO 9332
atgcggcggtccctctccctcctcgcgcggcagcaggtggcgcagcagcggcggctgctgagcaacgtgccggagtccaccgtctacgggggcccacgcccgcaggagtcggcggcggcgcggcgcgtgacggtgaccaccctccgcggcaagcaccgccgaggggagcccatcaccgtcgtcaccgcctacgactacccctccgcggtccacgtcgactccgcgggcatcgacgtctgcctcgtcggggactccgccgccatggtcgtccacggccacgacaccacgctccccatcacgctcgacctcatgctcgagcactgccgcgccgtggccaggggcgcgccaaggccgctcctcgtcggggatctcccgttcggctgctacgagtcctccgcagcgcaggctgttgattcagctgtgagggtactgaaggaaggtggaatggatgcaatcaagctggaagggggtgcaccgtccaggatcactgcagccaaggctatcgtggaggctggaattgctgtcatggggcatgttggcctcacaccgcaagctattagtgtgctcggtggatttaggcctcaagggaagacggttgacagtgctgtaaaggttgtggagacagcacttgccttgcaggaggctggatgcttctcggttgtgttggagtgtgtgcctgctccagtggcagccgctgcaacatcagcattgaaaatcccgaccattggcattggggctggaccattctgtagtggacaggtcttggtataccatgacttgttagggatgctacgacacccacaccatgccaaggtcacaccaaagttttgtaaacaatttggtaacgtgggcgatgtcatcaacaaggcgttatcagagtataagcaagaagtggaaactcattctttccctggtccaagccacacaccgtataagataactcccacagatgttgatggctttgcaaatgcactgcagaagatgggtttgagtgacgccgcagatgctgcggctgctgctgctgaaaacagggagaatggtggagaaccaaaaggaaaatag

SEQ ID NO: 9332 - protein, 353 aa, Sorghum bicolor
  misc_feature: Ceres ANNOT ID no. 6099924
  misc_feature (41)..(307): Pfam Id: Pantoate_transf Pfam Desc: Ketopantoate hydroxymethyltransferase
  misc_feature (1)..(353): NCBI GI: 13027351 NCBI Desc: 3-methyl-2-oxobutanoate hydroxy-methyl-transferase-like protein [oryza sativa (japonica cultivar-group)]
  misc_feature (18)..(353): NCBI GI: 21593121 NCBI Desc: 3-methyl-2-oxobutanoate hydroxy-methyl-transferase-like protein [arabidopsis thaliana]
  misc_feature (18)..(345): NCBI GI: 28466955 NCBI Desc: at2g46110 [arabidopsis thaliana]
  misc_feature (17)..(353): NCBI GI: 13027352 NCBI Desc: 3-methyl-2-oxobutanoate hydroxy-methyl-transferase-like protein [oryza sativa (japonica cultivar-group)]
  misc_feature (35)..(329): NCBI GI: 145342238 NCBI Desc: ketopantoate hydroxymethyltransferase [ostreococcus lucimarinus cce9901]
  misc_feature: Useful for making plants with modulated oxidative stress sensitivity
  misc_feature: GREAT-hit functional homolog of the protein sequence given in SEQ ID NO 13128
  misc_feature: Useful for making plants with modulated oxidative stress sensitivity
  misc_feature: Functional homolog of the protein sequence given in SEQ ID NO 13128
MRRSLSLLARQQVAQQRRLLSNVPESTVYGGPRPQESAAARRVTVTTLRGKHRRGEPITVVTAYDYPSAVHVDSAGIDVCLVGDSAAMVVHGHDTTLPITLDLMLEHCRAVARGAPRPLLVGDLPFGCYESSAAQAVDSAVRVLKEGGMDAIKLEGGAPSRITAAKAIVEAGIAVMGHVGLTPQAISVLGGFRPQGKTVDSAVKVVETALALQEAGCFSVVLECVPAPVAAAATSALKIPTIGIGAGPFCSGQVLVYHDLLGMLRHPHHAKVTPKFCKQFGNVGDVINKALSEYKQEVETHSFPGPSHTPYKITPTDVDGFANALQKMGLSDAADAAAAAAENRENGGEPKGK

SEQ ID NO: 9333 - DNA, 1644 bp, Sorghum bicolor
  misc_feature: Ceres ANNOT ID no. 6099930
  misc_feature: Encodes the peptide sequence at SEQ ID NO 9334
atgtcgtcggagcctccacccgccgcctcctctgccaccggcgcagaggaactctctgctgacctttccgccgccaccctcagcaagaagcagcagaagaaggacgccaggaaggcggagaaagctgagaaggcggcgcagcgccagcagcagcagcagcagccggtcgacgccgaggaccctttcgcggccaactacggcgatgtccccgtcgaggagatccagtcaaaggtcatctccggccgctcgtggacccaaatcggggacctcgacgactctgctgcgggccgctccgtgcttatccgcggagccgcgcaggctttccgcccggtcagcaagaagatggctttcgtcgtgctgcgccagcgcatgagcaccgtgcagtgcgtgctcgtcgccagcgctgacgccggcgtcagcacgcagatggtgcgcttcgccactgccctcagcaaggagtccatcgtcgacgttgagggcgtcgtctccctccccaaggagcccctcaaggccaccacacagcaggttgagattcaagtgaggaagatctattgcatcaatagggctatcccgacccttccaattaaccttgaagatgcggctcggagtgaggcagattttgagaaggctgaactggctggagaaaagcttgttcgtgttggtcaagatacccgcttgaactacagagctattgatcttcgaacaccctcgaatcaagctgtattccggatccagtgtcaagttgaaaacaaattcagagaatttttgttgtcgaaggattttgttgggatccacaccccaaaattgatttctggatctagtgaaggaggtgcagctgtattcaagcttttgtacaatggtcaacctgcctgtttagcacagtctcctcagttgtacaagcaaatggctatctgtggtggttttgaacgagtatttgaggttggccctgtgtttagagcagaaaattcaaacacacacaggcatctctgtgagtttgttggtcttgatgctgaaatggagattaaggagcattattttgaggtctgtgacattatagatggcttattcgtatcaatatttaaacacctgactgaaaactgcaagaaagaactcgaaacaataaacaggcagtatccgtttgaacctctgaagtatctagacaaaaccttgaagctcacttatgaggaagggattcaaatgttgaaggaagccggaacagaaattgagcctatgggtgacctcaatactgaagctgagaaaaaacttggtcggcttgtcagggaaaagtataacacagattttttcatcttgtatcgatatcctttggctgtacgtccgttctacaccatgccttgctatgacaacccagcttacaccaactcttttgatgtcttcattcgaggtgaggagataatatctggagcacaaaggatacacactcctgagctgttggccaagcgtgcaacagagtgtggaattgatgtgagcacaatctcggcctacattgaatccttcagctatggtgcacctccacatggtggtttcggtgtgggcttggagagggtcgtgatgctgttctgcgccctaaacaacatcaggaagacctcaatgttcccccgcgacccgcagaggcttgtgccttaa

SEQ ID NO: 9334 - protein, 547 aa, Sorghum bicolor
  misc_feature: Ceres ANNOT ID no. 6099930
  misc_feature (221)..(543): Pfam Id: tRNA-synt_2 Pfam Desc: tRNA synthetases class II (D, K and N)
  misc_feature (99)..(186): Pfam Id: tRNA_anti Pfam Desc: OB-fold nucleic acid binding domain
  misc_feature (10)..(547): NCBI GI: 92897799 NCBI Desc: aspartyl-trna synthetase, class iib; trna synthetase, class ii (d, k and n) [medicago truncatula]
  misc_feature (143)..(547): NCBI GI: 27311923 NCBI Desc: aspartate--trna ligase - like protein [arabidopsis thaliana]
  misc_feature (6)..(547): NCBI GI: 89306442 NCBI Desc: aspartyl-trna synthetase family protein [tetrahymena thermophila sb210]
  misc_feature (13)..(547): NCBI GI: 27503265 NCBI Desc: dars-prov protein [xenopus laevis]
  misc_feature (28)..(547): NCBI GI: 49119135 NCBI Desc: mgc80207 protein [xenopus laevis]
  misc_feature (42)..(547): SWISSPROT Homolog: EC 6.1.1.12 Aspartyl-tRNA synthetase, cytoplasmic
MSSEPPPAASSATGAEELSADLSAATLSKKQQKKDARKAEKAEKAAQRQQQQQQPVDAEDPFAANYGDVPVEEIQSKVISGRSWTQIGDLDDSAAGRSVLIRGAAQAFRPVSKKMAFVVLRQRMSTVQCVLVASADAGVSTQMVRFATALSKESIVDVEGVVSLPKEPLKATTQQVEIQVRKIYCINRAIPTLPINLEDAARSEADFEKAELAGEKLVRVGQDTRLNYRAIDLRTPSNQAVFRIQCQVENKFREFLLSKDFVGIHTPKLISGSSEGGAAVFKLLYNGQPACLAQSPQLYKQMAICGGFERVFEVGPVFRAENSNTHRHLCEFVGLDAEMEIKEHYFEVCDIIDGLFVSIFKHLTENCKKELETINRQYPFEPLKYLDKTLKLTYEEGIQMLKEAGTEIEPMGDLNTEAEKKLGRLVREKYNTDFFILYRYPLAVRPFYTMPCYDNPAYTNSFDVFIRGEEIISGAQRIHTPELLAKRATECGIDVSTISAYIESFSYGAPPHGGFGVGLERVVMLFCALNNIRKTSMFPRDPQRLVP

SEQ ID NO: 9335 - DNA, 1281 bp, Sorghum bicolor
  misc_feature: Ceres ANNOT ID no. 6099935
  misc_feature: Encodes the peptide sequence at SEQ ID NO 9336
atggaccgcttcgccgagacggagggcaagagggcgcacgacccgctgtacagcccgcggcgcgcagcgagggcgacggccacgggcttccccgtgggcgagcacggggaggtgctggcgggaccggtgatcgtgggcgcagggccggcggggctggcggtggcggcgtgcctcaccatgtggggcatcccgtacgtgctcctggaacgccatggcggcatcgcctcgctgtggcgccaccgcacgtaccgaaggctgcgcctccacctgcccaagcgctactgcgagctgccgctaatgcccttcccgccaagctacccggcctacccaaccagggagcagttcctcgcttacctcgaggactacatcgccaccttcggcatcaggcctttcttctgccaggccgtcgtcagcgccgagcacgacggcgacttctggtgcgtccgcgccgtcgacggcggcagcggcggagtcaccagggtataccgctccaaatggcttgtcgtcgccacgggtgagaacgccgagcccgtcgtgcccgacatcgacggcatcaatgccttcaggggcctggtcatgcactccagcgactactgcagcggcgaaggctaccggggtaagaaggtgctcgtcgtcggctgcggcaactccggtatggaggtgtctcttgacctctccaaccataatgtgcacacctccatggttgtgcgtgactcggtccatgtccttccaagagagatcatggggttctccacttttggtttgtccatgtggcttctcatgtgtctatcggtccagacagtggaccaggtcctcctcttactcacgcagctcgtgctaggtgacacctcacgcctcggcattcctcgacctagcattggcccgatggagcaaaagaaagtctccggaaagacaccggttctagatgtgggaactatagcgaagatcaagtctggagacataaaagtgtttccagcaattcaaagttttcaacagcatggtgttcaatttattgatggcaagactgaatcatttgatgttgtaattcttgccactggatacaaaagcaatgttccttattggttaaaggagaaagatttcttttcagagaaaaatggatttccacgcaattcaaatgaatggaaaggaaaaaatggtctttatgctgctgggttctcaagacgtgggctctttggtgtgtccatggatgctaccaatattgccgatgacatcgtccggtgttggaatgactttggctatgaaaggcacaagagaaaataa

SEQ ID NO: 9336 - protein, 426 aa, Sorghum bicolor
  misc_feature: Ceres ANNOT ID no. 6099935
  misc_feature (44)..(421): Pfam Id: FMO-like Pfam Desc: Flavin-binding monooxygenase-like
  misc_feature (1)..(422): NCBI GI: 13027342 NCBI Desc: dimethylaniline monooxygenase-like protein [oryza sativa (japonica cultivar-group)]
  misc_feature (1)..(415): NCBI GI: 92875435 NCBI Desc: pyridine nucleotide-disulphide oxidoreductase, class i; fad-dependent pyridine nucleotide-disulphide oxidoreductase [medicago truncatula]
  misc_feature (1)..(419): NCBI GI: 115439755 NCBI Desc: os01g0732700 [oryza sativa (japonica cultivar-group)]
  misc_feature (41)..(417): NCBI GI: 3142293 NCBI Desc: contains similarity to myosin ib heavy chain gbx70400 from gallus gallus. [arabidopsis thaliana]
  misc_feature (41)..(415): NCBI GI: 92895305 NCBI Desc: pyridine nucleotide-disulphide oxidoreductase, class i; fad-dependent pyridine nucleotide-disulphide oxidoreductase [medicago truncatula]
MDRFAETEGKRAHDPLYSPRRAARATATGFPVGEHGEVLAGPVIVGAGPAGLAVAACLTMWGIPYVLLERHGGIASLWRHRTYRRLRLHLPKRYCELPLMPFPPSYPAYPTREQFLAYLEDYIATFGIRPFFCQAVVSAEHDGDFWCVRAVDGGSGGVTRVYRSKWLVVATGENAEPVVPDIDGINAFRGLVMHSSDYCSGEGYRGKKVLVVGCGNSGMEVSLDLSNHNVHTSMVVRDSVHVLPREIMGFSTFGLSMWLLMCLSVQTVDQVLLLLTQLVLGDTSRLGIPRPSIGPMEQKKVSGKTPVLDVGTIAKIKSGDIKVFPAIQSFQQHGVQFIDGKTESFDVVILATGYKSNVPYWLKEKDFFSEKNGFPRNSNEWKGKNGLYAAGFSRRGLFGVSMDATNIADDIVRCWNDFGYERHKRK

SEQ ID NO: 9337 - DNA, 3783 bp, Sorghum bicolor
  misc_feature: Ceres ANNOT ID no. 6099970
  misc_feature: Encodes the peptide sequence at SEQ ID NO 9338
atggatgccacggatgttcaacagagcatgggatttatggagtccaggggtggtatgcctaagtttttccatgcccttggaccggcactcctgatttcaatggggtacattgatctcgggaagtgggtggcagcagttgaagctggttctcgttttggattcgacctggtgttactggctctccttttcaactttactgccattgtatgtcagtaccttgctgcttgcattggcactgtcacagggaagaatcttgcagagatatgccaccaagagtacaaccagccaacatgtattttcctgggtgttcaagctggattgtccttgttgacatcagagctgactatgatttttggcatagcactcggattcaacctcctgtttgaatatgatgatctcatcacagggatatgctttgcaacagtgggaaagaagatggaagggacagtaaatgcctgcatagcaggatttgcacttcttagttatgtgcttggcttattggttagccagccacaaattcctctcacaatgaatgtaatattccccaagatcagtggtgagagtgcttactctctgatggcacttcttggtgcaaacataatggcacacaacttctacattcattcatcagttgtccagggtcagaaaaagtcgtctgcagttggtcttggcgccttatttcacgaccatcttttttcaatattgttcatttttactggaatctttatggtgaactatgttctaatgaactctgcagcagcggaatctactaatactcttctcattaccttccaagatgttgtagagctaatgaatcagatatttgtaaatcctctggcaccaactatatttttagtggttcttctcttctccagccacatcatctcgctgacatctgctatcggtagccaagtgatttcacagcatttatttggtataaaccttcctctttctggacatcgtctcctgctgaaggtttttgccatagttcctactctgtactgggcgaaagttgcaggagctgaagggatataccaattattaattatatgtcagattatccaggccatgctccttccatcttcagtcatcccactttttcgtgttgcttcatccagatcaataatgggagcccatagagtgtctttgcatctggagatactggtttttcttgcatttctccttatgctattttcaaatatcatatttgtggcagaaatgctatttggtgacagtggctggatgaacaatctgaaaggatatactggaagccctgtggtgctcccatatactgttttcattttagttgcatgtgtatctgtggctttttcactgtacctggctgttacaccattgagatctggaagtcatgaagctgaatcccatgaatggtctgtgcattctcagagagaactcttgaatactcctcaagaaagggaagatgttaaggtggacaatgttacctatgaggaagatcagagatcagatgttggcccttctcccagggatgcgcctgacagccatccggagctggccatggactatattgatacttctgacactgctgtagaatctgatcacgactctcaacaatctactgcatatgcatccactgctcctgaaacctgcccctccccgtcatttactcgtgaggagtcaaaatcagttgttgcagtcaactggccggagcctttggagaaggttcctacttctactgtgatagaggaaagcacagtagaaagtgtggtctctaggatcacgactgaaagagatgttttagtagaaacagatgttttctcaggcaaggataaggaagatacacatgttttggagtctgagaagtcaattgttgatagcaccccttgtgtgtctgatgatggtccaccatctcttaccttcagcaggggaaaaggctcagatgcaggaaatggcaatggtagtctctcgaggctatccggtttgggccgtgcggcaaggaggcagctagctgctactcttgatgagttctgggggcatctgtttgattaccatggtaagctcactcaagaagccagcacaaaaaagtttggtatcttgcttgggatagaccttagaacacctaccacagctgtaagaacggataagcaagctgttgaaatacccaagagcccactggtgagagactcaatgcggggggcagcttttttgtcaagttcagtggacctgatgtcccctaagaatgagacatcgaatttggaacttgcatatgggcttcagaggggaccggccatgggattgtcaagctggtctcagggtatgcagctaccaaacacacagctgcagagctcaagcaacagcctacttgagcaaagtgcaagattaaactcaaattttagtgcgccatcttattcagacaacaatcaattctaccaacctgcaacaattcatgggtaccagctcacatcttacttgaaacagatgaatgccagcagaaacccttactctagcatgccactggacccacagcggcttccaaaatcatctgtgtctgctgtgccaacctatgttgattccatgatgaatgctcgtaatcataatctgcttgcttcactgggtgctactccttcacagattcctgcaacatcccgtgtaggctcaatgatgcctgaaagatcgtattacgatccttccactgttgatgggaatgaaaattctggttcgcctgcttactcaaaaaagtaccacagctcacctgatatgtctggaataatcgctgcaagtagagctgcactgttgaatgaagcaaagttgggtggtgccattggaccccagtcataccttagcaggctggcgtcagaaagatctcaatatgcaaactcagcagccaggcctgcggctccattagcatttgatgagctttcacctcctaagctccagagtgatatcttctcggcgcagtcgagcatgagcccaagtgctagatccctttgggctaagcaaccatttgagcaactgtttggcatgtcaagtgcagagctcagtaaaggtgacttcaatctttcaggcagatcaggtggcatggccaaggatgatttctcttataaggaatctgagacaaagcttcttcagtccctcagattctgcattatgaagctccttaagctagagggatcagggtggctgttcaagcaaaatggtggttgcgatgaagaactaattgaccgagttgctgcatctgagaagctattgatgcaagggactactgagaatcaactgcttcatggtgatcttcagcaacatacttctgatcaggtgggcatccaatacatgcgcacacttcccaactgtggggaggactgtgtttggcgcgcatcactcgttgttagttttggtgtctggtgcatccgccgagtgctggacatgtctctagtggaaagcagaccagaactttgggggaagtatacctatgtccttaaccgtcttcagggaatcttggacccagcattctccaagcctcggagtgctctgaccatatgtgcttgtcttcagaaagacatcagagtgctcaatagtccacccggcagtgggctaacagccatgggtcccatccccataccaatccgtggcaccttcacaactgcaggtgtggttctggagacgatcaaggatgtggagaccgcagtctcaggccgcaagggcaggagtggcacagcagcgggcgacgtcgccttccccaaggggaaggagaacctggcctctgtgctgaagcggtacaagcggaggctcgccagcaagggacagtag

SEQ ID NO: 9338 - protein, 1260 aa, Sorghum bicolor
  misc_feature: Ceres ANNOT ID no. 6099970
  misc_feature (44)..(383): Pfam Id: Nramp Pfam Desc: Natural resistance-associated macrophage protein
  misc_feature (1)..(1260): NCBI GI: 38607384 NCBI Desc: ethylene insensitive 2 [zea mays]
  misc_feature (17)..(1260): NCBI GI: 37622421 NCBI Desc: ein2 [oryza sativa (japonica cultivar-group)]
  misc_feature (17)..(1260): NCBI GI: 115470643 NCBI Desc: os07g0155600 [oryza sativa (japonica cultivar-group)]
  misc_feature (106)..(1260): NCBI GI: 115470647 NCBI Desc: os07g0157000 [oryza sativa (japonica cultivar-group)]
  misc_feature (121)..(1260): NCBI GI: 34394871 NCBI Desc: manganese transport protein-like protein [oryza sativa (japonica cultivar-group)]
MDATDVQQSMGFMESRGGMPKFFHALGPALLISMGYIDLGKWVAAVEAGSRFGFDLVLLALLFNFTAIVCQYLAACIGTVTGKNLAEICHQEYNQPTCIFLGVQAGLSLLTSELTMIFGIALGFNLLFEYDDLITGICFATVGKKMEGTVNACIAGFALLSYVLGLLVSQPQIPLTMNVIFPKISGESAYSLMALLGANIMAHNFYIHSSVVQGQKKSSAVGLGALFHDHLFSILFIFTGIFMVNYVLMNSAAAESTNTLLITFQDVVELMNQIFVNPLAPTIFLVVLLFSSHIISLTSAIGSQVISQHLFGINLPLSGHRLLLKVFAIVPTLYWAKVAGAEGIYQLLIICQIIQAMLLPSSVIPLFRVASSRSIMGAHRVSLHLEILVFLAFLLMLFSNIIFVAEMLFGDSGWMNNLKGYTGSPVVLPYTVFILVACVSVAFSLYLAVTPLRSGSHEAESHEWSVHSQRELLNTPQEREDVKVDNVTYEEDQRSDVGPSPRDAPDSHPELAMDYIDTSDTAVESDHDSQQSTAYASTAPETCPSPSFTREESKSVVAVNWPEPLEKVPTSTVIEESTVESVVSRITTERDVLVETDVFSGKDKEDTHVLESEKSIVDSTPCVSDDGPPSLTFSRGKGSDAGNGNGSLSRLSGLGRAARRQLAATLDEFWGHLFDYHGKLTQEASTKKFGILLGIDLRTPTTAVRTDKQAVEIPKSPLVRDSMRGAAFLSSSVDLMSPKNETSNLELAYGLQRGPAMGLSSWSQGMQLPNTQLQSSSNSLLEQSARLNSNFSAPSYSDNNQFYQPATIHGYQLTSYLKQMNASRNPYSSMPLDPQRLPKSSVSAVPTYVDSMMNARNHNLLASLGATPSQIPATSRVGSMMPERSYYDPSTVDGNENSGSPAYSKKYHSSPDMSGIIAASRAALLNEAKLGGAIGPQSYLSRLASERSQYANSAARPAAPLAFDELSPPKLQSDIFSAQSSMSPSARSLWAKQPFEQLFGMSSAELSKGDFNLSGRSGGMAKDDFSYKESETKLLQSLRFCIMKLLKLEGSGWLFKQNGGCDEELIDRVAASEKLLMQGTTENQLLHGDLQQHTSDQVGIQYMRTLPNCGEDCVWRASLVVSFGVWCIRRVLDMSLVESRPELWGKYTYVLNRLQGILDPAFSKPRSALTICACLQKDIRVLNSPPGSGLTAMGPIPIPIRGTFTTAGVVLETIKDVETAVSGRKGRSGTAAGDVAFPKGKENLASVLKRYKRRLASKGQ

SEQ ID NO: 9339 - DNA, 1371 bp, Sorghum bicolor
  misc_feature: Ceres ANNOT ID no. 6099978
  misc_feature: Encodes the peptide sequence at SEQ ID NO 9340
atggaagaccctcagaaatctgaaaaccgcaggcaaatccccaccgacatcgtaccgaacatcttgctgaggctgccgaccaaggactttgtccggtcatcctgcgtttgcaaggtgtggtgcagcatcgtcgcagacccctccttccgcaagctccatgtggcccatcatgccgccgccaccgcatcgtcgtcggagccggcggaggtccttcttgtcacagaaacccgcgagcccggaaggagcgacgaggccagcgtcttcaacctttcgagttcaaagcctttgtcccaggtcgccatcccaagcagataccgtctcgccggcgtctgcaacgacctcctgtgcttcgcgctcaaccacgatcaagcgccaccgatcgtgtgcaaccccgccaccggcgagacgctgcagcttccaaaggcgccaccgctccctacaggggaagagctgtcgcatctcttcgtcctagggttcaacccaccgaccaaggaatacaagatgttccggctctccttcccacaatggcacggatccagacatgagacaaatagctacatcgccgtgtacaccctgggcggcggcggcggctggcgccaatgctcctaccgctcccggtttcacccaatcaaatcgccggcgccggtacacatcgacggcaatatattcgtgccggcggctaatctacgcgctcgtgctgcgcgaatgtttgtgctcgatgtggccacggagacgccccgattgtaccgtattccgtacaactacagtgattatcacgagagttgggagatggtggccgacggctttgatctgaacgggcagatgtgcctcgtcgtgaacgtcggcttccatccccagcctcgccttaaggcccagttctgggtcatgcagccgcctggtgagattgagggcaaggacgacgacgacaagctgtattgggatctccggtatagcttcttcctcgatggccccttcgtcttcaacaggccgaggggtgtctggattgaccatacccagaccttgtgctacagggttggaaactctgtgtacagttataacacgagaggaggacactcaccgtcctccaacgacgtcgttgattctctgttgtttgaccaacgactcgagctcccagattctccatgtccatcggtgtcttcttgttggttgaagtttagccggtggagcatctgcggaggttatcgccccagcctgctctctcctctcgtcttcgcgttgccaccatcccaagacgagaaggcgaataaacggccacagttcgagcacactttgctacgtgctctcagggcgtccgcaacaaatgagggacgacatgattttccatatacttttagcttaattatatattga

SEQ ID NO: 9340 - protein, 456 aa, Sorghum bicolor
  misc_feature: Ceres ANNOT ID no. 6099978
  misc_feature (8)..(55): Pfam Id: F-box Pfam Desc: F-box domain
  misc_feature (4)..(257): NCBI GI: 86439730 NCBI Desc: fimbriata-like protein [triticum aestivum]
  misc_feature (4)..(257): NCBI GI: 86439727 NCBI Desc: fimbriata-like protein [triticum aestivum]
  misc_feature (13)..(244): NCBI GI: 15220834 NCBI Desc: f-box family protein [arabidopsis thaliana]
  misc_feature (4)..(199): NCBI GI: 86438632 NCBI Desc: fimbriata-like protein [brachypodium sylvaticum]
  misc_feature (13)..(193): NCBI GI: 42571859 NCBI Desc: f-box family protein [arabidopsis thaliana]
  misc_feature: The sequence is a functional homolog of SEQ ID NO. 456 in the 11/188,298 US application
MEDPQKSENRRQIPTDIVPNILLRLPTKDFVRSSCVCKVWCSIVADPSFRKLHVAHHAAATASSSEPAEVLLVTETREPGRSDEASVFNLSSSKPLSQVAIPSRYRLAGVCNDLLCFALNHDQAPPIVCNPATGETLQLPKAPPLPTGEELSHLFVLGFNPPTKEYKMFRLSFPQWHGSRHETNSYIAVYTLGGGGGWRQCSYRSRFHPIKSPAPVHIDGNIFVPAANLRARAARMFVLDVATETPRLYRIPYNYSDYHESWEMVADGFDLNGQMCLVVNVGFHPQPRLKAQFWVMQPPGEIEGKDDDDKLYWDLRYSFFLDGPFVFNRPRGVWIDHTQTLCYRVGNSVYSYNTRGGHSPSSNDVVDSLLFDQRLELPDSPCPSVSSCWLKFSRWSICGGYRPSLLSPLVFALPPSQDEKANKRPQFEHTLLRALRASATNEGRHDFPYTFSLIIY

SEQ ID NO: 9341 - DNA, 825 bp, Sorghum bicolor
  misc_feature: Ceres ANNOT ID no. 6099988
  misc_feature: Encodes the peptide sequence at SEQ ID NO 9342
atggttccaaatacagttcgtgtagcagtaggaatcctaggaaatgctgcttccatgctcctctacgcagcccctatgtatgcatcatatatatgtatcctgaattatattactatgcatgatcggaaacaattagtcttattgacgttcagaagggtgataaagaagggcaacgtggaggaattctcatgcgtgccatacatcctagctctgttcaactgcctcctatacacctggtacgggctcccagtagtgagctccggatgggagaaccttcccgtcgctaccatcaacggactgggcatcctgctagagatcacattcatcggcatatacatatggtttaggtttgccttgcagcttgtgcttcctgtcctggcgttgttcgccttgacagcggctttgtcgagctttatggcgcatacgcaccacatgcgcaaggtttttgtggggagtgttggtctggtggcttccatatccatgtacagctctccaatggtggctgctaagcgagtcatagagacgaaaagcgtggagttcatgccgttctacttgtcgctgttctccttcctgtccagcgctctctggatgatatacgggctcctcgggagggactttttcatcgcgtcgccaaacttcatcggcgttccgatgggcatgcttcagctgctgctgtactgcatctacaggagagaccacggggcagcagccgaagcagaggtgcgtgtgcatggcgccgccgctgatgaggagaagggcctgaaagcagcggtgccgatggccgtgctggtgcagccgcaggagacaactgatgcaagcaagtag

SEQ ID NO: 9342 - protein, 274 aa, Sorghum bicolor
  misc_feature: Ceres ANNOT ID no. 6099988
  misc_feature (8)..(120): Pfam Id: MtN3_slv Pfam Desc: MtN3/saliva family
  misc_feature (148)..(234): Pfam Id: MtN3_slv Pfam Desc: MtN3/saliva family
  misc_feature (47)..(271): NCBI GI: 9758000 NCBI Desc: mtn3 protein-like [arabidopsis thaliana]
  misc_feature (6)..(271): NCBI GI: 34146818 NCBI Desc: at5g53190 [arabidopsis thaliana]
  misc_feature (47)..(261): NCBI GI: 20161429 NCBI Desc: b1065e10.2 [oryza sativa (japonica cultivar-group)]
  misc_feature (49)..(231): NCBI GI: 56785283 NCBI Desc: mtn3-like [oryza sativa (japonica cultivar-group)]
  misc_feature (49)..(240): NCBI GI: 21592843 NCBI Desc: contains similarity to medicago truncatula mtn3 (gb:y08726) [arabidopsis thaliana]
  misc_feature: The sequence is a functional homolog of SEQ ID NO. 328 in the 11/188,298 US application
MVPNTVRVAVGILGNAASMLLYAAPMYASYICILNYITMHDRKQLVLLTFRRVIKKGNVEEFSCVPYILALFNCLLYTWYGLPVVSSGWENLPVATINGLGILLEITFIGIYIWFRFALQLVLPVLALFALTAALSSFMAHTHHMRKVFVGSVGLVASISMYSSPMVAAKRVIETKSVEFMPFYLSLFSFLSSALWMIYGLLGRDFFIASPNFIGVPMGMLQLLLYCIYRRDHGAAAEAEVRVHGAAADEEKGLKAAVPMAVLVQPQETTDASK

SEQ ID NO: 9343 - DNA, 501 bp, Sorghum bicolor
  misc_feature: Ceres ANNOT ID no. 6100013
  misc_feature: Encodes the peptide sequence at SEQ ID NO 9344
atggacgccctgacgcgcctccaccgctccctcgtcggcggcgacgacgacgaggatccgccggaggactccatccttgctgacaccgagggcctctgctccctctcccctctccagaggatctacgccttcgcggcatgcttggtggccggactcgccctcatgatcttgtcttttattgtcttcgtgagacctatcaagtttgcagtcatgtttacgtttggaaacatattggcagttgggagcacagcctttgttatggggccacaaaaacagataaggatgatgtttgatccagttcgtctgtatgcgacagctatttatgttggatgtgttgttttggctctaatctttgctctttggattcatgacaagctgctaacgctgattgcaatcatatgtgagatctgtgccctattttggtacagtttgagctacattccattcgcgcgaaggatggtttctgacctgatggtgaagttatgtgacactgaactttga

SEQ ID NO: 9344 - protein, 166 aa, Sorghum bicolor
  misc_feature: Ceres ANNOT ID no. 6100013
  misc_feature (35)..(154): Pfam Id: SFT2 Pfam Desc: SFT2-like protein
  misc_feature (9)..(162): NCBI GI: 54641745 NCBI Desc: ga18661-pa [drosophila pseudoobscura]
  misc_feature (9)..(166): NCBI GI: 21553317 NCBI Desc: chromosome 6 open reading frame 83 [homo sapiens]
  misc_feature (9)..(166): NCBI GI: 55154495 NCBI Desc: mgc105508 protein [rattus norvegicus]
  misc_feature (3)..(166): NCBI GI: 6594627 NCBI Desc: prgr1 [homo sapiens]
  misc_feature (9)..(158): NCBI GI: 24667600 NCBI Desc: cg5104-pb [drosophila melanogaster]
MDALTRLHRSLVGGDDDEDPPEDSILADTEGLCSLSPLQRIYAFAACLVAGLALMILSFIVFVRPIKFAVMFTFGNILAVGSTAFVMGPQKQIRMMFDPVRLYATAIYVGCVVLALIFALWIHDKLLTLIAIICEICALFWYSLSYIPFARRMVSDLMVKLCDTEL

SEQ ID NO: 9345 - DNA, 1113 bp, Sorghum bicolor
  misc_feature: Ceres ANNOT ID no. 6100016
  misc_feature: Encodes the peptide sequence at SEQ ID NO 9346
atgaggcgccgactgctgctggcgtgcctggctctgctggtgccgttgctggcggcgccgcgggcggccgtggcgcgggagtacgcggcggtgttcagcttcggcgactccctgtcggacaccggcaacctctgcgtggacggcatcccggactacctcgccacggcgcgctcgccgtacggcatgacctacttcggctaccccacggggcgcgtctccgacggccgcgtcgtcatcgacttcatcgcgcaggagctggggctgccgctgctgccgccgtccaaggcgaagaacgcgacgttccaccgcggcgccaacttcgccatcacgggcgccacggcgctgggcatggacttcttcgaggagcacgggctggcgcgcgccgtgtggagctccggctccctccacacccagatcgggtggttccgggacatgaagcccagcatctgcagctccccgcaagagtgccgggagctgttccggcggtcgctgttcgtggtgggagagttcggtggcaacgactacgggtcgaccatcttctcgttccggccactggaggaggtggacgcgctggtgccgcacgtggtgggcgccatcgcgcggggcatcgaggagctgatcgcggagggcgccgtggacctggtggtaccggggctgctccccacgggatgcttccccatgttcctgtccacgttcagcgacaagccggcggcggcgtacggtccccggagcgggtgcgtcaaggagctcaacacgctgtcgtgggtgcacaacgccgcactccagcgcaaggtggaggagctccgcgccaggcaccccgccgtgcgcatcgtctacgctgactactacacgccggctatccagttcatcctccacgccgaggagtacgggatgctgaagcagatgccgcgagcgtgctgcggtgcgtcaggtgtgggggagtacaacttcaacctgacgtccaagtgcggcgagccgggggcgtacgcgtgccaggacccttccaaccactggagctgggacggcgcccacctcaccgaagccgcctacggccacatcgccaagggctggctctacgggcccttcgccgacccgccaatcctccacccttga

SEQ ID NO: 9346 - protein, 370 aa, Sorghum bicolor
  misc_feature: Ceres ANNOT ID no. 6100016
  misc_feature (31)..(357): Pfam Id: Lipase_GDSL Pfam Desc: GDSL-like Lipase/Acylhydrolase
  misc_feature (5)..(367): NCBI GI: 47497746 NCBI Desc: lipase-like [oryza sativa (japonica cultivar-group)]
  misc_feature (5)..(367): NCBI GI: 115445329 NCBI Desc: os02g0250400 [oryza sativa (japonica cultivar-group)]
  misc_feature (10)..(368): NCBI GI: 115435284 NCBI Desc: os01g0216500 [oryza sativa (japonica cultivar-group)]
  misc_feature (25)..(368): NCBI GI: 115435276 NCBI Desc: os01g0215700 [oryza sativa (japonica cultivar-group)]
  misc_feature (7)..(358): NCBI GI: 48958181 NCBI Desc: esterase [alopecurus myosuroides]
MRRRLLLACLALLVPLLAAPRAAVAREYAAVFSFGDSLSDTGNLCVDGIPDYLATARSPYGMTYFGYPTGRVSDGRVVIDFIAQELGLPLLPPSKAKNATFHRGANFAITGATALGMDFFEEHGLARAVWSSGSLHTQIGWFRDMKPSICSSPQECRELFRRSLFVVGEFGGNDYGSTIFSFRPLEEVDALVPHVVGAIARGIEELIAEGAVDLVVPGLLPTGCFPMFLSTFSDKPAAAYGPRSGCVKELNTLSWVHNAALQRKVEELRARHPAVRIVYADYYTPAIQFILHAEEYGMLKQMPRACCGASGVGEYNFNLTSKCGEPGAYACQDPSNHWSWDGAHLTEAAYGHIAKGWLYGPFADPPILHP

SEQ ID NO: 9347 - DNA, 1692 bp, Sorghum bicolor
  misc_feature: Ceres ANNOT ID no. 6100023
  misc_feature: Encodes the peptide sequence at SEQ ID NO 9348
atggctgccaatcaggaggagcaggagcagcgccgccgccttctcgccgtcgcgacccgcttccctctcccaagcggctgcaggttctcctatggcacggcgggcttccgcgccgacggcgccaccatggcgcctgccgtctgccgcgccggcatcctcgccgcgctccgctccgtcaagctcgcgggcgccgccgtcgggatcgtcatcaccgcctcccacaaccccgtcggcgacaacggcgtcaagatcgccgaccccgacggcggcatgatggctcagcactgggagcccttcgccgacgccctcgccaacgcccccgaccccgacgccctcctccagttggtgcttcagtttgccaaggacgagggcattccattggggggccaagacacagcgcaagttctgcttggtagagataccagacccacaggagcttatctgcttgatgctgcactgcaggggataaatgctatagttggcgcacgcgcaattgacatgggaattttgaccacccctcaactgcattggatggtccggagcaaaaacagaggtgtcaaggcttccgagtcagattattttatgcaacttatcggatcgttcaggcgtatgttggaattagtgccaaaagataaaggtggggatgaggctgccaagaaactaattgtggatggagcaaatggcattggtggggtgaagctcgaacaaataaaggcggagctttcaggcctagatattagtgtgaggaattcgggcaaggaaggagaagggatactaaatcacatgtgtggtgcagactttgttcaaaaggagcgagttactccacatgggtttagccctgaagatgttggtgtaaggtgtgcaagtttggatggtgatgctgatcgactcgtctacttccgtttgtcatcagctagtgacaataggattgatcttgttgatggagataagatactatctctatttgccctatttatcagagagcagctagatattattaataacaatggtggtcaagcaaacaaatcattgtctgcaaggcttggaatagttcagacagcttatgcaaatggggcatcgacacaatttctaaagagccttggcctagaagtggtattcactcctacaggagtgaaatatctgcacaaaagggcattggagtatgacattggtatatattttgaggccaatggacatgggactgttgtattctcagaggacctcatctctcaactagagtcattaagcaatgagctcgcctctcaagctgccactggttcagcacagtatcgtgctgtaatgagattgttgctagcaagtcagctgatcaatcaggcagtaggtgatgctctgagtggtttgcttttagtggaggctattttacagtataagggatggtcatttcagagttggtgtgaactatacagtgatttgcctagtagacagctaaaagtgaaagttaaagatcaaagtgtaattgttacaacagatgcagagacaaaagttagtcagccttctagtttgcaagaattaatagataaggagactgccaactacaccaacgggcgatgctttgtgcgtccatctggtacagaagatgtggtacgggtgtatgcagaggcgtctacacaggtggaagctgacagtcttgcaaaatctgtggcacaccatgtggaacgccttcttggataa

SEQ ID NO: 9348 - protein, 563 aa, Sorghum bicolor
  misc_feature: Ceres ANNOT ID no. 6100023
  misc_feature (9)..(563): NCBI GI: 75225576 NCBI Desc: phosphoacetylglucosamine mutase (pagm) (acetylglucosamine phosphomutase) (n-acetylglucosamine-phosphate mutase)
  misc_feature (8)..(563): NCBI GI: 92896114 NCBI Desc: phosphoglucosamine mutase [medicago truncatula]
  misc_feature (7)..(563): NCBI GI: 19715620 NCBI Desc: at5g18070/mrg7_2 [arabidopsis thaliana]
  misc_feature (28)..(559): NCBI GI: 6320777 NCBI Desc: essential n-acetylglucosamine-phosphate mutase, a hexosephosphate mutase involved in the biosynthesis of chitin [saccharomyces cerevisiae]
  misc_feature (26)..(555): NCBI GI: 44981457 NCBI Desc: acr015wp [eremothecium gossypii]
  misc_feature (9)..(563): SWISSPROT Homolog: EC 5.4.2.3 Phosphoacetylglucosamine mutase
MAANQEEQEQRRRLLAVATRFPLPSGCRFSYGTAGFRADGATMAPAVCRAGILAALRSVKLAGAAVGIVITASHNPVGDNGVKIADPDGGMMAQHWEPFADALANAPDPDALLQLVLQFAKDEGIPLGGQDTAQVLLGRDTRPTGAYLLDAALQGINAIVGARAIDMGILTTPQLHWMVRSKNRGVKASESDYFMQLIGSFRRMLELVPKDKGGDEAAKKLIVDGANGIGGVKLEQIKAELSGLDISVRNSGKEGEGILNHMCGADFVQKERVTPHGFSPEDVGVRCASLDGDADRLVYFRLSSASDNRIDLVDGDKILSLFALFIREQLDIINNNGGQANKSLSARLGIVQTAYANGASTQFLKSLGLEVVFTPTGVKYLHKRALEYDIGIYFEANGHGTVVFSEDLISQLESLSNELASQAATGSAQYRAVMRLLLASQLINQAVGDALSGLLLVEAILQYKGWSFQSWCELYSDLPSRQLKVKVKDQSVIVTTDAETKVSQPSSLQELIDKETANYTNGRCFVRPSGTEDVVRVYAEASTQVEADSLAKSVAHHVERLLG

SEQ ID NO: 9349 - DNA, 807 bp, Sorghum bicolor
  misc_feature: Ceres ANNOT ID no. 6100027
  misc_feature: Encodes the peptide sequence at SEQ ID NO 9350
atgggctccgtccccttcgccgacgccgggctcctcgacgcgttctacggcggcggacatggacacaacgactacgggcttgttagccagcagctgacgtcgcctgtcgtcttggacggcggcgccggcgggctgctggacgccggtgcggcttccacggaggaggaggcgccgaagaggaagggagaccaccgccgggacgacaaggcggcgatggccctcaagaaccatagcgaggcggagcggcgccgcagggagaggatcaacgcgcacctcgccacgctccggaccatggtgccctgctccgacaagatggacaaggccgcgctgctggcggaggtgataacccacgtgcagaagctcaaggcgaccgcggcgcggatccgcgaccactgcgccgtcccggccgacgcggacgacgtcgccgtcgagctggtccagggcgcgcctccatctacgaccggcggcggcgtcctcgtgagggcgacgctgagctgcgacgacggcgccgacgtgttcgcggacgtcaagcaggcgctgcggccgctgcggctcagcgtcgtcggctccgaggtcaccacgctaggcggccgcgtccgcttcaccttcctcatcatgtcgtcgtcgtcgtcgtgcggcaacggcagcggcggcgacgtgggcgccgtcgtcgtcgagtcggtgcaccaggcgctccagtccgtcctcgacagggccaactccgcgctcgagttcgcgccgagggcgtcgcttctcaacaagcggcggagggtctccacgttcgagtcctcgagctcctcttcttga

SEQ ID NO: 9350 - protein, 268 aa, Sorghum bicolor
  misc_feature: Ceres ANNOT ID no. 6100027
  misc_feature (73)..(122): Pfam Id: HLH Pfam Desc: Helix-loop-helix DNA-binding domain
  misc_feature (1)..(268): NCBI GI: 115435302 NCBI Desc: os01g0218100 [oryza sativa (japonica cultivar-group)]
  misc_feature (45)..(265): NCBI GI: 92874661 NCBI Desc: helix-loop-helix dna-binding [medicago truncatula]
  misc_feature (56)..(239): NCBI GI: 92891143 NCBI Desc: probable dna-binding protein t6l1.1 [imported] - arabidopsis thaliana [medicago truncatula]
  misc_feature (22)..(235): NCBI GI: 42409474 NCBI Desc: dna-binding protein-like [oryza sativa (japonica cultivar-group)]
  misc_feature (40)..(143): NCBI GI: 50252324 NCBI Desc: dna binding protein-like [oryza sativa (japonica cultivar-group)]
  misc_feature: The plant is abnormally small.
  misc_feature: The sequence is a functional homolog of SEQ ID NO 1897 in the 10/374,780US patent application
  misc_feature: The sequence is a functional homolog of SEQ ID NO 1898 in the 10/374,780US patent application
  misc_feature: The sequence is a functional homolog of SEQ ID NO 1899 in the 10/374,780US patent application
  misc_feature: The sequence is a functional homolog of SEQ ID NO 1900 in the 10/374,780US patent application
  misc_feature: The sequence is a functional homolog of SEQ ID NO 1901 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 1897 in the 20060162006 US patent application
  misc_feature: The sequence is a functional homolog of SEQ ID NO 1898 in the 20060162006 US patent application
  misc_feature: The sequence is a functional homolog of SEQ ID NO 1899 in the 20060162006 US patent application
  misc_feature: The sequence is a functional homolog of SEQ ID NO 1900 in the 20060162006 US patent application
  misc_feature: The sequence is a functional homolog of SEQ ID NO 1901 in the 20060162006 US patent application
  misc_feature: Functional homolog of the protein sequence given in SEQ ID NO 13531
  misc_feature: The sequence is a functional homolog of SEQ ID NO. 414 in the 11/188,298 US application
MGSVPFADAGLLDAFYGGGHGHNDYGLVSQQLTSPVVLDGGAGGLLDAGAASTEEEAPKRKGDHRRDDKAAMALKNHSEAERRRRERINAHLATLRTMVPCSDKMDKAALLAEVITHVQKLKATAARIRDHCAVPADADDVAVELVQGAPPSTTGGGVLVRATLSCDDGADVFADVKQALRPLRLSVVGSEVTTLGGRVRFTFLIMSSSSSCGNGSGGDVGAVVVESVHQALQSVLDRANSALEFAPRASLLNKRRRVSTFESSSSSS

SEQ ID NO: 9351 - DNA, 1203 bp, Sorghum bicolor
  misc_feature: Ceres ANNOT ID no. 6100030
  misc_feature: Encodes the peptide sequence at SEQ ID NO 9352
atggcgtctctcgctgccgtcaagaaggtgctggtgctggtgccgatcacggcgggctcggagcccgtggaggcgttcgtccccatcgccgtcctccgccgcgcgggcgccgacgtcaccgtcgcggccgcgggtgccggagccggcctgcgcgtccacgccatgtacggggtcaccgtcgtcgcggacgccaacgtcgccgactgcgccgacgcctcctacgacctcgtcgccctccccggaggcgtccccggcgcggacaacctcggcggctgcgcggcgctggagagcatcgtgaggcgccaggcgctcgggggcggcctgtacgccgccatctgcgccgcgccgccgctggcgctggcgcgctggggcctgctcgacggcgtcaaggcaactgcgcatccggcgttcgtggacaagttcccggcggaggtggccgccgtggacgcgaacgtggtggtcgacggcagggtagtgacggggcgtggcccggcgccggccatggagttcgcgctcgctctcgtggaacagctctacggcaaggacaaggttgacgagattgccaaaccaatgatggtcagatatgaacccgggtacgccttcaaggaactgaacccggtccagtggcagtgcagcggcacgcccaaggtcctgatcccggtggccaacgggagcgacgagatggaggtgctcgtgaccgtcgacgtgctgcgccgggccaatgcggacgtcgtggtggcgtcggccgagggcggcgacgccgaggtcgtcgtcgtcgcgcgccacggcacgaggatcgtcgccgacgcgctgctggtcgacgccgtcgccgccggccagcagttcgacttcgtcgtcgtgccgggcggcatggccggcgccaagacgctggccggcacggaggcgctcgtggcgctgctgaaggagcatgcggcggcgggcagggcgtacggcgccatcggcgccgccacggcggaggtgctggagccgcacggcctcctcgagctcgagggcaagaaggcgacgacgacgtgcgcgtccatggcggactcccgcgagtgcgggagcagggtggtggtggacgggaacctggccacgagcagcggccccgggacggccatggagttcgcgctggccgtcgtggagaagctgctcggcgccgaggcggcaagggaggtggcggaagccctgctgttcgtctga

SEQ ID NO: 9352 - protein, 400 aa, Sorghum bicolor
  misc_feature: Ceres ANNOT ID no. 6100030
  misc_feature (38)..(179): Pfam Id: DJ-1_PfpI Pfam Desc: DJ-1/PfpI family
  misc_feature (243)..(385): Pfam Id: DJ-1_PfpI Pfam Desc: DJ-1/PfpI family
  misc_feature (5)..(400): NCBI GI: 115435298 NCBI Desc: os01g0217800 [oryza sativa (japonica cultivar-group)]
  misc_feature (1)..(400): NCBI GI: 115468368 NCBI Desc: os06g0531200 [oryza sativa (japonica cultivar-group)]
  misc_feature (12)..(398): NCBI GI: 33149230 NCBI Desc: thij-like protein [brassica rapa subsp. pekinensis]
  misc_feature (216)..(398): NCBI GI: 146305868 NCBI Desc: dj-1 family protein [pseudomonas mendocina ymp]
  misc_feature (7)..(189): NCBI GI: 123472608 NCBI Desc: dj-1 family protein [trichomonas vaginalis g3]
MASLAAVKKVLVLVPITAGSEPVEAFVPIAVLRRAGADVTVAAAGAGAGLRVHAMYGVTVVADANVADCADASYDLVALPGGVPGADNLGGCAALESIVRRQALGGGLYAAICAAPPLALARWGLLDGVKATAHPAFVDKFPAEVAAVDANVVVDGRVVTGRGPAPAMEFALALVEQLYGKDKVDEIAKPMMVRYEPGYAFKELNPVQWQCSGTPKVLIPVANGSDEMEVLVTVDVLRRANADVVVASAEGGDAEVVVVARHGTRIVADALLVDAVAAGQQFDFVVVPGGMAGAKTLAGTEALVALLKEHAAAGRAYGAIGAATAEVLEPHGLLELEGKKATTTCASMADSRECGSRVVVDGNLATSSGPGTAMEFALAVVEKLLGAEAAREVAEALLFV

SEQ ID NO: 9353 - DNA, 918 bp, Sorghum bicolor
  misc_feature: Ceres ANNOT ID no. 6100033
  misc_feature: Encodes the peptide sequence at SEQ ID NO 9354
atgccaccccataagattgaaactgggcatcaagatgtggtgcatgatatcgccatggattactatgggaagcgcctagctacagcctcctctgataacacaataaagatcattggcgtaagtggaaactcacaccagcagcttgcaactttgagtggacaccagggcccagtatggcaagtcgcatgggctcatcccaagtttggttccatgctcgcatcctgcagctacgacggccgggtgatcatctggaaggaaggaagcaagcctgatgaatgggcactggtacacacctttgctgagcacaagtcctccgtgaattccatcgcatgggcgcctcatgagctgggtctatgcttggcttgtggttcatcagatgggaacatttcagtcttcactgctcgttctgatggaggctgggacaccacacgtattgatcaggcgcatccagtcggtgtgacctcagtttcttgggccccagcaatggcaccgggagctctaatcagtgcaggatcttctggtcagtttgagtatgttcagaaactcgcttctggtggctgcgacaacacggtgaaggtgtggaagctcaacaatgggagttggcggatggactgtttccctgccttacagatgcacaaggactgggtgagagatgttgcgtgggcgccaaacctgggccttccaaagtccaccattgccagcgcctctcaggatggaacagttgttatctggacagcagcaaaagaaggcgagcagtgggaaggccaggtgctgtatgatttcaggacccctgtgtggaggctgtcatggtcactgactgggaacatattggcggtgtctgatggcaacaacaatgtgaccctgtggaaggaagctgtcgatggcgaatggcagcaagtgacgactgttgagccataa

SEQ ID NO: 9354 - protein, 305 aa, Sorghum bicolor
  misc_feature: Ceres ANNOT ID no. 6100033
  misc_feature (1)..(39): Pfam Id: WD40 Pfam Desc: WD domain, G-beta repeat
  misc_feature (45)..(85): Pfam Id: WD40 Pfam Desc: WD domain, G-beta repeat
  misc_feature (93)..(133): Pfam Id: WD40 Pfam Desc: WD domain, G-beta repeat
  misc_feature (140)..(195): Pfam Id: WD40 Pfam Desc: WD domain, G-beta repeat
  misc_feature (203)..(245): Pfam Id: WD40 Pfam Desc: WD domain, G-beta repeat
  misc_feature (1)..(304): NCBI GI: 18147582 NCBI Desc: sec13p [oryza sativa]
  misc_feature (1)..(304): NCBI GI: 83283979 NCBI Desc: protein transport sec13-like protein [solanum tuberosum]
  misc_feature (6)..(303): NCBI GI: 12805321 NCBI Desc: sec13l1 protein [mus musculus]
  misc_feature (6)..(303): NCBI GI: 54261633 NCBI Desc: sec13-like 1 [rattus norvegicus]
  misc_feature (6)..(303): NCBI GI: 52632407 NCBI Desc: sec13-like 1, isoform a [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MPPHKIETGHQDVVHDIAMDYYGKRLATASSDNTIKIIGVSGNSHQQLATLSGHQGPVWQVAWAHPKFGSMLASCSYDGRVIIWKEGSKPDEWALVHTFAEHKSSVNSIAWAPHELGLCLACGSSDGNISVFTARSDGGWDTTRIDQAHPVGVTSVSWAPAMAPGALISAGSSGQFEYVQKLASGGCDNTVKVWKLNNGSWRMDCFPALQMHKDWVRDVAWAPNLGLPKSTIASASQDGTVVIWTAAKEGEQWEGQVLYDFRTPVWRLSWSLTGNILAVSDGNNNVTLWKEAVDGEWQQVTTVEP

SEQ ID NO: 9355 - DNA, 375 bp, Sorghum bicolor
  misc_feature: Ceres ANNOT ID no. 6100051
  misc_feature: Encodes the peptide sequence at SEQ ID NO 9356
atgagacgacctcacgccgccgccgctaccgctctcgctgtcctcctcctcctcctgttcctcgccgtcgcgttgatccacagcaacggcggcctggcgaggaggaggccgacgaggtgggccgccgccgtcccgaggaagatgctgctcgccatgacaagcttcgacgctgccgcctcgccctcgtcaacagctggtcgtcaccaccaccaccatcttcatcatcatcaccaccaccaccatcttcatcatcgatggaaccggcacggggttattccatcacttccaccgtcagcgggtgacgaggcgatcgatccgcggtacggcgtgcagaagaggctggtgccttcaggccccaaccccttgcatcactga

SEQ ID NO: 9356 - protein, 124 aa, Sorghum bicolor
  misc_feature: Ceres ANNOT ID no. 6100051
  misc_feature (36)..(121): NCBI GI: 42563995 NCBI Desc: zinc finger (c3hc4-type ring finger) family protein [arabidopsis thaliana]
  misc_feature (68)..(89): NCBI GI: 15596494 NCBI Desc: probable metal transporter [pseudomonas aeruginosa pao1]
  misc_feature (97)..(124): NCBI GI: 44917497 NCBI Desc: at1g73965 [arabidopsis thaliana]
  misc_feature (60)..(89): NCBI GI: 37194901 NCBI Desc: pou12 protein [danio rerio]
  misc_feature (60)..(89): NCBI GI: 42406356 NCBI Desc: pou domain gene 12 [danio rerio]
MRRPHAAAATALAVLLLLLFLAVALIHSNGGLARRRPTRWAAAVPRKMLLAMTSFDAAASPSSTAGRHHHHHLHHHHHHHHLHHRWNRHGVIPSLPPSAGDEAIDPRYGVQKRLVPSGPNPLHH

SEQ ID NO: 9357 - DNA, 1053 bp, Sorghum bicolor
  misc_feature: Ceres ANNOT ID no. 6100052
  misc_feature: Encodes the peptide sequence at SEQ ID NO 9358
atgctgagggcggtggtgttcatcgtcttcctcctctccgtcacccggcgctacgggtgctcgcagagctacaacgcgatctacagcttcggcgactccatcgccgacaccggcaacctctgcacgggctccggcggctgcccgtcgtggctcaccaccgggcagccaccctacggtaacacccacttcgggcaccccaccggccggtgcaccgacggccgcgtcatcgtcgacttcctcgctgatcactttggcttgccgcttcttccgccgtccaaggcgatcggcgccggcgacgtcaagaagggcgcgaacatggccatcatcggcgccaccaccatggatttcgaattcttccagaagcacggcctcggcaacagcatctggaacaacggccccttgggtacacagatccagtggttccagcagctcatgccctccatctgcggcaccggtgccgaatgccagagctacttcaacaactccctgttcgtcgtcggcgagttcgggggcaacgattacaacgcgccgctcttcggcggcacggccatggccgagacgctgatcgaactgggcgcggtggacgtggtggtgccgggggtgctgccgatcgggtgcttcccgctgtacctgacgctgtaccagagctcgagcaaggacgactacgacgagatcggctgcctcaagagcttcaacaacctgtccagctaccacaacgagctgctgaagcaggcggtggccggcctgcagagcaagcacgccgccggagtccggctcatgtacgccgacttgtacgcgcaggtcgcggacatggtccggtcaccggagaccttcgggctaaaatacgggctgaaagtgtgctgcggcgccggcgggcagggctcctacaactacaacaacaatgcgcggtgcggaatgtccgggtcgagcgcgtgcggcgacccggagaagtacctggtgtgggacggcatccatctcacggacgccgcctaccgttccatcgcggatgcctggctcaagggcacctactgcagccccggcatcctgcgttga

SEQ ID NO: 9358 - protein, 350 aa, Sorghum bicolor
  misc_feature: Ceres ANNOT ID no. 6100052
  misc_feature (27)..(338): Pfam Id: Lipase_GDSL Pfam Desc: GDSL-like Lipase/Acylhydrolase
  misc_feature (3)..(349): NCBI GI: 115466518 NCBI Desc: os06g0157000 [oryza sativa (japonica cultivar-group)]
  misc_feature (24)..(186): NCBI GI: 47497746 NCBI Desc: lipase-like [oryza sativa (japonica cultivar-group)]
  misc_feature (24)..(186): NCBI GI: 115445329 NCBI Desc: os02g0250400 [oryza sativa (japonica cultivar-group)]
  misc_feature (1)..(178): NCBI GI: 9758938 NCBI Desc: gdsl-motif lipase/hydrolase-like protein [arabidopsis thaliana]
  misc_feature (1)..(178): NCBI GI: 21553708 NCBI Desc: gdsl-motif lipase/hydrolase-like protein [arabidopsis thaliana]
MLRAVVFIVFLLSVTRRYGCSQSYNAIYSFGDSIADTGNLCTGSGGCPSWLTTGQPPYGNTHFGHPTGRCTDGRVIVDFLADHFGLPLLPPSKAIGAGDVKKGANMAIIGATTMDFEFFQKHGLGNSIWNNGPLGTQIQWFQQLMPSICGTGAECQSYFNNSLFVVGEFGGNDYNAPLFGGTAMAETLIELGAVDVVVPGVLPIGCFPLYLTLYQSSSKDDYDEIGCLKSFNNLSSYHNELLKQAVAGLQSKHAAGVRLMYADLYAQVADMVRSPETFGLKYGLKVCCGAGGQGSYNYNNNARCGMSGSSACGDPEKYLVWDGIHLTDAAYRSIADAWLKGTYCSPGILR

SEQ ID NO: 9359 - DNA, 1275 bp, Sorghum bicolor
  misc_feature: Ceres ANNOT ID no. 6100056
  misc_feature: Encodes the peptide sequence at SEQ ID NO 9360
atggggaagcacgagttcctcacgccgaaggcgatcgcgaaccggatcaaggcgaaggggctgcagaagctgcggtggtattgccagatgtgccagaagcagtgccgcgacgagaacgggttcaagtgccactgcatgtcggagtcgcaccagcggcagatgcaggtgtttggcatggcgcccgaccgcgtcgtcgagggcttctccgaggagttcttcgagtccttcctctccctgatccgccgcgcgcaccgccactcccgcgtcgccgccaccgtcgtctacaacgagtacatcgccgaccggcaccacgtgcacatgaactccacgcggtgggccacgctcaccgagttcgtcaagttcctggggcgtgagggatactgcaaggtcgaggacacgcccaagggatggttcatgacctacatcgaccgtgactcggagcaggccgtcaaggaccgcctcaagcgcaagaggatcaagtcagacatggctgaggacgagcgccaggagcgcatgatcgcccgccagattgagcgtgcgcagaagtctttatccaaacccaatgatggtgatgttgccgagggtgagtctgagtccggcagtgaagaagagtattcaggctcggatgatgatggggaggagcgggaggatgacgcgaaagaggcaaacaaggcaacagggaagattgcaattgcactgcagaaggctatgccagggcccaaggttaatccttttgaggataagccgaagatgaaattcggttttgacgaagaggatgactcgggtacccaagagaaggtgaaggatgaggtgcccaagaagaagggaaaggatgtgaaggcagcagaggctaggaggtcagcattggacgagctgatgaaggaagaggagaaggccaaggagaggagcaatagaaaggactactggctgtgccctgggattgtggtcaaggtaatgagcaagtcattggcagagaaggggtactacaagcagaaaggggtggtgaagaaagttattgataaatatgttggggagattgagatgttggagagcaagcatgttctcagggtcgaccaagatgaacttgagactgtgatccctcagattggtgggctggtttggattgtaaatggggcttatcgggggtcaaatgccaggttgctctctgtggacacagagaaattctgtgcaaaagtgcaggttgagaaaggcctctatgatgggaaggttcttagggctgtcgaatatgaggacatttgcaagatatcctcttga

SEQ ID NO: 9360 - protein, 424 aa, Sorghum bicolor
  misc_feature: Ceres ANNOT ID no. 6100056
  misc_feature (369)..(402): Pfam Id: KOW Pfam Desc: KOW motif
  misc_feature (273)..(423): NCBI GI: 22327736 NCBI Desc: kin17 dna-binding protein-related [arabidopsis thaliana]
  misc_feature (1)..(275): NCBI GI: 49257754 NCBI Desc: mgc69184 protein [xenopus tropicalis]
  misc_feature (8)..(183): NCBI GI: 23481294 NCBI Desc: drosophila melanogaster kin17 protein [plasmodium yoelii yoelii]
  misc_feature (1)..(204): NCBI GI: 55962358 NCBI Desc: novel protein similar to vertebrate kin, antigenic determinant of reca protein homolog (mouse) (kin) [danio rerio]
  misc_feature (1)..(305): NCBI GI: 51258255 NCBI Desc: mgc81626 protein [xenopus laevis]
MGKHEFLTPKAIANRIKAKGLQKLRWYCQMCQKQCRDENGFKCHCMSESHQRQMQVFGMAPDRVVEGFSEEFFESFLSLIRRAHRHSRVAATVVYNEYIADRHHVHMNSTRWATLTEFVKFLGREGYCKVEDTPKGWFMTYIDRDSEQAVKDRLKRKRIKSDMAEDERQERMIARQIERAQKSLSKPNDGDVAEGESESGSEEEYSGSDDDGEEREDDAKEANKATGKIAIALQKAMPGPKVNPFEDKPKMKFGFDEEDDSGTQEKVKDEVPKKKGKDVKAAEARRSALDELMKEEEKAKERSNRKDYWLCPGIVVKVMSKSLAEKGYYKQKGVVKKVIDKYVGEIEMLESKHVLRVDQDELETVIPQIGGLVWIVNGAYRGSNARLLSVDTEKFCAKVQVEKGLYDGKVLRAVEYEDICKISS

SEQ ID NO: 9361 - DNA, 267 bp, Sorghum bicolor
  misc_feature: Ceres ANNOT ID no. 6100068
  misc_feature: Encodes the peptide sequence at SEQ ID NO 9362
atggcgtccaccaaggtccagcgtatcatgacccagcccatcaacctcatcttccgtttcctccagagcaaagcgcgcatccagatctggctcttcgagcagaaggacctccggattgagggtcgcatcatcggatttgatgagtacatgaacttggtcctcgatgatgctgaggaaatcaacgtcaagaaaaacactaggaaatcactgggccggatactcctcaaaggtgacaacataactttgatgatgaacactggcaagtga

SEQ ID NO: 9362 - protein, 88 aa, Sorghum bicolor
  misc_feature: Ceres ANNOT ID no. 6100068
  misc_feature (19)..(85): Pfam Id: LSM Pfam Desc: LSM domain
  misc_feature (1)..(85): NCBI GI: 7269933 NCBI Desc: small nuclear ribonucleoprotein homolog [arabidopsis thaliana]
  misc_feature (4)..(85): NCBI GI: 116129981 NCBI Desc: ensangp00000022836 [anopheles gambiae str. pest]
  misc_feature (25)..(88): NCBI GI: 115474803 NCBI Desc: os08g0151400 [oryza sativa (japonica cultivar-group)]
  misc_feature (2)..(85): NCBI GI: 54645039 NCBI Desc: ga15004-pa [drosophila pseudoobscura]
  misc_feature (5)..(85): NCBI GI: 50603823 NCBI Desc: mgc89991 protein [xenopus tropicalis]
MASTKVQRIMTQPINLIFRFLQSKARIQIWLFEQKDLRIEGRIIGFDEYMNLVLDDAEEINVKKNTRKSLGRILLKGDNITLMMNTGK

SEQ ID NO: 9363 - DNA, 1725 bp, Sorghum bicolor
  misc_feature: Ceres ANNOT ID no. 6100084
  misc_feature: Encodes the peptide sequence at SEQ ID NO 9364
atgtcgactcgccggcagcaccgccgcggcttcccgctggtcccgctcctcctctccctcctggcggccgccgcgtacggccgcctcatctccgacggcgccccgtcagcaccgctcctctcggtgatccgcctctcgggctccccgccggccgcggccgcggggaaggcggccgaggagaagtgcgagcagtcctacggtttcctaccctgcaccaccaccgtgctcgggaatctcttcctggtgctgacctacgggttcctcatgtacaaggcggccacgtacctgtccacggggagcgagctgctgctcgagatcatggggcccggcctcgtcggcggcctcctcctccctatcctcggcgccctccccgacgcgctcctcgtcctcgtatctggcctctccgggagtaaagaggaggcacagagtcaggtactgatcggaatggggctgcttgctggttccaccgtcttcctcctcaccctgctttggggaacctgtgtcgttgttggcaagtgtgaccttgggccaaaccgtgaggcagttgatgtaacagacaccaagggcttcagcttgactggcactggtattacaaccgatgtgcagaccagctatgctgcgcggatcatggggctatctgttatccccttcatcatcgctcagttcccaaagatgttgaagacccaccacgggcagcgtctagctatgttgctggccctcattgtgtctttcttgcttgtactttcctactgtctgtatcaggttttccagccttggattcagaggaggaagcttgcatatgcgaagcacaagcacgtgatctctgggatactgaagcacgcccaattgcagtcactcggtcgtctgctaaacgatgatggcacacccaatgaagacgtcatcagaaagctgttccacaagatagacatggacgagagccgctccctgtcccgtgccgagctccacgctctcatcatcggtatcaactttgaggaggttgaatttgacaggacagatgcggttgacaaggtcatggctgacttcgatacgtcccgcaacgatatcgttgaggaggaggagtttgtgcaggggatgaagaaatggctcaacgagttcaagcgcaacatgcccgcgggtggcgccttctccagcaagttcaatgaataccacgagaggacacggcaggagcacgaccagctgattgacaggtccgatgaggcggtggagagcgtggagaaccctgggtggtgcatcaccaaggctgtggcactgctgctactgggtgctgccatcgcggccgcgttcgcagacccgctcgtggacgctgttcacaacttctccaacgccacacacatcccgtccttcttcatctcgttcatcgccctcccgcttgcgaccaactccagcgaggccgtctccgccatcatcttcgccagcaggaagaagcagaggacctgctccctgaccttctccgaggtgtatggcggggtgacgatgaacaacacgctgtgcctcggtgtgttcctggcgctcatctacttcaggaacctgacgtgggacttctcatcggaggtgctcatcatcctgctggtctgcgtcgtcatggccctcttcaccagcttccggacgacgttcccgctctggacctgcctcgtcgcctacatgctctatccgttctcgctggtcatcgtctacatcctcgactatgtctttggctggtcatag

SEQ ID NO: 9364 - protein, 574 aa, Sorghum bicolor
  misc_feature: Ceres ANNOT ID no. 6100084
  misc_feature (87)..(257): Pfam Id: Na_Ca_ex Pfam Desc: Sodium/calcium exchanger protein
  misc_feature (430)..(564): Pfam Id: Na_Ca_ex Pfam Desc: Sodium/calcium exchanger protein
  misc_feature (9)..(574): NCBI GI: 115445305 NCBI Desc: os02g0247800 [oryza sativa (japonica cultivar-group)]
  misc_feature (13)..(574): NCBI GI: 7769854 NCBI Desc: f12m16.12 [arabidopsis thaliana]
  misc_feature (89)..(574): NCBI GI: 22137208 NCBI Desc: at1g53210/f12m16_12 [arabidopsis thaliana]
  misc_feature (29)..(566): NCBI GI: 42569601 NCBI Desc: calcium-binding ef hand family protein [arabidopsis thaliana]
  misc_feature (29)..(539): NCBI GI: 10764849 NCBI Desc: f1k23.2 [arabidopsis thaliana]
MSTRRQHRRGFPLVPLLLSLLAAAAYGRLISDGAPSAPLLSVIRLSGSPPAAAAGKAAEEKCEQSYGFLPCTTTVLGNLFLVLTYGFLMYKAATYLSTGSELLLEIMGPGLVGGLLLPILGALPDALLVLVSGLSGSKEEAQSQVLIGMGLLAGSTVFLLTLLWGTCVVVGKCDLGPNREAVDVTDTKGFSLTGTGITTDVQTSYAARIMGLSVIPFIIAQFPKMLKTHHGQRLAMLLALIVSFLLVLSYCLYQVFQPWIQRRKLAYAKHKHVISGILKHAQLQSLGRLLNDDGTPNEDVIRKLFHKIDMDESRSLSRAELHALIIGINFEEVEFDRTDAVDKVMADFDTSRNDIVEEEEFVQGMKKWLNEFKRNMPAGGAFSSKFNEYHERTRQEHDQLIDRSDEAVESVENPGWCITKAVALLLLGAAIAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPFSLVIVYILDYVFGWS

SEQ ID NO: 9365 - DNA, 960 bp, Sorghum bicolor
  misc_feature: Ceres ANNOT ID no. 6100086
  misc_feature: Encodes the peptide sequence at SEQ ID NO 9366
atggcgcagctgccgcccaagatccccaccatggcgccggcgtggccggagttcgggggcgggcaccaccaccaccaccaccagcagcagcagcgcagcccctccgtgggcacgttcctcgccgcgcccatgccgccgccgccgctccaccacccgccgccgcagcagcagcagccgtcgtgggtcgacgagttcctcgacttctccgccgccaagcgcggcgcgcaccgccgctccgtcagcgactccgtggcttttctcgaggccggccccggcgacggcaatgccggcgtcggggcgcacgacttcgaccgcctcgacgacgaccagctcctgtccatgttctccgacgacctgcagccgccgccgccgccaacgacgacgaccgcgcaagccgcgccggtggcgagctcctcgtcgccgtccgaccacaacagcatcaacgacgagaagacggacaggggcgaggccgaggaggcgcagagcaagtgccacggcgacgccaccgccgacgccgcgccggcctccgccgccccggtcgatcctaagcgtgtcaagaggatcctggcgaaccggcagtccgcgcagcggtcgcgcgtgcgcaagctgcagtacatctcggagttggagcgcagcgtcacgtcgcttcagacggaggtgtcggcactgtccccgcgcgtggcgttcctcgaccaccagcgctcgctgctgacgctggggaacagccacctcaagcagcgaatcgccgcgctcgcgcaggacaagatcttcaaagatgctcatcaggaggcactgaggaaggagatcgagaggctgaggcaaatctaccagcagcagagcctgaagagcggcgggggggaggccccagcgcccgacgcggccccggtctgcggcgacaaggacgacatgatcggcagcagcgaggggaccgccgcgcccgcgctcggcccgccctcgtga

SEQ ID NO: 9366 - protein, 319 aa, Sorghum bicolor
  misc_feature: Ceres ANNOT ID no. 6100086
  misc_feature (179)..(233): Pfam Id: bZIP_2 Pfam Desc: Basic region leucine zipper
  misc_feature (179)..(242): Pfam Id: bZIP_1 Pfam Desc: bZIP transcription factor
  misc_feature (1)..(315): NCBI GI: 56201514 NCBI Desc: bzip transcription factor rf2b -like [oryza sativa (japonica cultivar-group)]
  misc_feature (1)..(281): NCBI GI: 30689003 NCBI Desc: bzip transcription factor family protein [arabidopsis thaliana]
  misc_feature (1)..(291): NCBI GI: 113367174 NCBI Desc: bzip transcription factor bzip50 [glycine max]
  misc_feature (149)..(302): NCBI GI: 140053319 NCBI Desc: basic-leucine zipper (bzip) transcription factor [medicago truncatula]
  misc_feature (142)..(304): NCBI GI: 92871553 NCBI Desc: camp response element binding (creb) protein [medicago truncatula]
  misc_feature: The sequence is a functional homolog of SEQ ID NO 1080 in the 10/225,066US patent application
  misc_feature: The sequence is a functional homolog of SEQ ID NO 1362 in the 10/374,780US patent application
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 148 in the 10/412,699US patent application
  misc_feature: The sequence is a functional homolog of SEQ ID NO 1482 in the 10/412,699US patent application
  misc_feature: The sequence is a functional homolog of SEQ ID NO 1483 in the 10/412,699US patent application
  misc_feature: The sequence is a functional homolog of SEQ ID NO 18 in the 10/412,699US patent application
  misc_feature: The sequence is a functional homolog of SEQ ID NO 1834 in the 10/412,699US patent application
  misc_feature: The sequence is a functional homolog of SEQ ID NO 212 in the 10/374,780US patent application
  misc_feature: The sequence is a functional homolog of SEQ ID NO 2266 in the 10/374,780US patent application
  misc_feature: The sequence is a functional homolog of SEQ ID NO 341 in the 11/479,226US patent application
  misc_feature: The sequence is a functional homolog of SEQ ID NO 58 in the 11/375,241US patent application
  misc_feature: Useful for making plants with altered carotene content
  misc_feature: Useful for making plants with modulated endosperm cell number
  misc_feature: Useful for making plants with modulated endosperm cell size
  misc_feature: Useful for making plants with modulated growth and phenotype characteristics
  misc_feature: GREAT-hit functional homolog of the protein sequence given in SEQ ID NO 13519
  misc_feature: GREAT-hit functional homolog of the protein sequence given in SEQ ID NO 13522
  misc_feature: The sequence is a functional homolog of SEQ ID NO 148 in the 20040045049 US patent application
  misc_feature: The sequence is a functional homolog of SEQ ID NO 1482 in the 20040045049 US patent application
  misc_feature: The sequence is a functional homolog of SEQ ID NO 1483 in the 20040045049 US patent application
  misc_feature: The sequence is a functional homolog of SEQ ID NO 18 in the 20040045049 US patent application
  misc_feature: The sequence is a functional homolog of SEQ ID NO 1834 in the 20040045049 US patent application
  misc_feature: The sequence is a functional homolog of SEQ ID NO 1363 in the 10/374,780 US patent application
  misc_feature: The sequence is a functional homolog of SEQ ID NO 1364 in the 10/374,780 US patent application
  misc_feature: The sequence is a functional homolog of SEQ ID NO 1483 in the 10/412,699 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MAQLPPKIPTMAPAWPEFGGGHHHHHHQQQQRSPSVGTFLAAPMPPPPLHHPPPQQQQPSWVDEFLDFSAAKRGAHRRSVSDSVAFLEAGPGDGNAGVGAHDFDRLDDDQLLSMFSDDLQPPPPPTTTTAQAAPVASSSSPSDHNSINDEKTDRGEAEEAQSKCHGDATADAAPASAAPVDPKRVKRILANRQSAQRSRVRKLQYISELERSVTSLQTEVSALSPRVAFLDHQRSLLTLGNSHLKQRIAALAQDKIFKDAHQEALRKEIERLRQIYQQQSLKSGGGEAPAPDAAPVCGDKDDMIGSSEGTAAPALGPPS

SEQ ID NO: 9367 - DNA, 666 bp, Sorghum bicolor
  misc_feature: Ceres ANNOT ID no. 6100096
  misc_feature: Encodes the peptide sequence at SEQ ID NO 9368
atggcgcgccgtggcagcctgctcgccgtcgccgcggcgctgctggtcgccgtcgttgccgcggcggtgccgccgacgtgcgagcgcatcgagtgcccggcgtacgaggtggtggacagcgcgaacgggttcgagatccggcggtacacggacgccatgtggatcaccacggcgcccatcgaggacatctccttcgtcgccgccacgcgcaccggcttcctccagctgttcaactacatccagggcaagaacttgtacaacgagacgatcgagatgactgcgccggtgctgacgcaggtatcgcccagcgacgggcccttctgcgcctcctccttcaccgtcagcttctacgtgccggccaagaaccaggcggacccgccgccggccgaggggctacgcgtggaccgctgggctggggccaggtacgcggccgtgcgccgcttcgggggcttcgtggcggacgccgacgtcggggagcaggcggcgcagctcgacgccagcctccagggcaccaggtgggccgccgccgtcaacgacgcgcgcagggctgacccggcatcgccctacaccgtcgcgcagtacaactcgcccttcgagttcagcggcagggtcaacgagatttggatgctcttcgacgacgccgctgccgccgccaccagtatgtga

SEQ ID NO: 9368 - protein, 221 aa, Sorghum bicolor
  misc_feature: Ceres ANNOT ID no. 6100096
  misc_feature (29)..(212): Pfam Id: SOUL Pfam Desc: SOUL heme-binding protein
  misc_feature (24)..(212): NCBI GI: 5734756 NCBI Desc: similar to soul protein [arabidopsis thaliana]
  misc_feature (22)..(212): NCBI GI: 21593898 NCBI Desc: soul-like protein [arabidopsis thaliana]
  misc_feature (30)..(213): NCBI GI: 55962260 NCBI Desc: novel protein (zgc:56136) [danio rerio]
  misc_feature (30)..(213): NCBI GI: 41055642 NCBI Desc: similar to heme binding protein 2 [danio rerio]
  misc_feature (21)..(210): NCBI GI: 74753513 NCBI Desc: heme-binding protein 2 (protein soul) (placental protein 23) (pp23)
MARRGSLLAVAAALLVAVVAAAVPPTCERIECPAYEVVDSANGFEIRRYTDAMWITTAPIEDISFVAATRTGFLQLFNYIQGKNLYNETIEMTAPVLTQVSPSDGPFCASSFTVSFYVPAKNQADPPPAEGLRVDRWAGARYAAVRRFGGFVADADVGEQAAQLDASLQGTRWAAAVNDARRADPASPYTVAQYNSPFEFSGRVNEIWMLFDDAAAAATSM

SEQ ID NO: 9369 - DNA, 681 bp, Sorghum bicolor
  misc_feature: Ceres ANNOT ID no. 6100105
  misc_feature: Encodes the peptide sequence at SEQ ID NO 9370
atggggagccgcctggggcgccgcgtgatccacttcgccaacctcccgctgaagctcatgctgccccccgcgccgctctcctccgtgcaggagttcgccgtgcggaccgtcccatccgcgtccaaggtggacatccgccgctgcctcgagtccatgtacggcttctccgtcgccgaggtccgcacgctcaacatggagggcaagaagctccgccggggccccttcctcgccgccaagcccgactacaagaaggcctacgtcacgctccgagcgccgctcgcggtctcgcgcgacctgttccccatcggggccatcctcgaggagcgggagcgcaaggccagcgccgccgccgcgaggaggaaggcggtcgagggcgccgaggtggagggcgagcgcaaacggaagcactggatggagaacgaaagggagggcttctcccgggccggctgcgggaaggtcgtgtacgggaaccctgggaggctggggaggaagaggaggggtgggggcaagatgaaggaggaagctggggacgagggggccaagttcccatggaccgggatgcgcctggctaccgagaaaccgaggagggtgagacactctccaccgaagaagggaatagccttgaagcaaaaatcacggaaggtatccctgcagcaccgctcaacgaagttgaaagcttga

SEQ ID NO: 9370 - protein, 226 aa, Sorghum bicolor
  misc_feature: Ceres ANNOT ID no. 6100105
  misc_feature (7)..(99): Pfam Id: Ribosomal_L23 Pfam Desc: Ribosomal protein L23
  misc_feature (1)..(188): NCBI GI: 77999307 NCBI Desc: ribosomal protein l23 family protein [solanum tuberosum]
  misc_feature (30)..(90): NCBI GI: 53803406 NCBI Desc: ribosomal protein l23 [methylococcus capsulatus str. bath]
  misc_feature (30)..(90): NCBI GI: 81681359 NCBI Desc: 50s ribosomal protein l23
  misc_feature (29)..(91): NCBI GI: 123264743 NCBI Desc: 50s ribosomal protein l23
  misc_feature (29)..(91): NCBI GI: 71038046 NCBI Desc: ribosomal protein l23 [psychrobacter arcticum 273-4]
  misc_feature: Useful for making plants with modulated nitrogen use efficiency
  misc_feature: Functional homolog of the protein sequence given in SEQ ID NO 13017
MGSRLGRRVIHFANLPLKLMLPPAPLSSVQEFAVRTVPSASKVDIRRCLESMYGFSVAEVRTLNMEGKKLRRGPFLAAKPDYKKAYVTLRAPLAVSRDLFPIGAILEERERKASAAAARRKAVEGAEVEGERKRKHWMENEREGFSRAGCGKVVYGNPGRLGRKRRGGGKMKEEAGDEGAKFPWTGMRLATEKPRRVRHSPPKKGIALKQKSRKVSLQHRSTKLKA

SEQ ID NO: 9371 - DNA, 897 bp, Sorghum bicolor
  misc_feature: Ceres ANNOT ID no. 6100109
  misc_feature: Encodes the peptide sequence at SEQ ID NO 9372
atggcggcggtggcggagggatcggcatctgcggcggcgaaggaggtggagtaccaggcgggcgtgcagaagctggtggacctgctgtccaagctcaacccggccgccaaggagttcgtcccctccgcggccgcgtcgccgcccaagaaggcgctgtcggcggatgcgccggtgttcgattaccgctccatcggaggcgggaatggggccaccgacgctgccttttacgtcgggtttgggaaccagcaccgcaggagggggaatggatacatcaaccaaggaaggaggaggacaaatgatagggtgaggcgtgcagagagagaggacagcattaggcgaactgtttatgtctctgaacttgaccatactgtgacagaggagagacttgctgatatctttgctacctgtgggcaagttgttgattgcagaatttgtggtgatccccactcagttcttaggtttgcatttattgagttctctgatgaagagggcgcgagaactgcacttaaccttggaggcacaatttttggtttctaccctgttagagttttgccttcaaagacagctatcttacctgttaatccaaagtttcttcccaggacggaagatgagaaggaaatggtcatgcgaactgtctattgtacaaacatagataagatggttactcaattagatgtaaagaaattctttgaagaactttgtggtgaggtctctcggttgagacttctaggggataatgtacattccacaaggattgcttttgttgagtttgtccatgctgagggtgccatcatggctctgaattgcagcgggatgattttgggaactctgcctgtcagggtgagcccttctaagactccggtgaagccacgtgtaaatcgagtgggacctaactga

SEQ ID NO: 9372 - protein, 298 aa, Sorghum bicolor
  misc_feature: Ceres ANNOT ID no. 6100109
  misc_feature (115)..(183): Pfam Id: RRM_1 Pfam Desc: RNA recognition motif. (a.k.a. RRM, RBD, or RNP domain)
  misc_feature (212)..(281): Pfam Id: RRM_1 Pfam Desc: RNA recognition motif. (a.k.a. RRM, RBD, or RNP domain)
  misc_feature (27)..(44): Pfam Id: PAM2 Pfam Desc: Ataxin-2 C-terminal region
  misc_feature (2)..(298): NCBI GI: 56201749 NCBI Desc: rna-binding protein -like [oryza sativa (japonica cultivar-group)]
  misc_feature (80)..(298): NCBI GI: 79319864 NCBI Desc: cid8; rna binding [arabidopsis thaliana]
  misc_feature (18)..(291): NCBI GI: 1174153 NCBI Desc: rna-binding protein
  misc_feature (18)..(282): NCBI GI: 79319100 NCBI Desc: cid11; rna binding [arabidopsis thaliana]
  misc_feature (42)..(294): NCBI GI: 115474513 NCBI Desc: os08g0116400 [oryza sativa (japonica cultivar-group)]
  misc_feature: The sequence is a functional homolog of SEQ ID NO 1301 in the 10/666,642US patent application
  misc_feature: Useful for making plants with modulated growth and phenotype characteristics
  misc_feature: The sequence is a functional homolog of SEQ ID NO 1301 in the 20070033671 US patent application
  misc_feature: The sequence is a functional homolog of SEQ ID NO 1301 in the 10/666,642 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MAAVAEGSASAAAKEVEYQAGVQKLVDLLSKLNPAAKEFVPSAAASPPKKALSADAPVFDYRSIGGGNGATDAAFYVGFGNQHRRRGNGYINQGRRRTNDRVRRAEREDSIRRTVYVSELDHTVTEERLADIFATCGQVVDCRICGDPHSVLRFAFIEFSDEEGARTALNLGGTIFGFYPVRVLPSKTAILPVNPKFLPRTEDEKEMVMRTVYCTNIDKMVTQLDVKKFFEELCGEVSRLRLLGDNVHSTRIAFVEFVHAEGAIMALNCSGMILGTLPVRVSPSKTPVKPRVNRVGPN

SEQ ID NO: 9373 - DNA, 1725 bp, Sorghum bicolor
  misc_feature: Ceres ANNOT ID no. 6100112
  misc_feature: Encodes the peptide sequence at SEQ ID NO 9374
atgtcgctctcgtcggcgcgccagcgtcgtgccacggcggcgtctccaccgaccgacgatgggtacgctaaggacgccaaggacaggaggcggcggcccggcggcgacggggacggtgaggacgagggtatcaagtggttcctcccgttcctggcgctcgggctcctccgccacatgagcgcgtcctccaacctgatccatgactgcgacgaggttttcaactactgggagcccctccacttcctcctctaccgctccggctttcagacctgggagtacagttctgattttgctcttcggtcatatttgtaccttttttttcacgctcttgtagctgggcctgcttcactgatctttggtgagaataaggttcgtgtgttctactcattgagaatctttcttggtctcatttcaactattaccgaaactgttctggtggttgctctttcaagaagatatgggaagcgacttgcttgttatgttcttgcaatgctatgcttatccagcggttgcttctttgccagtaccagtttcttgccaagttcattctccatgtatgcagtaacactttcatctgcactcttccttcttgagaaatatgctggtgcagtctcagttgcagctgctggagtgatccttggttggcctttctcaattttggttttcctccctgttactgtttattctctaattagaggatcttttagaagggtttttctatctggattttttacttcactgtgctttcttgttctttcgtttgttgctgattactactgctatggtcgactgacattctcggtgtttaatcttctgaaatataacgttcttggtggtggtgaaagtcacttgtatggaaccgaggggctttcattttacttcaggaatggattcaataatttcaattttgccttcatcctggctcttcttttcttggtggttgtaccatttgcaagaaagaaatatgctcctgatctactgatagttgtctctcctgtctatatctggttggctttcatgtctttgcaggcacacaaagaagaaaggtttctctatccaatttacacattgatatgtgttgctgccgcagctgttattgatagcttacctgatcttttccatgacaaatattcatctgatcagtctatttttgaaaagatagcgaagggtctgcgtcctttgatccttggtttcattttgtgtgcttcccacagccgaacattttccatgttaaatggatatggtgctcccctgcagatctatcagcatctagaacatcatgatgacactgggcccgggtctattctctgtgttggaagtgagtggcatcgctatccatcatcgttcttcataccctcctatatcagtgaagttcggtggatagatgatggcttccgtggattgcttccatttcccttcaatgagaccctgggtggaacaactgcagctccgtcatacttcaataacaagaacaaggctgctgaagggcaatatcttaaagacatcggagcatgtaccttactggtggaacttgatctaagacggccttatccctcacgcgggagtgacttgtcaaagtgggaggcactggccgcactacagttcctggatagagagctttcccctgcactataccggtccttcttcataccataccgatggcaacaaaacaacgtgttcggcctgtacaagctactgaggaggttgcatcctgaccatgcgtga

SEQ ID NO: 9374 - protein, 574 aa, Sorghum bicolor
  misc_feature: Ceres ANNOT ID no. 6100112
  misc_feature (48)..(452): Pfam Id: Glyco_transf_22 Pfam Desc: Alg9-like mannosyltransferase family
  misc_feature (1)..(569): NCBI GI: 92895721 NCBI Desc: alg9-like mannosyltransferase [medicago truncatula]
  misc_feature (1)..(569): NCBI GI: 92918368 NCBI Desc: alg9-like mannosyltransferase [medicago truncatula]
  misc_feature (1)..(373): NCBI GI: 14328092 NCBI Desc: disrupted in bipolar disorder 1 [homo sapiens]
  misc_feature (1)..(373): NCBI GI: 119587558 NCBI Desc: asparagine-linked glycosylation 9 homolog (yeast, alpha- 1,2-mannosyltransferase), isoform cra_c [homo sapiens]
  misc_feature (50)..(568): NCBI GI: 108876810 NCBI Desc: glycosyltransferase [aedes aegypti]
  misc_feature: Useful for making plants with altered carbohydrate content
  misc_feature: Functional homolog of the protein sequence given in SEQ ID NO 14047
MSLSSARQRRATAASPPTDDGYAKDAKDRRRRPGGDGDGEDEGIKWFLPFLALGLLRHMSASSNLIHDCDEVFNYWEPLHFLLYRSGFQTWEYSSDFALRSYLYLFFHALVAGPASLIFGENKVRVFYSLRIFLGLISTITETVLVVALSRRYGKRLACYVLAMLCLSSGCFFASTSFLPSSFSMYAVTLSSALFLLEKYAGAVSVAAAGVILGWPFSILVFLPVTVYSLIRGSFRRVFLSGFFTSLCFLVLSFVADYYCYGRLTFSVFNLLKYNVLGGGESHLYGTEGLSFYFRNGFNNFNFAFILALLFLVVVPFARKKYAPDLLIVVSPVYIWLAFMSLQAHKEERFLYPIYTLICVAAAAVIDSLPDLFHDKYSSDQSIFEKIAKGLRPLILGFILCASHSRTFSMLNGYGAPLQIYQHLEHHDDTGPGSILCVGSEWHRYPSSFFIPSYISEVRWIDDGFRGLLPFPFNETLGGTTAAPSYFNNKNKAAEGQYLKDIGACTLLVELDLRRPYPSRGSDLSKWEALAALQFLDRELSPALYRSFFIPYRWQQNNVFGLYKLLRRLHPDHA

SEQ ID NO: 9375 - DNA, 1524 bp, Sorghum bicolor
  misc_feature: Ceres ANNOT ID no. 6100127
  misc_feature: Encodes the peptide sequence at SEQ ID NO 9376
atggcggcggccgtggcgtcgctgtacaggcgggtcctcccgtcgccgccggcggtggacttcgcttcgccggagggcaagcgcctcttcgccgaggccctggcggcgggcaccatggagggcttcttccccctggtctccgtcttccagacgcagtcggagccggccttctgcggcctcgcctccctcgccgtcgtcctcaacgcgctcgccatcgacccgggccgccgctggaaggggccctggcgctggttcgacgagtccatgctcgactgctgcgagcccctcgacaaggtcaaggaccagggcatcaccttcggcaaggtcgcctgcctcgcgcactgctccggcgccgacgtccaatccttccgcgccaaccgggtcaccatcgacgacctacggcggcatctcatccgatgcgtctcctcccaggactgccatcttattgcttcctaccacaggaaggctttcaaacagactggaactgggcatttctccccaatcggtggctaccatgccggacaggatatggcgctcatcttggatgtcgcccgtttcaaatatcctccacattgggttccattgcaacttctttgggaagccatgaataccactgatgactcaactggacttatcagagggttcatgcttatatcaagacagactgcagctccttcatcgctgtacacagtgagttgcagagatgaaaactggaaaagcatggcgaagtattgtgttgaagatttaccaaatcttttgaaggcagagaatctagacaacgttgcagcacttttgtcccgtttaattgagtctcttccagctgatgctgaatctttgatcaaatgggttgtagaagttaggagaaaagaggaaggtggaccaagcttaagcaaagaggagaaagaaaggcttttcttgaaggaaaatgtactgcagcaagttcgtgataccaggctatttgccatagtccatgatcaacagaatgctaataaaccatgttgtaattgctcatcactgagcgaagaagattcccttactaggattgcagccgttgtgtgctgtcagggagctgcaatgctatcaggaaaccttgtgccaagagatgccttctgctgcaaagaaacatgtttgaaatgtgtccaagcgaatggtgatgggctcaagaccgttatctcaggctctgtggtatctgaaggcagtgagcaaggtgttgatatgcttttaccaatgtcttcacctagtgccagttcatgcaattcaaacttgaggaacaatgtcatcaaatatccatcaaccgtggatgttctaactgttcttctgctggctttacatcccaacacgtggttgggcatcaaagatgagaagctgaaagctgaatttcagactcttatttcaactgacagtctacctgatgatctgaaacgagagatattgcatctaaggcggcaactctattatctaaaggcctgtaaagaagaggaatgtgaagacgcggagccaccatcgcctaagcagcaaagctga

SEQ ID NO: 9376 - protein, 507 aa, Sorghum bicolor
  misc_feature: Ceres ANNOT ID no. 6100127
  misc_feature (48)..(180): Pfam Id: Phytochelatin Pfam Desc: Phytochelatin synthase
  misc_feature (1)..(502): NCBI GI: 33187146 NCBI Desc: phytochelatins synthase [cynodon dactylon]
  misc_feature (5)..(503): NCBI GI: 5757804 NCBI Desc: phytochelatin synthase [triticum aestivum]
  misc_feature (2)..(232): NCBI GI: 48448412 NCBI Desc: phytochelatin synthase [oryza sativa]
  misc_feature (4)..(502): NCBI GI: 27448224 NCBI Desc: phytochelatins synthase [allium sativum]
  misc_feature (4)..(501): NCBI GI: 28569706 NCBI Desc: phytochelatin synthase [solanum tuberosum]
MAAAVASLYRRVLPSPPAVDFASPEGKRLFAEALAAGTMEGFFPLVSVFQTQSEPAFCGLASLAVVLNALAIDPGRRWKGPWRWFDESMLDCCEPLDKVKDQGITFGKVACLAHCSGADVQSFRANRVTIDDLRRHLIRCVSSQDCHLIASYHRKAFKQTGTGHFSPIGGYHAGQDMALILDVARFKYPPHWVPLQLLWEAMNTTDDSTGLIRGFMLISRQTAAPSSLYTVSCRDENWKSMAKYCVEDLPNLLKAENLDNVAALLSRLIESLPADAESLIKWVVEVRRKEEGGPSLSKEEKERLFLKENVLQQVRDTRLFAIVHDQQNANKPCCNCSSLSEEDSLTRIAAVVCCQGAAMLSGNLVPRDAFCCKETCLKCVQANGDGLKTVISGSVVSEGSEQGVDMLLPMSSPSASSCNSNLRNNVIKYPSTVDVLTVLLLALHPNTWLGIKDEKLKAEFQTLISTDSLPDDLKREILHLRRQLYYLKACKEEECEDAEPPSPKQQS

SEQ ID NO: 9377 - DNA, 1014 bp, Sorghum bicolor
  misc_feature: Ceres ANNOT ID no. 6100132
  misc_feature: Encodes the peptide sequence at SEQ ID NO 9378
atgggtccgcggtcggcgatgggatgttcgtccttgccgtcctcccgtgctctgtggctcacgacggccgtcgtcgcggcgctcgccgccggcgcgcaggcgtcgctgtcgccggggttctacgacgcgacgtgcccggggctgcagcccatcgtgcgccgcgtcgtggcgcgggccgtccagatggagccgcgcatgggggcgtccctcctccgcctcttcttccacgactgcttcgtcaatggctgcgacgcctccgtcttgctggacgacgtgcccggtagcttcgtcggggagaagaacgcgggtcccaacgccaactcgctgcgcgggttcgaggtcatcgacgccatcaaggcgcaggtcgaggcgtcctgcaacgccaccgtctcctgcgccgacatcgtcgccctcgccgcgcgcgacgccgtcaacctgctcggtgggccgaggtggtcggtgccgctaggccggcgagacgcgcggaacacgagcgcgaacgcggcgaacgccaacctaccgccgccggacgcgagcctaccgacgctgctgtccatgttcggcgccaagggcctggacgcgcgggacctgacggcgctgtcgggggcgcacacggtggggcgcgcccgctgcgtggtgttccgctcccacatctacaacgacacggccaccaccaacgccaccttcgcggcggagctccggagcaccgtctgcccctacacgggcggcgacgccaacctggcgccgctgaagctgcaggcgcccgacgtcttcgacaacggctacttccgggacctggtcacccgccgcgtgctgctgcggtccgaccaggcgctgtacgacggcggcaacggcaccacggacgcgctcgtgcgcgcctacgccgccaacgggacggcgttcgccgccgacttcgccgccgccatggtcaggatggggaacctgggaccgcctgccgggagcgccgccgccgccgccaccgaggtccggctcaactgccggcgagtgaactga

SEQ ID NO: 9378 - protein, 337 aa, Sorghum bicolor
  misc_feature: Ceres ANNOT ID no. 6100132
  misc_feature (52)..(297): Pfam Id: peroxidase Pfam Desc: Peroxidase
  misc_feature (25)..(337): NCBI GI: 55700871 NCBI Desc: tpa: class iii peroxidase 2 precursor [oryza sativa (japonica cultivar-group)]
  misc_feature (20)..(337): NCBI GI: 5453379 NCBI Desc: bacterial-induced peroxidase precursor [gossypium hirsutum]
  misc_feature (31)..(328): NCBI GI: 115445229 NCBI Desc: os02g0237000 [oryza sativa (japonica cultivar-group)]
  misc_feature (15)..(337): NCBI GI: 61697137 NCBI Desc: peroxidase [populus alba x populus tremula var. glandulosa]
  misc_feature (25)..(337): NCBI GI: 2944417 NCBI Desc: peroxidase flxper4 [linum usitatissimum]
  misc_feature (12)..(337): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at5g05340
  misc_feature: Useful for making plants with altered carbohydrate content
  misc_feature: Functional homolog of the protein sequence given in SEQ ID NO 13713
  misc_feature: Useful for making plants with altered cell wall content and/or composition
  misc_feature: Functional homolog of the protein sequence given in SEQ ID NO 13958
  misc_feature: Useful for making plants with modulated oxidative stress sensitivity
  misc_feature: Functional homolog of the protein sequence given in SEQ ID NO 13607
MGPRSAMGCSSLPSSRALWLTTAVVAALAAGAQASLSPGFYDATCPGLQPIVRRVVARAVQMEPRMGASLLRLFFHDCFVNGCDASVLLDDVPGSFVGEKNAGPNANSLRGFEVIDAIKAQVEASCNATVSCADIVALAARDAVNLLGGPRWSVPLGRRDARNTSANAANANLPPPDASLPTLLSMFGAKGLDARDLTALSGAHTVGRARCVVFRSHIYNDTATTNATFAAELRSTVCPYTGGDANLAPLKLQAPDVFDNGYFRDLVTRRVLLRSDQALYDGGNGTTDALVRAYAANGTAFAADFAAAMVRMGNLGPPAGSAAAAATEVRLNCRRVN

SEQ ID NO: 9379 - DNA, 726 bp, Sorghum bicolor
  misc_feature: Ceres ANNOT ID no. 6100136
  misc_feature: Encodes the peptide sequence at SEQ ID NO 9380
atggcgaccaacaaggacctgtgcaccgtcgagaggcgaggccgcgtgcacctcatcaccatcaccggcgccggcgagcaccgcctcaacccggacctcctcgcggccctccgctccgccgtggccgcctccgcgggcgcgggcgcgctggtgctcgccgcggaggggaagttcttctccaacgggttcgaccaggcgtgggcgcgcacggcgccgccccacctccacagcaccatggacggcgggctcctcgcgctggtggccgacctcctggcgctgcgcatgcccacggtggcggcggtgacggggcacgcggcggcggccgggtgcgcgctggctttggcgcacgacgccgtgctcatgcgccgcacccgcgggttcctgtacatgagcgaggtcgacgtcggcatcaagttcgtggacttcgtcgccgccgtgttgcgggacaaggtccccgacgccgcggccaggcgcgacctggtgatgcgcggggacagggtggccgcggccgaggccgtgcgccggggcctcgtggacgccgccgtcgacggcggccccgaggacgtggtggccgccgccgtcgccgaggccgagaggctggccgctaggggctgggacggggaggccgtcgccgagatcaggaaggccgcgtggccccagctgtggggccaggtcaaggaccacggcgccggcccggcgccggcgggtgtgcggccgcggctctag

SEQ ID NO: 9380 - protein, 241 aa, Sorghum bicolor
  misc_feature: Ceres ANNOT ID no. 6100136
  misc_feature (17)..(183): Pfam Id: ECH Pfam Desc: Enoyl-CoA hydratase/isomerase family
  misc_feature (7)..(241): NCBI GI: 115435164 NCBI Desc: os01g0205600 [oryza sativa (japonica cultivar-group)]
  misc_feature (7)..(223): NCBI GI: 7268149 NCBI Desc: carnitine racemase like protein [arabidopsis thaliana]
  misc_feature (7)..(221): NCBI GI: 21555734 NCBI Desc: carnitine racemase like protein [arabidopsis thaliana]
  misc_feature (7)..(216): NCBI GI: 38454116 NCBI Desc: at1g65520 [arabidopsis thaliana]
  misc_feature (7)..(221): NCBI GI: 30023700 NCBI Desc: at4g14440 [arabidopsis thaliana]
MATNKDLCTVERRGRVHLITITGAGEHRLNPDLLAALRSAVAASAGAGALVLAAEGKFFSNGFDQAWARTAPPHLHSTMDGGLLALVADLLALRMPTVAAVTGHAAAAGCALALAHDAVLMRRTRGFLYMSEVDVGIKFVDFVAAVLRDKVPDAAARRDLVMRGDRVAAAEAVRRGLVDAAVDGGPEDVVAAAVAEAERLAARGWDGEAVAEIRKAAWPQLWGQVKDHGAGPAPAGVRPRL

SEQ ID NO: 9381 - DNA, 1491 bp, Sorghum bicolor
  misc_feature: Ceres ANNOT ID no. 6100177
  misc_feature: Encodes the peptide sequence at SEQ ID NO 9382
atgcacggcaacggcggccgcggcgaccagcactcgccgaggtcggtcaagtcggctcccccccgcggcggtggcggtgcgggcgggggtgaccatgaccatcattactccccgtcagccaagaccccgcgcggcggcggcggagcaggagcagcggcgtccccgatgaaactgctgccgagcagcgcggcgtggctggtggacagccggtgggcgctgtcggccgcgctgagcctgctgctgttcctggccgtcgcgctcgccgtgacgtcctcctcgtcgtcctacatctcctcgtcgtcgtccttcttctccttcctgcccgccacccgcgccgccgacttcgtggagggggagcgtgcccggccgcaggcaacagccgcggccaacgacacggctcccccgcccggctccggcgtgccccggctggcgtacctcatctccggctccaagggcgacctggaccgtctctggcgcgcgctgcacgcgctgtaccacccgcgcaaccagtacgtggtgcacctggaccgcgaggcccccgtggcggagcgcctggagctggccgcccgcgtcgccaactccaccgtcttccgccgcaccggcaacgtccacgtcgtccgccgcgccaacatggtcacctaccgtggccccaccatggtggccaacacgctgcacgcctgcgccatcctcctccgccgcggcggcgcctgggactggttcatcaacctctccgcctccgattacccgctcatgacgcaggacgacatcctgcacacattctcgacggtgcccaggaatatcaacttcatcgggcacacgggcaacttaggctggaagatgtggcagcggggtcagcctatgatcgtggatccagggctatacggctccaagaagcaggacctcttctgggtggcaccgaagcgggcactgccgacggcattcaagctcttcacaggctccgcttgggtggcactgacgcgggacttggtggagtacacggtgtgggggtgggacaacctgccgcgcaccctgctcatgtactacgccaacttcatctcctccccggagggctacttccagacgctagtctgcaacgcaccgcgtttcgtgcccaccgtcgccaaccacgacctccaccacatccagtgggacgtgccgccgaaacagcacccgcgcgcgctcgcgctcgccgacatgcccggcatgcttgctagcggtgcgccattcgcgaggaagttcccgcgtgatgaccctgtgctcgacgccatcgatgacgggctcctcgcacgcccacgcctgaccaacaacattggcaacggcaccgccggcgaggtagcattcgtgcctggcggttggtgtggtgccgatgccacgtgccaggctgtggacaatgactgggtgctcagacctgggcctggagctgagcgcttcgggaggctcattgataggatcgttaggtccaaaactttcctcaataggcaatgcaagtag

SEQ ID NO: 9382 - protein, 496 aa, Sorghum bicolor
  misc_feature: Ceres ANNOT ID no. 6100177
  misc_feature (143)..(368): Pfam Id: Branch Pfam Desc: Core-2/I-Branching enzyme
  misc_feature (23)..(496): NCBI GI: 115435126 NCBI Desc: os01g0201100 [oryza sativa (japonica cultivar-group)]
  misc_feature (77)..(496): NCBI GI: 102139993 NCBI Desc: glycosyl transferase family 14 protein [musa acuminata]
  misc_feature (68)..(496): NCBI GI: 42567183 NCBI Desc: glycosyltransferase family 14 protein / core-2/i-branching enzyme family protein [arabidopsis thaliana]
  misc_feature (67)..(496): NCBI GI: 20856992 NCBI Desc: at3g15350/k7l4_15 [arabidopsis thaliana]
  misc_feature (67)..(496): NCBI GI: 15146308 NCBI Desc: at3g15350/k7l4_15 [arabidopsis thaliana]
  misc_feature: Useful for making plants with altered carbohydrate content
  misc_feature: Functional homolog of the protein sequence given in SEQ ID NO 14046
MHGNGGRGDQHSPRSVKSAPPRGGGGAGGGDHDHHYSPSAKTPRGGGGAGAAASPMKLLPSSAAWLVDSRWALSAALSLLLFLAVALAVTSSSSSYISSSSSFFSFLPATRAADFVEGERARPQATAAANDTAPPPGSGVPRLAYLISGSKGDLDRLWRALHALYHPRNQYVVHLDREAPVAERLELAARVANSTVFRRTGNVHVVRRANMVTYRGPTMVANTLHACAILLRRGGAWDWFINLSASDYPLMTQDDILHTFSTVPRNINFIGHTGNLGWKMWQRGQPMIVDPGLYGSKKQDLFWVAPKRALPTAFKLFTGSAWVALTRDLVEYTVWGWDNLPRTLLMYYANFISSPEGYFQTLVCNAPRFVPTVANHDLHHIQWDVPPKQHPRALALADMPGMLASGAPFARKFPRDDPVLDAIDDGLLARPRLTNNIGNGTAGEVAFVPGGWCGADATCQAVDNDWVLRPGPGAERFGRLIDRIVRSKTFLNRQCK

SEQ ID NO: 9383 - DNA, 2535 bp, Sorghum bicolor
  misc_feature: Ceres ANNOT ID no. 6100192
  misc_feature: Encodes the peptide sequence at SEQ ID NO 9384
atggtgacggcgaaggaggccgcggcggcggccatggacgccagcaagtacgtgcggtacacgccggagcaggtggaggcgctggagcggctctactacgagtgccccaagccgagctcgctgcgccgccagcagctcgtccgcgactgccccgtcctcgccagcgtcgaccccaagcagatcaaagtctggttccagaaccgcaggtgccgggagaagcagcggaaggagtcgtctcggttgcaggcgctgaaccggaagctgacggccatgaacaagctgctcatggaggagaacgaccgcctgcagaagcaggtctcgcagctcgtctacgagaacggctactaccgccagcagacgcagcagagcgcggggctggcgaccacggacacgagctgcgagtcggtcgtcaccagtggccaccagaacgtggccgcggcggcgccacaagcgcagccgcgcgacgcaggccctgctgggctcatgtccatagcggaggagacactgacggagtttctgtccaaggccacggggaccgccgtcgagtgggtccagatgcccgggatgaagcctggtccggattccattggaatcatagccatctcgcatggttgcgcgggtgtggctgcgcgagcttgcggcctcgtgggcatggagcctgccaaagttgctgaagtcctcaaggatcggctgctgtggctacgcgattgccgatctatggaggtggtgaatgttcttcctgccggtaacaatggcacaattgagcttctctacttgcagctctatgcccccacaacgctggcgccagctcgggacttctggttgctgcggtacacctccattcttgatgatggaagtttagtggtatgtgagagatcactcagtaccaagcagggtggcccaagcatgcctcttgtccagccttttatcaggggtgagatgcttcctagtgggttcttgattcggcctagcgacggtggaggcagtgttatacacatcgttgatcatattgacttggagccttggagcgtgcctgaagttgtgcggccactgtatgaatcatctgcaatggttgctcagaagatgtcaatggcggctttgcgctatcttaggcaggttgctcatgaagatacccattctgtaataaccggatggggacggcagcctgctgctttacgggctctgagccaaaagctcaccagaggtttcaatgaagctcttaatgggcttgctgatgatggatggtctgtggttgaaagtgatggagtggatgatgtttgtatctctgtcaactcatccccgagtaaagtgatcaactgcaatgcaactttcaataatggattgcctgtagtcagtagcagtgtactctgtgcaaaggcatcgatgctgctgcaggatgtttctccgccagcactcctgcgctttatgcgggaacagcggtcgcagtgggctgacagcaatttagatgcattctttgcttctgcaatgaaaccaaatttctgcaatttgcctatgtctcgccttggaggatttagtggtcaggtcatacttcctttagcccacacgtttgaccctgaagaattccttgaggttataaaattagggaatgccagtaattatcaagacgcactcctgcaccgtgatctgtttctgttacagatgtacaatggggtagacgagaatatggtaggaacttgttcagagctcatctttgcccctatagacgcatcattcagcgatgactctccactgctcccatctggtttccgcatcattccgatcgacgctcctctcgacacatctagccccaagtgcacattggacctagcctccacccttgaagttggaactcccagaagcaggataaatggcagcggtcctggaaatgctgcttctgctggctcaaaggctgtgatgacgatcgtgtttcagtttgccttcgagagccatctgcaggacagtgttgcagccatggcaaggcagtacatgcgaagcatcattgcatcagttcagaggatcgcgctggcgctctcctcctcacgcctcgttcctcatggcagcagcatcagtcacactcctgctagtccggaggcaaccacgcttgccagatggatctgccagagttacagatttcattttggggctgagcttatcaaatccggagatggtagcggctgtgaaggagtgctaaaaaccctttggcatcatgccagtgctatactctgctgctctttgaaggccttgccggtgttcacgttcgcgaaccagtctggcctggacatgctggagacaaccctggtggcgctccaggacatcaccctggagaaagtgttcgatgaccaagggaggaagaacctgtgcgcggagctccccggcatcatggagcaggggttcacgtgcatccccagcgggctgtgcgtctccggcctgggccggccggtgtcgtacgagaaggcgctggcgtggaaggtgctcgacgacgacagcggcgcgcactgcatctgcttcatgttcgtcaactggtcgtttgtgtaa

SEQ ID NO: 9384 - protein, 844 aa, Sorghum bicolor
  misc_feature: Ceres ANNOT ID no. 6100192
  misc_feature (696)..(844): Pfam Id: MEKHLA Pfam Desc: MEKHLA domain
  misc_feature (163)..(373): Pfam Id: START Pfam Desc: START domain
  misc_feature (14)..(74): Pfam Id: Homeobox Pfam Desc: Homeobox domain
  misc_feature (1)..(844): NCBI GI: 109729912 NCBI Desc: tpa: tpa_inf: class iii hd-zip iii protein hb8 [zea mays]
  misc_feature (12)..(844): NCBI GI: 60327635 NCBI Desc: class iii hd-zip protein 8 [populus trichocarpa]
  misc_feature (2)..(844): NCBI GI: 60327631 NCBI Desc: class iii hd-zip protein 6 [populus trichocarpa]
  misc_feature (12)..(844): NCBI GI: 60327629 NCBI Desc: class iii hd-zip protein 5 [populus trichocarpa]
  misc_feature (12)..(844): NCBI GI: 60327633 NCBI Desc: class iii hd-zip protein 7 [populus trichocarpa]
  misc_feature: The sequence is a functional homolog of SEQ ID NO 110 in the 10/412,699US patent application
  misc_feature: The sequence is a functional homolog of SEQ ID NO 1109 in the 10/412,699US patent application
  misc_feature: The sequence is a functional homolog of SEQ ID NO 1110 in the 10/412,699US patent application
  misc_feature: The sequence is a functional homolog of SEQ ID NO 1111 in the 10/412,699US patent application
  misc_feature: The sequence is a functional homolog of SEQ ID NO 1394 in the 10/666,642US patent application
  misc_feature: The sequence is a functional homolog of SEQ ID NO 1454 in the 10/666,642US patent application
  misc_feature: The sequence is a functional homolog of SEQ ID NO 162 in the 10/225,066US patent application
  misc_feature: The sequence is a functional homolog of SEQ ID NO 1774 in the 10/412,699US patent application
  misc_feature: The sequence is a functional homolog of SEQ ID NO 18 in the 10/412,699US patent application
  misc_feature: The sequence is a functional homolog of SEQ ID NO 186 in the 10/412,699US patent application
  misc_feature: The sequence is a functional homolog of SEQ ID NO 1868 in the 10/412,699US patent application
  misc_feature: The sequence is a functional homolog of SEQ ID NO 1994 in the 10/374,780US patent application
  misc_feature: The sequence is a functional homolog of SEQ ID NO 2124 in the 10/374,780US patent application
  misc_feature: The sequence is a functional homolog of SEQ ID NO 259 in the 11/479,226US patent application
  misc_feature: The sequence is a functional homolog of SEQ ID NO 666 in the 10/374,780US patent application
  misc_feature: The sequence is a functional homolog of SEQ ID NO 667 in the 10/374,780US patent application
  misc_feature: The sequence is a functional homolog of SEQ ID NO 668 in the 10/374,780US patent application
  misc_feature: The sequence is a functional homolog of SEQ ID NO 669 in the 10/374,780US patent application
  misc_feature: The sequence is a functional homolog of SEQ ID NO 720 in the 10/374,780US patent application
  misc_feature: The sequence is a functional homolog of SEQ ID NO 721 in the 10/374,780US patent application
  misc_feature: The sequence is a functional homolog of SEQ ID NO 783 in the 10/666,642US patent application
  misc_feature: The sequence is a functional homolog of SEQ ID NO 784 in the 10/666,642US patent application
  misc_feature: The sequence is a functional homolog of SEQ ID NO 785 in the 10/666,642US patent application
  misc_feature: Useful for making plants with modulated growth and phenotype characteristics
  misc_feature: The sequence is a functional homolog of SEQ ID NO 110 in the 20040045049 US patent application
  misc_feature: The sequence is a functional homolog of SEQ ID NO 1109 in the 20040045049 US patent application
  misc_feature: The sequence is a functional homolog of SEQ ID NO 1110 in the 20040045049 US patent application
  misc_feature: The sequence is a functional homolog of SEQ ID NO 1111 in the 20040045049 US patent application
  misc_feature: The sequence is a functional homolog of SEQ ID NO 1774 in the 20040045049 US patent application
  misc_feature: The sequence is a functional homolog of SEQ ID NO 18 in the 20040045049 US patent application
  misc_feature: The sequence is a functional homolog of SEQ ID NO 186 in the 20040045049 US patent application
  misc_feature: The sequence is a functional homolog of SEQ ID NO 1868 in the 20040045049 US patent application
  misc_feature: The sequence is a functional homolog of SEQ ID NO 669 in the 20060162006 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: Useful for making plants with altered carbohydrate content
  misc_feature: Functional homolog of the protein sequence given in SEQ ID NO 13708
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
MVTAKEAAAAAMDASKYVRYTPEQVEALERLYYECPKPSSLRRQQLVRDCPVLASVDPKQIKVWFQNRRCREKQRKESSRLQALNRKLTAMNKLLMEENDRLQKQVSQLVYENGYYRQQTQQSAGLATTDTSCESVVTSGHQNVAAAAPQAQPRDAGPAGLMSIAEETLTEFLSKATGTAVEWVQMPGMKPGPDSIGIIAISHGCAGVAARACGLVGMEPAKVAEVLKDRLLWLRDCRSMEVVNVLPAGNNGTIELLYLQLYAPTTLAPARDFWLLRYTSILDDGSLVVCERSLSTKQGGPSMPLVQPFIRGEMLPSGFLIRPSDGGGSVIHIVDHIDLEPWSVPEVVRPLYESSAMVAQKMSMAALRYLRQVAHEDTHSVITGWGRQPAALRALSQKLTRGFNEALNGLADDGWSVVESDGVDDVCISVNSSPSKVINCNATFNNGLPVVSSSVLCAKASMLLQDVSPPALLRFMREQRSQWADSNLDAFFASAMKPNFCNLPMSRLGGFSGQVILPLAHTFDPEEFLEVIKLGNASNYQDALLHRDLFLLQMYNGVDENMVGTCSELIFAPIDASFSDDSPLLPSGFRIIPIDAPLDTSSPKCTLDLASTLEVGTPRSRINGSGPGNAASAGSKAVMTIVFQFAFESHLQDSVAAMARQYMRSIIASVQRIALALSSSRLVPHGSSISHTPASPEATTLARWICQSYRFHFGAELIKSGDGSGCEGVLKTLWHHASAILCCSLKALPVFTFANQSGLDMLETTLVALQDITLEKVFDDQGRKNLCAELPGIMEQGFTCIPSGLCVSGLGRPVSYEKALAWKVLDDDSGAHCICFMFVNWSFV

SEQ ID NO: 9385 - DNA, 1611 bp, Sorghum bicolor
  misc_feature: Ceres ANNOT ID no. 6100202
  misc_feature: Encodes the peptide sequence at SEQ ID NO 9386
atgcctgacatggagtccgtcgcagcccttatggactcgacaagctccaagatacagcagcttcaggaggcatttgctgagcttgagagccagagtgctgtctccatgaaccttaagtggaagcagcttgaagaccactttcgtggccttgaacagtccctcaagaaaaagtttgacgagctaaaagagcaggaggaggagttccaggagattgtcgcaaaatcagatctgatgctggagcagcgggaggcagctgttgtggccaaggaactgacctctctggagaggttgcaggagaagagggatgctgcattagctatgatctttagcaagtctaggctttccttacctgttcctgccatcaatccaatgaacaaggcactggataatcttggtgtcaagtggcctaaaccggcttctgaagagagtgtgcacttgcaagatggtaatgctgcagtgaggcctcgttctgagcttgcctcactctgtgaggaaatgaatgttaaggggcttcataagttcatatccgacaacaggaagaacttggcagccatccgcgaggaaattcccagtgcactgaagaaaacatctgatccttatggcttggtgttggattccctggaagacttctattctggagataatcttgtattagatggcaaaaaggatggagaccttctgggtgttagaaggacctgcctgatgttgatggagtcacttggacagctgcaaactaataatataacttgtttctctttggaggggcacatgcttacaactaatatcgtagagcgagcaaagaagattgcatttgagtggaagtccaagttagataatcttgacattgatgctagtaatgggaactgtcttgaagctcatgcatttcttcaactcctggcaacctttggtatttctgctgaatataacgaagatgacctgtgcaaattgcttccatatgtcagtcgtcgtcgtcagacacctgaactttgtcgattgcttgggttgtcgcagaaaatgccaggtgtcattgaagttctggtggaaagtggaagacctattgatgcaattaatttggcttatgtgtttgagcttactgaacagtttgagccagtgcaactgcttaaagcatatctgagggatgttaagaaagtgtcacatgccaggaatgtcaaaggttctcctggggcacagaatgagatgaatgaacgcgagttgtctgcactgaaatctgtcattaagtgcattgaagagcacaagcttgaggagcagtaccctgtggatccacttcagaaaagggttttgcagctagagaaagcaaaggcagacaagaggagggctgttgaagcagcaaagccacagtccaagcggcctcgtgccaatggatcggcctttgcacaccgtgctacaggctttgctgacaagagcttctacccagcagcagcaaccccagagaggcatccctccaatccttacgagaggcagtttgtgtatggtgctgaggctcatcttccaccaatggtgagctcagcgtcttacaccatgcaacctgcccacggaccttattacggtaatggctacccagttcagtaccaggtcccgtatatccactaa

SEQ ID NO: 9386 - protein, 536 aa, Sorghum bicolor
  misc_feature: Ceres ANNOT ID no. 6100202
  misc_feature (145)..(451): Pfam Id: Frigida Pfam Desc: Frigida-like protein
  misc_feature (1)..(536): NCBI GI: 115478146 NCBI Desc: os09g0248300 [oryza sativa (japonica cultivar-group)]
  misc_feature (11)..(475): NCBI GI: 145572856 NCBI Desc: abi3-interacting protein 2 [callitropsis nootkatensis]
  misc_feature (127)..(534): NCBI GI: 21554367 NCBI Desc: hydroxyproline-rich glycoprotein-like protein [arabidopsis thaliana]
  misc_feature (127)..(534): NCBI GI: 16974572 NCBI Desc: at4g14900/dl3490c [arabidopsis thaliana]
  misc_feature (58)..(450): NCBI GI: 115470809 NCBI Desc: os07g0173200 [oryza sativa (japonica cultivar-group)]
  misc_feature: Useful for making plants with altered alkaloid content
  misc_feature: GREAT-hit functional homolog of the protein sequence given in SEQ ID NO 13314
  misc_feature: Useful for making plants with altered carbohydrate content
  misc_feature: Functional homolog of the protein sequence given in SEQ ID NO 14045
MPDMESVAALMDSTSSKIQQLQEAFAELESQSAVSMNLKWKQLEDHFRGLEQSLKKKFDELKEQEEEFQEIVAKSDLMLEQREAAVVAKELTSLERLQEKRDAALAMIFSKSRLSLPVPAINPMNKALDNLGVKWPKPASEESVHLQDGNAAVRPRSELASLCEEMNVKGLHKFISDNRKNLAAIREEIPSALKKTSDPYGLVLDSLEDFYSGDNLVLDGKKDGDLLGVRRTCLMLMESLGQLQTNNITCFSLEGHMLTTNIVERAKKIAFEWKSKLDNLDIDASNGNCLEAHAFLQLLATFGISAEYNEDDLCKLLPYVSRRRQTPELCRLLGLSQKMPGVIEVLVESGRPIDAINLAYVFELTEQFEPVQLLKAYLRDVKKVSHARNVKGSPGAQNEMNERELSALKSVIKCIEEHKLEEQYPVDPLQKRVLQLEKAKADKRRAVEAAKPQSKRPRANGSAFAHRATGFADKSFYPAAATPERHPSNPYERQFVYGAEAHLPPMVSSASYTMQPAHGPYYGNGYPVQYQVPYIH

SEQ ID NO: 9387 - DNA, 1830 bp, Sorghum bicolor
  misc_feature: Ceres ANNOT ID no. 6100211
  misc_feature: Encodes the peptide sequence at SEQ ID NO 9388
atggacgagttcgacagcggcggccggagcggggacaggccgggcgccgccgcggccggaggcgacgacggggctgctccaccgttgccccatacggtacaaattgggaattcaccaacctatagacttgaaaggaagcttggaaagggaggatttggacaagtatatgttggtcgacgtatttcagctcctcgtctcagtgaccgtaaccctggttcaaatgctttagaggttgcactgaaatttgaacatcaaaccagcaaaggttgcaactatggagctccttatgagtggcaagtttacaacactctcagtggaaaccatggtgtcccacgagtacactacaaaggaaagcagggagagttttacatcatggttatggatatgttgggaccaagcctatgggatgtttggaataataattcccactcgatgtctgttgagatggttgcttgcataggtatagaggcaatctccatactggaaaagatgcactctaaagggtatgtccatggtgatgtgaagcctgagaactttttgcttggtcctcctggtaccccagaagagaagaagctttttctcgttgaccttggattggcaactaaatggaaggatgctggtacggggcaccacgttgaatatgaccagagacctgatatttttaggggaactgttcgctatgctagtgtgcatgcccacttgggaaggactgggagcaggagagatgatcttgaatccctcgcatacacgcttatttttcttctccgtggccgcctcccttggcaaggataccagggagagaacaaaggttttcttgtctgcaagaaaaagatggcgacatctccggagtctttgtgtggaatttgtccgcaacctttccggaattttgttgagtatgtcgtgaacttgaaatttgatgaagaaccaaattatgcgaagtgcatctctctttttgatggcattgttggcccaaatccagacataagaccgataaacacagatggtgctcaaaagctaatatatcaggtaggccagaagagaggccgcttaatagtggacgaaaatgatgatgagcaacctaagaaaaaaatcagaatggggatgccggcaactcagtggattagtgtctacaatgcccgtcgacctatgaaacagaggtaccactacaatgtagcggataatagattgctgcagcatattcaaaagggaaacgaagatggcttgtttattagttcagttgcctccagctcgaatctgtgggctttaattatggatgctggcactggttttacatctcaagtatacgaactttctaattactttcttcacaaggaatggataatggagcagtgggagagaaatttctatatcactgcactggctggtgcgaataatggaagctctttggtgattatgtcaagaggaacacaatatgcccagcagtcctacaaagtaagcgatacatttcccttcaaatggataaacaaaaagtggaaggagggcttctatgtcactgctatggcaacagctggaagccgatgggcagttgtcatgtcccgcaatgctggtttcacttctcaggtagtggagcttgatttcttatatccgagtgagggcatccacatgcgttgggacaatggctatcgcatcacggcaacagctgccacatgggaccaggcggcctttatcttgagcataccaaggagaaagcctactgatgaaacacaggagaccctgagaacatctgcttttcctagccagcatgtgaaggacaaatggtccaagaacctgtacctagcttccatctgttatggaagatcggtgtcctaa

SEQ ID NO: 9388 - protein, 609 aa, Sorghum bicolor
  misc_feature: Ceres ANNOT ID no. 6100211
  misc_feature (41)..(318): Pfam Id: Pkinase Pfam Desc: Protein kinase domain
  misc_feature (1)..(609): NCBI GI: 115462563 NCBI Desc: os05g0200500 [oryza sativa (japonica cultivar-group)]
  misc_feature (3)..(609): NCBI GI: 115435096 NCBI Desc: os01g0198200 [oryza sativa (japonica cultivar-group)]
  misc_feature (1)..(609): NCBI GI: 115439889 NCBI Desc: os01g0744300 [oryza sativa (japonica cultivar-group)]
  misc_feature (1)..(609): NCBI GI: 30682888 NCBI Desc: protein kinase family protein [arabidopsis thaliana]
  misc_feature (1)..(609): NCBI GI: 42570917 NCBI Desc: protein kinase family protein [arabidopsis thaliana]
  misc_feature: The sequence is a functional homolog of SEQ ID NO. 332 in the 11/188,298 US application
  misc_feature: The sequence is a functional homolog of SEQ ID NO. 399 in the 11/188,298 US application
  misc_feature: The sequence is a functional homolog of SEQ ID NO. 310 in the 11/188,298 US application
MDEFDSGGRSGDRPGAAAAGGDDGAAPPLPHTVQIGNSPTYRLERKLGKGGFGQVYVGRRISAPRLSDRNPGSNALEVALKFEHQTSKGCNYGAPYEWQVYNTLSGNHGVPRVHYKGKQGEFYIMVMDMLGPSLWDVWNNNSHSMSVEMVACIGIEAISILEKMHSKGYVHGDVKPENFLLGPPGTPEEKKLFLVDLGLATKWKDAGTGHHVEYDQRPDIFRGTVRYASVHAHLGRTGSRRDDLESLAYTLIFLLRGRLPWQGYQGENKGFLVCKKKMATSPESLCGICPQPFRNFVEYVVNLKFDEEPNYAKCISLFDGIVGPNPDIRPINTDGAQKLIYQVGQKRGRLIVDENDDEQPKKKIRMGMPATQWISVYNARRPMKQRYHYNVADNRLLQHIQKGNEDGLFISSVASSSNLWALIMDAGTGFTSQVYELSNYFLHKEWIMEQWERNFYITALAGANNGSSLVIMSRGTQYAQQSYKVSDTFPFKWINKKWKEGFYVTAMATAGSRWAVVMSRNAGFTSQVVELDFLYPSEGIHMRWDNGYRITATAATWDQAAFILSIPRRKPTDETQETLRTSAFPSQHVKDKWSKNLYLASICYGRSVS

SEQ ID NO: 9389 - DNA, 603 bp, Sorghum bicolor
  misc_feature: Ceres ANNOT ID no. 6100223
  misc_feature: Encodes the peptide sequence at SEQ ID NO 9390
atggccgcccaccaggcgccggcgtcctcgggggccgggcctcgacggcgccctcgcgtcctcctggccgcctccggcagcgtggccgccatcaagttcgaggccctctgccgcagcgtcgccgagtgggcggacgtccgcgcggtggcgaccgcgtccgcgctgcacttcatcgacgaggcctccttccccgacggcgtcccgctctacaccgacgacgacgagtggtcccgctggaggcgggtcggcgacgaggtcctgcacatcgagctgcgccggtgggccgacgccctcgtcatcgcgccgctctcggccaacaccctcgccaaggtcgccggcgggctgtgcgacaacctcctcacctgcgtggtgcgtgcctgggactacagcaagcccgtctacgtcgcgccggccatgaacaccttcatgtgggacaaccccttcacggcgcgccacctcgccgtcctgcgcgacctcggcatgtccatcgtccagccggtcaccaagcgtctggcctgtggggactacggcaatggcgcgatggcggagccgtcggagatctgcaagaccctggtgctcttcttcggtccacaacatctttag

SEQ ID NO: 9390 - protein, 200 aa, Sorghum bicolor
  misc_feature: Ceres ANNOT ID no. 6100223
  misc_feature (18)..(138): Pfam Id: Flavoprotein Pfam Desc: Flavoprotein
  misc_feature (16)..(198): NCBI GI: 52218792 NCBI Desc: at3g18030 [arabidopsis thaliana]
  misc_feature (16)..(198): NCBI GI: 8778701 NCBI Desc: t1n15.24 [arabidopsis thaliana]
  misc_feature (16)..(198): NCBI GI: 2047324 NCBI Desc: hal3b protein [arabidopsis thaliana]
  misc_feature (16)..(198): NCBI GI: 28948674 NCBI Desc: chain a, ppc decarboxylase mutant c175s complexed with pantothenoylaminoethenethiol
  misc_feature (15)..(195): NCBI GI: 92886295 NCBI Desc: flavoprotein [medicago truncatula]
  misc_feature (16)..(198): SWISSPROT Homolog: EC 4.1.1.36 Phosphopantothenoylcysteine decarboxylase
  misc_feature: The plant flowers significantly late compared to wild-type.
  misc_feature: Useful for making plants with modulated flowering time
  misc_feature: Functional homolog of the protein sequence given in SEQ ID NO 13537
  misc_feature: Useful for making plants with modulated flowering time
  misc_feature: Functional homolog of the protein sequence given in SEQ ID NO 13537
MAAHQAPASSGAGPRRRPRVLLAASGSVAAIKFEALCRSVAEWADVRAVATASALHFIDEASFPDGVPLYTDDDEWSRWRRVGDEVLHIELRRWADALVIAPLSANTLAKVAGGLCDNLLTCVVRAWDYSKPVYVAPAMNTFMWDNPFTARHLAVLRDLGMSIVQPVTKRLACGDYGNGAMAEPSEICKTLVLFFGPQHL

SEQ ID NO: 9391 - DNA, 756 bp, Sorghum bicolor
  misc_feature: Ceres ANNOT ID no. 6100225
  misc_feature: Encodes the peptide sequence at SEQ ID NO 9392
atggccaccgcggcggcgaccatgaccatggcgacgccccacccccgcgcccgcgcacccctccgcgtctgcgccgcctgggacatgaacccgggcgccgccaccgtggccacgcccaagccctccaaggccaaggccaagccgccgccgcccgccaccactacccctgcccgcccgcctcctccgacacacgccgacctcttcgcgcgctccagcgagggccaaggagtggtaaagaagagcacatatatgggctttgagaaatggtggttgccacctccaccagaggtgaagaaacctcgatcgctctacagtgcggcatcactggcttacttgggagactgcatatatgaactttatgctcggaggcacttcttctttccacctctgagcatcaatgagtacaacaaacgtgtgatggatgttgtgaagtgtgagtcacaggaccttttgttaaacaagcttcttggagaggattttctaactgaagaagaaagggacatacttcgttgggggaggaatattgttagcagcaaaactcgcaccagaaagcgtgcaggaattgcagtctacaatcgggcatcttcacttgaaacactgattggatatctttacctcacaaatttcaaacggttagagcaacttatgtttcaattgggcttcacaagtggtgcctcttcacaacatattgaaaacaaccccagcttctgccacacctccacaacctgcaacaaagtgaacagctccaaggtgtaa

SEQ ID NO: 9392 - protein, 251 aa, Sorghum bicolor
  misc_feature: Ceres ANNOT ID no. 6100225
  misc_feature (3)..(200): NCBI GI: 115484857 NCBI Desc: os11g0237700 [oryza sativa (japonica cultivar-group)]
  misc_feature (23)..(201): NCBI GI: 124360401 NCBI Desc: ribonuclease iii [medicago truncatula]
  misc_feature (30)..(168): NCBI GI: 145325433 NCBI Desc: rna binding / ribonuclease iii [arabidopsis thaliana]
  misc_feature (105)..(216): NCBI GI: 86605013 NCBI Desc: rnase3 domain protein [cyanobacteria bacterium yellowstone a-prime]
  misc_feature (105)..(216): NCBI GI: 113475948 NCBI Desc: ribonuclease iii [trichodesmium erythraeum ims101]
MATAAATMTMATPHPRARAPLRVCAAWDMNPGAATVATPKPSKAKAKPPPPATTTPARPPPPTHADLFARSSEGQGVVKKSTYMGFEKWWLPPPPEVKKPRSLYSAASLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQLMFQLGFTSGASSQHIENNPSFCHTSTTCNKVNSSKV

SEQ ID NO: 9393 - DNA, 1467 bp, Sorghum bicolor
  misc_feature: Ceres ANNOT ID no. 6100226
  misc_feature: Encodes the peptide sequence at SEQ ID NO 9394
  misc_feature: Down-regulated in root tissues in response to salicylic acid treatment
atgagccgctacgacggccgcgctgcggacgcgggctcttaccgcgaccgccgcagcgagggggcgttcggaggcgggtcgagggcgttcgcggcgccgagcaaagcggacgcgtccgcggcggcctcggagctcgatgggctgccgcgcttcgagaagaacttctacgtggagtcgccctcggtggccggcatgacggaggaagaggtggaggcgtatcgtcgccgccgggagatcaccgttgagggccgtgacgtgcccaagccggtgcttgagttccgtgatgttggcttcccagaatatgtgttgcaagaaattacaaaagctggttttgtggaacctacacctatccagtcgcaaggttggccaatggcactgaggggccgtgaccttattggcattgcagagacaggatcagggaaaactcttgcttaccttttacctgccattgttcatgtgaatgctcagcctattcttgcccctggcgatggtccaatcgtcttggtgttagctcctacacgtgaacttgctgttcagatacagcaagaagcaaccaagtttggtgcatcatcaaagataaaaagtacttgcatatacggtggtgtgccaaaaggtccacaagttcgtgatcttcaaaaaggtgttgaaattgttatagccacaccaggacgactaattgatatgatagaatcacatcatacaaacttgcgaagggtcacatatcttgttttagatgaagcagatcggatgctagatatgggatttgaacctcagattaagaaaattgtttctcagattcgtccagatcgtcaaacactttactggagcgctacatggccaaaggaagttgagcagttagcaaggaatttcctttttgacccatacaaggtcactattggttctgaagaattgaaggctaatcatgccattgttcagcatgtagagatactatctgagagtcagaagtataacaagctggttaatctactggaggatataatggatggtagccgaattttaatatttatggacaccaagaagggatgcgatcagattactagacagcttcgaatggatggttggcctgctttgtctatccatggtgacaagagccaagcagaacgggattgggtgctttctgaatttaagtcagggaaaagtcctattatgacagccactgatgttgctgcccgaggcttagtgaagtatgtcattaactatgattttccggggtcgcttgaggattatgttcatcgtattggacgaactggcagagcaggtgcaaaaggaacagcttactcctttttcactgcagctaatgccagatttgccaaggaacttattagtattctggaagaagctggacaaaaggtcagctctgagttagctgctatgggtcgtggtgcacctcccccttcttcaggttaccgtgatagatatagggggtatgggggtggccgatcatag

SEQ ID NO: 9394 - protein, 488 aa, Sorghum bicolor
  misc_feature: Ceres ANNOT ID no. 6100226
  misc_feature (115)..(286): Pfam Id: DEAD Pfam Desc: DEAD/DEAH box helicase
  misc_feature (355)..(427): Pfam Id: Helicase_C Pfam Desc: Helicase conserved C-terminal domain
  misc_feature (1)..(488): NCBI GI: 143361556 NCBI Desc: dead-box atp-dependent rna helicase 20
  misc_feature (1)..(487): NCBI GI: 124360402 NCBI Desc: helicase, c-terminal [medicago truncatula]
  misc_feature (1)..(287): NCBI GI: 5669638 NCBI Desc: ethylene-responsive rna helicase [lycopersicon esculentum]
  misc_feature (3)..(488): NCBI GI: 143454263 NCBI Desc: dead-box atp-dependent rna helicase 30
  misc_feature (1)..(487): NCBI GI: 10177293 NCBI Desc: atp-dependent rna helicase-like protein [arabidopsis thaliana]
  misc_feature: Down-regulated in root tissues in response to salicylic acid treatment
MSRYDGRAADAGSYRDRRSEGAFGGGSRAFAAPSKADASAAASELDGLPRFEKNFYVESPSVAGMTEEEVEAYRRRREITVEGRDVPKPVLEFRDVGFPEYVLQEITKAGFVEPTPIQSQGWPMALRGRDLIGIAETGSGKTLAYLLPAIVHVNAQPILAPGDGPIVLVLAPTRELAVQIQQEATKFGASSKIKSTCIYGGVPKGPQVRDLQKGVEIVIATPGRLIDMIESHHTNLRRVTYLVLDEADRMLDMGFEPQIKKIVSQIRPDRQTLYWSATWPKEVEQLARNFLFDPYKVTIGSEELKANHAIVQHVEILSESQKYNKLVNLLEDIMDGSRILIFMDTKKGCDQITRQLRMDGWPALSIHGDKSQAERDWVLSEFKSGKSPIMTATDVAARGLVKYVINYDFPGSLEDYVHRIGRTGRAGAKGTAYSFFTAANARFAKELISILEEAGQKVSSELAAMGRGAPPPSSGYRDRYRGYGGGRS

SEQ ID NO: 9395 - DNA, 1413 bp, Sorghum bicolor
  misc_feature: Ceres ANNOT ID no. 6100229
  misc_feature: Encodes the peptide sequence at SEQ ID NO 9396
atggcgtctccgccccgctccgtcgaggtccggacccccggcgactcgccgcggcccaccgccgctctactctcctcatccgtggccgcaccccagcactcatccgccccccgcctcctgcttctcctcaccgtggtcctcgtcgccgccgcggccttcgtcctgctccgcccgacccctgccctcaccgtcgtgaccgcggtctccgccgcggcgcggccgctctccaagctaccgaagcccgtggtgctgctcatatcctccgacggcttccgcttcgggtaccagtacaaggccccgctcccgcacatccgccgcctcttcgccaatggcacctccgccgccgagggcttgatccccgtcttccccacgctcaccttccccaaccactactccatcgtcaccggtctgtacccctcctcccacggcatcatcaacaactacttccccgaccccatctcgggggactacttcaacatgcgaaaccacgatcccaagttttggctcggggagccgctctgggaaaccgctgccaaccaggggctcctggccgccacattcttctggccgggctcggaggttaagaagggttcctggaactgccccgagaagtactgccaactatacaatggctcggtgccgtttgaggagagggtcgacaccatccttggctatttcgatctcccgtctgaccaaatgccacagttcctgacgctgtactttgaggatcctgatcaccaggggcaccaggtgggtcctgacgatccggcaatcactgatgcggtcgtacatatcgatgagatgctcgggaggctcattgctggtttggaggcgaggggagtgtttgaggatgtgaacattatattgctaggtgatcatggtatggttgggacctgtgacacaaagcttgtgtttctcgaagagttggctccatggatcgagttgaagtcagattgggttctgtcagtgacgccattgctagcaatcaggccaccagatggtgtgtctccagctgaggtcgtggccaagatgaatgagggacttggatctgggaaggtggagaatgggaaatatttgaagatgtacttaaaagaggagttgcctactcgcctacattactcagagagttacaggatcccaccaatcatcgggctggtggaggaagggtataagattgagatgaaacactccaagaaaaatgagtgtggaggggcacatgggtatgacaatgccttcttctcaatgaggaccatatttgccgcacatggaccacgttttcagggtggtagaactgtgccctcatttgagaatgtggagatatacaatgtcatcacttccattctcaatttgaagcccgctccaaacaatggttcagcttctttccctggcacaattcttttgccaagcaaatga

SEQ ID NO: 9396 - protein, 470 aa, Sorghum bicolor
  misc_feature: Ceres ANNOT ID no. 6100229
  misc_feature (81)..(409): Pfam Id: Phosphodiest Pfam Desc: Type I phosphodiesterase / nucleotide pyrophosphatase
  misc_feature (1)..(470): NCBI GI: 7638402 NCBI Desc: ose4 [oryza sativa]
  misc_feature (39)..(468): NCBI GI: 7269867 NCBI Desc: nucleotide pyrophosphatase-like protein [arabidopsis thaliana]
  misc_feature (20)..(468): NCBI GI: 12081942 NCBI Desc: nucleotide pyrophosphatase-like protein [spinacia oleracea]
  misc_feature (6)..(468): NCBI GI: 92869618 NCBI Desc: type i phosphodiesterase/nucleotide pyrophosphatase [medicago truncatula]
  misc_feature (25)..(469): NCBI GI: 92891011 NCBI Desc: type i phosphodiesterase/nucleotide pyrophosphatase [medicago truncatula]
MASPPRSVEVRTPGDSPRPTAALLSSSVAAPQHSSAPRLLLLLTVVLVAAAAFVLLRPTPALTVVTAVSAAARPLSKLPKPVVLLISSDGFRFGYQYKAPLPHIRRLFANGTSAAEGLIPVFPTLTFPNHYSIVTGLYPSSHGIINNYFPDPISGDYFNMRNHDPKFWLGEPLWETAANQGLLAATFFWPGSEVKKGSWNCPEKYCQLYNGSVPFEERVDTILGYFDLPSDQMPQFLTLYFEDPDHQGHQVGPDDPAITDAVVHIDEMLGRLIAGLEARGVFEDVNIILLGDHGMVGTCDTKLVFLEELAPWIELKSDWVLSVTPLLAIRPPDGVSPAEVVAKMNEGLGSGKVENGKYLKMYLKEELPTRLHYSESYRIPPIIGLVEEGYKIEMKHSKKNECGGAHGYDNAFFSMRTIFAAHGPRFQGGRTVPSFENVEIYNVITSILNLKPAPNNGSASFPGTILLPSK

SEQ ID NO: 9397 - DNA, 579 bp, Sorghum bicolor
  misc_feature: Ceres ANNOT ID no. 6100230
  misc_feature: Encodes the peptide sequence at SEQ ID NO 9398
atgtccaagtacggcaccatccccacctcctcctccgcgggcggcggggtgtcactcggcggcgcctccccgctcgacttcatctcgcgcgccaaggcccggggcgcctcggcgctggcgacgcgccggccctggcgcgagctcgcggacgtccacgccgtcggcctgcccccgagcctcggcgacgcgtacctccgcgtgcgcgccaacctcgcgcacttcgccatgaactacgccatcgtcgtgctcgtcgtcgtcttcctctccctcctctggcaccccgtctccctcatcgtcttcctcgtctgcatgctcgcctggctcgtcctctacttcctccgcgacgagcccctcgtcctcttcggccgcgtcgtcgccgacggctacgtcctcgccgcgctcgccgtcatcacgctcggcctcctcctcctcaccgacgccaccgccaacatcctctcctcgctgagcataggcctcgtcctcgtcctcctgcacgccgcgctgcacaaggccgacgacaacgccgcagacgaggtcgaccgctggtacgcgccggtgtcacagcagccgtcgcactag

SEQ ID NO: 9398 - protein, 192 aa, Sorghum bicolor
  misc_feature: Ceres ANNOT ID no. 6100230
  misc_feature (34)..(185): Pfam Id: PRA1 Pfam Desc: PRA1 family protein
  misc_feature (22)..(178): NCBI GI: 62870981 NCBI Desc: prenylated rab acceptor family protein [thlaspi caerulescens]
  misc_feature (1)..(173): NCBI GI: 92869613 NCBI Desc: prenylated rab acceptor pra1 [medicago truncatula]
  misc_feature (4)..(177): NCBI GI: 124360406 NCBI Desc: prenylated rab acceptor pra1 [medicago truncatula]
  misc_feature (1)..(178): NCBI GI: 18072825 NCBI Desc: prenylated rab receptor 2 [arabidopsis thaliana]
  misc_feature (22)..(173): NCBI GI: 115455249 NCBI Desc: os03g0741600 [oryza sativa (japonica cultivar-group)]
MSKYGTIPTSSSAGGGVSLGGASPLDFISRAKARGASALATRRPWRELADVHAVGLPPSLGDAYLRVRANLAHFAMNYAIVVLVVVFLSLLWHPVSLIVFLVCMLAWLVLYFLRDEPLVLFGRVVADGYVLAALAVITLGLLLLTDATANILSSLSIGLVLVLLHAALHKADDNAADEVDRWYAPVSQQPSH

SEQ ID NO: 9399 - DNA, 1923 bp, Sorghum bicolor
  misc_feature: Ceres ANNOT ID no. 6100231
  misc_feature: Encodes the peptide sequence at SEQ ID NO 9400
atggaagctgcaatacccctcgggctcgcccttccccgaggcagcaccggcatctgcagcttctccgtactgctcaactccgcgaccaagcccaacctcagctgcttcggcagggtccccggaaagctcccgcttttcccgtcccgcgccgtctccgaggaccgcgccgacgccacgccgcagtggcaactcgactttcttggggcgagcgcggtgacccccgacacgcctgaggacgaggatgaggaggacctcctcccagccgaggccaccgactggtgcgtccgcgcgcgccgctctgccctgcgctccatcgaggagcggggcctcgcgccctcgctgcagcggatggtgtcaccgcccaagaagaagaaaaagaagaagactgccaagaagaaagaactcaagaaggcggccgccgagctcaagcgccgcaataagcaggtggatgacgcagagggagacgaagatgacgacgatgatgtcgttgatgatttgcagaacatggacgacctggagctccgggtcgcacagttcgccgacggcatgttcgacgaaaagcgccagagaaacagggagaccttcgtccagaccttgtccaggttctcggccgcaccttccaaccggagcaaagaggtgtccttgaaccgctccatcgtccaggcgcaaactgccaacgaggtgctggacctcaccgcagaggtgatcaccgctgtcgccaagggtctcagcccctcgccgctcacgccgctcaacatcgccactgcgctccaccgcatagcgaggaacatggaggcggtgtccatgatgcagacgcaccggcttgcctttgcacgccagagggacatgtccatgctcgtgggtctggccatggtggccctgccagagtgctcgccgcagggtgtctccaacatcgcctgggctttgtccaagattggtggtgacctgctatacctgccggagatggatcggatagctgatgtggccatgtccaaggttcaagacttcaatgcacagaacgttgccaatgttgcaggagcattcgcttccatgcgccaatcagcaccggggcttttttcagcactggccctgagagctgcacaaatactgcagacattcaaggagcaagagcttgctcaattcttgtggggttgtgcttctctaaatgagtgcccccatcccctgcttgatgcactggatactgcttttcagaacgataccagttttcagtgccatgtatctgatttaaaatcaagcgcgcatcagagttcagcagaagaagaactttctggtggagaagatggtagcactagcagtgcccgtacactgaacttcagccgagatcaggttgggaatattgcttggtcctatgctgtcattgggcaaatggaccgtccattcttttcacatatgtggaaaactctgagtcaattcgaagagcaaagagtttccgatcagtatagagaagacatgatgtttgcttcacaagtttacctggcaaaccagtctttgaagcttgaataccgagatcttggactgtgcttaagaagtgatcttgaggagaaagtaacaaaagctggaaagagcaaaaggttcaatcagaagacaacctcttcatttcaaaaggaggttggccgtcttctctatagtacagggcatgagtgggttagagaatatgcaatcgatggttacactgttgatgccgtgttagttgatgagaagcttgcatttgagatagatgggccaacacacttctctaggaatttaggtacaccattaggccacacagcatttaaacgacgctacattactgcttctgggtggaagttggtttccttgtctcttcaagagtgggaggacctacaaggtgagtttgaacaattggaatatttgaggagaatattagacatagaagctgaataa

SEQ ID NO: 9400 - protein, 640 aa, Sorghum bicolor
  misc_feature: Ceres ANNOT ID no. 6100231
  misc_feature (577)..(634): Pfam Id: RAP Pfam Desc: RAP domain
  misc_feature (76)..(640): NCBI GI: 115453599 NCBI Desc: os03g0425000 [oryza sativa (japonica cultivar-group)]
  misc_feature (76)..(640): NCBI GI: 115453599 NCBI Desc: os03g0425000 [oryza sativa (japonica cultivar-group)]
MEAAIPLGLALPRGSTGICSFSVLLNSATKPNLSCFGRVPGKLPLFPSRAVSEDRADATPQWQLDFLGASAVTPDTPEDEDEEDLLPAEATDWCVRARRSALRSIEERGLAPSLQRMVSPPKKKKKKKTAKKKELKKAAAELKRRNKQVDDAEGDEDDDDDVVDDLQNMDDLELRVAQFADGMFDEKRQRNRETFVQTLSRFSAAPSNRSKEVSLNRSIVQAQTANEVLDLTAEVITAVAKGLSPSPLTPLNIATALHRIARNMEAVSMMQTHRLAFARQRDMSMLVGLAMVALPECSPQGVSNIAWALSKIGGDLLYLPEMDRIADVAMSKVQDFNAQNVANVAGAFASMRQSAPGLFSALALRAAQILQTFKEQELAQFLWGCASLNECPHPLLDALDTAFQNDTSFQCHVSDLKSSAHQSSAEEELSGGEDGSTSSARTLNFSRDQVGNIAWSYAVIGQMDRPFFSHMWKTLSQFEEQRVSDQYREDMMFASQVYLANQSLKLEYRDLGLCLRSDLEEKVTKAGKSKRFNQKTTSSFQKEVGRLLYSTGHEWVREYAIDGYTVDAVLVDEKLAFEIDGPTHFSRNLGTPLGHTAFKRRYITASGWKLVSLSLQEWEDLQGEFEQLEYLRRILDIEAE

SEQ ID NO: 9401 - DNA, 900 bp, Sorghum bicolor
  misc_feature: Ceres ANNOT ID no. 6100246
  misc_feature: Encodes the peptide sequence at SEQ ID NO 9402
atgtcttccaacggcaagcccaccccgcagcccccggcagcggcagcggccggcaacggcgccggagcgggcggcccgcccaagatgtaccagcggcccatctaccggccacagcaggcgcccgcgaagcgccggcgcactggcgggcggtcctgcccgttcagctgctgctgctgcttcttctggacggtgctcgtcatcctcctcctcgccttcctggccgccgtggtgggcggcgccttctacctcctgtaccgcccgcaccgcccggcgttcacgctgaccgtggcgcgcgtgacgaagctgagcctgtcgtcgtccgccacggcgcccgcgctgagcgacgccatcgacgtgacgctgacggccaagaaccccaacaagaagctcgtctacctctacgacgacttcaccgtgacggccgccacggccgccaacgccgtcccgctcggcgaggcgtccgtgcccgggttcacggccgacgccggcaacatcaccgtcatcaaggccaccgtctcggcgtccgcgctcacggtcgatcccaccgcggcgagctccgacatcaagaagtccggcgagttccccatcaccgtggacctggagaccaaggccggcgtcagggtgggcgggctcaagaccaagaagattggcatccaggtgcactgcgacggcgtcaaggtggccgcgcccgcggccccgcccgcggcgccggccgccaagaaaaagaagctagggaaggccacggcggcggccgacgctccggcccccgcggcggcggcggaagcgccggcacctgtgtccgccgtcgacgacgcgccggcgccgcccgccgcggcgaccaccgtggcgcgcgtgtgcgaggtcaggatccgggtcaagatctggaagtggaccttctag

SEQ ID NO: 9402 - protein, 299 aa, Sorghum bicolor
  misc_feature: Ceres ANNOT ID no. 6100246
  misc_feature (82)..(222): Pfam Id: Hin1 Pfam Desc: Harpin-induced protein 1 (Hin1)
  misc_feature (90)..(299): NCBI GI: 115462555 NCBI Desc: os05g0199100 [oryza sativa (japonica cultivar-group)]
  misc_feature (14)..(239): NCBI GI: 92898246 NCBI Desc: heavy metal transport/detoxification protein; harpin-induced 1 [medicago truncatula]
  misc_feature (18)..(237): NCBI GI: 124360377 NCBI Desc: harpin-induced 1 [medicago truncatula]
  misc_feature (7)..(238): NCBI GI: 11762174 NCBI Desc: at1g17620 [arabidopsis thaliana]
  misc_feature (7)..(232): NCBI GI: 15239459 NCBI Desc: harpin-induced protein-related / hin1-related / harpin-responsive protein-related [arabidopsis thaliana]
MSSNGKPTPQPPAAAAAGNGAGAGGPPKMYQRPIYRPQQAPAKRRRTGGRSCPFSCCCCFFWTVLVILLLAFLAAVVGGAFYLLYRPHRPAFTLTVARVTKLSLSSSATAPALSDAIDVTLTAKNPNKKLVYLYDDFTVTAATAANAVPLGEASVPGFTADAGNITVIKATVSASALTVDPTAASSDIKKSGEFPITVDLETKAGVRVGGLKTKKIGIQVHCDGVKVAAPAAPPAAPAAKKKKLGKATAAADAPAPAAAAEAPAPVSAVDDAPAPPAAATTVARVCEVRIRVKIWKWTF

SEQ ID NO: 9403 - DNA, 1677 bp, Sorghum bicolor
  misc_feature: Ceres ANNOT ID no. 6100269
  misc_feature: Encodes the peptide sequence at SEQ ID NO 9404
atggctgcccacgccgtcaccccgctcaccatctgccgcctccgccgcggcgtccccctccaccacagccgccgcctcctcgccgtggccgccgcagcgccggaagcgcctgcgcctccccccgcgatatcccagtcgccgccgtccccggttccgccccgcaagggctacttcccgaagcgcggcgagaccgtcgagctcacctgcgaggcgctcgccttcaagggtaagggcgtctgcaaggtcgcgggctccaccttcgtcctgctctgcgatggcgcgctccccggcgagcgcctcgtcgcccgcgtcagccgcctccgccgcggcgccttcgccgaggccgccaagctcaggaccctcgagccgcaccacgacgccgtcgaggcgccctgccccctcgctgctgattgcggtggctgcaagacccagactctcgcgtacgccgcgcagatccgtcacaagcatctccaggttcgcgatttgctcgtgaactttggcaagtttgatcccaagcgcatggagagctcggaaccggatgcgatcctcaaacccatcgtgccgtgcgacgagatattccgatacaggaacaagatggagttctcgtttgggaccaagagatgggtgcaaaaggagttgaagggcaaggatgaggaggtgggggtgaagcaggaaacgaatgaaactgatggatatgcgcttggactgcacgcaccaggattctttgacaaggtgctacatgtgcagaaatgttttctgcagagtgaaccagcagataaggttcttgcagttgttcaagaaacctggatggatcctgccgtaggcctcacaccttatgatgtccataagcatgttgggtttctcaagcatcttatgataagaaccggaagaaacgtcagcactggaactccagaagtaatggtcaattttgtgacgccatgttataaaccagatctattgatgcctcttgttgacaaaatcacaaaaatacctgaagtggtcagcatcataaataatgtgaactcatctgttggcaatacatctgtcggtgaacaagaatataccttgtacgggaagccaaacattacagagatgttgagaggacttacgttccagatatctgcaaactccttttttcagactaatacaaagcaggctgatgttctttacaagcttattgaagactctgctgggcttaaaggcgatggctctgaaattgttcttgacttgttttgtggaactggaaccattggtttgacccttgccagaagggcaaagcatgtttatggatatgaagttgtccctgaggccattgcagatgcacgaaagaatgccaagttgaatggtatcgataatgcaacatttgttcaaggggatctcaataaaatcaatgaatcattcgggaaggaatttccaaagcctgacatcatcatttcagatcctaatcgacccgggatgcatatgaagttaatcaagtggctgttagaagttaaagctcctcgaatagtgtatgtctcctgtaatccagctacttgtgctcgggatttggactacctatgtcacggcgtggaggagaaagatttgagaggattctatgacctgaagagtgtaattcctgtggatatgtttcctcatactcctcatatcgagtgtgtctgcttattggagctgcgttga

SEQ ID NO: 9404 - protein, 558 aa, Sorghum bicolor
  misc_feature: Ceres ANNOT ID no. 6100269
  misc_feature (231)..(558): Pfam Id: tRNA_U5-meth_tr Pfam Desc: tRNA (Uracil-5-)-methyltransferase
  misc_feature (57)..(557): NCBI GI: 9280234 NCBI Desc: rna methyltransferase-like protein [arabidopsis thaliana]
  misc_feature (185)..(556): NCBI GI: 121543411 NCBI Desc: rna methyltransferase [candidatus desulfococcus oleovorans hxd3]
  misc_feature (179)..(558): NCBI GI: 88805891 NCBI Desc: rna methyltransferase, trma family protein [robiginitalea biformata htcc2501]
  misc_feature (235)..(558): NCBI GI: 15613250 NCBI Desc: rna methyltransferase [bacillus halodurans c-125]
  misc_feature (183)..(558): NCBI GI: 117578388 NCBI Desc: trna (uracil-5-)-methyltransferase [gramella forsetii kt0803]
MAAHAVTPLTICRLRRGVPLHHSRRLLAVAAAAPEAPAPPPAISQSPPSPVPPRKGYFPKRGETVELTCEALAFKGKGVCKVAGSTFVLLCDGALPGERLVARVSRLRRGAFAEAAKLRTLEPHHDAVEAPCPLAADCGGCKTQTLAYAAQIRHKHLQVRDLLVNFGKFDPKRMESSEPDAILKPIVPCDEIFRYRNKMEFSFGTKRWVQKELKGKDEEVGVKQETNETDGYALGLHAPGFFDKVLHVQKCFLQSEPADKVLAVVQETWMDPAVGLTPYDVHKHVGFLKHLMIRTGRNVSTGTPEVMVNFVTPCYKPDLLMPLVDKITKIPEVVSIINNVNSSVGNTSVGEQEYTLYGKPNITEMLRGLTFQISANSFFQTNTKQADVLYKLIEDSAGLKGDGSEIVLDLFCGTGTIGLTLARRAKHVYGYEVVPEAIADARKNAKLNGIDNATFVQGDLNKINESFGKEFPKPDIIISDPNRPGMHMKLIKWLLEVKAPRIVYVSCNPATCARDLDYLCHGVEEKDLRGFYDLKSVIPVDMFPHTPHIECVCLLELR

SEQ ID NO: 9405 - DNA, 687 bp, Sorghum bicolor
  misc_feature: Ceres ANNOT ID no. 6100272
  misc_feature: Encodes the peptide sequence at SEQ ID NO 9406
atggaggcgggccaggtaccggacgggagggctctgatggcggccgtcaccaccacaggcggcggtgggcgggagccggagggcctgccgtgcccgcgctgcgagtccgtcaacaccaagttctgctactacaacaactacaacctctcccagccgcgctacttctgcaagacgtgccgccgctactggacgcgcgggggcgcgctccgcaacgtccccgtcggcggcaacacccgcaaggccacgcccgcaaccggccgccgcaagcgctccactccagctcccgtcaacgtcaccgtgccggcgcccgcgaccgcgtcgcctccgcctccgccggcgctccacggcggctcgctgctgcgcccgtacggcggcggcggcggcagcggcctcctgtcgttcgccgcgccggccctggcgtcgccgctcgccgccgcggacccggaccgccggctgctcgacttcggcggcagcttcacctcgctgatcgcgcccggggtggcggacgtcggtgtccacttctccgccgggttcctgatgggcgggctcgcgccggcggccctgcctcgcgcgcctggctctgtcgctgctctgccgccaccgccaccgcagcagcagcccacggtgtcccaggcgttgcccgagggcatggtctggagcatggggtggccggacctgtccatctaa

SEQ ID NO: 9406 - protein, 228 aa, Sorghum bicolor
  misc_feature: Ceres ANNOT ID no. 6100272
  misc_feature (24)..(86): Pfam Id: zf-Dof Pfam Desc: Dof domain, zinc finger
  misc_feature (21)..(203): NCBI GI: 46390595 NCBI Desc: dof zinc finger protein [oryza sativa (japonica cultivar-group)]
  misc_feature (25)..(217): NCBI GI: 115456249 NCBI Desc: os03g0821200 [oryza sativa (japonica cultivar-group)]
  misc_feature (20)..(171): NCBI GI: 37051131 NCBI Desc: dna binding with one finger 5 protein [pisum sativum]
  misc_feature (25)..(131): NCBI GI: 112363358 NCBI Desc: dof1 [glycine max]
  misc_feature (10)..(102): NCBI GI: 33332411 NCBI Desc: dof-like protein 34 [oryza sativa]
  misc_feature: The plant is abnormally small.
  misc_feature: The plant produces a reduced number of seeds.
  misc_feature: The sequence is a functional homolog of SEQ ID NO 1133 in the 10/374,780US patent application
  misc_feature: The sequence is a functional homolog of SEQ ID NO 1790 in the 10/374,780US patent application
  misc_feature: Useful for biocontainment applications
  misc_feature: Useful for making plants with altered alkaloid content
  misc_feature: Useful for making plants with altered sterol content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Useful for making plants with modulated nitrogen use efficiency
  misc_feature: Functional homolog of the protein sequence given in SEQ ID NO 12960
  misc_feature: Functional homolog of the protein sequence given in SEQ ID NO 13027
  misc_feature: Functional homolog of the protein sequence given in SEQ ID NO 13435
  misc_feature: Functional homolog of the protein sequence given in SEQ ID NO 13440
  misc_feature: The sequence is a functional homolog of SEQ ID NO 1133 in the 20060162006 US patent application
  misc_feature: The sequence is a functional homolog of SEQ ID NO 1790 in the 20060162006 US patent application
  misc_feature: The sequence is a functional homolog of SEQ ID NO. 486 in the 11/188,298 US application
  misc_feature: The sequence is a functional homolog of SEQ ID NO. 379 in the 11/188,298 US application
  misc_feature: The sequence is a functional homolog of SEQ ID NO. 489 in the 11/188,298 US application
MEAGQVPDGRALMAAVTTTGGGGREPEGLPCPRCESVNTKFCYYNNYNLSQPRYFCKTCRRYWTRGGALRNVPVGGNTRKATPATGRRKRSTPAPVNVTVPAPATASPPPPPALHGGSLLRPYGGGGGSGLLSFAAPALASPLAAADPDRRLLDFGGSFTSLIAPGVADVGVHFSAGFLMGGLAPAALPRAPGSVAALPPPPPQQQPTVSQALPEGMVWSMGWPDLSI

SEQ ID NO: 9407 - DNA, 1044 bp, Sorghum bicolor
  misc_feature: Ceres ANNOT ID no. 6100278
  misc_feature: Encodes the peptide sequence at SEQ ID NO 9408
atgggggactccagcggctccgtgtcggtcgacgtcgagcggctcttcttcggcggcaaggagcatcgagtaagaacgaggcatggccctctatcggtttctgtgtatggagatgaggacaagcccgcgctcgtaacttatccggatgtagccttaaatcacatgtcttgcttccaaggattgttcttctgtccagaggctgtgtcgctgttgcttcacaatttctgtgtgtatcacatcacacctcaaggacacgagttaggagcagctccgatttcagctgatgtgcctctgccatccgtcgatgaccttgcagatcaggttgctgatgtccttgattttttcagtttagggtctgtaatgtgcttgggtgtcactgctggtgcctatgtcctcaccctctttgcaacgaagtatcgggagagggttcttggcctaattttggtttcacctgtatgcaaagccccctcttggagcgagtggttgtataataaggtattattaaacttgctttattactatgggacacgtgggttagtcaaggaaagtttgcttcagcgatatttcagcatggacgttcgtggtaacgggcaagatcctgaatcagagattgtccaagcctgcagaagtttacttgatgagaggcagggaactaacgtctggcggttccttcaggcaattaacaggcggcatgatttaacagaatcattgaagaagcttcagtgccggaccctgatttttgttggggacaactcacagttccatgctgacgctgtccacatgaccacaaagctggaccggagatactgcgctctagtcgaggttcaggcctgtggttcgcttgtcacagaagagcagccccatgcgatggtgatcccgatggaatacttcctaatgggatacgggctttacaggccatcccagcaggaaagcagcccccggagcacactgagcccgttctgcatatcgcccgagcttctatcgccggagagcatgggagtgaagctgaagcccatcaagacacgcatctcgcttaacgtttag

SEQ ID NO: 9408 - protein, 347 aa, Sorghum bicolor
  misc_feature: Ceres ANNOT ID no. 6100278
  misc_feature (21)..(305): Pfam Id: Ndr Pfam Desc: Ndr family
  misc_feature (1)..(344): NCBI GI: 21593137 NCBI Desc: pollen specific protein sf21 [arabidopsis thaliana]
  misc_feature (1)..(345): NCBI GI: 13605684 NCBI Desc: at5g11790/t22p22_180 [arabidopsis thaliana]
  misc_feature (1)..(343): NCBI GI: 82494244 NCBI Desc: sf21c1 [helianthus annuus]
  misc_feature (21)..(343): NCBI GI: 145329178 NCBI Desc: ndr family protein [arabidopsis thaliana]
  misc_feature (1)..(343): NCBI GI: 145308278 NCBI Desc: sf21c6 [helianthus annuus]
MGDSSGSVSVDVERLFFGGKEHRVRTRHGPLSVSVYGDEDKPALVTYPDVALNHMSCFQGLFFCPEAVSLLLHNFCVYHITPQGHELGAAPISADVPLPSVDDLADQVADVLDFFSLGSVMCLGVTAGAYVLTLFATKYRERVLGLILVSPVCKAPSWSEWLYNKVLLNLLYYYGTRGLVKESLLQRYFSMDVRGNGQDPESEIVQACRSLLDERQGTNVWRFLQAINRRHDLTESLKKLQCRTLIFVGDNSQFHADAVHMTTKLDRRYCALVEVQACGSLVTEEQPHAMVIPMEYFLMGYGLYRPSQQESSPRSTLSPFCISPELLSPESMGVKLKPIKTRISLNV

SEQ ID NO: 9409 - DNA, 1140 bp, Sorghum bicolor
  misc_feature: Ceres ANNOT ID no. 6100285
  misc_feature: Encodes the peptide sequence at SEQ ID NO 9410
atgatgatgatgggcgagggagtgagcgtgccgccgtggacccaccacgtccccgtgagcggcgtcgacgtcggcggcggcgacgagatgacgccgtacctgctcgcggcgctgcgccagtacctgccgtgcaacgacgccgccgctggcgccgaggcggacgacgaggacgcggccgccatggccgcgggcgtcgacggctacggctgcgacgagttccgcatgtacgagttcaaggtccgccgttgcgcccgcgcgcgcagccacgactggaccgagtgccccttcgcgcacccgggggagaaggcccgccgccgcgacccgcgcaagtaccactactccggcaccgcctgcccggacttccgcaagggcgggtgcaagcgcggcgacaactgcgacttcgcgcacggcgtcttcgagtgctggctccacccggcgcgctaccgcacccagccctgcaaggacggcaccgcctgccgccgccgggtctgcttcttcgcccacaccccggaccagctgcgggtgctgcccaccacgcagcatcagcagtccagcccccgcggcgccgcggcgtgctccccgctcgccgactcctacgacggctccccgctgcggcgccaggcggtcgagagcttccgcaccaagagcatcatgtcctcgtcgccgaccagcaccctcatgtcgccgcccaagtcgccgccgtcggagtccccgccattgtcgccggacggggccgccgcgttccgccgcgggtcctggccgggcgtggggtcccccgtcaacgacgtgctcgccacactccgccagctccgcctcagcaaggcgaactcgtccccgtcgggcgggtggggcggctacccggcatccgcggtcggctacgcatcgcccacggcgggtgggttctacagcctgccaaccacgccgacaaccctggccaccgcctccggctacatggccaacatggagccgcttgacgtcagcttctgcggcgacgaggagcctgtggagagggtggagtccgggcgggccctccgcaccaaggtgttcgagcggctcagcagggatggcgctgtttccggcgacgccaccgccggaatcagtggccctgacgtcgggtgggtctccgacctcatcaactga

SEQ ID NO: 9410 - protein, 379 aa, Sorghum bicolor
  misc_feature: Ceres ANNOT ID no. 6100285
  misc_feature (113)..(138): Pfam Id: zf-CCCH Pfam Desc: Zinc finger C-x8-C-x5-C-x3-H type (and similar)
  misc_feature (1)..(379): NCBI GI: 115435036 NCBI Desc: os01g0192000 [oryza sativa (japonica cultivar-group)]
  misc_feature (8)..(242): NCBI GI: 92893962 NCBI Desc: zinc finger, ccch-type [medicago truncatula]
  misc_feature (61)..(242): NCBI GI: 92887662 NCBI Desc: zinc finger, ccch-type [medicago truncatula]
  misc_feature (68)..(239): NCBI GI: 21655307 NCBI Desc: at5g58620/mzn1_70 [arabidopsis thaliana]
  misc_feature (68)..(233): NCBI GI: 140039408 NCBI Desc: zinc finger, ccch-type [medicago truncatula]
  misc_feature: The sequence is a functional homolog of SEQ ID NO 1138 in the 11/479,226 US patent application
  misc_feature: The sequence is a functional homolog of SEQ ID NO 500 in the 10/412,699 US patent application
  misc_feature: Useful for making plants with modulated flowering time
  misc_feature: Functional homolog of the protein sequence given in SEQ ID NO 13971
MMMMGEGVSVPPWTHHVPVSGVDVGGGDEMTPYLLAALRQYLPCNDAAAGAEADDEDAAAMAAGVDGYGCDEFRMYEFKVRRCARARSHDWTECPFAHPGEKARRRDPRKYHYSGTACPDFRKGGCKRGDNCDFAHGVFECWLHPARYRTQPCKDGTACRRRVCFFAHTPDQLRVLPTTQHQQSSPRGAAACSPLADSYDGSPLRRQAVESFRTKSIMSSSPTSTLMSPPKSPPSESPPLSPDGAAAFRRGSWPGVGSPVNDVLATLRQLRLSKANSSPSGGWGGYPASAVGYASPTAGGFYSLPTTPTTLATASGYMANMEPLDVSFCGDEEPVERVESGRALRTKVFERLSRDGAVSGDATAGISGPDVGWVSDLIN

SEQ ID NO: 9411 - DNA, 1518 bp, Sorghum bicolor
  misc_feature: Ceres ANNOT ID no. 6100291
  misc_feature: Encodes the peptide sequence at SEQ ID NO 9412
atgtaccgagtcgcctccggcctcggcgccctcaagaggcatggggcagatgctcaaatgatgaatgttgcaatcaggtgtgccagcacaagtgttgcacaagggtcatctggtggcttctggacctggttgactggtgcacgctcaaatgaaatacctcctccagattttgcacttccgggagtgactattcctcctccgctacctgatcatgtggaggctggcaagacaatagtcacaacacttcccaatggtgttaaaatagcctctgagacatctgcaggatcatcttgttctgttggagtttatgttgattgtggttctgtatatgaagcacctgaaacaacaggcgccagtcaactggtgaagacaatggccttcgcaaccactgccaacaggagcgaattgcgggttgtgcgtgaaattgacgcaataggtggcactgccaaagcatctgctagccgtgagatgatgagctacacttacagggccctgaagacttacatgcctgaaatggttgaggtgcttattgattgtgtacgcaaccctgcttttcttgattgggaggtcaaggaacagattttgaggctaaaggcagagcttgtgaaatcatcaagtaatcctgaaaaattccttttggaggctcttcattctactggctattctggtgctttagcaaacccactaattgcatcagaatatgcaattagcagattgaattcagatgtcctggagcaatttataattgagaactacactgctccccgcattgttctagctgcatcaggtgttgaccatgaagaattggtatctattgctgggccccttctgtctgacattcccagtgtatctggaacaacaaggccaaaatctacttacataggtggcgaatacaaaaaaagtgcagattcatcgaacacagatgttgcattggcattcgaggtcccaagtggttggctcaaagaaaaagattttgtgaccgcatcagttcttcagacacttctgggtggcggtggcaaattttcttggggaaggcaaggaaaggggttgcattcgcgtctaaaccatctagtaaatgaatttgatcagatcaagtcaatctctgctttcaaggacgttcacagtaatactggcatctttggaatccatacatctactgatgcatcatttgttcctaaagctattgacctagcagccagagagctcacttcccttgcaactccaggacaagttgaccaaagccaactagaccgtgctaaagcctcagctaaatcagcgatactggcgaacctggaatcgcaggcatcactaacagaagacatggggcgccaagttttggcatttggtgaaaggaaacctgctgagcaccttctcaaggctattgacggtgttactctgaaagatgtaacatctgttgctgaaaagatcatttcatcaccattgacaatggcatctcatggaaacgttctgaacatgccaacttatgagtcggtcagtggcaagttccgctcaaaatga

SEQ ID NO: 9412 - protein, 505 aa, Sorghum bicolor
  misc_feature: Ceres ANNOT ID no. 6100291
  misc_feature (87)..(233): Pfam Id: Peptidase_M16 Pfam Desc: Insulinase (Peptidase family M16)
  misc_feature (238)..(423): Pfam Id: Peptidase_M16_C Pfam Desc: Peptidase M16 inactive domain
  misc_feature (1)..(505): NCBI GI: 11993905 NCBI Desc: mitochondrial processing peptidase alpha-chain precursor [dactylis glomerata]
  misc_feature (1)..(505): NCBI GI: 587562 NCBI Desc: mitochondrial processing peptidase [solanum tuberosum]
  misc_feature (24)..(505): NCBI GI: 115464979 NCBI Desc: os05g0524300 [oryza sativa (japonica cultivar-group)]
  misc_feature (1)..(505): NCBI GI: 21493 NCBI Desc: mitochondrial processing peptidase [solanum tuberosum]
  misc_feature (1)..(505): NCBI GI: 15076515 NCBI Desc: mitochondrial processing peptidase alpha subunit [morus alba]
MYRVASGLGALKRHGADAQMMNVAIRCASTSVAQGSSGGFWTWLTGARSNEIPPPDFALPGVTIPPPLPDHVEAGKTIVTTLPNGVKIASETSAGSSCSVGVYVDCGSVYEAPETTGASQLVKTMAFATTANRSELRVVREIDAIGGTAKASASREMMSYTYRALKTYMPEMVEVLIDCVRNPAFLDWEVKEQILRLKAELVKSSSNPEKFLLEALHSTGYSGALANPLIASEYAISRLNSDVLEQFIIENYTAPRIVLAASGVDHEELVSIAGPLLSDIPSVSGTTRPKSTYIGGEYKKSADSSNTDVALAFEVPSGWLKEKDFVTASVLQTLLGGGGKFSWGRQGKGLHSRLNHLVNEFDQIKSISAFKDVHSNTGIFGIHTSTDASFVPKAIDLAARELTSLATPGQVDQSQLDRAKASAKSAILANLESQASLTEDMGRQVLAFGERKPAEHLLKAIDGVTLKDVTSVAEKIISSPLTMASHGNVLNMPTYESVSGKFRSK

SEQ ID NO: 9413 - DNA, 345 bp, Sorghum bicolor
  misc_feature: Ceres ANNOT ID no. 6100295
  misc_feature: Encodes the peptide sequence at SEQ ID NO 9414
atgtcgtggcaggcctacgtggacgagcacctgctgtgcgacatcgacggccagaccagcgcctcaccgccgcggcgccgtcaaacccgaagaaatcacttccgacctgtcgtaatgaatgatttcaatgaaccaggctctctggcgcccactggtttataccttgggggtagcaaatacatggctatccaaggtaaacctagagttttcattcgagagaagaagggaccaggtggggttacaatcaaaaagaccagtctggccatcataactgggatttacgaggagccaatggcacggcgcctggccagtgcaaacgtggttgtggagaggcttggtgactga

SEQ ID NO: 9414 - protein, 114 aa, Sorghum bicolor
  misc_feature: Ceres ANNOT ID no. 6100295
  misc_feature (2)..(114): Pfam Id: Profilin Pfam Desc: Profilin
  misc_feature (1)..(114): NCBI GI: 3021373 NCBI Desc: profilin [glycine max]
  misc_feature (1)..(114): NCBI GI: 3021375 NCBI Desc: profilin [glycine max]
  misc_feature (1)..(114): NCBI GI: 14161637 NCBI Desc: profilin [ananas comosus]
  misc_feature (1)..(114): NCBI GI: 52352489 NCBI Desc: profilin [citrullus lanatus]
  misc_feature (1)..(114): NCBI GI: 110729187 NCBI Desc: profilin [glycine max]
  misc_feature: Useful for biocontainment applications
  misc_feature: Useful for making plants with modulated biomass
  misc_feature: Functional homolog of the protein sequence given in SEQ ID NO 13035
MSWQAYVDEHLLCDIDGQTSASPPRRRQTRRNHFRPVVMNDFNEPGSLAPTGLYLGGSKYMAIQGKPRVFIREKKGPGGVTIKKTSLAIITGIYEEPMARRLASANVVVERLGD

SEQ ID NO: 9415 - DNA, 1941 bp, Sorghum bicolor
  misc_feature: Ceres ANNOT ID no. 6100307
  misc_feature: Encodes the peptide sequence at SEQ ID NO 9416
  misc_feature: Down-regulated in shoot tissues in response to aminocyclopropane carboxylic treatment
  misc_feature: Up-regulated in root tissues in response to methyl jasmonate treatment
  misc_feature: Down-regulated in shoot tissues in response to methyl jasmonate treatment
atgatgtccgcgcgcaccgccgccgcgtcgcccgcctccgcgtggaagcggggaggaggacggagcgagggcggtggcagcagctgcgacggatgcaggacctacaggaacaccttgcggaggagggccgcggcggccaaggtgcgcgccgtgccgccgaagcgggtggaggcggtcgcgatgggctccgccgcggagacggagacgcaggaggaggtggaggtggcggcgaccggcggcgtcgtcgaggacccctacggcgaggacagcgccaccgaggagctgcccgtcacgccctgggccttctccgtcgcaagcggttacacccttttgagggatccacatcacaacaagggtcttgccttcacggagaaggagagggatgcacactacttgcgtggactgcttcctcctgcagttgtgtctcaggaactccaaattaagaagatcatgcacaacctgcggcagtaccaggtccctttgcagcgctatatggccatgatggaccttcaggagaggaacgagaggcttttctacaagcttttaattgataatgtggaggagctgcttcctgttgtttacacaccaactgtaggtgaggcttgccagaagtatgggtccatctttcgacaaccacagggtctgtatgtcagcctgagggacaaggggagggtcctagaagttctaaggaactggccacaaagggacattcaagttatctgtgttactgatggtgagcgaatcttgggacttggagatttgggttgtcagggaatgggaattcctgtaggcaagcttgctctatacactgctcttggaggagttcgtccatcagcttgtttgcctatcacaattgacgttggcacaaataatgagaaactgcttaatgatgaattctacattggactccggcaaaaacgtgcaactggcaaggagtatgatgagcttatggaagagttcatggctgctattaagcaaatctacggtgagaaagtcctcattcagtttgaggactttgccaatcataatgcctttgatttgcttgaaaaatataggaagagccatcttgttttcaatgatgatatccagggcacagcatcagtggtccttgcaggtctgttagcagcactcaagatggttggtgggaccctggcagagcagacttatttgttccttggtgctggggaggctggaactggtattgcagaactcattgctcttgagatttcaaaacagacgaaggccccaattgaagagtgccgcaagaaggtttggctggtggactcaaagggtttgattgttgactctcgtaaaaactcccttcagccattcaaaaaaccttgggcacatgagcatgagcccttgggaaccttatatgatgctgttcagtccatcaaacctacagttctgattgggacatctggagttggaagaacattcacaaaagaagttgttgaggccatggcttccttcaatgagaggcctatcatcttttcactgtcaaatccaacctcacattctgaatgcactgctgaacaagcatatacctggactcagggtcgtgcagtatttgcgagtggcagtccatttgcccctgtggagtacgacgggaagacttttgtacctgggcagtcgaacaatgcctacatcttccctggactcggcctcggtcttgttatttctggagccgtccgtgtccacgaggacatgcttcttgccgcctcggctgcactagctgatcaggccacagaggagaactttgtcacgggatcgatcttcccacccttcaccaacattagaaagatctctgcgcacattgctgcagccgtggctgcaaaagcttatgaactcggtttggcgacccgtctgcctcccccccgagacctggtgaaatatgcagagagctgcatgtacactcctgtctaccgtaactatcggtag

SEQ ID NO: 9416 - protein, 646 aa, Sorghum bicolor
  misc_feature: Ceres ANNOT ID no. 6100307
  misc_feature (362)..(615): Pfam Id: Malic_M Pfam Desc: Malic enzyme, NAD binding domain
  misc_feature (171)..(360): Pfam Id: malic Pfam Desc: Malic enzyme, N-terminal domain
  misc_feature (1)..(646): NCBI GI: 37147841 NCBI Desc: non-photosynthetic nadp-malic enzyme [zea mays]
  misc_feature (1)..(646): NCBI GI: 18460985 NCBI Desc: nadp-dependent malic enzyme [zea mays]
  misc_feature (106)..(646): NCBI GI: 4096786 NCBI Desc: nadp-malic enzyme [zea mays]
  misc_feature (1)..(646): NCBI GI: 30526303 NCBI Desc: nadp-dependent malic enzyme [sorghum bicolor]
  misc_feature (1)..(646): NCBI GI: 126737 NCBI Desc: nadp-dependent malic enzyme, chloroplast precursor (nadp-me)
  misc_feature (1)..(646): SWISSPROT Homolog: EC 1.1.1.40 NADP-dependent malic enzyme, chloroplast precursor
  misc_feature (107)..(642): SWISSPROT Homolog: EC 1.1.1.38 NAD-dependent malic enzyme, mitochondrial precursor
  misc_feature: Down-regulated in shoot tissues in response to aminocyclopropane carboxylic treatment
  misc_feature: Up-regulated in root tissues in response to methyl jasmonate treatment
  misc_feature: Down-regulated in shoot tissues in response to methyl jasmonate treatment
  misc_feature: The sequence is a functional homolog of SEQ ID NO. 292 in the 11/188,298 US application
MMSARTAAASPASAWKRGGGRSEGGGSSCDGCRTYRNTLRRRAAAAKVRAVPPKRVEAVAMGSAAETETQEEVEVAATGGVVEDPYGEDSATEELPVTPWAFSVASGYTLLRDPHHNKGLAFTEKERDAHYLRGLLPPAVVSQELQIKKIMHNLRQYQVPLQRYMAMMDLQERNERLFYKLLIDNVEELLPVVYTPTVGEACQKYGSIFRQPQGLYVSLRDKGRVLEVLRNWPQRDIQVICVTDGERILGLGDLGCQGMGIPVGKLALYTALGGVRPSACLPITIDVGTNNEKLLNDEFYIGLRQKRATGKEYDELMEEFMAAIKQIYGEKVLIQFEDFANHNAFDLLEKYRKSHLVFNDDIQGTASVVLAGLLAALKMVGGTLAEQTYLFLGAGEAGTGIAELIALEISKQTKAPIEECRKKVWLVDSKGLIVDSRKNSLQPFKKPWAHEHEPLGTLYDAVQSIKPTVLIGTSGVGRTFTKEVVEAMASFNERPIIFSLSNPTSHSECTAEQAYTWTQGRAVFASGSPFAPVEYDGKTFVPGQSNNAYIFPGLGLGLVISGAVRVHEDMLLAASAALADQATEENFVTGSIFPPFTNIRKISAHIAAAVAAKAYELGLATRLPPPRDLVKYAESCMYTPVYRNYR

SEQ ID NO: 9417 - DNA, 2967 bp, Sorghum bicolor
  misc_feature: Ceres ANNOT ID no. 6100313
  misc_feature: Encodes the peptide sequence at SEQ ID NO 9418
  misc_feature: Down-regulated in root tissues in response to salicylic acid treatment
  misc_feature: Up-regulated in root tissues in response to salicylic acid treatment
  misc_feature: Down-regulated in shoot tissues in response to aminocyclopropane carboxylic treatment
  misc_feature: Down-regulated in shoot tissues in response to salicylic acid treatment
atggcgactttcgcgaaacctgagaacgcactcaagagagctgaagaattaatccatgttgggcaaaagcaggcagccctgcaggctttacatgatctcattacctcgaaaaggtacaggtcatggcagaagcctctcgaaaagatcatgatgaagtatgtagaactctgtgtagacctgaggaaaggtagatatgcaaaagatggtcttattcagtataggattgtctgccagcaagtgaacgtgtcatccttggaggatgtcataaagcacttcatgcagctttccaatgagaaagctgaacaagctaagagtcaggcagaagccctggaagatgctctggatgttgaagatctggaagcagacaagcgacctgaggacctcatgctcagttttgttagtggggagaaaggaaaggaccgatcagataaggaagttgtaactccatggtttaagttcctctgggaaacatacaggactgttctagagatactaaggaacaattcaaagcttgaagcgttatatgctatgactgctcatagggcttttcaattctgtaaacagtataagagaacaactgaattccgtaggttgtgtgagattatcagaaatcatcttgctaatctcaacaaatatcgtgatcaaagagatcgtcctgatctgactgcacctgaaagtttacaactgtatcttgatacacgtgttgagcagcttaaagttgctacagagctttccctttggcaggaagccttccgatcggtggaagatatccatggtttgatgagcatggtgaagaaaatgccaaaaccttctatcttggtggtgtattatgcaaagttgactgaaatcttctggatatctgacagccacctttatcatgcatatgcgtggctcaagcttttcaacttgcaaaagagctacaataaaaacttgtctcagaaggacctacaattaatagcatcttcggtcttacttgctgcactatctgtggcaccttatgaccaaaagtatggtgcatctcatcttgagacagagaatgagaaggaacgtaacatgcggatggccaaccttgttaacttctcacttgattccaagcgtgaaaatagggaaatgccttcaagagcatctcttctatctgagttggcctcaaaaggagtcctttcatgtgcttcccaagaagtgcgagatttgtacaaccttttggaacatgaatttctgcctctggaccttgcatcaaaagtgcagccgcttctttcgaagatttcaaagattggagggaagctttcatcagcttcttctgttccagaggttaagctatctcagtacatttcagcattggagaagctgacaacattgagagtgctacaacaggcctcttctattttccagtccatgaagattgatatgctctcaagaatgattcctttctttgacttttctgttgtggagaagatttctgttgatgctgtgaaacgcaattttgttgctataaaagttaaccatttatctggagctgttcattttggtactgtggacatagaatctgatggcttaagtgatcaccttagtattcttgctgattcattaaacaaagcgaggattcatatttgtccaccagtgaaaaagccgtctaaactcagtgaaagtctcgttagtttggctggaatagtggagaatgagcataagaggcttcttgcaagaaagtccatcattgaaaaacgcaaagaagagcttgagcgtcaaatattggagaaggaaaaagaagaagaaaaaaagagaatgagcagtcaaaagaaaaccgcggatgaggaaagggtgaggcttctcaatgaacagaggcagagggagcaggaccggattcgtagagagatagaggaaaaaaataaagcagaagcaaaaaagttgctggaagacttgaagaaggcagggaaaaaacatgtcgttgttgaaggggagcttactaaggaggccatcatggaattagcacggaatgaacagttgaaggagcgccaggaaatggagaaaaaactgcagaagtttgcaaaaacaatggattatctggaaagggcaaaaaggcaggaagaggcaccactgattgaacaagctttccaaaaacgtctcgaggaagagaagatccttcacgagcaagagcagcttcgggagattgaactcagcaagcaacaccatgctggcgacttgcaagagaaaaatagactttctcgaatgttggagcacaagaacgctttccaagagagaattgtccaacgccgtgaagctgagtttggtcgtctagagaaagagagagatgaacgaatcagtcagttgatatcatcaagaaagcgtgaaagggagacagtaaggaagttgatgtattatctgaacctggaggaacagcggattgaaatgcttcgtgaggaagaggaagctagaaaacgtgaagaggaagagaggaggaagagagaggaggctgaaaggaaagctaagcttgatgctattgctgaaaagcagcgacagagagagatagagttggaggagaaggcaaaggcgagcagggagaagctcttaaagggatctgaggctgtgcgcgctcctgactcttcacctgttgcactgccacctcgagagtcagcagcagcgcctgctgctgctgctgctgcggctgcagctgctccagctcctagtaaatatgttcccaagtttaaacgcggtggtgatagcagcagcagctcttctggtagccagagaccaacagatgtgcgtccacgcgatgaagatcgctggggttcacgtgaagagcgctcacgcccagatgtgcgtccgctcaggcaagatgggcctgcacgacaggatgcacccccaacccgccaagatggcccgcctccgtctactgatcgctggcgccctggatcaagatattcttcaaactcttcgtcctcttcatcaacctggggacggccacggaactga

SEQ ID NO: 9418 - protein, 988 aa, Sorghum bicolor
  misc_feature: Ceres ANNOT ID no. 6100313
  misc_feature (372)..(510): Pfam Id: PCI Pfam Desc: PCI domain
  misc_feature (1)..(971): NCBI GI: 5106764 NCBI Desc: eukaryotic translation initiation factor 3 large subunit [zea mays]
  misc_feature (1)..(937): NCBI GI: 92897901 NCBI Desc: proteasome component region pci [medicago truncatula]
  misc_feature (2)..(970): NCBI GI: 89365957 NCBI Desc: eukaryotic translation initiation factor 3, subunit 10 theta, 150/170kda [homo sapiens]
  misc_feature (2)..(970): NCBI GI: 119569793 NCBI Desc: eukaryotic translation initiation factor 3, subunit 10 theta, 150/170kda [homo sapiens]
  misc_feature (2)..(970): NCBI GI: 40788877 NCBI Desc: kiaa0139 [homo sapiens]
  misc_feature: Down-regulated in root tissues in response to salicylic acid treatment
  misc_feature: Up-regulated in root tissues in response to salicylic acid treatment
  misc_feature: Down-regulated in shoot tissues in response to aminocyclopropane carboxylic treatment
  misc_feature: Down-regulated in shoot tissues in response to salicylic acid treatment
MATFAKPENALKRAEELIHVGQKQAALQALHDLITSKRYRSWQKPLEKIMMKYVELCVDLRKGRYAKDGLIQYRIVCQQVNVSSLEDVIKHFMQLSNEKAEQAKSQAEALEDALDVEDLEADKRPEDLMLSFVSGEKGKDRSDKEVVTPWFKFLWETYRTVLEILRNNSKLEALYAMTAHRAFQFCKQYKRTTEFRRLCEIIRNHLANLNKYRDQRDRPDLTAPESLQLYLDTRVEQLKVATELSLWQEAFRSVEDIHGLMSMVKKMPKPSILVVYYAKLTEIFWISDSHLYHAYAWLKLFNLQKSYNKNLSQKDLQLIASSVLLAALSVAPYDQKYGASHLETENEKERNMRMANLVNFSLDSKRENREMPSRASLLSELASKGVLSCASQEVRDLYNLLEHEFLPLDLASKVQPLLSKISKIGGKLSSASSVPEVKLSQYISALEKLTTLRVLQQASSIFQSMKIDMLSRMIPFFDFSVVEKISVDAVKRNFVAIKVNHLSGAVHFGTVDIESDGLSDHLSILADSLNKARIHICPPVKKPSKLSESLVSLAGIVENEHKRLLARKSIIEKRKEELERQILEKEKEEEKKRMSSQKKTADEERVRLLNEQRQREQDRIRREIEEKNKAEAKKLLEDLKKAGKKHVVVEGELTKEAIMELARNEQLKERQEMEKKLQKFAKTMDYLERAKRQEEAPLIEQAFQKRLEEEKILHEQEQLREIELSKQHHAGDLQEKNRLSRMLEHKNAFQERIVQRREAEFGRLEKERDERISQLISSRKRERETVRKLMYYLNLEEQRIEMLREEEEARKREEEERRKREEAERKAKLDAIAEKQRQREIELEEKAKASREKLLKGSEAVRAPDSSPVALPPRESAAAPAAAAAAAAAAPAPSKYVPKFKRGGDSSSSSSGSQRPTDVRPRDEDRWGSREERSRPDVRPLRQDGPARQDAPPTRQDGPPPSTDRWRPGSRYSSNSSSSSSTWGRPRN

SEQ ID NO: 9419 - DNA, 852 bp, Sorghum bicolor
  misc_feature: Ceres ANNOT ID no. 6100314
  misc_feature: Encodes the peptide sequence at SEQ ID NO 9420
atgctcctgcgctccgcgccgcgccgcctccacctactccacccgcaccacctccggctcctctccgccgctgcgctcgcctccgcggtcccggcccaggccccaaccgagtgggccgaggctccgcttgcctctgtgcaccctgccgccgacgacgcctcgctcttccacgtctccctcgacctctccgcgcaccgggggctcctcgcctcccacgccgccgccggccagttcctccccttccgcctccccgcctcgccctaccccatcttcctcgccatcgcatcccctcctcctccaccacaacccgcgcccgaggccctagcggagccagcctcctgcttcgagttcctcgtcaagcgcctcccgggaaccccctccgcgcgcctctgtgacctccaccccggcgacctcgtccatgttggcgccagcgtcgtcggcggcggatttgatgtcgccaggatagctgacgccagcgacgtcctcgtcttcgccaccggatccgggatcagccctatacggtcacttattgagtcaggttttgctgaaaacaaaaaaactgacgtaagcctcttttatggggttagaaatcttcagaggatggcatatcaggaaaggtttgatgactgggaatccagaggagttaaaattgtacctgtcctctcaagaccagatggtcaatggacaggggaacgaggttatgtccagaatgtgttctcaaggatgaagaatattgtaaacccttcatcagtgggagcaattttgtgtgggcataaacagatgactgaggaaatcacaagagttcttgttgctgatggtttgtcaaaagatagaatcttaactaacttctga

SEQ ID NO: 9420 - protein, 283 aa, Sorghum bicolor
  misc_feature: Ceres ANNOT ID no. 6100314
  misc_feature (162)..(267): Pfam Id: NAD_binding_1 Pfam Desc: Oxidoreductase NAD-binding domain
  misc_feature (68)..(283): NCBI GI: 115434222 NCBI Desc: os01g0120600 [oryza sativa (japonica cultivar-group)]
  misc_feature (8)..(283): NCBI GI: 92894452 NCBI Desc: phenol hydroxylase reductase [medicago truncatula]
  misc_feature (12)..(280): NCBI GI: 1170601 NCBI Desc: fruit protein pkiwi502
  misc_feature (11)..(246): NCBI GI: 42571485 NCBI Desc: oxidoreductase nad-binding domain-containing protein [arabidopsis thaliana]
  misc_feature (68)..(283): NCBI GI: 108763602 NCBI Desc: oxidoreductase, nad-binding [myxococcus xanthus dk 1622]
MLLRSAPRRLHLLHPHHLRLLSAAALASAVPAQAPTEWAEAPLASVHPAADDASLFHVSLDLSAHRGLLASHAAAGQFLPFRLPASPYPIFLAIASPPPPPQPAPEALAEPASCFEFLVKRLPGTPSARLCDLHPGDLVHVGASVVGGGFDVARIADASDVLVFATGSGISPIRSLIESGFAENKKTDVSLFYGVRNLQRMAYQERFDDWESRGVKIVPVLSRPDGQWTGERGYVQNVFSRMKNIVNPSSVGAILCGHKQMTEEITRVLVADGLSKDRILTNF

SEQ ID NO: 9421 - DNA, 1086 bp, Sorghum bicolor
  misc_feature: Ceres ANNOT ID no. 6100316
  misc_feature: Encodes the peptide sequence at SEQ ID NO 9422
atgacgcggaggtgctcgcactgcagcaacaacggccacaactcgcgcacctgccccgcccgctccggcggcggggtgaggctatttggcgtgcgcctcacaacggcgccggctccggcggcgatgaagaagagcgccagcatgagctgcatcgcgtcctcgctcgggggcgggtccgggggctcgtcgccgccggcgggaggagtgggtggtggcaggggaggaggagacggcggggccggctacgtctccgatgatcccgggcacgcctcctgctcgacgaatggccgcgtcgagcggaagaaaggtacaccttggactgaagaagagcatagaatgtttctgatgggtcttcagaagcttggtaagggagattggcgcgggatatctcgaaactttgttgtttccaggaccccgactcaagtggcaagccatgctcaaaagtactttattagacagacaaactcatcaagacggaagaggcggtcaagcttgtttgacatggttgcagaaatgccagtagacgagtccctagctgctgcggaacaaattactatccaaaatactcaagatgaagctgcaagttcaaatcaactgccgaccttacatcttgggcatcagaaggaagcagagtttgctaagcaaatgccaacttttcagctaaggcagcatgaggaatctgaatatgcagaaccttcattgacattaccagatttagagatgaactccagtgtaccattcaataccatagctgttccgacgatgccagcattctaccctgcgttggtccctgttccactaactctttggcctccaagtgttgcccatgtggaggacgcaggcacaacccatgaaatcctaaaaccaactcctttgaatggtaaggaggtgattaaagcagatgatgttgttggtatgtctaagctcagcattggtgaggccagctctggctccatggaacccacagctctttcccttcagcttattggatcgacagatacaaggcagtcagcttttcatgtgagtccaccaatgaatagacctgaactaagcaagagaaacagcagtccaattcatgccgtttga

SEQ ID NO: 9422 - protein, 361 aa, Sorghum bicolor
  misc_feature: Ceres ANNOT ID no. 6100316
  misc_feature (103)..(150): Pfam Id: Myb_DNA-binding Pfam Desc: Myb-like DNA-binding domain
  misc_feature (1)..(361): NCBI GI: 110931652 NCBI Desc: myb transcription factor myb52 [glycine max]
  misc_feature (1)..(356): NCBI GI: 110931662 NCBI Desc: myb transcription factor myb62 [glycine max]
  misc_feature (1)..(200): NCBI GI: 110931692 NCBI Desc: myb transcription factor myb93 [glycine max]
  misc_feature (22)..(361): NCBI GI: 29028776 NCBI Desc: at3g16350 [arabidopsis thaliana]
  misc_feature (1)..(175): NCBI GI: 24850307 NCBI Desc: transcription factor mybs3 [oryza sativa (japonica cultivar-group)]
  misc_feature: The sequence is a functional homolog of SEQ ID NO 1045 in the 11/479,226US patent application
  misc_feature: The sequence is a functional homolog of SEQ ID NO 1072 in the 10/225,066US patent application
  misc_feature: The sequence is a functional homolog of SEQ ID NO 130 in the 10/412,699US patent application
  misc_feature: The sequence is a functional homolog of SEQ ID NO 2258 in the 10/374,780US patent application
  misc_feature: The sequence is a functional homolog of SEQ ID NO 306 in the 11/479,226US patent application
  misc_feature: The sequence is a functional homolog of SEQ ID NO 452 in the 10/412,699US patent application
  misc_feature: Useful for making plants with altered cell wall content and/or composition
  misc_feature: Useful for making plants with high aluminum sensitivity
  misc_feature: Useful for making plants with modulated growth and phenotype characteristics
  misc_feature: Useful for making plants with modulated high pH sensitivity
  misc_feature: Useful for making plants with modulated low iron sensitivity
  misc_feature: Useful for making plants with modulated phosphate use efficiency
  misc_feature: Functional homolog of the protein sequence given in SEQ ID NO 13427
  misc_feature: Functional homolog of the protein sequence given in SEQ ID NO 13428
  misc_feature: The sequence is a functional homolog of SEQ ID NO 130 in the 20040045049 US patent application
  misc_feature: The sequence is a functional homolog of SEQ ID NO 452 in the 20040045049 US patent application
  misc_feature: The sequence is a functional homolog of SEQ ID NO. 514 in the 11/188,298 US application
  misc_feature: The sequence is a functional homolog of SEQ ID NO. 357 in the 11/188,298 US application
MTRRCSHCSNNGHNSRTCPARSGGGVRLFGVRLTTAPAPAAMKKSASMSCIASSLGGGSGGSSPPAGGVGGGRGGGDGGAGYVSDDPGHASCSTNGRVERKKGTPWTEEEHRMFLMGLQKLGKGDWRGISRNFVVSRTPTQVASHAQKYFIRQTNSSRRKRRSSLFDMVAEMPVDESLAAAEQITIQNTQDEAASSNQLPTLHLGHQKEAEFAKQMPTFQLRQHEESEYAEPSLTLPDLEMNSSVPFNTIAVPTMPAFYPALVPVPLTLWPPSVAHVEDAGTTHEILKPTPLNGKEVIKADDVVGMSKLSIGEASSGSMEPTALSLQLIGSTDTRQSAFHVSPPMNRPELSKRNSSPIHAV

SEQ ID NO: 9423 - DNA, 759 bp, Sorghum bicolor
  misc_feature: Ceres ANNOT ID no. 6100320
  misc_feature: Encodes the peptide sequence at SEQ ID NO 9424
atgggtattcattggaatttcgaagtctgtggaggtgacattctgattctagtgagagtacacctttatttcgcatggaacacaaagacagggatgaaactaagtcttcaagggccttctagtctggtttgttccatggctatcacggatgagatgctgtttgctggtacgagagatggtcgcatcatggcctggaaatttccttctaaggagagtaaaattgaaccagtgttcatcctcagtggccatcaacgtccagttgtttcattgtctatctcagcaagaagactatactctggctcacttgacaagaccatcaaagcatgggaccttacgacttggcagtgtgttcaaacactctttgagcataaagctgctgtaacatctgtgctttgttgggacgaaaagttattatcttgctcccttgacaagactgtaaaggtctggactctgtcagagtctggaaaccttcaagccaaatatactcatgctgaggagcatggtttgcgcacactcttcggcatgcaccgagttggtaagacgccagttctcttctgctccctccacaacagcaattgcatccgcttgttcaacctgccatcgttcgatgggatgggcacgctcctctccaagaaagaggtgagaaccatcgagctcacagctggtgggctgctcttcaccggagactgctccggcgagctgaaagtgtggaggtgggcgccccaggaccaggaggcagtggcggatgtgcattcatag

SEQ ID NO: 9424 - protein, 252 aa, Sorghum bicolor
  misc_feature: Ceres ANNOT ID no. 6100320
  misc_feature (74)..(110): Pfam Id: WD40 Pfam Desc: WD domain, G-beta repeat
  misc_feature (114)..(150): Pfam Id: WD40 Pfam Desc: WD domain, G-beta repeat
  misc_feature (25)..(246): NCBI GI: 115434986 NCBI Desc: os01g0187500 [oryza sativa (japonica cultivar-group)]
  misc_feature (12)..(242): NCBI GI: 12057164 NCBI Desc: zfwd1 protein [arabidopsis thaliana]
  misc_feature (12)..(247): NCBI GI: 12057166 NCBI Desc: zfwd2 protein [arabidopsis thaliana]
  misc_feature (25)..(240): NCBI GI: 12057168 NCBI Desc: zfwd3 protein [arabidopsis thaliana]
  misc_feature (26)..(148): NCBI GI: 115447899 NCBI Desc: os02g0677700 [oryza sativa (japonica cultivar-group)]
  misc_feature: The plant is abnormally small.
  misc_feature: Useful for making plants with modulated biomass
  misc_feature: Functional homolog of the protein sequence given in SEQ ID NO 12972
  misc_feature: Useful for making plants with altered terpenoid content
  misc_feature: Functional homolog of the protein sequence given in SEQ ID NO 13137
MGIHWNFEVCGGDILILVRVHLYFAWNTKTGMKLSLQGPSSLVCSMAITDEMLFAGTRDGRIMAWKFPSKESKIEPVFILSGHQRPVVSLSISARRLYSGSLDKTIKAWDLTTWQCVQTLFEHKAAVTSVLCWDEKLLSCSLDKTVKVWTLSESGNLQAKYTHAEEHGLRTLFGMHRVGKTPVLFCSLHNSNCIRLFNLPSFDGMGTLLSKKEVRTIELTAGGLLFTGDCSGELKVWRWAPQDQEAVADVHS

SEQ ID NO: 9425 - DNA, 1203 bp, Sorghum bicolor
  misc_feature: Ceres ANNOT ID no. 6100334
  misc_feature: Encodes the peptide sequence at SEQ ID NO 9426
atggcggcgacctccggcgcgccggttcccgacgacaacgggcacggccgcctcgcgtcgtccctgacggcgcgctactcggactgggtgctggaggcgctggacgagctcccggggagcttcctgctcacggaccccgccctgccgggccaccccatcgtgtacgcctcggggggcctcgccgcgctcaccggctacgcgccgcgcgacgtgctgggccgcaacgcgcgcctcttccagggcgccgccaccgaccgcgccgccgtcgccggcgtccgcgaggccgtccgcgcgcaccgcgcgcaccaggccgcgctcctcaactaccgccgcgacggcgccccgcactgggtcctgctccacctcgcccccgtcttccacgcacgcgacggcaccctgctccacttcctcgccgtccaggtgcccatcgcccccgctgccgccacgcgcggggcgacgtgccacgccacggggcatttgctagccgcgtgccgcgacgaggctagcagggtcgcagaggattttccctgctccacccacgcggccaaggtgtttgtcgatatggacaagagagggctggaggccgaggaactgcgtgtagctagtgactgtgagaaagagatggcaacaagtatggctaacaacattgtctctgtgctgaaccgctacagcaagctaactggtctagtggtcagcagccaaagatgcagctcggttggcatcccagcactcagttcgtcgttaaacctctctctcggtagaatcaaacaaagctttgtattgactgactcccgcctgcctgacatgccaattatttatgctagtgatgcttttacatcattaacaggttactcaagagaagaaatattgggctgtaactgcaaagtcttaaacggtccaggcactagcttggaggttttagaggagataaatcagcatatttgttctgagcaggcatgcacagtggatctactaagttacaggaaagatggaagttcgttctgtgatcttctacatgtatctcctatccgagatgcttcaggcaaggttgcctttcatatctgggttcaccttgacatgggtgcaaagcacgagtttaatgggttggtccctgaagtatggctgcttggtgctgttggagcggtgagggttgctgtgagaggcttgtcggcgtcaggtagcctgttgagaccatcccaatag

SEQ ID NO: 9426 - protein, 400 aa, Sorghum bicolor
  misc_feature: Ceres ANNOT ID no. 6100334
  misc_feature (21)..(387): NCBI GI: 18146960 NCBI Desc: twin lov protein 1 [arabidopsis thaliana]
  misc_feature (21)..(356): NCBI GI: 42570655 NCBI Desc: pac motif-containing protein [arabidopsis thaliana]
  misc_feature (248)..(364): NCBI GI: 38344593 NCBI Desc: osjnba0079m09.13 [oryza sativa (japonica cultivar-group)]
  misc_feature (248)..(364): NCBI GI: 116308943 NCBI Desc: osigba0092o07.5 [oryza sativa (indica cultivar-group)]
  misc_feature (248)..(364): NCBI GI: 60099456 NCBI Desc: phototropin [phaseolus vulgaris]
MAATSGAPVPDDNGHGRLASSLTARYSDWVLEALDELPGSFLLTDPALPGHPIVYASGGLAALTGYAPRDVLGRNARLFQGAATDRAAVAGVREAVRAHRAHQAALLNYRRDGAPHWVLLHLAPVFHARDGTLLHFLAVQVPIAPAAATRGATCHATGHLLAACRDEASRVAEDFPCSTHAAKVFVDMDKRGLEAEELRVASDCEKEMATSMANNIVSVLNRYSKLTGLVVSSQRCSSVGIPALSSSLNLSLGRIKQSFVLTDSRLPDMPIIYASDAFTSLTGYSREEILGCNCKVLNGPGTSLEVLEEINQHICSEQACTVDLLSYRKDGSSFCDLLHVSPIRDASGKVAFHIWVHLDMGAKHEFNGLVPEVWLLGAVGAVRVAVRGLSASGSLLRPSQ

SEQ ID NO: 9427 - DNA, 708 bp, Sorghum bicolor
  misc_feature: Ceres ANNOT ID no. 6100335
  misc_feature: Encodes the peptide sequence at SEQ ID NO 9428
atggcggcatcgctaggactcgcccacgacgccagctgctacgccgcctacccgccggccgccgccgctgcctcctcgtacttcccatcaccaccaccacccggcgacctcgtggcggagttcccaccgaccgccgccgccacggccatggctgatgactactactactactacttccagttcggcgaggagatgggcggcgctcgcgctcccggctgcggcggcggctactgctcgccgccggcgccggcgttcgacaatggcatgagcctgctgagctatggcggcgtcgacggcgacgggaggaggccgatgagcggaccagctgctggcactggtgggaacggcggcggcggccggccgccggcgtcacggatcgggttccggacgaggtcggaggtggacgtgctggacgacggcttcaagtggcgcaagtacggcaagaaggcggtcaagagcagccccaacccgaggaactactaccggtgctcgtcggagggctgcggcgtcaagaagcgcgtggagcgggacagcgacgacccgcgctacgtcatcaccacctacgacggcgtccacaaccacgccgcgccgggcgccgcctacctctgcccgccgccgccgcgcgcacccagctggagcggcgcttttgacgcgtgggaggcgcagctggcggcggcggcggctcactcgtcggagtcgtcgtactga

SEQ ID NO: 9428 - protein, 235 aa, Sorghum bicolor
  misc_feature: Ceres ANNOT ID no. 6100335
  misc_feature (137)..(196): Pfam Id: WRKY Pfam Desc: WRKY DNA -binding domain
  misc_feature (123)..(197): Pfam Id: FAR1 Pfam Desc: FAR1 family
  misc_feature (104)..(233): NCBI GI: 46394274 NCBI Desc: tpa: wrky transcription factor 10 [oryza sativa (japonica cultivar-group)]
  misc_feature (1)..(233): NCBI GI: 125491391 NCBI Desc: wrky transcription factor [triticum aestivum]
  misc_feature (120)..(213): NCBI GI: 73811201 NCBI Desc: wrky1 [lolium perenne]
  misc_feature (125)..(200): NCBI GI: 52353747 NCBI Desc: wrky transcription factor 67 [oryza sativa (japonica cultivar-group)]
  misc_feature (125)..(200): NCBI GI: 46394388 NCBI Desc: tpa: wrky transcription factor 67 [oryza sativa (indica cultivar-group)]
  misc_feature: The sequence is a functional homolog of SEQ ID NO 130 in the 10/714,887US patent application
  misc_feature: The sequence is a functional homolog of SEQ ID NO 130 in the 11/435,388US patent application
  misc_feature: The sequence is a functional homolog of SEQ ID NO 134 in the 10/714,887US patent application
  misc_feature: The sequence is a functional homolog of SEQ ID NO 134 in the 11/435,388US patent application
  misc_feature: The sequence is a functional homolog of SEQ ID NO 142 in the 10/714,887US patent application
  misc_feature: The sequence is a functional homolog of SEQ ID NO 142 in the 11/435,388US patent application
  misc_feature: The sequence is a functional homolog of SEQ ID NO 152 in the 10/714,887US patent application
  misc_feature: The sequence is a functional homolog of SEQ ID NO 152 in the 11/435,388US patent application
  misc_feature: The sequence is a functional homolog of SEQ ID NO 1533 in the 10/374,780US patent application
  misc_feature: The sequence is a functional homolog of SEQ ID NO 1535 in the 10/374,780US patent application
  misc_feature: The sequence is a functional homolog of SEQ ID NO 154 in the 10/714,887US patent application
  misc_feature: The sequence is a functional homolog of SEQ ID NO 154 in the 11/435,388US patent application
  misc_feature: The sequence is a functional homolog of SEQ ID NO 156 in the 10/714,887US patent application
  misc_feature: The sequence is a functional homolog of SEQ ID NO 156 in the 11/435,388US patent application
  misc_feature: The sequence is a functional homolog of SEQ ID NO 158 in the 10/714,887US patent application
  misc_feature: The sequence is a functional homolog of SEQ ID NO 158 in the 11/435,388US patent application
  misc_feature: The sequence is a functional homolog of SEQ ID NO 16 in the 10/412,699US patent application
  misc_feature: The sequence is a functional homolog of SEQ ID NO 1610 in the 10/412,699US patent application
  misc_feature: The sequence is a functional homolog of SEQ ID NO 1617 in the 10/412,699US patent application
  misc_feature: The sequence is a functional homolog of SEQ ID NO 1619 in the 10/412,699US patent application
  misc_feature: The sequence is a functional homolog of SEQ ID NO 194 in the 10/666,642US patent application
  misc_feature: The sequence is a functional homolog of SEQ ID NO 202 in the 10/714,887US patent application
  misc_feature: The sequence is a functional homolog of SEQ ID NO 202 in the 11/435,388US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 52 in the 10/666,642US patent application
  misc_feature: The sequence is a functional homolog of SEQ ID NO 6 in the 10/714,887US patent application
  misc_feature: The sequence is a functional homolog of SEQ ID NO 6 in the 11/435,388US patent application
  misc_feature: The sequence is a functional homolog of SEQ ID NO 80 in the 10/412,699US patent application
  misc_feature: The sequence is a functional homolog of SEQ ID NO 806 in the 10/412,699US patent application
  misc_feature: The sequence is a functional homolog of SEQ ID NO 970 in the 10/666,642US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 16 in the 20040045049 US patent application
  misc_feature: The sequence is a functional homolog of SEQ ID NO 1610 in the 20040045049 US patent application
  misc_feature: The sequence is a functional homolog of SEQ ID NO 1617 in the 20040045049 US patent application
  misc_feature: The sequence is a functional homolog of SEQ ID NO 1619 in the 20040045049 US patent application
  misc_feature: The sequence is a functional homolog of SEQ ID NO 80 in the 20040045049 US patent application
  misc_feature: The sequence is a functional homolog of SEQ ID NO 806 in the 20040045049 US patent application
  misc_feature: The sequence is a functional homolog of SEQ ID NO 130 in the 20060015972 US patent application
  misc_feature: The sequence is a functional homolog of SEQ ID NO 134 in the 20060015972 US patent application
  misc_feature: The sequence is a functional homolog of SEQ ID NO 154 in the 20060015972 US patent application
  misc_feature: The sequence is a functional homolog of SEQ ID NO 156 in the 20060015972 US patent application
  misc_feature: The sequence is a functional homolog of SEQ ID NO 158 in the 20060015972 US patent application
  misc_feature: The sequence is a functional homolog of SEQ ID NO 202 in the 20060015972 US patent application
  misc_feature: The sequence is a functional homolog of SEQ ID NO 204 in the 20060015972 US patent application
  misc_feature: The sequence is a functional homolog of SEQ ID NO 130 in the 10/714,887 US patent application
  misc_feature: The sequence is a functional homolog of SEQ ID NO 130 in the 11/435,388 US patent application
  misc_feature: The sequence is a functional homolog of SEQ ID NO 144 in the 10/714,887 US patent application
  misc_feature: The sequence is a functional homolog of SEQ ID NO 144 in the 11/435,388 US patent application
  misc_feature: The sequence is a functional homolog of SEQ ID NO 1611 in the 10/412,699 US patent application
  misc_feature: The sequence is a functional homolog of SEQ ID NO 971 in the 10/666,642 US patent application
  misc_feature: The sequence is a functional homolog of SEQ ID NO 142 in the 10/714,887 US patent application
  misc_feature: The sequence is a functional homolog of SEQ ID NO 142 in the 11/435,388 US patent application
  misc_feature: The sequence is a functional homolog of SEQ ID NO 1610 in the 10/412,699 US patent application
  misc_feature: The sequence is a functional homolog of SEQ ID NO 970 in the 10/666,642 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAASLGLAHDASCYAAYPPAAAAASSYFPSPPPPGDLVAEFPPTAAATAMADDYYYYYFQFGEEMGGARAPGCGGGYCSPPAPAFDNGMSLLSYGGVDGDGRRPMSGPAAGTGGNGGGGRPPASRIGFRTRSEVDVLDDGFKWRKYGKKAVKSSPNPRNYYRCSSEGCGVKKRVERDSDDPRYVITTYDGVHNHAAPGAAYLCPPPPRAPSWSGAFDAWEAQLAAAAAHSSESSY

SEQ ID NO: 9429 - DNA, 2391 bp, Sorghum bicolor
  misc_feature: Ceres ANNOT ID no. 6100350
  misc_feature: Encodes the peptide sequence at SEQ ID NO 9430
atgggcaccgggggagacggggacaaggcgggcccggcgctgccgctggaggcgctgctggcgctcgggctcgaccagcgcaccgccgagaacgcgctcgtcaacagcaaggtcaccgccaacctcgccgcagtcatagccgaggctggtataaaggaatgcgacaagtctgttggcaatcttctatatgcagttgccaccaagtacccaactaatgcgcttgttcatcgtcctgtccttattagctatgtcttgtcaacaaagataaagaaccctgcacagctagatgctgctctgtcatttcttactaatactggtcctgattctctagatgtgggcaaatttgaagaagcatgtggtgtaggtgtggttgtttccattgaggaaattaaatctactgttactgacgttcttgaggagaatatggaagctataaaggagcagcggtatcacataaatgttggtatgctatgtggactggttaggaagagacacccctggggtgatgctaaggcgataaaggaggaaattgacaagaggcttgtagaaatcctaggtccgaagacagaagctgacaatataaaaccagtgaaaaagaagaaggaaaaaccagcaaaagttgaggagaaaaaagttgcagtggccactgctgcaccaccaactgaggaggaattgaacccatatactatatttcctcaaccagaggaaaactttaaggttcatacagaaatattttacagcgatgggaacatatggagagcacataacacaaaagaaattttagaaaaacatcttaaggcaactggaggaaaagtgatgacccgttttccaccggaacctaatggatatcttcatattggtcatgccaaggctatgtttattgattttggtctggctaaggagcgaaatggccattgctaccttaggtttgatgacacaaatccggaagctgaaaagaaagaatacatagaccacattcaggaaattgtccattggatgggatgggagccctacaaagtaacatacacgagtgactatttccaagctttgtatgagcatgctgttgaattaatacggaaagggctagcctatgtggatcaccagaccgcagaagaaatcaaggagtacagggaaaagaagatgaatagtccatggagggataggccaattgaagagtcactgaaactatttgaagacatgaggcgtgggttgattgcggagggtacagcaactctccgaatgaagcaggacatgcagaatgagaacaaaaatatgtctgatttaatagcatatagaataaaattcacccctcatccacatgctggtgacaagtggtgtatctatccgagctacgactatgctcattgcatggtggattctcttgaaaacatcacacattcgctgtgcacacttgagtttgacatacgtcgcccttcatactactggctacttgttgccttgggcctttatcaaccatatgtgtgggagtattcaaggctaaacatatcaaatactgtgatgtctaaaagaaagttgaatcgacttgtgacagagaagtgggtagatgggtgggatgatccccgcttgttgacattggcaggactccggcgacggggagtatcatcaactgcaattaattcgtttatccgtggaattggcataacgagaagtgacaatagtttaattcgcgttgatcgtctagaataccacatcagggaagagcttaacaaaacagcccctcgaaccatggctgttttgcgccctctaaaggttgtaataactaacttggaagaaggaaaagtactagaccttgatgggaaaatgtggcctgatgcttctgatactgatgcttcctcccactataaggttccgttctcaagaactgtctacattgagaaaactgattttcgcctgaaggactcaaaagactactatgggctagcccctggcaaatctgtcatgctaaggtatgcattccccataaaatgcacagatgttatctatggtgatagtcctgatgatgttgttgaaattcgagctgaatatgatcctttgaagacttctaaacttaagggtgttctgcactgggtttctgagccagcacctggtgtcgaaccattgaaggtggaagtaagattatttgagaaattgttcatgtcagagaatcctgctgaattggaggattggcttggtgatcttaaccctcactccaaagaggtgataaaggacgcttatgctgtaccatcactcgccactgcagttctgggtgacaagttccagtttgagcggcttggctacttcgccgtggatacggactccactcctgagaagctcgtgttcaacagaactgttaccctccgtgattcgtttgggaaagctggacccaagtga

SEQ ID NO: 9430 - protein, 796 aa, Sorghum bicolor
  misc_feature: Ceres ANNOT ID no. 6100350
  misc_feature (271)..(577): Pfam Id: tRNA-synt_1c Pfam Desc: tRNA synthetases class I (E and Q), catalytic domain
  misc_feature (579)..(770): Pfam Id: tRNA-synt_1c_C Pfam Desc: tRNA synthetases class I (E and Q), anti-codon binding domain
  misc_feature (14)..(171): Pfam Id: tRNA_synt_1c_R1 Pfam Desc: Glutaminyl-tRNA synthetase, non-specific RNA binding regionpart 1
  misc_feature (172)..(264): Pfam Id: tRNA_synt_1c_R2 Pfam Desc: Glutaminyl-tRNA synthetase, non-specific RNA binding regionpart 2
  misc_feature (16)..(794): NCBI GI: 2995455 NCBI Desc: trna-glutamine synthetase [lupinus luteus]
  misc_feature (434)..(794): NCBI GI: 25293277 NCBI Desc: probable glutaminyl-trna synthetase (glnrs) [imported] - arabidopsis thaliana
  misc_feature (22)..(793): NCBI GI: 60464534 NCBI Desc: glutamine-trna ligase [dictyostelium discoideum]
  misc_feature (16)..(792): NCBI GI: 49619001 NCBI Desc: glutaminyl-trna synthetase [danio rerio]
  misc_feature (21)..(792): NCBI GI: 17864488 NCBI Desc: cg10506-pa [drosophila melanogaster]
  misc_feature (16)..(794): SWISSPROT Homolog: EC 6.1.1.18 Glutaminyl-tRNA synthetase
MGTGGDGDKAGPALPLEALLALGLDQRTAENALVNSKVTANLAAVIAEAGIKECDKSVGNLLYAVATKYPTNALVHRPVLISYVLSTKIKNPAQLDAALSFLTNTGPDSLDVGKFEEACGVGVVVSIEEIKSTVTDVLEENMEAIKEQRYHINVGMLCGLVRKRHPWGDAKAIKEEIDKRLVEILGPKTEADNIKPVKKKKEKPAKVEEKKVAVATAAPPTEEELNPYTIFPQPEENFKVHTEIFYSDGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIRKGLAYVDHQTAEEIKEYREKKMNSPWRDRPIEESLKLFEDMRRGLIAEGTATLRMKQDMQNENKNMSDLIAYRIKFTPHPHAGDKWCIYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFIRGIGITRSDNSLIRVDRLEYHIREELNKTAPRTMAVLRPLKVVITNLEEGKVLDLDGKMWPDASDTDASSHYKVPFSRTVYIEKTDFRLKDSKDYYGLAPGKSVMLRYAFPIKCTDVIYGDSPDDVVEIRAEYDPLKTSKLKGVLHWVSEPAPGVEPLKVEVRLFEKLFMSENPAELEDWLGDLNPHSKEVIKDAYAVPSLATAVLGDKFQFERLGYFAVDTDSTPEKLVFNRTVTLRDSFGKAGPK

SEQ ID NO: 9431 - DNA, 1920 bp, Sorghum bicolor
  misc_feature: Ceres ANNOT ID no. 6100355
  misc_feature: Encodes the peptide sequence at SEQ ID NO 9432
atgacgggcggccaccacttcaacaatatcctcctcggggggcgcggtggcacgaaccctggtcagtttaaagtgtattctggtggacttgcatggaagagacaaggtggaggaaagaccattgagattgacaaagctgatgtaaccgcagttacttggatgaaagtccccagagcatatcagcttggagtcaggattaaggatggcctgttctaccgatttattggcttccgtgaacaggatgtgagcagcttgaccaacttcatacaaaagaatatgggtgtcacaccagatgaaaaacagctttctgttagtggccacaattggggagggattgatatagatggaaacatgctaacctttatggttggttcaaagcaagcatttgaagtatccctagcagatgttgcacaaacccagatgcaaggaaaaacagatgttctcttagagcttcatgttgatgatactactggagccaatgagaaagactccctcatggatttaagttttcatgtgcctacttcgaatactcagtttgttggggatgagaatcgccctccagctcacattttatgggagactatattgaaatttgctgatgttggttcttctgaagaaccagttgtcacatttgacggaattgcgattcttacaccaagaggacgttatagtgttgagcttcatctgtcatttctgcgactccaaggacaagctaatgatttcaaaatccaatacagcagcatcgttcgcctctttcttttgccaaagtcaaacaatcctcatacatttgttgttatcactcttgatccaccaatccgtaaaggacaaacattgtatcctcacattgttattcagtttgagacagaggcagtagttgaaagagacctggcattgagtaaagagctgttggttgacaaatacaaggacaggcttgaggaatcttacaagggtctaatacatgaggtatttaccaaagtcctccgtggtctatctggtgctaaagtcacaaggccaggttctttcagaagttgccaagatggatatgcagttaaatcatcactcaaagctgaagatggactgttatatccacttgaaaagggtttcttcttcttgccaaagccacctacactcattcttcatgaggagattgagtttgttgaatttgaacgtcatggtgctgggggtgccagtatatcatttcactattttgacctccttgtcaaactgaaaaatgaccaagagcatctcttcagaaatattcaaaggaatgagtaccacaacctcttcaacttcatcaatggaaagaacattaaaataatgaaccttggaggagatggtcaaggtgcaagtggtgtagttacagatgttctacgagacactgatgatgatgctgttgatccacatctagagcgtattaagaatcaggctggggatgatgaaagtgatgaagaggatgaagattttgttgcagataaggatgatagtggatctcctactgatgactcgggtgatgaggattcagatgctagtgatagtggtggtgaaaaagagaaatcatccaagaaggaagcaagcagttcaaagccagttcagaaaaggaagcctaaggccagggatgacgaagggcatgagaagaaaaaggcaaagaagaaaaaagatcctaatgcccccaaaagagcaatgacaccgttcatgtatttctcaatggctgaacgaggaaacatgaagagcagcaacccagatttgccgacgactgagattgcaaagaagcttggggagatgtggcaaaagatgtcaagcgaagagaagcagccttacatccagcaggcccaggtcgacaagaaacgttatgaaaaagagtctgccgtctatcgtggtgaagctacagctgatgtggattctggcaacgagtctgactag

SEQ ID NO: 9432 - protein, 639 aa, Sorghum bicolor
  misc_feature: Ceres ANNOT ID no. 6100355
  misc_feature (218)..(435): Pfam Id: SSrecog Pfam Desc: Structure-specific recognition protein (SSRP1)
  misc_feature (358)..(503): Pfam Id: Rtt106 Pfam Desc: Histone chaperone Rttp106-like
  misc_feature (557)..(625): Pfam Id: HMG_box Pfam Desc: HMG (high mobility group) box
  misc_feature (1)..(639): NCBI GI: 8920409 NCBI Desc: ssrp1 protein [zea mays]
  misc_feature (1)..(639): NCBI GI: 21314337 NCBI Desc: early drought induced protein [oryza sativa (indica cultivar-group)]
  misc_feature (1)..(639): NCBI GI: 75263890 NCBI Desc: fact complex subunit ssrp1-a (facilitates chromatin transcription complex subunit ssrp1-a) (recombination signal sequence recognition protein 1-a) (early drought-induced protein
  misc_feature (1)..(639): NCBI GI: 75263890 (continued) r1g1a)
  misc_feature (1)..(639): NCBI GI: 75253362 NCBI Desc: fact complex subunit ssrp1-b (facilitates chromatin transcription complex subunit ssrp1-b) (recombination signal sequence recognition protein 1-b)
  misc_feature (1)..(639): NCBI GI: 75218951 NCBI Desc: fact complex subunit ssrp1 (facilitates chromatin transcription complex subunit ssrp1) (recombination signal sequence recognition protein 1)
MTGGHHFNNILLGGRGGTNPGQFKVYSGGLAWKRQGGGKTIEIDKADVTAVTWMKVPRAYQLGVRIKDGLFYRFIGFREQDVSSLTNFIQKNMGVTPDEKQLSVSGHNWGGIDIDGNMLTFMVGSKQAFEVSLADVAQTQMQGKTDVLLELHVDDTTGANEKDSLMDLSFHVPTSNTQFVGDENRPPAHILWETILKFADVGSSEEPVVTFDGIAILTPRGRYSVELHLSFLRLQGQANDFKIQYSSIVRLFLLPKSNNPHTFVVITLDPPIRKGQTLYPHIVIQFETEAVVERDLALSKELLVDKYKDRLEESYKGLIHEVFTKVLRGLSGAKVTRPGSFRSCQDGYAVKSSLKAEDGLLYPLEKGFFFLPKPPTLILHEEIEFVEFERHGAGGASISFHYFDLLVKLKNDQEHLFRNIQRNEYHNLFNFINGKNIKIMNLGGDGQGASGVVTDVLRDTDDDAVDPHLERIKNQAGDDESDEEDEDFVADKDDSGSPTDDSGDEDSDASDSGGEKEKSSKKEASSSKPVQKRKPKARDDEGHEKKKAKKKKDPNAPKRAMTPFMYFSMAERGNMKSSNPDLPTTEIAKKLGEMWQKMSSEEKQPYIQQAQVDKKRYEKESAVYRGEATADVDSGNESD

SEQ ID NO: 9433 - DNA, 753 bp, Sorghum bicolor
  misc_feature: Ceres ANNOT ID no. 6100356
  misc_feature: Encodes the peptide sequence at SEQ ID NO 9434
atggcggactaccacttcgtgtacaaggacgtggaggggaggagcacagagtgggacgacatccagcgccgcctcgggaacctgcctccgaagccggagcccttcaagccgccgcccttcgcccccaaggtcgacgccgacgagcagcccaagtcaaaggaatggctcgacgagcgcgagcccgaagagctcgaggaactcgaggacgacctggacgacgaccgcttcctcgagcagtacaggaagatgaggcttgcagagctgagggaggccgcaaaagccgcgcgatttggtagtatagttcccatcactggctcagacttcgtgcgggaggtgtctcaggcaccatcagatgtttgggttgtggtcttcctctacaaggatgggatacctgaatgtggattgcttcagaattgtttggaggaattggctacaagatacccagcgacaaagtttgttaaaattatctccacagactgcatccccaactacccagataggaatgttcctacaatactggtgtataacaacagtgctgtcaaagggacttatgttggtttgcagaagtttggtggaaagagatgcacacctgaatctgttgcattagccctttgccagtcagacccggtactgaatgatggacatggtggcagcgattcatctcgggacaatgtcatcgaaggtgttcgcaggaagttcatagagaaggttgtggcacagcatgaagagcgggaagaagaggatagtgactaa

SEQ ID NO: 9434 - protein, 250 aa, Sorghum bicolor
  misc_feature: Ceres ANNOT ID no. 6100356
  misc_feature (1)..(227): Pfam Id: Phosducin Pfam Desc: Phosducin
  misc_feature (1)..(249): NCBI GI: 144923078 NCBI Desc: phosducin; thioredoxin-like fold [medicago truncatula]
  misc_feature (16)..(210): NCBI GI: 13542796 NCBI Desc: iap-associated factor viaf1 [mus musculus]
  misc_feature (16)..(250): NCBI GI: 9957067 NCBI Desc: iap-associated factor viaf1 [danio rerio]
  misc_feature (16)..(210): NCBI GI: 28574924 NCBI Desc: cg18593-pa [drosophila melanogaster]
  misc_feature (16)..(250): NCBI GI: 46391102 NCBI Desc: phosducin-like 3 [danio rerio]
MADYHFVYKDVEGRSTEWDDIQRRLGNLPPKPEPFKPPPFAPKVDADEQPKSKEWLDEREPEELEELEDDLDDDRFLEQYRKMRLAELREAAKAARFGSIVPITGSDFVREVSQAPSDVWVVVFLYKDGIPECGLLQNCLEELATRYPATKFVKIISTDCIPNYPDRNVPTILVYNNSAVKGTYVGLQKFGGKRCTPESVALALCQSDPVLNDGHGGSDSSRDNVIEGVRRKFIEKVVAQHEEREEEDSD

SEQ ID NO: 9435 - DNA, 1023 bp, Sorghum bicolor
  misc_feature: Ceres ANNOT ID no. 6100382
  misc_feature: Encodes the peptide sequence at SEQ ID NO 9436
atggctttgttcgcggtccaggctgcatcgacatcccagtcgtcgtcttcttcgccggcggttcttcagcagtcgccgttgccctcgaggcgggcggccgcggcggcggtgaagaagatgccgcagcgaaagaaggctgcggcggtcgtcagggcggtcgccgcgccgccgccggctccgcctgtaccggggccgcccaagccagctggcgagcggtgccgcctgccggtgtcgcagaccatgtccaggctcaaggcgcagggcaagacggcgttcatcccgtacatcaccgccggcgaccctgacctggcgacgacggcagaggcgctgcggctcctggacgcctgcggcgccgacgtcatcgagctgggcgtgcccttctccgacccctacgccgacgggccggtcatccaggcctcgatggcgcgggcgcggacgacgggcggcggcgcgacgccggacggcgtgctggcgatgctgagggaggtgacgccggagctgtcctgcccggtggtgctcttctcctacttcaaccccatcgtgcggtggggcctgcccggcttcgccgccgccgtcaaggatgcgggtgcacacggcctaatagtgcctgatctgccttacgcggacacgtgtgcactgaggagtgaagccatcaagaacgacctcgagctggtgctgcttacgacgccagctacaccggaagagaggatgaaggagatcacagaagcttccgaaggctttgtttaccttgtgagtgtcaatggagttacaggttcccgtgcagacgtgaacacgcgtgtcgagtctctcattcaggaggttaaacaggtcactgataaacctgtggctgttggatttggcatctccaagcctgagcatgtaaaacagattgcagagtggggtgcggatggagtgatcattgggagtgcgatggtgaagcagctgggtgaagcaacatctcccaaagaagggctcaaaaggctaaaggaatatgcaaggagcatgaagaatgcactgcaatga

SEQ ID NO: 9436 - protein, 340 aa, Sorghum bicolor
  misc_feature: Ceres ANNOT ID no. 6100382
  misc_feature (81)..(340): Pfam Id: Trp_syntA Pfam Desc: Tryptophan synthase alpha chain
  misc_feature (5)..(339): NCBI GI: 11993325 NCBI Desc: indole-3-glycerol phosphate lyase [zea mays]
  misc_feature (14)..(339): NCBI GI: 33383132 NCBI Desc: indole synthase [triticum aestivum]
  misc_feature (14)..(339): NCBI GI: 62148960 NCBI Desc: indole synthase [triticum aestivum]
  misc_feature (25)..(339): NCBI GI: 62148962 NCBI Desc: indole synthase [triticum aestivum]
  misc_feature (9)..(339): NCBI GI: 73920965 NCBI Desc: indole-3-glycerol phosphate lyase, chloroplast precursor (indole synthase) (tryptophan synthase alpha chain) (benzoxazineless 1)
  misc_feature (77)..(339): SWISSPROT Homolog: EC 4.2.1.20 Tryptophan synthase alpha chain
MALFAVQAASTSQSSSSSPAVLQQSPLPSRRAAAAAVKKMPQRKKAAAVVRAVAAPPPAPPVPGPPKPAGERCRLPVSQTMSRLKAQGKTAFIPYITAGDPDLATTAEALRLLDACGADVIELGVPFSDPYADGPVIQASMARARTTGGGATPDGVLAMLREVTPELSCPVVLFSYFNPIVRWGLPGFAAAVKDAGAHGLIVPDLPYADTCALRSEAIKNDLELVLLTTPATPEERMKEITEASEGFVYLVSVNGVTGSRADVNTRVESLIQEVKQVTDKPVAVGFGISKPEHVKQIAEWGADGVIIGSAMVKQLGEATSPKEGLKRLKEYARSMKNALQ

SEQ ID NO: 9437 - DNA, 561 bp, Sorghum bicolor
  misc_feature: Ceres ANNOT ID no. 6100390
  misc_feature: Encodes the peptide sequence at SEQ ID NO 9438
atggagatgatcgacgcggagctgcgtcttggtccgcctgggagcaacagcgacgtcgtcgtcaccgtcgtgcagccgacgaggacgccggcgtcggcggcggcgaaacggcggccggagtcgtcggtggtgaagagcgaggcgtccgggacggacgaccatgacgacgcggcaccggcctccaaggtgcaggtggtggggtggccgccggtgagagcgtaccggaagaacgcgttccacgcggcggcggaggcgaggagggcgacaaagggcggcgagcagcaaggatctggcctgtacgtgaaggtgagcatggacggggcgccctacctccggaaggtcgacctgcggacctacggcggctaccgggagctgagagacgcgctggacacgctcttcggttgcttctcctcctctgccgccgccgacggcggctgccagttcgccatcgcctacgaggacaaggacggcgacctcatgctcgccggcgacgtgccctgggagatgttcatctgttcttgcaagaagctgaggatcatgagggggtccgaagcaagataa

SEQ ID NO: 9438 - protein, 186 aa, Sorghum bicolor
  misc_feature: Ceres ANNOT ID no. 6100390
  misc_feature (1)..(187): Pfam Id: AUX_IAA Pfam Desc: AUX/IAA family
  misc_feature (2)..(186): NCBI GI: 75233435 NCBI Desc: auxin-responsive protein iaa14 (indoleacetic acid-induced protein 14)
  misc_feature (8)..(186): NCBI GI: 75225715 NCBI Desc: auxin-responsive protein iaa24 (indoleacetic acid-induced protein 24)
  misc_feature (24)..(137): NCBI GI: 81074526 NCBI Desc: aux/iaa protein-like [solanum tuberosum]
  misc_feature (24)..(137): NCBI GI: 25989504 NCBI Desc: aux/iaa protein [solanum tuberosum]
  misc_feature (30)..(185): NCBI GI: 90811713 NCBI Desc: auxin-regulated protein [striga asiatica]
  misc_feature: The sequence is a functional homolog of SEQ ID NO 1149 in the 10/412,699US patent application
  misc_feature: The sequence is a functional homolog of SEQ ID NO 648 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 648 in the 20070022495 US patent application
  misc_feature: Useful for making plants with modulated nitrogen use efficiency
  misc_feature: Functional homolog of the protein sequence given in SEQ ID NO 13612
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with altered terpenoid content
  misc_feature: Functional homolog of the protein sequence given in SEQ ID NO 14048
MEMIDAELRLGPPGSNSDVVVTVVQPTRTPASAAAKRRPESSVVKSEASGTDDHDDAAPASKVQVVGWPPVRAYRKNAFHAAAEARRATKGGEQQGSGLYVKVSMDGAPYLRKVDLRTYGGYRELRDALDTLFGCFSSSAAADGGCQFAIAYEDKDGDLMLAGDVPWEMFICSCKKLRIMRGSEAR

SEQ ID NO: 9439 - DNA, 1326 bp, Sorghum bicolor
  misc_feature: Ceres ANNOT ID no. 6100391
  misc_feature: Encodes the peptide sequence at SEQ ID NO 9440
atggatttcagttgttttcagccccacacggggatttctagttacctgccatttgattcgtacatgcagcaaaatggacgctatgagctccatcctgttgatcatcatccatttgaggttattggggactgtacttctgcaaccttcaacgaccttggacaccggttctttgtagaaagagaaatcaagaagcctacgtttgaccatgcttcatcggtcggtcaaagagttggatctcaactgcctctactgactcccaaaactgaggtttctcatctcatggacggtggacttggatcatataaagcatatgggatgaatggcaggtttctgccaagaaagaagacctctttgaagaaagccaatgttgtggttgtgaaagggcagtggactccagcggaagataggaagctggtaaaattagtggaacaatttggactgaggaaatggtcttacatagcacaactgctaccaggaagagtgggaaagcaatgcagagaaagatggcacaaccatttgaggccgaacatcaagaaagacatttggagtgacgaggaagacatggttctgatacaagcacacaaggaagtgggcaacaaatgggcagagatagctaagcgactacccggcaggacagagaactccataaaaaaccactggaacgcaacaaagcgaaggcagtttgcacggaggcggagccgtagctccaaggggcccaaatcaggcactcttctgcagaactacatcaaaggcctgggtattgctggcccaagcaacaagaccgctgctgcacctcttcctgaacctacactgtcaccgtcctcacttgaagctcccggagcaaagtcagcaaagactgatgaaataacgctggaagtggaacacatcagcatgtcgtccaacataccggattcccaaggcattcttcttcttcccagtatccatgagtacaacaactgcagcgagtctcagtcctgcgaagatcttcttgcccctatctgtgacgagttttcagttgaaatgtgtgacggcctgttcgacacgaacgaggacgcagatgccttccaagtgtacgccatggacgacgacatcgacatgaactacatcttcaactatattgagcatgctgcgatcaaggtggatcctgagatagacatggagatgatgatgatgatgatgtgggatggcgacgacggcggcctcctcgggtgtgatgctgatcctgctggaccagctcatgtcgaaactgtgcatgtgaaggaggagatggacctgatcgagatggtggcagccacacagaactgtggcgaggcagaaaaccactag

SEQ ID NO: 9440 - protein, 441 aa, Sorghum bicolor
  misc_feature: Ceres ANNOT ID no. 6100391
  misc_feature (127)..(173): Pfam Id: Myb_DNA-binding Pfam Desc: Myb-like DNA-binding domain
  misc_feature (179)..(224): Pfam Id: Myb_DNA-binding Pfam Desc: Myb-like DNA-binding domain
  misc_feature (101)..(254): NCBI GI: 140043816 NCBI Desc: homeodomain-related [medicago truncatula]
  misc_feature (101)..(254): NCBI GI: 76365135 NCBI Desc: myb family transcription factor [arabidopsis thaliana]
  misc_feature (113)..(249): NCBI GI: 124360577 NCBI Desc: homeodomain-related [medicago truncatula]
  misc_feature (125)..(243): NCBI GI: 9795157 NCBI Desc: myb dna-binding-like protein [arabidopsis thaliana]
  misc_feature (107)..(280): NCBI GI: 9294482 NCBI Desc: probable myb-like dna-binding protein [arabidopsis thaliana]
  misc_feature: The plant is abnormally small.
  misc_feature: The plant produces a reduced number of seeds.
  misc_feature: The sequence is a functional homolog of SEQ ID NO 114 in the 10/374,780US patent application
  misc_feature: The sequence is a functional homolog of SEQ ID NO 172 in the 10/412,699US patent application
  misc_feature: The sequence is a functional homolog of SEQ ID NO 18 in the 10/412,699US patent application
  misc_feature: The sequence is a functional homolog of SEQ ID NO 1876 in the 10/412,699US patent application
  misc_feature: The sequence is a functional homolog of SEQ ID NO 1917 in the 10/374,780US patent application
  misc_feature: The sequence is a functional homolog of SEQ ID NO 192 in the 10/225,068US patent application
  misc_feature: The sequence is a functional homolog of SEQ ID NO 1949 in the 11/479,226US patent application
  misc_feature: The sequence is a functional homolog of SEQ ID NO 2722 in the 10/374,780US patent application
  misc_feature: The sequence is a functional homolog of SEQ ID NO 36 in the 10/225,066US patent application
  misc_feature: The sequence is a functional homolog of SEQ ID NO 362 in the 10/225,066US patent application
  misc_feature: The sequence is a functional homolog of SEQ ID NO 38 in the 10/286,264US patent application
  misc_feature: The sequence is a functional homolog of SEQ ID NO 42 in the 10/374,780US patent application
  misc_feature: Useful for biocontainment applications
  misc_feature: Useful for making plants with modulated biomass
  misc_feature: Useful for making plants with modulated growth and phenotype characteristics
  misc_feature: The sequence is a functional homolog of SEQ ID NO 38 in the 20030093837 US patent application
  misc_feature: The sequence is a functional homolog of SEQ ID NO 18 in the 20040045049 US patent application
  misc_feature: The sequence is a functional homolog of SEQ ID NO 1876 in the 20040045049 US patent application
  misc_feature: The sequence is a functional homolog of SEQ ID NO 36 in the 20050160493 US patent application
  misc_feature: The sequence is a functional homolog of SEQ ID NO 362 in the 20050160493 US patent application
  misc_feature: The sequence is a functional homolog of SEQ ID NO 1917 in the 20060162006 US patent application
  misc_feature: Functional homolog of the protein sequence given in SEQ ID NO 13550
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MDFSCFQPHTGISSYLPFDSYMQQNGRYELHPVDHHPFEVIGDCTSATFNDLGHRFFVEREIKKPTFDHASSVGQRVGSQLPLLTPKTEVSHLMDGGLGSYKAYGMNGRFLPRKKTSLKKANVVVVKGQWTPAEDRKLVKLVEQFGLRKWSYIAQLLPGRVGKQCRERWHNHLRPNIKKDIWSDEEDMVLIQAHKEVGNKWAEIAKRLPGRTENSIKNHWNATKRRQFARRRSRSSKGPKSGTLLQNYIKGLGIAGPSNKTAAAPLPEPTLSPSSLEAPGAKSAKTDEITLEVEHISMSSNIPDSQGILLLPSIHEYNNCSESQSCEDLLAPICDEFSVEMCDGLFDTNEDADAFQVYAMDDDIDMNYIFNYIEHAAIKVDPEIDMEMMMMMMWDGDDGGLLGCDADPAGPAHVETVHVKEEMDLIEMVAATQNCGEAENH

SEQ ID NO: 9441 - DNA, 1167 bp, Sorghum bicolor
  misc_feature: Ceres ANNOT ID no. 6100392
  misc_feature: Encodes the peptide sequence at SEQ ID NO 9442
atggagagcaccgtgctcgcctgcgaggcgccagccggcggcgccgccgcggcgcccggagcgggaggaggggacggaggagccggggacgtggtgatgctgaggcggtcgtccctcgcggcgtgcctcacgtgcccgctctgcggccgcctcttccgcgacgcggccaccatcaccgagtgcctccacaccttttgcaggaagtgcatatcagaggagttcataaataaggaagtgtgttgctgccctatttgtagcattcatttgggctgtgctccattggagaaactcagaattgatcatagcctacagtatgtaaggtcaaaggtattcccttttaaaaaacaaaaggttgaggacccagaagtcacatcgccaattacatcacctatcaagacgaaagaacgatctttatcttcgttgacaaaacatgctccccaaatgtctatgcaaaaatgcttgacaaagaggagaacaaaagcttcatgcttacgcaaactccctttgcactcaaccttgcggggcagtagtaatatcacaaaaaaatctgggggatggagacctttagggtgtcactttcgagcagctaaaaacaaaaagtctcttcgatctaaatcagaagatgtaaagacagctgaaaaaaagactggtgatccaggtgatataactcttgccagtcaagcaaagactaagaagcagtttacaagacgtggaaatctggagaagagaactggaaccaagaaactattgattttaaaggagaaacagaaaaatacaaagccaaaggatattcctaataagaggagattgcaagcattatggttctaccttcttgctgcttttgaccagaaaggacagcctcctctaccgcagataccatcaaaatttttgaggatcaaggatgtaaatttgcctgcttccttcatacagaaataccttgtgcaaaaacttaatctttcaagtgaagctgaggtggagatactctgcggcggcaaaccagtgagcccaggaattaccctgcacgacctagcagattactggattgacaaacgaccaaagggccgagtgcgatcatctgtgggcacacctgcggctgaattcgtgctgaaggtattttatgccaggtcaggagtgccccttcctgaaactgaaaacaacaaagattga

SEQ ID NO: 9442 - protein, 388 aa, Sorghum bicolor
  misc_feature: Ceres ANNOT ID no. 6100392
  misc_feature (45)..(85): Pfam Id: zf-C3HC4 Pfam Desc: Zinc finger, C3HC4 type (RING finger)
  misc_feature (31)..(221): NCBI GI: 42561762 NCBI Desc: zinc finger (c3hc4-type ring finger) family protein [arabidopsis thaliana]
  misc_feature (61)..(183): NCBI GI: 115489434 NCBI Desc: os12g0600200 [oryza sativa (japonica cultivar-group)]
  misc_feature (197)..(382): NCBI GI: 42571369 NCBI Desc: zinc finger (c3hc4-type ring finger) family protein [arabidopsis thaliana]
  misc_feature (166)..(379): NCBI GI: 115455251 NCBI Desc: os03g0741700 [oryza sativa (japonica cultivar-group)]
  misc_feature (32)..(156): NCBI GI: 46227384 NCBI Desc: ring domain protein [cryptosporidium parvum]
MESTVLACEAPAGGAAAAPGAGGGDGGAGDVVMLRRSSLAACLTCPLCGRLFRDAATITECLHTFCRKCISEEFINKEVCCCPICSIHLGCAPLEKLRIDHSLQYVRSKVFPFKKQKVEDPEVTSPITSPIKTKERSLSSLTKHAPQMSMQKCLTKRRTKASCLRKLPLHSTLRGSSNITKKSGGWRPLGCHFRAAKNKKSLRSKSEDVKTAEKKTGDPGDITLASQAKTKKQFTRRGNLEKRTGTKKLLILKEKQKNTKPKDIPNKRRLQALWFYLLAAFDQKGQPPLPQIPSKFLRIKDVNLPASFIQKYLVQKLNLSSEAEVEILCGGKPVSPGITLHDLADYWIDKRPKGRVRSSVGTPAAEFVLKVFYARSGVPLPETENNKD

SEQ ID NO: 9443 - DNA, 1149 bp, Sorghum bicolor
  misc_feature: Ceres ANNOT ID no. 6100398
  misc_feature: Encodes the peptide sequence at SEQ ID NO 9444
atggaggtagtggaggaagccaaccgggccgccgtggagagctgcaagaagctcgtcgccgtgctctcgctctccggtgccgacgcgttccggcctttgcccgtggccgcggagaccgacgaggcggtcgcccggttcggcaaggtggtcgccgtcctgagcgacaggctcggccatgccagagcaagggttgctggcaagaggagcccaccggcgcctcccgtcgatgcgagctgcctcttggagtaccacccgtcgctggcagtggcaccgcgacacactaccaacggcggccatctgctggtcagtgctacttctcctcctcctcctccgccgccgccgccgacgacgacgacgtcgctgagcatgttcctcgagacgtcgctgctagagttaaacaactcttgcagcgtgcctccatcttcgtcgccggccatggcggtgcagaagagcagcccgaaagtcgccgcgcccaatccgtgcaccagcaccccccacatccagttgcagcccaccacccagttccagccaccgccacagcagcaggcggcgaagaagcagaagagcttccagttcgaccagacgccgagcggcgagcagttccacatcgaggtccctgtgccgctgccccgtggcgccgcccccgccgcgaaggaggtgatcagcttcagcttcgacaacaactcggtgtgcacgtcgtcggcggccacgtccttcttcacgtccatcagcagtcagctgatcagcatgtccgacgccgcgacgagctccgccgccaggcccgccacggcgaagaagatgtgcggcaagggagtggaggacggcggcggcggcgtcagatgccattgcccgaagaagaagaagccgagggagaagagggtggtgagggtgccggcgatcagcgacaagaacgccgacatcccggcggacaactactcttggaggaagtatgggcagaaacccatcaaaggctctcctcacccaaggggatactacaggtgcagcagcaagaaggactgcccggcgaggaagcacgtggagcggtgccgcagcgacgccgccatgctgatcgtcacctacgagaacgaccacaaccacgcgcagccgctcgacccctccgtgctcaccgccgccaacgcggaaccttga

SEQ ID NO: 9444 - protein, 382 aa, Sorghum bicolor
  misc_feature: Ceres ANNOT ID no. 6100398
  misc_feature (308)..(368): Pfam Id: WRKY Pfam Desc: WRKY DNA -binding domain
  misc_feature (1)..(382): NCBI GI: 46394266 NCBI Desc: tpa: wrky transcription factor 6 [oryza sativa (japonica cultivar-group)]
  misc_feature (1)..(369): NCBI GI: 11993901 NCBI Desc: somatic embryogenesis related protein [dactylis glomerata]
  misc_feature (2)..(368): NCBI GI: 77556448 NCBI Desc: wrky transcription factor 1 [oryza sativa (japonica cultivar-group)]
  misc_feature (160)..(373): NCBI GI: 10798760 NCBI Desc: wrky transcription factor nteig-d48 [nicotiana tabacum]
  misc_feature (2)..(363): NCBI GI: 77556447 NCBI Desc: wrky transcription factor 1 [oryza sativa (japonica cultivar-group)]
  misc_feature: The plants are small.
  misc_feature: The sequence is a functional homolog of SEQ ID NO 10 in the 10/412,699US patent application
  misc_feature: The sequence is a functional homolog of SEQ ID NO 1020 in the 10/412,699US patent application
  misc_feature: The sequence is a functional homolog of SEQ ID NO 1021 in the 10/412,699US patent application
  misc_feature: The sequence is a functional homolog of SEQ ID NO 1026 in the 10/412,699US patent application
  misc_feature: The sequence is a functional homolog of SEQ ID NO 124 in the 11/479,226US patent application
  misc_feature: The sequence is a functional homolog of SEQ ID NO 525 in the 10/374,780US patent application
  misc_feature: The sequence is a functional homolog of SEQ ID NO 526 in the 10/374,780US patent application
  misc_feature: The sequence is a functional homolog of SEQ ID NO 528 in the 10/374,780US patent application
  misc_feature: The sequence is a functional homolog of SEQ ID NO 534 in the 10/374,780US patent application
  misc_feature: The sequence is a functional homolog of SEQ ID NO 676 in the 10/412,699US patent application
  misc_feature: The sequence is a functional homolog of SEQ ID NO 887 in the 10/666,642US patent application
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1020 in the 20040045049 US patent application
  misc_feature: The sequence is a functional homolog of SEQ ID NO 1021 in the 20040045049 US patent application
  misc_feature: The sequence is a functional homolog of SEQ ID NO 1026 in the 20040045049 US patent application
  misc_feature: The sequence is a functional homolog of SEQ ID NO 676 in the 20040045049 US patent application
  misc_feature: The sequence is a functional homolog of SEQ ID NO 528 in the 20060162006 US patent application
  misc_feature: The sequence is a functional homolog of SEQ ID NO 887 in the 20070033671 US patent application
  misc_feature: Functional homolog of the protein sequence given in SEQ ID NO 13583
MEVVEEANRAAVESCKKLVAVLSLSGADAFRPLPVAAETDEAVARFGKVVAVLSDRLGHARARVAGKRSPPAPPVDASCLLEYHPSLAVAPRHTTNGGHLLVSATSPPPPPPPPPTTTTSLSMFLETSLLELNNSCSVPPSSSPAMAVQKSSPKVAAPNPCTSTPHIQLQPTTQFQPPPQQQAAKKQKSFQFDQTPSGEQFHIEVPVPLPRGAAPAAKEVISFSFDNNSVCTSSAATSFFTSISSQLISMSDAATSSAARPATAKKMCGKGVEDGGGGVRCHCPKKKKPREKRVVRVPAISDKNADIPADNYSWRKYGQKPIKGSPHPRGYYRCSSKKDCPARKHVERCRSDAAMLIVTYENDHNHAQPLDPSVLTAANAEP

SEQ ID NO: 9445 - DNA, 1518 bp, Sorghum bicolor
  misc_feature: Ceres ANNOT ID no. 6100417
  misc_feature: Encodes the peptide sequence at SEQ ID NO 9446
  misc_feature: Down-regulated in shoot tissues in response to salicylic acid treatment
atggcgcttctcctccatccccgcctcccctcccaccctctccgcgcggcagcccaccaccaccacgccatctcggacgcctcttgcgtccttaccctccccggccccggaaggaagcgcacgctgctcgcggcggtcacgtgctgcgcggccagggtcaaggagcccgctccgagtgcaggcgccttgccgccgccgccgcaggcgctggcgaaggaggcgcacaagtacttcgaccacgccgtggtcaccgtccgcgcgggcgacggcgggcacggcgccgtgctcgccatgccgccgccgccctccgcggacgccgccaagcctcgcggcaggttcaacaggggcgagaagaagagcaagaaggtgtcatacaagcgcaactacgacgggtccgtggcgctgccgatgggcgggcacggcggcgacgtcgtggtgtacgccgacgaggccgaggagacgctgctgcggttccacgagaaggcgcggtactgcgctaaacggggaggaaacgtgggcgccgctggcggcacgctcagctcgcggatgcacagcgggttcgctggggagacgctcaggatacccgtgcctgtaggaactgttgtgaaacgcaagaagggggctgttctggcggatttggctcatcccggtgatgaagtgctcgttgctagaggaggccagggcgggatcagcttgatagatgtgcctgagtacaggaggaggaaagccatggccttatccccaaatattatgcgagatactagcgacaaagtattaactcatggtcagcctggtgaggaagtaagcttggagttgatcttaagggtagttgctgatgttggccttgtgggacttccaaatgctggaaaatcaacacttctatcagctataacacttgcaagaccagacattgctgattatccgttcactacattaatgcccaatcttggccggcttggtggagatcctgctttaggggccttacagttttcttcagaagcaacattggcagacttgccaggtctaattgagggcgctcatctaggaaagggtcttggccgcaatttcttaagacatttaaggagaactagagtaatcgtccatgttgtcgatgctgctgcagatgaccctgtcaatgattataagattgtcagagaagaattaaggatgtataacccccaatacctggagcgaccttatgttgtggtcctgaacaagattgatcttcctaaggctaatgataggctatcatcactggccttagagatatcttcaattggatgtgaagaaggacatgaccaaagtggcagcaaagataacctacatggacacgtaagcaatcatcaggtcttatcagaggctaaagttgaaggtggcgaaaaggagcttggggactatccaagacctcaagctgttgtggctgctagcgtattgaggcatattgggatcgacgagatgctgaaggagataagggctgccctgagaaaatgctttgatcacaagttaccagaaccttga

SEQ ID NO: 9446 - protein, 505 aa, Sorghum bicolor
  misc_feature: Ceres ANNOT ID no. 6100417
  misc_feature (278)..(408): Pfam Id: MMR_HSR1 Pfam Desc: GTPase of unknown function
  misc_feature (77)..(274): Pfam Id: GTP1_OBG Pfam Desc: GTP1/OBG
  misc_feature (252)..(426): NCBI GI: 33866460 NCBI Desc: gtp1/obg family gtp-binding protein [synechococcus sp. wh 8102]
  misc_feature (262)..(429): NCBI GI: 146400934 NCBI Desc: gtp1/obg sub domain protein [acidiphilium cryptum jf-5]
  misc_feature (252)..(425): NCBI GI: 78185390 NCBI Desc: small gtp-binding protein domain [synechococcus sp. cc9902]
  misc_feature (252)..(409): NCBI GI: 116073765 NCBI Desc: gtp1/obg family gtp-binding protein [synechococcus sp. rs9916]
  misc_feature (252)..(425): NCBI GI: 116072697 NCBI Desc: small gtp-binding protein domain [synechococcus sp. bl107]
  misc_feature: Down-regulated in shoot tissues in response to salicylic acid treatment
MALLLHPRLPSHPLRAAAHHHHAISDASCVLTLPGPGRKRTLLAAVTCCAARVKEPAPSAGALPPPPQALAKEAHKYFDHAVVTVRAGDGGHGAVLAMPPPPSADAAKPRGRFNRGEKKSKKVSYKRNYDGSVALPMGGHGGDVVVYADEAEETLLRFHEKARYCAKRGGNVGAAGGTLSSRMHSGFAGETLRIPVPVGTVVKRKKGAVLADLAHPGDEVLVARGGQGGISLIDVPEYRRRKAMALSPNIMRDTSDKVLTHGQPGEEVSLELILRVVADVGLVGLPNAGKSTLLSAITLARPDIADYPFTTLMPNLGRLGGDPALGALQFSSEATLADLPGLIEGAHLGKGLGRNFLRHLRRTRVIVHVVDAAADDPVNDYKIVREELRMYNPQYLERPYVVVLNKIDLPKANDRLSSLALEISSIGCEEGHDQSGSKDNLHGHVSNHQVLSEAKVEGGEKELGDYPRPQAVVAASVLRHIGIDEMLKEIRAALRKCFDHKLPEP

SEQ ID NO: 9447 - DNA, 3201 bp, Sorghum bicolor
  misc_feature: Ceres ANNOT ID no. 6100421
  misc_feature: Encodes the peptide sequence at SEQ ID NO 9448
atggcttaccgcggcggcggccgaggaggaggccgcggcggcgaccgcggggaccagcgcccgccgtacggccacggaggagccgggggatccggaggcggcggcggaggccggcccttcatctggccgccaccgccttccacgccgcgcccggtgatgccggcgccgccgccggggccatacccggtcccggtgccgatgggcggctaccgcgggcccatggtgatgccgcacccgggcgcgtacggggttccgatggccgtgtaccggccgtccgggcaagcggccgtgttcagggcgcccgcgccagcggcgccgcaggtctccttctcgcctgcgcctccggcagctccggtcaccatcagggcgccgccaccatcctcgaagacgacgtcgccggctgctccgtcgtctaccactccggcgcctccacgccagtccgcgcggcagagcgcctccacgccggcgtccgattcggctccggccgcctcctccgcgccgtctcccgcggcggccctggcgaaggaggtggagaagaagctgttcgtctccgagaccgcgctggcgccgcctgcgtcggcggcgcatgggacggctgctgcccgcgcggacgaggcgtcggacctcgacctggcgccggtctccaagaaggggctggcgcaccccgctcgcccgggcctcgccaccgtggggaagaaggtgatgatccgcgcgaaccacttcctcgtcaacgtcgccgacaacaacttgttccactatgatgtggctattaatcctgagtcaaagtcaagacaaaccaacagggaagttctgaatgagcttatcaagttgcatgggaagacagctctgggtggcaaactgcctgcctatgatggaaggaagagtctttatactgctggttcacttccttttgaatcagaggagtttgtggttacgctggttgatccagaaaagaaggacaaagaaagggcggagagggagtacaaaatcacaattcgtatcgctgggagaacagatttgtaccaccttcagcagtttctgcgcggaagacagagggatatgcctcaagaaaccatacaagtacttgatgttgtcctcagggagtcgccatcttggaattatgtcacagtgtccagatcctttttctctactacttttggccaccgaggcgacattggcgaggggcttgagtgttggaggggttactaccaaagcctgcgcccgacacaaatggggctttcactgaatatagacatatcagcaacatccttttttaagcctgtgtcagttatcaaatttgtggaggagtacctgaacatgcgtgatacatctcggcctttgtcggacagagatcgtgtgaagataaagaaagcattacgtggagttcgcattgaaacaacccaccaacaggatcaaatcagaagatacaagataacaggggttacttccatccctatgagccagctgatatttcctgttgatgataaaggaacaagaaagactgttgtgcagtacttctgggacaaatacaactacagcttgaagcatggttcttggccttgtcttcaggctggcagtgattcacgacctgtatatttgcctatggaggtttgtaaaattctggaagggcagagatactctaagaagcttaatgacagacaagtgaccaacatacttagagcaacatgtaaacgtccccaggagagggagcagagcatacatgatatggttctgcataacaagtatgcagatgataggtttgctcaggagtttggcatcaaattgaaatatcatgagtctggtagggagaaaacctgtgcgccaagtgttggacaatggaacatgatcaataagaaaatgatcaacggaggaactattgataactggacttgtttgaacttttcacgcatgcgacctgatgaggtacagaggttctgtatggatctgattcatatgtgcaatgcaactggaatggttgtcaatccacgtccatttgttgatgtcaagtctgcagctcccaaccatatagagaatgctttgagagatgtacacaggagagccacacaaatgcttgcccaacaaggagtgggaaatcagctgcagcttctgatcgtaattctgcctgatgttagtggttcttatggtaaaatcaaaagagtctgtgagactgacattggaattgtatctcagtgttgcttgccaaagcatgctagcagaccaaacaaacaatatttagaaaatgttgcactcaaaatcaatgtcaaggttggtgggcgcaacacagttcttgagcgagcctttgtacgcaatggcataccctttgtgtcagaagtcccaacaatcatctttggtgcagatgtcacacaccccccaccaggagaggactctgcctcatccattgctgctgtggtggcatcaatggactggccagaaatcaccaagtacagaggcttggtttctgctcaaccacaccgacaagagataatagaagatttgtttactgtcactaaggatctgcagaaggggcacagtgttaatggtggaatgatcagggagctactgattgctttccgcaggaagacaaacagaaggcctgagaggataatattctatcgggacggtgtaagtgaaggtcaattcagccatgtacttcttcatgaaatggatgccatcagaaaggcttgcgcttctttggaggagggatatctacctccagtcacatttgtggttgtccagaaaaggcatcacacaaggcttttccctgaggttcatggaaggcgtgatatgactgataaaagtggaaacattcttcccggaactgtggttgaccaacagatttgccatcctactgagtttgatttctacttgtgtagtcatgctggtattcagggaacaagtcggcccacccattaccatgtcctctatgatgagaatcattttactgctgatgcactgcagtcactgaccaacaatctatgctacacttatgctcgttgcacccgtgctgtatcagtggttccaccagcctactatgcccaccttgccgcattccgggcacgctactatgtggaaggagaaagctcagacggtggctcaacccctggcagcagcgggcagacagtagcccgggagggtcctgtggaggtgcgtcaacttccgaagatcaaggacaacgtgaaggacgttatgttctactgctga

SEQ ID NO: 9448 - protein, 1066 aa, Sorghum bicolor
  misc_feature: Ceres ANNOT ID no. 6100421
  misc_feature (702)..(1024): Pfam Id: Piwi Pfam Desc: Piwi domain
  misc_feature (428)..(565): Pfam Id: PAZ Pfam Desc: PAZ domain
  misc_feature (12)..(1066): NCBI GI: 115455965 NCBI Desc: os03g0800200 [oryza sativa (japonica cultivar-group)]
  misc_feature (141)..(1066): NCBI GI: 84688906 NCBI Desc: ago1-1 [nicotiana benthamiana]
  misc_feature (200)..(1066): NCBI GI: 84688908 NCBI Desc: ago1-2 [nicotiana benthamiana]
  misc_feature (162)..(1066): NCBI GI: 4510428 NCBI Desc: argonaute (ago1)-like protein [arabidopsis thaliana]
  misc_feature (190)..(1066): NCBI GI: 50725578 NCBI Desc: zll/pnh homologous protein [oryza sativa (japonica cultivar-group)]
  misc_feature: The sequence is a functional homolog of SEQ ID NO 102 in the 10/286,264US patent application
  misc_feature: The sequence is a functional homolog of SEQ ID NO 1579 in the 11/479,226US patent application
  misc_feature: The sequence is a functional homolog of SEQ ID NO 2084 in the 10/374,780US patent application
  misc_feature: The sequence is a functional homolog of SEQ ID NO 752 in the 10/412,699US patent application
  misc_feature: Useful for making plants with modulated growth and phenotype characteristics
  misc_feature: The sequence is a functional homolog of SEQ ID NO 102 in the 20030093837 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 2086 in the 10/374,780 US patent application
MAYRGGGRGGGRGGDRGDQRPPYGHGGAGGSGGGGGGRPFIWPPPPSTPRPVMPAPPPGPYPVPVPMGGYRGPMVMPHPGAYGVPMAVYRPSGQAAVFRAPAPAAPQVSFSPAPPAAPVTIRAPPPSSKTTSPAAPSSTTPAPPRQSARQSASTPASDSAPAASSAPSPAAALAKEVEKKLFVSETALAPPASAAHGTAAARADEASDLDLAPVSKKGLAHPARPGLATVGKKVMIRANHFLVNVADNNLFHYDVAINPESKSRQTNREVLNELIKLHGKTALGGKLPAYDGRKSLYTAGSLPFESEEFVVTLVDPEKKDKERAEREYKITIRIAGRTDLYHLQQFLRGRQRDMPQETIQVLDVVLRESPSWNYVTVSRSFFSTTFGHRGDIGEGLECWRGYYQSLRPTQMGLSLNIDISATSFFKPVSVIKFVEEYLNMRDTSRPLSDRDRVKIKKALRGVRIETTHQQDQIRRYKITGVTSIPMSQLIFPVDDKGTRKTVVQYFWDKYNYSLKHGSWPCLQAGSDSRPVYLPMEVCKILEGQRYSKKLNDRQVTNILRATCKRPQEREQSIHDMVLHNKYADDRFAQEFGIKLKYHESGREKTCAPSVGQWNMINKKMINGGTIDNWTCLNFSRMRPDEVQRFCMDLIHMCNATGMVVNPRPFVDVKSAAPNHIENALRDVHRRATQMLAQQGVGNQLQLLIVILPDVSGSYGKIKRVCETDIGIVSQCCLPKHASRPNKQYLENVALKINVKVGGRNTVLERAFVRNGIPFVSEVPTIIFGADVTHPPPGEDSASSIAAVVASMDWPEITKYRGLVSAQPHRQEIIEDLFTVTKDLQKGHSVNGGMIRELLIAFRRKTNRRPERIIFYRDGVSEGQFSHVLLHEMDAIRKACASLEEGYLPPVTFVVVQKRHHTRLFPEVHGRRDMTDKSGNILPGTVVDQQICHPTEFDFYLCSHAGIQGTSRPTHYHVLYDENHFTADALQSLTNNLCYTYARCTRAVSVVPPAYYAHLAAFRARYYVEGESSDGGSTPGSSGQTVAREGPVEVRQLPKIKDNVKDVMFYC

SEQ ID NO: 9449 - DNA, 1119 bp, Sorghum bicolor
  misc_feature: Ceres ANNOT ID no. 6100441
  misc_feature: Encodes the peptide sequence at SEQ ID NO 9450
atggagaggggcgccgccaccgccgccgcggtgctcggctgcgccctccgctccccttctccctccccgtcccaggctccccggtggccgccgctcctccgctgcccccgtcgcggcccgccccggcctgcccgctcccttatgccgcccgcgcggcgtttcaggtctctagacatgaagaagggacagagtaggaactcactgaagaccttcagctcatctggacactcgggggttagactaaacaatgaagatctcatcaatgacaggctcctaatagattgtggagaggatcaagattgtgtgctcggtggcatagttgccctgggaaagtttgatgccctccacattggtcatcgggaattggcaatgcatgcttctaaagcagggactccttttcttctgtcttttgtgggaatggccgaagtacttggctggacatataggcctcctatagttgctcattgtgatcgcaagcgggtcctttcatcttgggctccatactgtaggaatgtggtacctcttgaatatcaagttgagttttcaaaggtcaggtccctgtctccacgacaatttgttgaaaggttatcaaaggatcttagaataaaaggtgtcgtggcaggtgaaaattacaggtttggttacaaagcatctggtgatgcagctgagttagtgaaactatgtgaggaatttgatttaagtgcattcattgtacgctctgtcatggacacagcaaaaagatctcataatggagtttcagctgctataaattccagtgataaaggacaggtttcttccagccgtgtccgccatgcgttggctatgggtgacatggaatatgtctctgaattactagggaggaaacaccgtcttgtgctaatggttaaccaacactgccttcacgaaaagaaaaacattgtactccctaattcttgcatgttgaacatgccaccagctgaaggtctctatgaaaactgcgaccttgttaatggagggtatcttggaccatgtagagtgatcatcgactctgacaccattatcattgagatgaaagacgagaacagcttatctctaaatcctattcaagaagttcagcagttagggattgagtttggataa

SEQ ID NO: 9450 - protein, 372 aa, Sorghum bicolor
  misc_feature: Ceres ANNOT ID no. 6100441
  misc_feature (98)..(249): Pfam Id: FAD_syn Pfam Desc: FAD synthetase
  misc_feature (102)..(354): NCBI GI: 42573309 NCBI Desc: riboflavin biosynthesis protein-related [arabidopsis thaliana]
  misc_feature (106)..(323): NCBI GI: 125747095 NCBI Desc: bifunctional flavokinase/fad-synthetase [streptomyces davawensis]
  misc_feature (106)..(334): NCBI GI: 117928718 NCBI Desc: riboflavin biosynthesis protein ribf [acidothermus cellulolyticus 11b]
  misc_feature (106)..(323): NCBI GI: 133914988 NCBI Desc: riboflavin kinase / fmn adenylyltransferase [saccharopolyspora erythraea nrrl 2338]
  misc_feature (107)..(291): NCBI GI: 126661618 NCBI Desc: bifunctional riboflavin kinase/fmn adenylyltransferase [cyanothece sp. ccy0110]
MERGAATAAAVLGCALRSPSPSPSQAPRWPPLLRCPRRGPPRPARSLMPPARRFRSLDMKKGQSRNSLKTFSSSGHSGVRLNNEDLINDRLLIDCGEDQDCVLGGIVALGKFDALHIGHRELAMHASKAGTPFLLSFVGMAEVLGWTYRPPIVAHCDRKRVLSSWAPYCRNVVPLEYQVEFSKVRSLSPRQFVERLSKDLRIKGVVAGENYRFGYKASGDAAELVKLCEEFDLSAFIVRSVMDTAKRSHNGVSAAINSSDKGQVSSSRVRHALAMGDMEYVSELLGRKHRLVLMVNQHCLHEKKNIVLPNSCMLNMPPAEGLYENCDLVNGGYLGPCRVIIDSDTIIIEMKDENSLSLNPIQEVQQLGIEFG

SEQ ID NO: 9451 - DNA, 2775 bp, Sorghum bicolor
  misc_feature: Ceres ANNOT ID no. 6100443
  misc_feature: Encodes the peptide sequence at SEQ ID NO 9452
atgggcaagcggaagcagcgcggcggcggcgacggcgacggagaacccgccgcggaaggcgagacggccaccgttggtgctggcggaggacacagcccctccactgtgttcgtctccaacctcccctacaccttcaagtcctccgatctcgaggcggtgtttagtgaggtcggcccagtgcggcgctgctttatggtcgcagagaaaggatcggagaagagtcgaggctttgggttcgtgcaatttgcaactgttcaagatgctgatcgagctattcaacaaaagaatggatttcctgttgctggtaggaaaatcagagttaagctagcaatgaatcgtgctccactgaaggaacgtttgcaaaagaaggagaatatgcaagtgaaggactctgatgcaaaagatgaagcagacgagactgctcctgctgaaaagcataaggggaaatctcataaaacagatccagaaccagagcaaccacatttgttgtcaaaggatgctatggtaccaaaggaagctcccattggtgaccccgaaaaagtgaaaagttctgaaaagcaaagggttgcaaagacggtgatttttggtggcttgcaagactccgccatggcaagtgaggttttccgtcaagctcgagaaattggttcagttgtatctgtaaactatccacttcccaaaggggaaatggacttccatggacttgctcgagatggatgcacatcagatatggctgctgtactctttgcaagtgtgaaatcagcttgcgattctgttgtccaactgcatcgcaaggaagtcaagggagctattgtttgggctcgtcaacttggcggagagggttcaaagatcagaaaatggagagtgattgtcaggaatcttccattcaagattacagagaaggagatcatggatatgtttggttcagcagggtttgtctgggatgtgtcaattccacataagtctgatgagggaatatcaaaaggctttgcttttgtatctttcacacggaagcaagatgcagaaaatgctataaaaaatattaatggaaaagttgttgcaaagcgaccagtggctgtcgattgggctgttcccaaaaaagtgtacactgttgctgcaaaagctgatgctaaggataatgagcctgagaatatacctgacaatgtcagtgatgatgacacctctgacgatagtcttgttggagaagctagctctgaacttgacctggagacttctaatcgtccatctgaggatgatttcaaagctgaagcagatatttctagaaaagttcttgagaatttgatcaagtcatcagagaagtccgaaccatctgcaatcgaaggttcggacattgataccgacactgaaacagaagatgtcgcatcagaaaaggagaagtctgattcacctgtagctggcaagttggctaagtcgaagcctgtaacagatgcagaaatcagtaatcctgcttccaaacccaagaaaaatgatactggcctggataggactatattcattagcaaccttccttttgatataagtaatgaggaggtaacagcacgcttctcagtctttgggaaggttgaatctttcttcccggttcttcataaacttactaagagacctagaggtactggtttcatgaagttttctacaacagaggcagctgatgcagcagtttctgccgccaatgttgctcctggcttaggaatttctttaaagagcaggccacttaatgtcatgaaagcgatggacaaggagtcagctcacaaaaaggcacttgagaaggcaaagactgaggtcgaggatcgacgaaacctatacttggctaaggagggggaaatacttgctggaacaccagctgcagaaggtgtgtcagatgctgacatgaataaacgtaattggttagctagaaggaaagcggagatgcttcagtctccaaaatttcacgtgtcaagaacaaggcttatcatctacaatttgcctaagactatgaccattaatgatgtaaagaagctttgcagagaagcagtcatttctcgtgctaccaaacaaaatcccgtcatccggaaggtgaatatcctgaagaatgaaaagaaaggcgtacagaagcattcacgtggtgtagcctttgttgattttcaagaacatgaacacgctcttgttgctctaagggttctaaacaacaacccagaaacttttggttcagaacgtcgtccagttgtagagttcgcacttgaggatgttgaaaaggtgaggcttcaaaagattcggatggaacggcatcgcaagtcagcagcagaaaccacagaagttcaggagaccccttcaggggatcaacctgcaagtgaaggccatattgcagataacagcaggacttccagaaaaggaaacaagtggaaatcacacaatagaccatctaaaccatccgattctgttgaagggccggccaaggatcctctagttcgtggagatcgaagcgcgagacctgcaaagagagcaaggaagacagatgtggggactgttttgccggaccgagggctaacgattgcaaccccaaacactgctcaaaatcaagctgtgccaagtgagcgtgatcaggcagctgctccaaagaaaaggaaaaacagaaaagacagccaggcagagcaaaagagaggaaaggctacaaaaaggaccaggaaagaacctgccagggaaggaggcgtggataagtcgctggtggagcagtaccgttccaagttcttgcaacatggtgttagcaagaccaaaggatag

SEQ ID NO: 9452 - protein, 924 aa, Sorghum bicolor
  misc_feature: Ceres ANNOT ID no. 6100443
  misc_feature (36)..(107): Pfam Id: RRM_1 Pfam Desc: RNA recognition motif. (a.k.a. RRM, RBD, or RNP domain)
  misc_feature (288)..(359): Pfam Id: RRM_1 Pfam Desc: RNA recognition motif. (a.k.a. RRM, RBD, or RNP domain)
  misc_feature (503)..(579): Pfam Id: RRM_1 Pfam Desc: RNA recognition motif. (a.k.a. RRM, RBD, or RNP domain)
  misc_feature (233)..(900): NCBI GI: 115456299 NCBI Desc: os03g0824300 [oryza sativa (japonica cultivar-group)]
  misc_feature (33)..(891): NCBI GI: 140049097 NCBI Desc: rna-binding region rnp-1 (rna recognition motif) [medicago truncatula]
  misc_feature (282)..(923): NCBI GI: 94733636 NCBI Desc: novel protein (zgc:56258) [danio rerio]
  misc_feature (284)..(921): NCBI GI: 26252146 NCBI Desc: rbm28 protein [mus musculus]
  misc_feature (284)..(921): NCBI GI: 51095071 NCBI Desc: rna binding motif protein 28 [homo sapiens]
  misc_feature: The sequence is a functional homolog of SEQ ID NO. 339 in the 11/188,298 US application
MGKRKQRGGGDGDGEPAAEGETATVGAGGGHSPSTVFVSNLPYTFKSSDLEAVFSEVGPVRRCFMVAEKGSEKSRGFGFVQFATVQDADRAIQQKNGFPVAGRKIRVKLAMNRAPLKERLQKKENMQVKDSDAKDEADETAPAEKHKGKSHKTDPEPEQPHLLSKDAMVPKEAPIGDPEKVKSSEKQRVAKTVIFGGLQDSAMASEVFRQAREIGSVVSVNYPLPKGEMDFHGLARDGCTSDMAAVLFASVKSACDSVVQLHRKEVKGAIVWARQLGGEGSKIRKWRVIVRNLPFKITEKEIMDMFGSAGFVWDVSIPHKSDEGISKGFAFVSFTRKQDAENAIKNINGKVVAKRPVAVDWAVPKKVYTVAAKADAKDNEPENIPDNVSDDDTSDDSLVGEASSELDLETSNRPSEDDFKAEADISRKVLENLIKSSEKSEPSAIEGSDIDTDTETEDVASEKEKSDSPVAGKLAKSKPVTDAEISNPASKPKKNDTGLDRTIFISNLPFDISNEEVTARFSVFGKVESFFPVLHKLTKRPRGTGFMKFSTTEAADAAVSAANVAPGLGISLKSRPLNVMKAMDKESAHKKALEKAKTEVEDRRNLYLAKEGEILAGTPAAEGVSDADMNKRNWLARRKAEMLQSPKFHVSRTRLIIYNLPKTMTINDVKKLCREAVISRATKQNPVIRKVNILKNEKKGVQKHSRGVAFVDFQEHEHALVALRVLNNNPETFGSERRPVVEFALEDVEKVRLQKIRMERHRKSAAETTEVQETPSGDQPASEGHIADNSRTSRKGNKWKSHNRPSKPSDSVEGPAKDPLVRGDRSARPAKRARKTDVGTVLPDRGLTIATPNTAQNQAVPSERDQAAAPKKRKNRKDSQAEQKRGKATKRTRKEPAREGGVDKSLVEQYRSKFLQHGVSKTKG

SEQ ID NO: 9453 - DNA, 1872 bp, Sorghum bicolor
  misc_feature: Ceres ANNOT ID no. 6100455
  misc_feature: Encodes the peptide sequence at SEQ ID NO 9454
atgtgcccagcagcctcgagcacgagctcggccaagccgtcgaagaagcggaagcagcccgtcgtcgccccgccggagtcggactctgaggaggactctgtctacgacaccgcctccgacgatggcgaggaggaagaggagaggcaggagttagagagcgaggatgaagaccaggaggtggaggacgggagcgaggacgacgaggaagatgaagatgatgacgagagcgaggtggaggaagaggaggtgaaggaggaaaaggaaaaggaggaggaggaggtgaaggagaaaaaggaaaagaagaaggcgaagaaggcgaagaaggaagaggaaaagaaggtgaagaagaagagcgaggggagtggaattctgtctaacaagctcttctcggagctccccatctccgagctcactgccaaggccatcagagagatgaactacacccacctcacccagattcaagctagatcaataccacatctgttggagggaaaggatgtgatgggcgcagccaagactggctctgggaagactcttgcattccttataccagctattgagctgctctatcacctgcgtttctcatcgaggaatgggactggtgttattgtggtttgcccgacacgggagcttgctatccagacacacaatgttgccaaggagttaatgaaatatcactcgcaaactcttggatatgttattggtggtaataatcgaagaagtgaggctgatcagcttgcaaagggggtcaatttattagttgctaccccaggcaggcttttggaccatctacaaaataccaagagtttcatatacaaaaggctaaagtgccttgtaattgatgaagccgaccgcatacttgagcaaaattttgaggaagatatgaaacaaatatttaaacgccttccccagaataggcagactgttcttttttctgctacgcagactccagaggttgaaaagtttgctaaattgtcatttgagaaaaatgaagaaagtaaagaaaaacctgtttatgttggagttgatgatgataagtcaaaggctactgttgaaggcttgcagcagggttattgtgtcatttctagcgagaaaaggttcctggttctgtatgctttcctaaaaaagaaacagaacaaaaagatcatggtgttcttttcatcatgtaattcagtaaagttccacgcagaacttctgaatttccttgggatagattgttctgatatccatgggaaacagaagcagcagaagcgaactactacattctttagcttctgcaaggcagaaaagggcatcttattgtgcactaacgtggctgcccgtggacttgatattcctgacgtggattatattgtgcaatatgaccctccagatgaaccgaaggattacattcacagagttggtcgtaccgcgcgtggtgagaaaggcaaaggaagtgcattactgttcttactaccagaagaattgaagtttctaatttacctaaaggcggccaaggttaccctgacagaatatgagttcaatcaaaagaatgtgccaaatttgcaatcacacctcgagaatattgttggtgagaattactttctgaaccagtctgccaaagaagcctacagatcctacgttttggcatacgattctcactctatgaaagacatttttaatgttcatcaactcgacctgcagaaagtagcagcgtcattctgtttcaggaatcctccaaaagtgaatctggacctggatagcagtgcagcaaaacatcggaagaagatgaggagagtagatggtgggaagaggcatggcatcagcgctttgaacccatatgggaggaaggacaaagacggtggcgataaacggcagtttgcgagattctag

SEQ ID NO: 9454 - protein, 623 aa, Sorghum bicolor
  misc_feature: Ceres ANNOT ID no. 6100455
  misc_feature (151)..(322): Pfam Id: DEAD Pfam Desc: DEAD/DEAH box helicase
  misc_feature (398)..(474): Pfam Id: Helicase_C Pfam Desc: Helicase conserved C-terminal domain
  misc_feature (147)..(319): Pfam Id: ResIII Pfam Desc: Type III restriction enzyme, res subunit
  misc_feature (22)..(622): NCBI GI: 140049266 NCBI Desc: helicase, c-terminal [medicago truncatula]
  misc_feature (3)..(596): NCBI GI: 28571808 NCBI Desc: cg6375-pb, isoform b [drosophila melanogaster]
  misc_feature (42)..(599): NCBI GI: 19115400 NCBI Desc: probable atp-dependent rna helicase [schizosaccharomyces pombe]
  misc_feature (10)..(622): NCBI GI: 46329511 NCBI Desc: mgc83105 protein [xenopus laevis]
  misc_feature (23)..(622): NCBI GI: 51010913 NCBI Desc: dead (asp-glu-ala-asp) box polypeptide 18 [danio rerio]
MCPAASSTSSAKPSKKRKQPVVAPPESDSEEDSVYDTASDDGEEEEERQELESEDEDQEVEDGSEDDEEDEDDDESEVEEEEVKEEKEKEEEEVKEKKEKKKAKKAKKEEEKKVKKKSEGSGILSNKLFSELPISELTAKAIREMNYTHLTQIQARSIPHLLEGKDVMGAAKTGSGKTLAFLIPAIELLYHLRFSSRNGTGVIVVCPTRELAIQTHNVAKELMKYHSQTLGYVIGGNNRRSEADQLAKGVNLLVATPGRLLDHLQNTKSFIYKRLKCLVIDEADRILEQNFEEDMKQIFKRLPQNRQTVLFSATQTPEVEKFAKLSFEKNEESKEKPVYVGVDDDKSKATVEGLQQGYCVISSEKRFLVLYAFLKKKQNKKIMVFFSSCNSVKFHAELLNFLGIDCSDIHGKQKQQKRTTTFFSFCKAEKGILLCTNVAARGLDIPDVDYIVQYDPPDEPKDYIHRVGRTARGEKGKGSALLFLLPEELKFLIYLKAAKVTLTEYEFNQKNVPNLQSHLENIVGENYFLNQSAKEAYRSYVLAYDSHSMKDIFNVHQLDLQKVAASFCFRNPPKVNLDLDSSAAKHRKKMRRVDGGKRHGISALNPYGRKDKDGGDKRQFARF

SEQ ID NO: 9455 - DNA, 762 bp, Sorghum bicolor
  misc_feature: Ceres ANNOT ID no. 6100457
  misc_feature: Encodes the peptide sequence at SEQ ID NO 9456
atggagccatccccagcagtcgctgcggagctctggtgcccaccacacctcgccgcgggcggcggccgccaggtggaggcgacctccgctctcacggagaagagcagtggcggccgcggaggaggcagcgccgtcaggaggaggccgagggagaccctggcgtccgaggaagactcgtcccggatcgtctctacttccggcggcggccaggatttgacagatccagaagcaaaacgttccaaaacaaataagtccagtaataataatggcagtctaagaacagaggctgaaactgacccaagaagtgctggcaaggctgttagtaaaagccttccagcagcagagccaccaaaacaagattatatccatgtcagggcaaggaggggccaagcaactgatagtcatagtcttgcagaaagggcacgacgtgagaaaataagcgaacggatgaaagttctccaagatctcgtgcctggatgtaacaaggttattggcaaagcatcagtacttgatgagataattaattacatccagtcgttgcaatgccaagttgagttcctgtccatgaagcttgaggcggttaatgcccacgcgaaccagggagttgaagcatttccagtcaaagattatggtgctgagacatacaacacagcccctgggctgacatttgatacgcaaaccagtagagaatacgcccagggcacgtcgacctcagaatggcttcacatgcagattggcagtggctatgaaagggtttcatga

SEQ ID NO: 9456 - protein, 253 aa, Sorghum bicolor
  misc_feature: Ceres ANNOT ID no. 6100457
  misc_feature (131)..(181): Pfam Id: HLH Pfam Desc: Helix-loop-helix DNA-binding domain
  misc_feature (1)..(216): NCBI GI: 115471019 NCBI Desc: os07g0193800 [oryza sativa (japonica cultivar-group)]
  misc_feature (29)..(253): NCBI GI: 55419646 NCBI Desc: bhlh transcription factor [gossypium hirsutum]
  misc_feature (47)..(253): NCBI GI: 33339703 NCBI Desc: myc1 [catharanthus roseus]
  misc_feature (56)..(209): NCBI GI: 8778763 NCBI Desc: t30e16.21 [arabidopsis thaliana]
  misc_feature (56)..(209): NCBI GI: 30696324 NCBI Desc: basic helix-loop-helix (bhlh) family protein [arabidopsis thaliana]
  misc_feature: The plant is abnormally small.
  misc_feature: The sequence is a functional homolog of SEQ ID NO 1781 in the 11/479,226US patent application
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: The sequence is a functional homolog of SEQ ID NO 270 in the 10/374,780US patent application
  misc_feature: The sequence is a functional homolog of SEQ ID NO 38 in the 11/375,241US patent application
  misc_feature: The sequence is a functional homolog of SEQ ID NO 4 in the 10/225,066US patent application
  misc_feature: The sequence is a functional homolog of SEQ ID NO 444 in the 10/374,780US patent application
  misc_feature: The sequence is a functional homolog of SEQ ID NO 460 in the 11/435,388US patent application
  misc_feature: The sequence is a functional homolog of SEQ ID NO 48 in the 10/225,066US patent application
  misc_feature: The sequence is a functional homolog of SEQ ID NO 480 in the 10/225,066US patent application
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 13025
  misc_feature: The sequence is a functional homolog of SEQ ID NO 4 in the 20050160493 US patent application
  misc_feature: The sequence is a functional homolog of SEQ ID NO 48 in the 20050160493 US patent application
  misc_feature: The sequence is a functional homolog of SEQ ID NO 480 in the 20050160493 US patent application
  misc_feature: The sequence is a functional homolog of SEQ ID NO 1929 in the 20060162006 US patent application
  misc_feature: The sequence is a functional homolog of SEQ ID NO 1930 in the 20060162006 US patent application
  misc_feature: The sequence is a functional homolog of SEQ ID NO 1929 in the 10/374,780 US patent application
  misc_feature: The sequence is a functional homolog of SEQ ID NO 1930 in the 10/374,780 US patent application
  misc_feature: Useful for making plants with modulated biomass
  misc_feature: Functional homolog of the protein sequence given in SEQ ID NO 13025
  misc_feature: The sequence is a functional homolog of SEQ ID NO 122 in the 10/374,780 US patent application
  misc_feature: The sequence is a functional homolog of SEQ ID NO 244 in the 10/225,068 US patent application
  misc_feature: Useful for making plants with altered alkaloid content
  misc_feature: Functional homolog of the protein sequence given in SEQ ID NO 14050
  misc_feature: The sequence is a functional homolog of SEQ ID NO 864 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MEPSPAVAAELWCPPHLAAGGGRQVEATSALTEKSSGGRGGGSAVRRRPRETLASEEDSSRIVSTSGGGQDLTDPEAKRSKTNKSSNNNGSLRTEAETDPRSAGKAVSKSLPAAEPPKQDYIHVRARRGQATDSHSLAERARREKISERMKVLQDLVPGCNKVIGKASVLDEIINYIQSLQCQVEFLSMKLEAVNAHANQGVEAFPVKDYGAETYNTAPGLTFDTQTSREYAQGTSTSEWLHMQIGSGYERVS

SEQ ID NO: 9457 - DNA, 894 bp, Sorghum bicolor
  misc_feature: Ceres ANNOT ID no. 6100465
  misc_feature: Encodes the peptide sequence at SEQ ID NO 9458
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
atggcgccgccggtcgccctgctccttctcgccgccatcgtgctcgcgcgggtcgtcacccacgcccacggtggcggcggcggcttctatgatccggcgcgcgtcacccagctctcctggcgccccagggcgttcctctacagcggcttcctgtcggacaccgagtgcgaccacctcatcaacctggcgaaaggcagcatggagaagtcgatggtggcggataacgactccgggaaaagcctcatgagccaagtgcgcaccagctccggcgcctttttggccaagcacgaggatgaaattgtctctgcaattgagaaacgcgtagctgcttggacatttcttccggaagaaaacgctgaatcaatgcaggttctgcgctatgaaatcggtcagaagtatgatgcccactttgattattttcatgacaaaaataacgtgaagcatggcggtcagcgatttgcaactgtccttatgtacttgacagatgtcaagaagggtggagaaactgtatttccaaatgctgagggaagccatttacagtacaaggatgaaacttggtcagagtgttcaagatctggcctggcagtgaagccaaaaaaaggagacgcgctactgttcttcggtcttcatctcaatgcaacaactgatacaagtagtcttcatgggagctgcccagtaattgagggtgagaagtggtctgcaacgaaatggattcacgtcagatcattcgataatcctccaaatgtaaggatggacgcgccatgttccgatgacaatgagctctgccctaaatgggctgctattggggaatgttacaagaacccaacatacatggttggcaccaaggatactaatggattttgccgcaaaagttgtgggctctgtgatgcttga

SEQ ID NO: 9458 - protein, 297 aa, Sorghum bicolor
  misc_feature: Ceres ANNOT ID no. 6100465
  misc_feature (118)..(240): Pfam Id: 2OG-FeII_Oxy Pfam Desc: 2OG-Fe(II) oxygenase superfamily
  misc_feature (255)..(295): Pfam Id: ShK Pfam Desc: ShK domain-like
  misc_feature (30)..(297): NCBI GI: 9294583 NCBI Desc: prolyl 4-hydroxylase alpha subunit-like protein [arabidopsis thaliana]
  misc_feature (30)..(297): NCBI GI: 18086437 NCBI Desc: at3g28480/mfj20_16 [arabidopsis thaliana]
  misc_feature (30)..(297): NCBI GI: 92868637 NCBI Desc: metridin-like shk toxin; 2og-fe(ii) oxygenase [medicago truncatula]
  misc_feature (5)..(297): NCBI GI: 34393269 NCBI Desc: prolyl 4-hydroxylase alpha-1 subunit precursor-like protein [oryza sativa (japonica cultivar-group)]
  misc_feature (5)..(297): NCBI GI: 115471029 NCBI Desc: os07g0194500 [oryza sativa (japonica cultivar-group)]
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: The sequence is a functional homolog of SEQ ID NO. 333 in the 11/188,298 US application
MAPPVALLLLAAIVLARVVTHAHGGGGGFYDPARVTQLSWRPRAFLYSGFLSDTECDHLINLAKGSMEKSMVADNDSGKSLMSQVRTSSGAFLAKHEDEIVSAIEKRVAAWTFLPEENAESMQVLRYEIGQKYDAHFDYFHDKNNVKHGGQRFATVLMYLTDVKKGGETVFPNAEGSHLQYKDETWSECSRSGLAVKPKKGDALLFFGLHLNATTDTSSLHGSCPVIEGEKWSATKWIHVRSFDNPPNVRMDAPCSDDNELCPKWAAIGECYKNPTYMVGTKDTNGFCRKSCGLCDA

SEQ ID NO: 9459 - DNA, 855 bp, Sorghum bicolor
  misc_feature: Ceres ANNOT ID no. 6100467
  misc_feature: Encodes the peptide sequence at SEQ ID NO 9460
  misc_feature: Down-regulated in shoot tissues in response to salicylic acid treatment
atgcgggccctcgcgcgcgccgcgtcgctgctccgccgcgccgcggggtccgcgcccactacggtggcgctgcaccacaaccacctgccgcgtggcgtgggcccgtgcctcgcgaagaatccaggtttctttttcaatgggtattctactcttttggctccaccaagtgaagtgctgattccaccagaacttctttctagcaggactgtgtggacaccagatcgggagcttgggcagtacgaagacctggtagctagggtcactaactttcataatgaggacaagggtttcatggttttggatggtgatgtttttgatgttccaattaggaaggatattgttcaccgggtagggacacactcaactaaaactatcagtgaagtgagtggcactggaagaaagccttacaagcaaaaaggaactggaagagcacggcacggcacactgcgtggtccccagttccgcggtggtgcaaccatgcatgggcctaaaccacgaagccatgcaatcaagctgcagaagaaagtacggcgtctggggcttaagattgccttgtctgctcgaactgcagaggggaagctcttggtctttgaggacttggaagtccctagccacaagacaaaaaacattgtgcaatacattagacagatggatgataccaagaaggttctgttggtggatggaggtgacattgataagaagctaaagctggctactcaaaaccttcactatgttaatgtacttccttccattgggctcaatgtctacagtatcctccagcatgacacccttgtaatgactcgggccgctatcaacagaatcgttgagcggatgcatactcccatcaaccggtag

SEQ ID NO: 9460 - protein, 284 aa, Sorghum bicolor
  misc_feature: Ceres ANNOT ID no. 6100467
  misc_feature (97)..(277): Pfam Id: Ribosomal_L4 Pfam Desc: Ribosomal protein L4/L1 family
  misc_feature (49)..(284): NCBI GI: 21553676 NCBI Desc: 50s ribosomal protein l4 [arabidopsis thaliana]
  misc_feature (49)..(284): NCBI GI: 20197568 NCBI Desc: 50s ribosomal protein l4 [arabidopsis thaliana]
  misc_feature (87)..(278): NCBI GI: 83576933 NCBI Desc: ribosomal protein l4/l1e [rhodospirillum rubrum atcc 11170]
  misc_feature (86)..(278): NCBI GI: 91205876 NCBI Desc: 50s ribosomal protein l4 [rickettsia bellii rml369-c]
  misc_feature (86)..(278): NCBI GI: 144900885 NCBI Desc: 50s ribosomal protein l4 [magnetospirillum gryphiswaldense msr-1]
  misc_feature: Down-regulated in shoot tissues in response to salicylic acid treatment
MRALARAASLLRRAAGSAPTTVALHHNHLPRGVGPCLAKNPGFFFNGYSTLLAPPSEVLIPPELLSSRTVWTPDRELGQYEDLVARVTNFHNEDKGFMVLDGDVFDVPIRKDIVHRVGTHSTKTISEVSGTGRKPYKQKGTGRARHGTLRGPQFRGGATMHGPKPRSHAIKLQKKVRRLGLKIALSARTAEGKLLVFEDLEVPSHKTKNIVQYIRQMDDTKKVLLVDGGDIDKKLKLATQNLHYVNVLPSIGLNVYSILQHDTLVMTRAAINRIVERMHTPINR

SEQ ID NO: 9461 - DNA, 1971 bp, Sorghum bicolor
  misc_feature: Ceres ANNOT ID no. 6100469
  misc_feature: Encodes the peptide sequence at SEQ ID NO 9462
atgcggaggtcgtcggggcccggcacgccgtgccgccgccgcgcgatccaggtgctcgtggcggtctccctcgcctacgcgctcgccgtgctgctcctcgagtcgccgctcgtgtccacgtccctgcccggggcgggggcgtccgccgcggcgtcgcggaagctccacctcgacggcgcgtgggagggcgtggggcgaaccgcgccggcgcgccccgggaagcacccgcacagggagaccctctcggcggacgcgtggtggggacgggcacgccggttggcggggatcgtctctggcctcgagctccgccacctcaactccacccgctccggctcgctccgcaaggtcgccgccgaggccgccgagtcaggggcccgcgtgttctccggcctggaggctctagcgacgaccctggcgtcctcgcgtgattcctcaggggaggaagagaagagcaagtgcccgcactcgatcgtcctcagcggtgacgagttccgggagagggggcggacggtggagctgccgtgcgggctcacgctgggttcgtatatcacggtcgccgcgacgccgcaccaggcgcaccctgagcgggatcctaagatcacgatgctcagggagggggaagagccgatcatggtgtcgcagttcatgatggagctgcaggggctcaagacggtggacggcgaggatccgcccaggattctccatttcaacccccgcctccgcggcgactggagcggcaagccggtgatcgagcagaacacctgctaccgcatgcagtggggcactccgcttcgctgcgagggctggaggtcccgtgccgacgaagagactgtggatgggttggtcaagtgtgagaagtggattcgggatgatgaaggacggtcggaggagtcaaaaacgtcatggtggctgaaccggctcattggccgcacaaagaccgtctccgttgattggccatacccattcgtggaggaccgcctgtttgttctaactctcactgctggattggagggttaccatgtgaatgttgatggacggcatgtgacatcatttccataccgcactggatttgttcttgaggatgctactggcttatcattgaatggggacctagatgttcaatcagtgtttgcggggactctgcccaccacacatcctagcttttctccacagaaacacctagagatgttgcccagttggcaggcccctccccttccagacgaaccagttgagattttcatcggtatcctgtcagcaggcaaccattttgctgaacgtatggctgcgagaaagacatggatgtctgctgcccagaagtcatcgaatgttgtggcccggttttttgttgccctgcatggcagaaatgaagttaatgtggagctgaaaaaggaggctgagtttttcggcgacattgttattgtgccattcatggatagctatgatttggttgttcttaagacaattgccatatgcgagtatggggtccatgttgtatctgctagatacataatgaagtgcgatgatgatacttttgttagacttgattcagtaatggctgaagtgaagaaaatccagaacggtataagtctctatatagggaacatgaattatcaccacaagccattgcgcgatgggaaatgggctgttacttatgaggaatggccagaagaggattatcccatctatgcaaatggtcctggatatgttatatcctctgacatcgcagattctattctatcagactttctaaaccataaattaaggcttttcaaaatggaggatgtgagcatgggcatgtgggttgagcggttcaacaacaccagatttgttaaatacgtccacagcgtcaaattttgtcaattcggatgcatagatgattattacactgcacattaccaatcaccgaggcagatgttgtgtttgtgggacaagctacaggctggaaaagcccaatgttgcaatatgagatag

SEQ ID NO: 9462 - protein, 656 aa, Sorghum bicolor
  misc_feature: Ceres ANNOT ID no. 6100469
  misc_feature (168)..(378): Pfam Id: Gal-bind_lectin Pfam Desc: Galactoside-binding lectin
  misc_feature (424)..(616): Pfam Id: Galactosyl_T Pfam Desc: Galactosyltransferase
  misc_feature (12)..(656): NCBI GI: 15241899 NCBI Desc: galactosyltransferase family protein [arabidopsis thaliana]
  misc_feature (12)..(656): NCBI GI: 19699371 NCBI Desc: at1g74800/f25a4_38 [arabidopsis thaliana]
  misc_feature (20)..(656): NCBI GI: 5882743 NCBI Desc: ests gbh36134 and gbh36132 come from this gene. [arabidopsis thaliana]
  misc_feature (7)..(656): NCBI GI: 34393273 NCBI Desc: galactosyltransferase family-like protein [oryza sativa (japonica cultivar-group)]
  misc_feature (10)..(451): NCBI GI: 115456021 NCBI Desc: os03g0803600 [oryza sativa (japonica cultivar-group)]
  misc_feature: Useful for making plants with altered carbohydrate content
  misc_feature: Functional homolog of the protein sequence given in SEQ ID NO 13850
  misc_feature: The sequence is a functional homolog of SEQ ID NO. 346 in the 11/188,298 US application
MRRSSGPGTPCRRRAIQVLVAVSLAYALAVLLLESPLVSTSLPGAGASAAASRKLHLDGAWEGVGRTAPARPGKHPHRETLSADAWWGRARRLAGIVSGLELRHLNSTRSGSLRKVAAEAAESGARVFSGLEALATTLASSRDSSGEEEKSKCPHSIVLSGDEFRERGRTVELPCGLTLGSYITVAATPHQAHPERDPKITMLREGEEPIMVSQFMMELQGLKTVDGEDPPRILHFNPRLRGDWSGKPVIEQNTCYRMQWGTPLRCEGWRSRADEETVDGLVKCEKWIRDDEGRSEESKTSWWLNRLIGRTKTVSVDWPYPFVEDRLFVLTLTAGLEGYHVNVDGRHVTSFPYRTGFVLEDATGLSLNGDLDVQSVFAGTLPTTHPSFSPQKHLEMLPSWQAPPLPDEPVEIFIGILSAGNHFAERMAARKTWMSAAQKSSNVVARFFVALHGRNEVNVELKKEAEFFGDIVIVPFMDSYDLVVLKTIAICEYGVHVVSARYIMKCDDDTFVRLDSVMAEVKKIQNGISLYIGNMNYHHKPLRDGKWAVTYEEWPEEDYPIYANGPGYVISSDIADSILSDFLNHKLRLFKMEDVSMGMWVERFNNTRFVKYVHSVKFCQFGCIDDYYTAHYQSPRQMLCLWDKLQAGKAQCCNMR

SEQ ID NO: 9463 - DNA, 1377 bp, Sorghum bicolor
  misc_feature: Ceres ANNOT ID no. 6100481
  misc_feature: Encodes the peptide sequence at SEQ ID NO 9464
atgggggcgctgtcgcggccggaggaggtgctggcgctggtgaagctgcgggtggcggcggggcagatcaagcgccagatcccgcccgaggagcactgggccttcggctactccatgctccagaaggtctcccgcagcttcgccctcgtcatccagcagctcccaccccaactccgcaatgccgtgtgcatcttctacctcgtgctccgtgccctcgacaccgttgaggatgacactagcatcccgacggaggtgaaggtgcccatcctccaggaattctaccggcacatctacaaccgcgactggcatttttcgtgtggaacaaatcactacagagtgctgatggataactttcaccacgtatccactgccttcctggagcttggtcaaggttaccaaaaggcaatagaagaaatcactaggcgaatgggagcaggaatggcaaaatttatatgcaaggaggtcgaaactgttgatgactatgacgagtattgtcactatgtggccgggctagttggttatggactttccagactcttttatgctactgggacggaagatcttgctccagattcactgtcaaattcaatgggtctatttttacagaaaactaatataatcagggactatttggaggacataaatgagataccaaggtcccgcatgttctggcctcgagagatatggagtaaatatgcagataaacttgaggatttcaaatatgaggaaaattctgaaaaggcggtacagtgcttgaatgatctggtgactaatgcattgattcatgctgaagagtgccttcaatacatgtcagctttgaagggtcatgccattttccgtttttgtgcaataccccagataatggcaattggaacatgtgctctttgctacaataatgtgcatgtcttcagaggagttgtcaagatgagacgtggtctcacggctcgaataattgatgagacaaactcaatggcagacgtctatacttctttctatgagttttcttcattgatagagtcaaagatagatgacaatgatccaaatgctgctctaacacggagacgtgtggattcaataaagcaaacttgcaagtcatctggtttggtaaagaggagggggtaccacttggacaagtcaccttataggcctatgctgatcatgattgtcctcctgctggtggctattcttttcggggtactgtataccaaatcctttttgtactctgtagtttccaaaggctgcgggaaatttggaagtgctgactgtagatcgatacggctgcatgatacggcttccgtgactccgttgctgatctcaattcgtttgttgattttgatttctcgtggggtgtatgtgtgttcaagctgttttaagtga

SEQ ID NO: 9464 - protein, 458 aa, Sorghum bicolor
  misc_feature: Ceres ANNOT ID no. 6100481
  misc_feature (40)..(327): Pfam Id: SQS_PSY Pfam Desc: Squalene/phytoene synthase
  misc_feature (1)..(401): NCBI GI: 2463567 NCBI Desc: squalene synthase [zea mays]
  misc_feature (1)..(406): NCBI GI: 41224629 NCBI Desc: squalene synthase [panax ginseng]
  misc_feature (1)..(400): NCBI GI: 75859951 NCBI Desc: squalene synthase [panax notoginseng]
  misc_feature (1)..(400): NCBI GI: 2463569 NCBI Desc: squalene synthase [glycine max]
  misc_feature (1)..(400): NCBI GI: 123718158 NCBI Desc: squalene synthase [panax quinquefolius]
  misc_feature (4)..(400): SWISSPROT Homolog: EC 2.5.1.21 Squalene synthetase
  misc_feature: Useful for making plants with altered sterol content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13435
  misc_feature: Useful for making plants with altered sterol content
  misc_feature: Functional homolog of the protein sequence given in SEQ ID NO 14049
MGALSRPEEVLALVKLRVAAGQIKRQIPPEEHWAFGYSMLQKVSRSFALVIQQLPPQLRNAVCIFYLVLRALDTVEDDTSIPTEVKVPILQEFYRHIYNRDWHFSCGTNHYRVLMDNFHHVSTAFLELGQGYQKAIEEITRRMGAGMAKFICKEVETVDDYDEYCHYVAGLVGYGLSRLFYATGTEDLAPDSLSNSMGLFLQKTNIIRDYLEDINEIPRSRMFWPREIWSKYADKLEDFKYEENSEKAVQCLNDLVTNALIHAEECLQYMSALKGHAIFRFCAIPQIMAIGTCALCYNNVHVFRGVVKMRRGLTARIIDETNSMADVYTSFYEFSSLIESKIDDNDPNAALTRRRVDSIKQTCKSSGLVKRRGYHLDKSPYRPMLIMIVLLLVAILFGVLYTKSFLYSVVSKGCGKFGSADCRSIRLHDTASVTPLLISIRLLILISRGVYVCSSCFK

SEQ ID NO: 9465 - DNA, 1377 bp, Sorghum bicolor; identical to SEQ ID NO: 9463
  misc_feature: Ceres ANNOT ID no. 6100484
  misc_feature: Encodes the peptide sequence at SEQ ID NO 9466

SEQ ID NO: 9466 - protein, 458 aa, Sorghum bicolor; identical to SEQ ID NO: 9464
  misc_feature: Ceres ANNOT ID no. 6100484
  misc_feature (40)..(327): Pfam Id: SQS_PSY Pfam Desc: Squalene/phytoene synthase
  misc_feature (1)..(401): NCBI GI: 2463567 NCBI Desc: squalene synthase [zea mays]
  misc_feature (1)..(406): NCBI GI: 41224629 NCBI Desc: squalene synthase [panax ginseng]
  misc_feature (1)..(400): NCBI GI: 75859951 NCBI Desc: squalene synthase [panax notoginseng]
  misc_feature (1)..(400): NCBI GI: 2463569 NCBI Desc: squalene synthase [glycine max]
  misc_feature (1)..(400): NCBI GI: 123718158 NCBI Desc: squalene synthase [panax quinquefolius]
  misc_feature (4)..(400): SWISSPROT Homolog: EC 2.5.1.21 Squalene synthetase
  misc_feature: Useful for making plants with altered sterol content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13435
  misc_feature: Useful for making plants with altered sterol content
  misc_feature: Functional homolog of the protein sequence given in SEQ ID NO 14049

SEQ ID NO: 9467 - DNA, 1908 bp, Sorghum bicolor
  misc_feature: Ceres ANNOT ID no. 6100485
  misc_feature: Encodes the peptide sequence at SEQ ID NO 9468
  misc_feature: Down-regulated in shoot tissues in response to aminocyclopropane carboxylic treatment
  misc_feature: Down-regulated in shoot tissues in response to salicylic acid treatment
atgcgatcttcatgggctgattcagttgcgaacgccgaggaatcggcgcccgcgactgtaactgctactgcccctgctgctaatcatcagaactcgcgccccaccctcagtgcatacgttcctccccaccttcgtggccgctcaggtggtcctctccctgagaacaaagcagcgcctgctgcagctcctgcaccagctgacgtaaggcctgctactgtgcagccttctggttacgcagctgttgttggtggcggctctcgctgggcaggccctgctgttggtggtagtggcggcggtggtggtagcgccatagttggtcctcgccagggtggtggcggtcgaggcggtggttggaactcccgacctgggtgggaccgtagagaccgtgaaccaaacccttttgccaatacagaggctgcagatgttgatttcgagagtcaggagaatacaggcatcaattttgacgcctatgaggatattcctgttgagacaagtggccatgacgtccctccgccagtcaatacctttgcagagattgatttgggtgatgcagtgaatgagaatatacgacggtgcaagtatgtgaagccaacaccggtacagcgacatgctattcctatcgccaatgcaggtcgggacctcatggcttgtgcacagacagggtctggaaagactgcagccttctgtttccctatcattagtgggatcttgaagtcaagggacttgaggccaccccagacccagaggcaaagagccagggctgcttgccctctggcattgatactatcccctactcgtgagctatctatgcaaattcatgaagaagcaaagaagttttcataccaaactggtgtgagggtggttgttgcatatggtggagcaccaatacatcagcagctgagggaactggaaaggggtgtcgaaatccttgtggcaactcctggtcgtttgatggacctgttggagagagccagagtgtcactgcaaacgataaagtatttaactcttgatgaagctgatcgaatgctcgatatgggctttgagccacagatccgcaagattgttgagcaaatggatatgccccctcgtggtgtgaggcagactatgctgtttagtgctacttttccaaaagaaatccagcggctggcttcagatttccttgctgattacatattccttgctgttggaagagttggttccagtacggatttgattgctcagagggttgagtttgttcttgaggcagacaaaagaagttaccttatggaccttcttcacgcacaaaaagccaacggcacccatggaaagcaatctcttactttggtatttgtggagacgaagagaggagctgatgctctggaggactggctgtttaaaaacgggttccctgcaacaagcattcacggtgaccgaacacaacaggaaagagagtacgcattgaggtccttcaagagtggagcaacacccatacttgttgcaactgatgtggctgctcgcggacttgacatacctcacgttgctcatgtcatcaattttgacctcccaaatgatatagatgactatgttcatcgtattgggaggacaggacgagcggggaaatctggtctagctactgcctttttcaacgagggcaacctatcactagcaaggccattatgtgatctaatgcatgaggctaaccaagaggtcccaacatggcttgagaactatgctgcccgttcttcatacggtggtggcggtggtagaaatcgccgatcaggtggtgctcgatttggtggccgtgacttccgccgtgaccgggacttcaggggaggcggcggcggaggaggatatagtggcggtggttatggtggtggtggtggatatggcggcagctacggtggaggtgcaactagttcctgggactag

SEQ ID NO: 9468 - protein, 635 aa, Sorghum bicolor
  misc_feature: Ceres ANNOT ID no. 6100485
  misc_feature (198)..(382): Pfam Id: DEAD Pfam Desc: DEAD/DEAH box helicase
  misc_feature (456)..(532): Pfam Id: Helicase_C Pfam Desc: Helicase conserved C-terminal domain
  misc_feature (51)..(635): NCBI GI: 92888082 NCBI Desc: helicase, c-terminal [medicago truncatula]
  misc_feature (39)..(635): NCBI GI: 6735368 NCBI Desc: atp-dependent rna helicase-like protein [arabidopsis thaliana]
  misc_feature (215)..(635): NCBI GI: 21387105 NCBI Desc: atp-dependent rna helicase-like protein [arabidopsis thaliana]
  misc_feature (41)..(629): NCBI GI: 134034090 NCBI Desc: atp-dependent rna helicase ded1
  misc_feature (59)..(633): NCBI GI: 121789113 NCBI Desc: atp-dependent rna helicase ded1
  misc_feature: Down-regulated in shoot tissues in response to aminocyclopropane carboxylic treatment
  misc_feature: Down-regulated in shoot tissues in response to salicylic acid treatment
MRSSWADSVANAEESAPATVTATAPAANHQNSRPTLSAYVPPHLRGRSGGPLPENKAAPAAAPAPADVRPATVQPSGYAAVVGGGSRWAGPAVGGSGGGGGSAIVGPRQGGGGRGGGWNSRPGWDRRDREPNPFANTEAADVDFESQENTGINFDAYEDIPVETSGHDVPPPVNTFAEIDLGDAVNENIRRCKYVKPTPVQRHAIPIANAGRDLMACAQTGSGKTAAFCFPIISGILKSRDLRPPQTQRQRARAACPLALILSPTRELSMQIHEEAKKFSYQTGVRVVVAYGGAPIHQQLRELERGVEILVATPGRLMDLLERARVSLQTIKYLTLDEADRMLDMGFEPQIRKIVEQMDMPPRGVRQTMLFSATFPKEIQRLASDFLADYIFLAVGRVGSSTDLIAQRVEFVLEADKRSYLMDLLHAQKANGTHGKQSLTLVFVETKRGADALEDWLFKNGFPATSIHGDRTQQEREYALRSFKSGATPILVATDVAARGLDIPHVAHVINFDLPNDIDDYVHRIGRTGRAGKSGLATAFFNEGNLSLARPLCDLMHEANQEVPTWLENYAARSSYGGGGGRNRRSGGARFGGRDFRRDRDFRGGGGGGGYSGGGYGGGGGYGGSYGGGATSSWD

SEQ ID NO: 9469 - DNA, 1254 bp, Sorghum bicolor
  misc_feature: Ceres ANNOT ID no. 6100488
  misc_feature: Encodes the peptide sequence at SEQ ID NO 9470
  misc_feature: Up-regulated in root tissues in response to salicylic acid treatment
atggaggctgcggcggtcgtgggtttgggtactggcgcgggcgcgggcctgaccaggtggcaggcggcggcgctggcagcggtggccgggtgggtgtgtgcggcctccttcttcgacctcacgcgccggacgcgcgcgctcgtccagccgtgggtcacgcgccgggtgcacgccgagacggcggccatcctcaggttacagaggttgttggagcacaagttgttggacaatttcttctctgtgctgtcatgcgttgtctccgtgcccttctacacgggattcctccctcttctcttctggagtggacacggcagactggctaggcagatgaccctcctcatggctttctgcgattacctcggcaactctctcaaggatatggtgtcagcccctcggccatgctctcctcctgttagaagagtgacagctacagaagatgagaaggaaaatgccatggaatatggcctgccatcatcgcatgctctcaacactgtttgtttgatgggatatctattacattatgtcctcacatatggagaacatggcagtgttatagttgctgcgggtttatctctagctttcttacttgttatgctagttggcattgcgaggatatatttgggtatgcacagcttgaccgatgttgttgctggaattggttttggaattgtcatccttgcattctggttggctgtcgatgaccatgttgatgccttcattgtctctgggaaaaatgttgcaaccttctgggcaggcctttctctattgatgtgctttgcgtatccaaagccagaattccctactcctagctttgattaccacacagcattcaatggagtcgctttcggaattgtgtacggcatccaacaaacctacttccactttcacacccctgacgcccccctcatctttagcgctcagctgccccttcccacattcgccgggcgcatcctcatcgggatcccaaccatcctgatcgtgaaattctgcagcaaagcgctctccaagtggctgctgcccgtgatgtgcagcaccctgggcatccccattgtgtcatcttgctacgtccctgccctgaaagtcgacagcagcggcaagaacaagcaggccgccgggtacctccagcggctgttctctcactttccccagaaggcctacgacgtggacacgggcatcaggttcgtccagtacgccggcctcgcatggtccgtggttgacttggtgccggccatattcagccatttgaatctgtag

SEQ ID NO: 9470 - protein, 417 aa, Sorghum bicolor
  misc_feature: Ceres ANNOT ID no. 6100488
  misc_feature (106)..(238): Pfam Id: PAP2 Pfam Desc: PAP2 superfamily
  misc_feature (106)..(417): NCBI GI: 145332885 NCBI Desc: phosphatidic acid phosphatase family protein / pap2 family protein [arabidopsis thaliana]
  misc_feature (56)..(299): NCBI GI: 119402836 NCBI Desc: sphingosine-1-phosphate phosphohydrolase [aspergillus clavatus nrrl 1]
  misc_feature (56)..(371): NCBI GI: 126274015 NCBI Desc: yeast sphingolipid resistance gene [pichia stipitis cbs 6054]
  misc_feature (56)..(287): NCBI GI: 119477540 NCBI Desc: sphingosine-1-phosphate phosphohydrolase [neosartorya fischeri nrrl 181]
  misc_feature (45)..(412): NCBI GI: 7708609 NCBI Desc: spac823.11 [schizosaccharomyces pombe]
  misc_feature: Up-regulated in root tissues in response to salicylic acid treatment
MEAAAVVGLGTGAGAGLTRWQAAALAAVAGWVCAASFFDLTRRTRALVQPWVTRRVHAETAAILRLQRLLEHKLLDNFFSVLSCVVSVPFYTGFLPLLFWSGHGRLARQMTLLMAFCDYLGNSLKDMVSAPRPCSPPVRRVTATEDEKENAMEYGLPSSHALNTVCLMGYLLHYVLTYGEHGSVIVAAGLSLAFLLVMLVGIARIYLGMHSLTDVVAGIGFGIVILAFWLAVDDHVDAFIVSGKNVATFWAGLSLLMCFAYPKPEFPTPSFDYHTAFNGVAFGIVYGIQQTYFHFHTPDAPLIFSAQLPLPTFAGRILIGIPTILIVKFCSKALSKWLLPVMCSTLGIPIVSSCYVPALKVDSSGKNKQAAGYLQRLFSHFPQKAYDVDTGIRFVQYAGLAWSVVDLVPAIFSHLNL

SEQ ID NO: 9471 - DNA, 2196 bp, Sorghum bicolor
  misc_feature: Ceres ANNOT ID no. 6100489
  misc_feature: Encodes the peptide sequence at SEQ ID NO 9472
atggcggcgagcgcgagggggagcgtgtgggagatccagccgcgcgacgtggaggcggcggggctcgccgcagccgacgcggccgcgttcgtcgccgcgctccgctccgccgcggccgccgcgggctcgggagccacgcgggacgccgtgtgggcggcggttgcggcggcgggggtgctgcggccggagcacccgcacgcgctccaccagctcgtctactactccacctacgctgggtgggaccgcgacgcccggggcccgccgccgtactggttcccgtctccaattgactgtaagcaaacaaacctggggagattgatggaagcaaatggaccaaagctgttaggatcatcatacaaggaccctatatcaagtcttagccacttttacaggttttccgtagagaaccaagaggtctactggtcaatggtgctaaagcaactagcagtcaattttaaacaagaaccaaggtcaattctgagtacatcagatagatcaaagaaaggggggacatggcttcaaggtgcagtgctcaatatagctgaatgttgtctgctgccttgtccttccctgaagaggacagatgacagtacagctatcatttggagggatgaaggccttgatgattatccagtgaaccgtatgtcactgaaggagcttcgcggtcaagtgataactgttgcacatgccttagatgccatgtttgagaagggggaccggattgcaatagacatgcctatgacatgcaatgcagtcataatatatttggcgatcatccttggtggctttgttgttgtatctatagcggatagttttgcacctcaggagattggtagtcgtatgggtgtctcaaaagcaaaagcaatttttacccaggatttcattgttagaggagggaagaaagttccactttacagtcgtgtcgtacaagggacttcgtctaaagctgttgtgattcctgcaattggagactctattggaattacgctaaggaatggtgatatgtcatggaaagattttctttctcgtgctgctggaaggtcatcttcttattctccagtttatcaatctgtggatgcactaactaatatactattttcttcaggaacaactggggagccaaaagcaataccgtggacacaactttctcccataagatgtgcatctgatacctgggcgcatttggatgttcgtccatgtgaaataggttgctggccaactaatctgggctgggttatgggaccaataatcatatactcatgctttctaaatggggcggctttggctttatatcatggatctccacttggacgcgatttctgcaagtttgtacaggatgctggtgtgactgtattaggaagtgtgcctagcttggtgaagtcatggaaagctgggaactgtgctgaagggcttgactggaccaaaatcagagtactaggcacaacaggggaggcttctgatattgatgacaatctgtggctaacttcgcgtgcctcatacaagcccattgttgagtgctgtgggggcacagagttggcatcctcatacattcaagggagtcttttgcgaccacaggtctttggagcttttagtggtgcatcaatgtccactgggtttgtcatacttgatgaacagggaactccgtatcctgatgatgtaccttgcactggagaagtgggtctcttccctttgtattttggtgctagtgatcgacttctcaatgctaatcatgacaaggtttactttgatggaatgcccatttataaaggaaggcaactcagacgacatggagatataatccagaggacagtaggtgggtactatattgtacagggaagggcggatgacaccatgaaccttggaggaattaagaccagttcagttgagatagagcgggtatgcaacagagctgacgagtgtctgctagaaacagcagcagttagcatcaagccttctggcgggggaccagaacatctagctatcttagcagtgctaaaagatagatcggcccagtatgacgtgaatcttctcaagaggaagtttcagacagccattcagaagaaccttaaccctctcttcaaggtgagctatgtcaaagtcgttcctgagttcccaagaacagcttcgaacaagctgctgagaagggttctgagggatcaactagcgcaggaactctcaaatcggagcaagctatga

SEQ ID NO: 9472 - protein, 731 aa, Sorghum bicolor
  misc_feature: Ceres ANNOT ID no. 6100489
  misc_feature (216)..(646): Pfam Id: AMP-binding Pfam Desc: AMP-binding enzyme
  misc_feature (8)..(731): NCBI GI: 29893268 NCBI Desc: acyl-activating enzyme 18 [arabidopsis thaliana]
  misc_feature (107)..(731): NCBI GI: 140066676 NCBI Desc: amp-dependent synthetase and ligase [medicago truncatula]
  misc_feature (8)..(731): NCBI GI: 42568023 NCBI Desc: acyl-activating enzyme 17 (aae17) [arabidopsis thaliana]
  misc_feature (71)..(731): NCBI GI: 29893266 NCBI Desc: acyl-activating enzyme 17 [arabidopsis thaliana]
  misc_feature (71)..(731): NCBI GI: 9759363 NCBI Desc: acetyl-coa synthetase-like protein [arabidopsis thaliana]
MAASARGSVWEIQPRDVEAAGLAAADAAAFVAALRSAAAAAGSGATRDAVWAAVAAAGVLRPEHPHALHQLVYYSTYAGWDRDARGPPPYWFPSPIDCKQTNLGRLMEANGPKLLGSSYKDPISSLSHFYRFSVENQEVYWSMVLKQLAVNFKQEPRSILSTSDRSKKGGTWLQGAVLNIAECCLLPCPSLKRTDDSTAIIWRDEGLDDYPVNRMSLKELRGQVITVAHALDAMFEKGDRIAIDMPMTCNAVIIYLAIILGGFVVVSIADSFAPQEIGSRMGVSKAKAIFTQDFIVRGGKKVPLYSRVVQGTSSKAVVIPAIGDSIGITLRNGDMSWKDFLSRAAGRSSSYSPVYQSVDALTNILFSSGTTGEPKAIPWTQLSPIRCASDTWAHLDVRPCEIGCWPTNLGWVMGPIIIYSCFLNGAALALYHGSPLGRDFCKFVQDAGVTVLGSVPSLVKSWKAGNCAEGLDWTKIRVLGTTGEASDIDDNLWLTSRASYKPIVECCGGTELASSYIQGSLLRPQVFGAFSGASMSTGFVILDEQGTPYPDDVPCTGEVGLFPLYFGASDRLLNANHDKVYFDGMPIYKGRQLRRHGDIIQRTVGGYYIVQGRADDTMNLGGIKTSSVEIERVCNRADECLLETAAVSIKPSGGGPEHLAILAVLKDRSAQYDVNLLKRKFQTAIQKNLNPLFKVSYVKVVPEFPRTASNKLLRRVLRDQLAQELSNRSKL

SEQ ID NO: 9473 - DNA, 1167 bp, Sorghum bicolor
  misc_feature: Ceres ANNOT ID no. 6100494
  misc_feature: Encodes the peptide sequence at SEQ ID NO 9474
atggagcagcagcaggtgagggggaggaggaggagaaacggcgtgctgcaggtgcaggacggctcggagatccgttctctcgtggagaacaaggaggcgttcactaggttcgtcgacgaccgattccagaagctcgacgccgatggcgacgggaggctgtcggtgagagagctccagccggccgttgctgacatcggtgccgccatagggctgccggcgagagggtcgtcgccgcaggcggaccacatctacgcggaggtcctaaacgagttcactcaggggaagcaagactcggtgagcaagccggagttccagcgggtgctgtccgacatactccttgggatggcggctgggctgaagagggacccgattgtgatcctgaggataaacggggaggacctgaatgagttcgtcgagagtccgaggtatgagcctgaagccatggccatattttcacaagtgggagtgggagtgggagtggggtctgacaacaacgcaacgccaaagctgcgccagtgcttgttggccgctcttggacagctcacggtcgaccatggcatgccaccagcttctgattcctgggtcatggagaatgttgtggagcctgcgttgcaagagctgtctgctaatcagctcgatcagcctgtttcccaggaagtcttcttccaagaattcaggaaatttctgggcatcatggctctaagactgcaacagcaccctgtgatcgtcgcccatacagagaacacctttgacgggagtggtatcaggaggctactgtcgaacaagttcgaattagacaagctgctggattctgtatggagagacgttccgaaagaacacaaagataaaacgtcgaaggagtacctccggattgcgcttgataggattgccgattcagcgagtctgccaccttttggagccgtcgatcaggttgatgctgtggtgaacgaagcattcaagatggcgaaagctgacgaaatgaaggcggtggacgaagcagagttcaagaagctgctgacggagattcttggggccatcatgctgcagttggacggcaacccgatcggtgtctcaaccaacaccgtcgtccatgagcccatgtccacctcctccgcgctgttgtcaccgacgccgctgtctccaatggtgtcctcaccaagtgaataa

SEQ ID NO: 9474 - protein, 388 aa, Sorghum bicolor
  misc_feature: Ceres ANNOT ID no. 6100494
  misc_feature (37)..(65): Pfam Id: efhand Pfam Desc: EF hand
  misc_feature (20)..(382): NCBI GI: 3550661 NCBI Desc: 39 kda ef-hand containing protein [solanum tuberosum]
  misc_feature (115)..(377): NCBI GI: 22136428 NCBI Desc: ef-hand containing protein-like [arabidopsis thaliana]
  misc_feature (2)..(149): NCBI GI: 115453495 NCBI Desc: os03g0411300 [oryza sativa (japonica cultivar-group)]
  misc_feature (82)..(360): NCBI GI: 15241944 NCBI Desc: calcium-binding ef hand family protein [arabidopsis thaliana]
  misc_feature (18)..(127): NCBI GI: 140046306 NCBI Desc: calcium-binding ef-hand [medicago truncatula]
MEQQQVRGRRRRNGVLQVQDGSEIRSLVENKEAFTRFVDDRFQKLDADGDGRLSVRELQPAVADIGAAIGLPARGSSPQADHIYAEVLNEFTQGKQDSVSKPEFQRVLSDILLGMAAGLKRDPIVILRINGEDLNEFVESPRYEPEAMAIFSQVGVGVGVGSDNNATPKLRQCLLAALGQLTVDHGMPPASDSWVMENVVEPALQELSANQLDQPVSQEVFFQEFRKFLGIMALRLQQHPVIVAHTENTFDGSGIRRLLSNKFELDKLLDSVWRDVPKEHKDKTSKEYLRIALDRIADSASLPPFGAVDQVDAVVNEAFKMAKADEMKAVDEAEFKKLLTEILGAIMLQLDGNPIGVSTNTVVHEPMSTSSALLSPTPLSPMVSSPSE

SEQ ID NO: 9475 - DNA, 1563 bp, Sorghum bicolor
  misc_feature: Ceres ANNOT ID no. 6100498
  misc_feature: Encodes the peptide sequence at SEQ ID NO 9476
atggaactcctctccctccacttcctgcacccgcgaaccgggcgcccttcacttcccctcgccgccgcagcgccatcaaacaccaggcggccgcagagccgcacgtacctgctggcgccaccacgacgcacgcgcggcgcgccccggctgtcggtgtccgccgtggcggccgagaagccccgagccgaggaagcgccgccgtccccgtccaagacggaggcattcgattggctagaccagtggtacccgatcgcccctgtatgcgacctcgacccgcgggcgccgcacggcaaggtggtgctgggactcagcgtcgtcgcctggtacgaccgcggcgccggcgagtggcgcgtgttcgaggacgcctgcccgcaccgcctcgcgccgctgtcgcagggccgcatcgacggcaagggacggctccagtgcgcgtaccacggatggtgcttcgacggcgccggcgcgtgcgcgttcatcccgcaggcgcccgccctcggcccgccggtgcacgagaaccgcagggcgtgcgtggcgtcgtacccctgcgtggtgcagaacaacatcctgtggttctacccgaggacggaggccgagcacagggacgtgctgcggcggaagcggccgccgtacttcgccgagatcgacgacccgtcctacttcaccacgttcggcatgagggatgtctccgtggggtatgatgtggcggtagacaacatcttcgacattgcgcatgtcccgtacgcgcacaaggggctgctaccctactttcttgagcatgaccaagagtgcggtgagccgatcaagatggagatagagcatgctgatgtgcatgggttcctgtccaagatgaaaggaggcagcatccggtttgtggcgccatgcacgttccacggcacacctgctagtaccaaagtggctgccggtggcgaggcggcagtttggttcatgctggttgccctcatcatccctgttgctccagggaggagcagggtgatctgggcgttcccgaggaacgccggggtttggctccacaagctcataccacggtggttcttccacagcgtcacaaatcgggttatcgattcagatgtttgcctcatgcatgttgaggagcgcaaatttgccgcggcgggactggaaaactggcacagatcttgctacgtgccgacatcttcagacggcatggtggtcgccttcagggactggttcaggaaacactgcaaccatcaggttggctggggagccccacagcccgaccaccagctgccaccaagctctaccaaggatcatctcctggagaggtactggtcgcacgtcgcgcagtgcacgagctgcagcgcggcgctgaggagcatgaggctgctcgaggtcgcgctgcaggtcatgtcggtctccgtcatcggatccctcgccgtcgccaaagggtcgtcgttgctcacgtcggttgttcagagagccgtagttgtgactgcagccgtgttgtgcttcatggcgtctcggtggcttgctacttacatcgagaagaacttctattttcaggatttcattcactcttacaactga

SEQ ID NO: 9476 - protein, 520 aa, Sorghum bicolor
  misc_feature: Ceres ANNOT ID no. 6100498
  misc_feature (290)..(384): Pfam Id: PaO Pfam Desc: Pheophorbide a oxygenase
  misc_feature (80)..(187): Pfam Id: Rieske Pfam Desc: Rieske [2Fe-2S] domain
  misc_feature (1)..(303): NCBI GI: 115456059 NCBI Desc: os03g0805600 [oryza sativa (japonica cultivar-group)]
  misc_feature (49)..(244): NCBI GI: 115456063 NCBI Desc: os03g0805800 [oryza sativa (japonica cultivar-group)]
  misc_feature (1)..(519): NCBI GI: 92869808 NCBI Desc: rieske [2fe-2s] region [medicago truncatula]
  misc_feature (63)..(517): NCBI GI: 140063774 NCBI Desc: rieske [2fe-2s] region [medicago truncatula]
  misc_feature (63)..(373): NCBI GI: 140063771 NCBI Desc: rieske [2fe-2s] region [medicago truncatula]
MELLSLHFLHPRTGRPSLPLAAAAPSNTRRPQSRTYLLAPPRRTRGAPRLSVSAVAAEKPRAEEAPPSPSKTEAFDWLDQWYPIAPVCDLDPRAPHGKVVLGLSVVAWYDRGAGEWRVFEDACPHRLAPLSQGRIDGKGRLQCAYHGWCFDGAGACAFIPQAPALGPPVHENRRACVASYPCVVQNNILWFYPRTEAEHRDVLRRKRPPYFAEIDDPSYFTTFGMRDVSVGYDVAVDNIFDIAHVPYAHKGLLPYFLEHDQECGEPIKMEIEHADVHGFLSKMKGGSIRFVAPCTFHGTPASTKVAAGGEAAVWFMLVALIIPVAPGRSRVIWAFPRNAGVWLHKLIPRWFFHSVTNRVIDSDVCLMHVEERKFAAAGLENWHRSCYVPTSSDGMVVAFRDWFRKHCNHQVGWGAPQPDHQLPPSSTKDHLLERYWSHVAQCTSCSAALRSMRLLEVALQVMSVSVIGSLAVAKGSSLLTSVVQRAVVVTAAVLCFMASRWLATYIEKNFYFQDFIHSYN

SEQ ID NO: 9477 - DNA, 1578 bp, Sorghum bicolor
  misc_feature: Ceres ANNOT ID no. 6100500
  misc_feature: Encodes the peptide sequence at SEQ ID NO 9478
atggaccccctctcccttctgcagatccctcgcgcatcgcgcccaccgctccccctgtccgcggccgccgcgccattgagctgcaggaggctaaacgtaagcggcggcgcgcgccccgtgccgaggcggctgcaacgccgcgccgcgcggctgtcggtgtccgccgtggcgaccgatacgccgcggaccgaggaggagcagccgtcgccgtcgccgtcgccgtcgccgtcagggaaggagcagttcgactggctggaccagtggtacccattcgcccccgtgtgcgacctcgacccgcgcgcgcctcacggcaagacggtgctggggctcagcgtcgtggcctggtacgaccgcggcgccggcgagtggcgcgtcttcgatgacgcctgcccgcaccgcctcgcgccgctctccgagggccggatcgacgacaagggccgcctccagtgcgtctaccatggctggtgcttcgacggcgccggcgcctgcaagttcatcccccaggcacccgccctcggcccgccggtgcacacgagccccaaggcgtgcgtggcgtcgtacccctgcgtcgtgcagaacaacatcctgtggttctacccgagggccgaccccgagtacaaggacgtgctgcagaggaagcggccgccgttcatccctgaaatcgacgacccggagttcgtcaccgtctatggcatcagagacctcccttacgggtatgatattttgattgagaaccttttggatcctgctcatgtcccgtatgcgcacaaggggatcattcgcggcatccttgagtatgatagagagggtggcggtccatcgaagatgaagatcgagcaggcaaacatacaagggtttgtgtcgccgcaggagcggggctacttccagttcgtcgctccctgcacgtcgttcgccgcaccgtttccacaaccacaagaggacaagaagaagaaggtgcctcgggtcatgctggtattcttatgcattccggtcagtcctggcaggagcagggtgatctgggcgttcccgaggaacattggggtatggctccaccacatcacaccacggtggctgtaccacgtcgggcagaatcttgtattggattcagacattttcctcctccatgttgaggagcgtaaatttgccacggtagggcttgataactggcagaaagcttgctatgtgcccacatcgtcagacagcatggtggtcgccttcaggaactggttcaaaaaattctccaagaatcagatcggctgggcaaccccacaaatcgatcagctgccaccaacacctaccaaggatcagctcatggagaggtactggtcacacgtggcgcagtgcacgagctgcaacgcggcgctgaaggccatgaaggcgcttgaggttgtcctgcaggttgcctcggtcgccgtcgtcgggtttctcgccgtcgccaaggaaaccctggtcacgtcgactgttcagagggccgcggtcgtgtcggctgccgtgctatgcttcgctgcgtcccgatggcttgccaacttcatccagaagaacttctacttccaagattacatccacgcctacaagtga

SEQ ID NO: 9478 - protein, 525 aa, Sorghum bicolor
  misc_feature: Ceres ANNOT ID no. 6100500
  misc_feature (297)..(391): Pfam Id: PaO Pfam Desc: Pheophorbide a oxygenase
  misc_feature (87)..(194): Pfam Id: Rieske Pfam Desc: Rieske [2Fe-2S] domain
  misc_feature (1)..(313): NCBI GI: 115456059 NCBI Desc: os03g0805600 [oryza sativa (japonica cultivar-group)]
  misc_feature (332)..(525): NCBI GI: 115456063 NCBI Desc: os03g0805800 [oryza sativa (japonica cultivar-group)]
  misc_feature (4)..(525): NCBI GI: 92869808 NCBI Desc: rieske [2fe-2s] region [medicago truncatula]
  misc_feature (44)..(522): NCBI GI: 140063774 NCBI Desc: rieske [2fe-2s] region [medicago truncatula]
  misc_feature (44)..(380): NCBI GI: 140063771 NCBI Desc: rieske [2fe-2s] region [medicago truncatula]
MDPLSLLQIPRASRPPLPLSAAAAPLSCRRLNVSGGARPVPRRLQRRAARLSVSAVATDTPRTEEEQPSPSPSPSPSGKEQFDWLDQWYPFAPVCDLDPRAPHGKTVLGLSVVAWYDRGAGEWRVFDDACPHRLAPLSEGRIDDKGRLQCVYHGWCFDGAGACKFIPQAPALGPPVHTSPKACVASYPCVVQNNILWFYPRADPEYKDVLQRKRPPFIPEIDDPEFVTVYGIRDLPYGYDILIENLLDPAHVPYAHKGIIRGILEYDREGGGPSKMKIEQANIQGFVSPQERGYFQFVAPCTSFAAPFPQPQEDKKKKVPRVMLVFLCIPVSPGRSRVIWAFPRNIGVWLHHITPRWLYHVGQNLVLDSDIFLLHVEERKFATVGLDNWQKACYVPTSSDSMVVAFRNWFKKFSKNQIGWATPQIDQLPPTPTKDQLMERYWSHVAQCTSCNAALKAMKALEVVLQVASVAVVGFLAVAKETLVTSTVQRAAVVSAAVLCFAASRWLANFIQKNFYFQDYIHAYK

SEQ ID NO: 9479 - DNA, 741 bp, Sorghum bicolor
  misc_feature: Ceres ANNOT ID no. 6100501
  misc_feature: Encodes the peptide sequence at SEQ ID NO 9480
atgcagatcctccggcggaaggttcttgaggcttcccgccgcctccctctcttctacgctgcgcacagcggacgcgcccatgcggtcgctacgctggcgggcgccgccgcgcggtgggccccgccggccacctcgggctcacttgccgctgctccgtgggctgccacccagcgccgcggcgtcaagatgctcggctccgacgtgaaacttggaaatatcatacaaagaagaggtcgcatttatcaggtaataaaagcacaacattcgcatcaaggaagaggaggagccacaatacaggtcgaactgagggatgttgacactggaaacaaattaacagaaagatttcgtactgatgaggcccttgagagagtttttgttgaggagaagtcattcacatatctgtatcaggaaggagatactgtgacacttatggagcctgaaacatttgagcaacttgaagtttcgaaggaactgtttggcaaagctgcagcatacctgaaagatgaaatgaaggtgaatctacaatactttgatggccggccaatgtctggtacagttcctcaacgagtgacttgtactgttgttgaagcacagccaaatacaaaagggctaactgctcaacctcagtataaaagggtcttgctggacaatggtctttcagtgcttgcaccaccctttattgaagcgggtgagaagattgtaatcagtacagccgatgattcttatatgacgagggcataa

SEQ ID NO: 9480 - protein, 246 aa, Sorghum bicolor
  misc_feature: Ceres ANNOT ID no. 6100501
  misc_feature (190)..(245): Pfam Id: Elong-fact-P_C Pfam Desc: Elongation factor P, C-terminal
  misc_feature (128)..(182): Pfam Id: EFP Pfam Desc: Elongation factor P (EF-P) OB domain
  misc_feature (64)..(121): Pfam Id: EFP_N Pfam Desc: Elongation factor P (EF-P) KOW-like domain
  misc_feature (43)..(246): NCBI GI: 92888068 NCBI Desc: elongation factor p/yeip [medicago truncatula]
  misc_feature (61)..(246): NCBI GI: 85541069 NCBI Desc: elongation factor p (ef-p)
  misc_feature (61)..(246): NCBI GI: 58038711 NCBI Desc: protein translation elongation factor p (ef-p) [gluconobacter oxydans 621h]
  misc_feature (61)..(246): NCBI GI: 144898371 NCBI Desc: translation elongation factor p [magnetospirillum gryphiswaldense msr-1]
  misc_feature (61)..(246): NCBI GI: 114327749 NCBI Desc: protein translation elongation factor p [granulobacter bethesdensis cgdnih1]
MQILRRKVLEASRRLPLFYAAHSGRAHAVATLAGAAARWAPPATSGSLAAAPWAATQRRGVKMLGSDVKLGNIIQRRGRIYQVIKAQHSHQGRGGATIQVELRDVDTGNKLTERFRTDEALERVFVEEKSFTYLYQEGDTVTLMEPETFEQLEVSKELFGKAAAYLKDEMKVNLQYFDGRPMSGTVPQRVTCTVVEAQPNTKGLTAQPQYKRVLLDNGLSVLAPPFIEAGEKIVISTADDSYMTRA

SEQ ID NO: 9481 - DNA, 897 bp, Sorghum bicolor
  misc_feature: Ceres ANNOT ID no. 6100502
  misc_feature: Encodes the peptide sequence at SEQ ID NO 9482
  misc_feature: Up-regulated in shoot tissues in response to methyl jasmonate treatment
  misc_feature: Up-regulated in root tissues in response to methyl jasmonate treatment
atgcgctgcgccgccgccgcgcttgcggtcgccctcatcgctgccgtcgccggcgcagccgccgcggggtcgccggccgcgggcacgtgcgcgcggaggggcgcgccgccgttcctcgacgccgtcggatcccgctgccccttcgtccggatcgagccgtccccgcctctcgaggtgagaggagaggctgttgatactgagttgaaccttcgaaggaggggtgcttcatacttcattctcttttatgctgcatggtgtccattttcgagcaaattccaaccaacatttgaagctcttagcacgatgtaccctcagatacatcactttgctgttgaagaatcttctgctacaccaagtttgttttcaagatatggagtccgtggtttcccagccattctttttgtaaatgagactacgatggttcgatatcggggttcaaaagatcttaactctctggtcaatttctataaagagactacaggtctcgatccaattgcatatattgatgttgtccaccaagagagcacaggaagcttgagctcagttatgccatgggatcgttctctgcgtgaatttgccaaagatgagccatatttgttagctgcagttctttttatcatcctgaaggttgcagcgcacttcatacctgttgtcatgtctcatctgagagctttcttagttgtccgtgtccaaaacttgaacctagggatccgtaggggatcaaaccagctcttggaacgagcattgaatgttcttgatatgaggaggctttggagcaagctgagactgagcaacaaggcaacggacttgaggaagggagcaagtaatgcacgagcttgggcttcctcatttgcttctgtttcactgggtgaaccatcatcttcgagacaagcgtag

SEQ ID NO: 9482 - protein, 298 aa, Sorghum bicolor
  misc_feature: Ceres ANNOT ID no. 6100502
  misc_feature (1)..(298): NCBI GI: 58014114 NCBI Desc: adenosine 5'-phosphosulfate reductase 8 [zea mays]
  misc_feature (1)..(298): NCBI GI: 58014116 NCBI Desc: adenosine 5'-phosphosulfate reductase 9 [zea mays]
  misc_feature (6)..(296): NCBI GI: 92881790 NCBI Desc: thioredoxin domain 2; thioredoxin fold [medicago truncatula]
  misc_feature (8)..(298): NCBI GI: 21536613 NCBI Desc: contains similarity to protein disulfide isomerase-related protein [arabidopsis thaliana]
  misc_feature (34)..(298): NCBI GI: 58014110 NCBI Desc: adenosine 5'-phosphosulfate reductase 6 [zea mays]
  misc_feature: Up-regulated in shoot tissues in response to methyl jasmonate treatment
  misc_feature: Up-regulated in root tissues in response to methyl jasmonate treatment
MRCAAAALAVALIAAVAGAAAAGSPAAGTCARRGAPPFLDAVGSRCPFVRIEPSPPLEVRGEAVDTELNLRRRGASYFILFYAAWCPFSSKFQPTFEALSTMYPQIHHFAVEESSATPSLFSRYGVRGFPAILFVNETTMVRYRGSKDLNSLVNFYKETTGLDPIAYIDVVHQESTGSLSSVMPWDRSLREFAKDEPYLLAAVLFIILKVAAHFIPVVMSHLRAFLVVRVQNLNLGIRRGSNQLLERALNVLDMRRLWSKLRLSNKATDLRKGASNARAWASSFASVSLGEPSSSRQA

SEQ ID NO: 9483 - DNA, 1455 bp, Sorghum bicolor
  misc_feature: Ceres ANNOT ID no. 6100509
  misc_feature: Encodes the peptide sequence at SEQ ID NO 9484
atggcaaacatacgtgcacttctggtcggcttgtcgcgggcaaggggttccttagcagaggtgggcagatgtgcgtccacgaggccatcacttctagcatctctgggcgcacattacaagatccccatgccagcccactggttctcatctgcagggcttcctccacatctggtggttggaatgccagcactatcccctactatgaatcaaggtaacatcgcgaaatggagaaaacaggaaggagacaagatagaggttggtgatgtgatatgtgagatagaaactgataaagccactcttgagtttgaaagccttgaagaggggtatctggccaagattttagcacctgaaggttctaaagatgttcaggttggacaacccattgctgtcacggttgaagacctcgaggatattaaaagtataccagccgatacatcttttggaggtgaacaaaaggaggagcattcaacagaaagtgtgccacaaaataaagtagttaatgtgcctgaacaaacctcaacagtgagccggatcagcccagcagctaagttactgatcaaggaacatggactggatacgtcatccctgagagcaacaggcccccgtggcacccttctgaaaggggatgttctggcggcattgaagtcaggtgtcagttcaagttcaatcaaagaaaagaaagctccagctcaaccttcatctcagccaactcgagattcccaagctcaagcatcccctgtttcacaaaaggctgatacatatgaagatattccaaatagtcagatacgcaaggtcattgcaaaaaggttgctcgaatcaaaacagacgactccacatttgtatctatccaaagatgttgtgctggatcccttgcttgctttcaggaatgaactaaaagagcaacatggcattaaagtttcagtaaatgatatcatcataaaggctgtggcaattgccttgcggaacgtccctgaagcaaatgcttactggaacaatgagaaggaagaaacccaaaagtgtgattcagttgatatatctattgccgttgctacagagaagggcctgatgaccccaatagtaagaaatgcggatcaaaagactatatctgcaatatcctcagaggttaagcagctggctgaaaaggcaagagctgggaagcttgcacctaacgaatttcaagggggaactttcagtatctcgaatcttggaatgtaccctgtggaccatttctgtgcaatcattaaccctccacagtctggcattctcgcagtcggtagaggaaacaaggttgttgaacctgttgtggacagcgatggaacagagaaggctgctgcggttacaaagatgagcttgacactatctgctgaccatcgtgtttttgatgggcaagtaggaggcaagtttttcacggagctggcgctgaatttcagtgacattaggagactgctattgtaa

SEQ ID NO: 9484 - protein, 484 aa, Sorghum bicolor
  misc_feature: Ceres ANNOT ID no. 6100509
  misc_feature (251)..(484): Pfam Id: 2-oxoacid_dh Pfam Desc: 2-oxoacid dehydrogenases acyltransferase (catalytic domain)
  misc_feature (57)..(131): Pfam Id: Biotin_lipoyl Pfam Desc: Biotin-requiring enzyme
  misc_feature (176)..(212): Pfam Id: E3_binding Pfam Desc: e3 binding domain
  misc_feature (50)..(484): NCBI GI: 110737396 NCBI Desc: dihydrolipoamide s-acetyltransferase precursor [arabidopsis thaliana]
  misc_feature (50)..(484): NCBI GI: 559395 NCBI Desc: dihydrolipoamide acetyltransferase (e2) subunit of pdc [arabidopsis thaliana]
  misc_feature (50)..(484): NCBI GI: 5881965 NCBI Desc: dihydrolipoamide s-acetyltransferase [arabidopsis thaliana]
  misc_feature (61)..(484): NCBI GI: 83593214 NCBI Desc: dihydrolipoamide acetyltransferase, long form [rhodospirillum rubrum atcc 11170]
  misc_feature (61)..(468): NCBI GI: 88940283 NCBI Desc: dihydrolipoamide acetyltransferase, long form [acidiphilium cryptum jf-5]
  misc_feature (50)..(484): SWISSPROT Homolog: EC 2.3.1.12 Dihydrolipoyllysine-residue acetyltransferase component 1 of pyruvatedehydrogenase complex, mitochondrial precursor
MANIRALLVGLSRARGSLAEVGRCASTRPSLLASLGAHYKIPMPAHWFSSAGLPPHLVVGMPALSPTMNQGNIAKWRKQEGDKIEVGDVICEIETDKATLEFESLEEGYLAKILAPEGSKDVQVGQPIAVTVEDLEDIKSIPADTSFGGEQKEEHSTESVPQNKVVNVPEQTSTVSRISPAAKLLIKEHGLDTSSLRATGPRGTLLKGDVLAALKSGVSSSSIKEKKAPAQPSSQPTRDSQAQASPVSQKADTYEDIPNSQIRKVIAKRLLESKQTTPHLYLSKDVVLDPLLAFRNELKEQHGIKVSVNDIIIKAVAIALRNVPEANAYWNNEKEETQKCDSVDISIAVATEKGLMTPIVRNADQKTISAISSEVKQLAEKARAGKLAPNEFQGGTFSISNLGMYPVDHFCAIINPPQSGILAVGRGNKVVEPVVDSDGTEKAAAVTKMSLTLSADHRVFDGQVGGKFFTELALNFSDIRRLLL

SEQ ID NO: 9485 - DNA, 978 bp, Sorghum bicolor
  misc_feature: Ceres ANNOT ID no. 6100512
  misc_feature: Encodes the peptide sequence at SEQ ID NO 9486
atggaagaaaccctagccgtcgaatccgccgccggcgagacggcggccgcgcaggcgcctgagcggaaggaagagacgctcgaggaggtgctctcgaggcacaggaaagagaaatcaaaactccaggataaggaaacaagcctcaagaaagctgctgcaaaaggaagcaaagctgagcagaaggcaaagaaaaagcaggtagaggaagagattacacgcctctcaagagagttagaggcgaatcatgctgcagagcttgcttcctttgggtacaaaccctctggcagctcagagaagggaaaccttgacaacttagtgaaggccatagctggtgtttcagtttccagcaattcggattctgcaaagcccagcaagggaacacgacggcgagagaagaaggcgaaggaggaagctgctcgagagcagcggatccaagaagaacaaagcaatctcgtgagcgaccgcatgttagaaaacgagaagcttgaaaggaagcttgagcccttggggctgaccattcaagagataaagccggacggtcactgcctgtaccgtgctgtcgaaaaccagctattgctccattccaatggtgctgcacagtacagttaccaggacctacggcaaatggcagccaagtacatgagggagcatgctgctgatttcctcccattttacttagcagaaggcaaggccgatattggaccagatcccatggagagcttcgagaggtactgtgaggagatggaatccactgcagcttggggtgggcagctcgaacttggtgcactgacccactgcctgaagaaacatatcgtggtctactcaggctccttcccggatgtggagatgggcaaagaatacaaatctggatctggaggtagtgatgccggtgatgcaagcatcaggctgtcgtttcacaggcatgcctatggtctaggcgagcactacaactcggtgattccagccgaatcatcttaa

SEQ ID NO: 9486 - protein, 325 aa, Sorghum bicolor
  misc_feature: Ceres ANNOT ID no. 6100512
  misc_feature (177)..(316): Pfam Id: OTU Pfam Desc: OTU-like cysteine protease
  misc_feature (1)..(322): NCBI GI: 90399337 NCBI Desc: h0313f03.22 [oryza sativa (indica cultivar-group)]
  misc_feature (1)..(322): NCBI GI: 5679842 NCBI Desc: l1332.6 [oryza sativa (indica cultivar-group)]
  misc_feature (1)..(321): NCBI GI: 89953403 NCBI Desc: fgenesh protein 81 [beta vulgaris]
  misc_feature (19)..(325): NCBI GI: 82183961 NCBI Desc: otu domain-containing protein 6b
  misc_feature (16)..(319): NCBI GI: 4929625 NCBI Desc: cgi-77 protein [homo sapiens]
MEETLAVESAAGETAAAQAPERKEETLEEVLSRHRKEKSKLQDKETSLKKAAAKGSKAEQKAKKKQVEEEITRLSRELEANHAAELASFGYKPSGSSEKGNLDNLVKAIAGVSVSSNSDSAKPSKGTRRREKKAKEEAAREQRIQEEQSNLVSDRMLENEKLERKLEPLGLTIQEIKPDGHCLYRAVENQLLLHSNGAAQYSYQDLRQMAAKYMREHAADFLPFYLAEGKADIGPDPMESFERYCEEMESTAAWGGQLELGALTHCLKKHIVVYSGSFPDVEMGKEYKSGSGGSDAGDASIRLSFHRHAYGLGEHYNSVIPAESS

SEQ ID NO: 9487 - DNA, 1020 bp, Sorghum bicolor
  misc_feature: Ceres ANNOT ID no. 6100519
  misc_feature: Encodes the peptide sequence at SEQ ID NO 9488
atgtcaggggctttagatcttgctcggagcatgggagggtcgattgacaaggaccaagtcaaatcggccattgatcagtacttgaagtaccacgacctacacggaggtgaacaagaatcgaggaaatcaaattacactgatttggtgaataagtactatgatcttgccactggcttctacgaatatggatggggcgactcattccattttgctggcagatatccaggtgagactttccgtgaagccatcaagcggcatgagcattttattgcactacaattggggctcaagaaggggatgaaggttctggatgtgggatgtggaattgggggacctttaatagaaattgccagattcagctcagcaatgataactggattgaactacaacgactaccagatctcaaggggaaaggagctcgttttttcggctggcttgaatgagcaatgctccttcttgaagggggatttcatgaacatgccgatagctgataacacctttgatgcggcctttgcaatagatgctacgtgtcacgcaccagatgcacaaggcgtctacagtgagatctaccgtgtgctgaaacctggacagtattttgcacttaatgaatggtgcttgaccgaccgatttgatccaaacaacgctaagcatctggccatcaaggctgagattgagctcggcgatggcctgccaccactcgccagatttgaggtcatttgtgcaaaggatcttgctcaagattttccttgcccgtggtaccagacgatagatcccaacaatttttcatggactagcttccaatgcacacgaccaggacggatcatcacccgtgcaattgtcaatgcattggagttcctccgtattgccccagcaggcagcgcgggaatctacagcttcttgacgagtgcctctgatggccttctaaagggtggccgggaaggaatcttcacagccagcttcttcgtcctgggccgcaagcctctcaaggaaactggattagcgaacgacggcaatctttga

SEQ ID NO: 9488 - protein, 339 aa, Sorghum bicolor
  misc_feature: Ceres ANNOT ID no. 6100519
  misc_feature (210)..(327): Pfam Id: Sterol_MT_C Pfam Desc: Sterol methyltransferase C-terminal
  misc_feature (103)..(201): Pfam Id: Methyltransf_11 Pfam Desc: Methyltransferase domain
  misc_feature (103)..(199): Pfam Id: Methyltransf_12 Pfam Desc: Methyltransferase domain
  misc_feature (39)..(303): Pfam Id: CMAS Pfam Desc: Cyclopropane-fatty-acyl-phospholipid synthase
  misc_feature (2)..(330): NCBI GI: 1899060 NCBI Desc: endosperm c-24 sterol methyltransferase [zea mays]
  misc_feature (2)..(330): NCBI GI: 2909846 NCBI Desc: (s)-adenosyl-l-methionine:delta 24-sterol methyltransferase [zea mays]
  misc_feature (2)..(330): NCBI GI: 68566037 NCBI Desc: cycloartenol-c-24-methyltransferase 1 (24-sterol c-methyltransferase 1) (sterol c-methyltransferase 1)
  misc_feature (2)..(330): NCBI GI: 34393309 NCBI Desc: cycloartenol-c24-methyltransferase [oryza sativa (japonica cultivar-group)]
  misc_feature (2)..(331): NCBI GI: 73761691 NCBI Desc: 24-sterol c-methyltransferase [gossypium hirsutum]
  misc_feature (2)..(330): SWISSPROT Homolog: EC 2.1.1.41 Cycloartenol-C-24-methyltransferase 1
MSGALDLARSMGGSIDKDQVKSAIDQYLKYHDLHGGEQESRKSNYTDLVNKYYDLATGFYEYGWGDSFHFAGRYPGETFREAIKRHEHFIALQLGLKKGMKVLDVGCGIGGPLIEIARFSSAMITGLNYNDYQISRGKELVFSAGLNEQCSFLKGDFMNMPIADNTFDAAFAIDATCHAPDAQGVYSEIYRVLKPGQYFALNEWCLTDRFDPNNAKHLAIKAEIELGDGLPPLARFEVICAKDLAQDFPCPWYQTIDPNNFSWTSFQCTRPGRIITRAIVNALEFLRIAPAGSAGIYSFLTSASDGLLKGGREGIFTASFFVLGRKPLKETGLANDGNL

SEQ ID NO: 9489 - DNA, 1296 bp, Sorghum bicolor
  misc_feature: Ceres ANNOT ID no. 6100526
  misc_feature: Encodes the peptide sequence at SEQ ID NO 9490
atggcgtcgccgtcccgaacaaacaagccgcagcttgtgttgtggccgtcactcctcacgctgctgatcttcttgcccggcgccctagaggcttctgctgcggcagcagctgctacgggccgcaggtcgctgctggcggcgtcgccgtcgtcgagcgtgttcagcctcgaccgctacggcgcctgcggcgacgggagccacgacgacacccaggcgctggcccgggcgtggaacgcggcgtgcgcttcgccgcagccggccgtcctgctcgtccccggcggcaagcgctacctgctcaagctcgtcactctttccggcccgtgcaagtccagcgtcacggtgacagtgaagggcacgctggtggcgtcgccgaaccggtccgactggagcgacgaggaccggcggcactggatcgtgttccgtcaggttgacaggctcaccgtcaatggcgccggcaccgtcgacggcaacggcgagacgtggtggaagaactcgtgcaagatcaacaaggctctcccgtgcaaggaggccccaacggcgctgtcgttccatttctgcacgagcttgagagtgcaggatctgaatgttgtcaacagccagcagatccacatgtccattgaggattgcaccggcgtgcagctgacaggcctgtcgatcacggcgcccggcaccagtcccaacactgacggcatccacatcacacgcagcaacgatgtgcaggtcaccaactgcaagatcaagacaggtgacgattgcctgtccatcgagagtgggacgcacaacctccatgtgtcgcaagtggtatgtgggccagggcatgggatcagcatcgggagcttaggagacgacaactcgagagccgaagtctcaggcatcaccatagattcagtacaattatacggcacgaccaacggagcacgcatcaagacgtaccagggaggaagtgggtacgccaaggacatcacgttccaaaacatggtcatgtacgacgtcgcgaacccgatcatcatcgaccagaactactgcgacaaggctacggcgccatgcgaattgcagggatcggcagtggaggtcagcaatgtcgtgttcaagaacatcaaggggacgacagtgaccaaggacgctatcatgctgaattgcagcaggaacgtcccgtgccttggcattaccctgcagaacattaacctgaggatgcagggcagtaacggtaaggatgccgcggaaagcacatgccagaatgcgagatggagaaaatccgggacggttcttccacagccgtgcacctccaaaaactag

SEQ ID NO: 9490 - protein, 431 aa, Sorghum bicolor
  misc_feature: Ceres ANNOT ID no. 6100526
  misc_feature (81)..(427): Pfam Id: Glyco_hydro_28 Pfam Desc: Glycosyl hydrolases family 28
  misc_feature (50)..(424): NCBI GI: 15081600 NCBI Desc: polygalacturonase pg1 [vitis vinifera]
  misc_feature (41)..(425): NCBI GI: 3320462 NCBI Desc: polygalacturonase precursor [cucumis melo]
  misc_feature (50)..(424): NCBI GI: 7959983 NCBI Desc: polygalacturonase a [actinidia chinensis]
  misc_feature (39)..(429): NCBI GI: 19310405 NCBI Desc: at2g41850/t11a7.5 [arabidopsis thaliana]
  misc_feature (50)..(424): NCBI GI: 548488 NCBI Desc: polygalacturonase precursor (pg) (pectinase)
  misc_feature (50)..(424): SWISSPROT Homolog: EC 3.2.1.15 Polygalacturonase precursor
  misc_feature: Useful for making plants with altered cell wall content and/or composition
  misc_feature: GREAT-hit functional homolog of the protein sequence encoded by LOCUS at2g41850
  misc_feature: Functional homolog of the protein sequence encoded by LOCUS at4g32370
  misc_feature: Functional homolog of the protein sequence encoded by LOCUS at5g27530
  misc_feature: Functional homolog of the protein sequence encoded by LOCUS at5g44830
  misc_feature: Useful for making plants with altered carbohydrate content
  misc_feature: Functional homolog of the protein sequence given in SEQ ID NO 13985
  misc_feature: Useful for making plants with altered cell wall content and/or composition
  misc_feature: Functional homolog of the protein sequence given in SEQ ID NO 14051
  misc_feature: The sequence is a functional homolog of SEQ ID NO. 450 in the 11/188,298 US application
MASPSRTNKPQLVLWPSLLTLLIFLPGALEASAAAAAATGRRSLLAASPSSSVFSLDRYGACGDGSHDDTQALARAWNAACASPQPAVLLVPGGKRYLLKLVTLSGPCKSSVTVTVKGTLVASPNRSDWSDEDRRHWIVFRQVDRLTVNGAGTVDGNGETWWKNSCKINKALPCKEAPTALSFHFCTSLRVQDLNVVNSQQIHMSIEDCTGVQLTGLSITAPGTSPNTDGIHITRSNDVQVTNCKIKTGDDCLSIESGTHNLHVSQVVCGPGHGISIGSLGDDNSRAEVSGITIDSVQLYGTTNGARIKTYQGGSGYAKDITFQNMVMYDVANPIIIDQNYCDKATAPCELQGSAVEVSNVVFKNIKGTTVTKDAIMLNCSRNVPCLGITLQNINLRMQGSNGKDAAESTCQNARWRKSGTVLPQPCTSKN

SEQ ID NO: 9491 - DNA, 1404 bp, Sorghum bicolor
  misc_feature: Ceres ANNOT ID no. 6100542
  misc_feature: Encodes the peptide sequence at SEQ ID NO 9492
atgaggtcaaataagatatttggtttatccatttctcttgtactcatcaacctagcttctatattggaacgagctgatgagaatctcctcccagctgtttacaaagaagtcagtgctgctttcgatgctggtcctactgatctggggtaccttacatttctgatgaactttctgaagtccatagcatctcccttggcaggtgtccttgctcttcaatatgaccgccctgcagttcttgcgatagggactgcgttctgggctttgtcaacaggggctgttggtgtcagccagtatttcgggcaggttgcattctggagagctgttaatggtgttgggcttgccattgtaataccagcgcttcaatccttcattgctgatagttacaaagatggcacacgtggagcgggatttggtttgctagcacttattggttcagtaggtggtataggaggtagtgttttggcaacaatcgtggctggaggggattattatggtattccaggatggcggcttgcatttatatccgttgcatttgtgagcttcttaattggacttcttgtatacttttatgctgttgatcctaggaaaacatctccaagccattttggtggtgatgaggacaatgagaggttacatttggtcagcaatggtatccttcctccacattcaatctggaaggattcatggatagcggcgagatccgtaatgaaggtgcggacgtttcaaatcattgtattgcaaggcattgttggctctctgccatgggctgctgtagttttcttcaccatgtggtttgaactcattggttttgacaacagcagctcagcggcgctaaatagctttttcgctattgggtgcgccagtggatcatttctaggtggtgtgatagcagatcgcttatctagatactatccagattctgctcgcatcatgtgcgctcagtttagcgccttcatgggcatccctttctcatggatcctccttacagtcattccccagtctgttgattactggtctgcctatgctgtcacactctttttaatgggcattaccataagctggtgcgctacttgtgcaaacaaccccatgttcgcagaggtagtacctcccaagcaccgcacaatgatctacgcctttgaccgcgcgtttgagggttcatttggctcacttgctgcacctgctgttggtatagtgaccgagaagatctatggctacaatgcaaagaccgttgatctagcacatggatcagtggacggagcttatgcactctcgagaggcctattgactatgatgattgtcccttttgctctgtgcctcatgttttacaccccattgtatacagttttcaagcgtgaccgagaaaatgttagattggccagcatcaaggaacaggagcttatatga

SEQ ID NO: 9492 - protein, 467 aa, Sorghum bicolor
  misc_feature: Ceres ANNOT ID no. 6100542
  misc_feature (16)..(392): Pfam Id: MFS_1 Pfam Desc: Major Facilitator Superfamily
  misc_feature (59)..(467): NCBI GI: 115471131 NCBI Desc: os07g0208900 [oryza sativa (japonica cultivar-group)]
  misc_feature (158)..(467): NCBI GI: 34393426 NCBI Desc: membrane transporter pfb0275w-like protein [oryza sativa (japonica cultivar-group)]
  misc_feature (21)..(466): NCBI GI: 42569131 NCBI Desc: transporter-related [arabidopsis thaliana]
  misc_feature (12)..(466): NCBI GI: 115478853 NCBI Desc: os09g0371200 [oryza sativa (japonica cultivar-group)]
  misc_feature (12)..(466): NCBI GI: 37806444 NCBI Desc: transporter-like protein [oryza sativa (japonica cultivar-group)]
MRSNKIFGLSISLVLINLASILERADENLLPAVYKEVSAAFDAGPTDLGYLTFLMNFLKSIASPLAGVLALQYDRPAVLAIGTAFWALSTGAVGVSQYFGQVAFWRAVNGVGLAIVIPALQSFIADSYKDGTRGAGFGLLALIGSVGGIGGSVLATIVAGGDYYGIPGWRLAFISVAFVSFLIGLLVYFYAVDPRKTSPSHFGGDEDNERLHLVSNGILPPHSIWKDSWIAARSVMKVRTFQIIVLQGIVGSLPWAAVVFFTMWFELIGFDNSSSAALNSFFAIGCASGSFLGGVIADRLSRYYPDSARIMCAQFSAFMGIPFSWILLTVIPQSVDYWSAYAVTLFLMGITISWCATCANNPMFAEVVPPKHRTMIYAFDRAFEGSFGSLAAPAVGIVTEKIYGYNAKTVDLAHGSVDGAYALSRGLLTMMIVPFALCLMFYTPLYTVFKRDRENVRLASIKEQELI

SEQ ID NO: 9493 - DNA, 1065 bp, Sorghum bicolor
  misc_feature: Ceres ANNOT ID no. 6100543
  misc_feature: Encodes the peptide sequence at SEQ ID NO 9494
atggcgtcgtccacctccgcgacgtcgggcggcgacgagtgcccgcgcgcgcctacaagcgacgcgtccgctgcggcggggacagcgccgctgacgctgccgcaggcgcacgtggagtgggccgcctcgatgcaggcctactacgccgccggtgggcagccttacgcctggcacaccgcgcagcagcacctgatggcggcggccgcagccgcggcgggggcaccgtacgggacgccggtgccgttccaccccgcgtactacgccacgcacgcgtcaatggccacgagtgtgccctaccctagtgctgagccggtggcggtggcggaagggaagggcaagaggaagagccctggcgccccttctgttggttgcacttccggaagtgccggtggaagcgagaactcatcagataaaagagatgctagtgctcatcataaggtattaccttctgtaaagaggagaaagtccagcggcgccaacgtacaaggtgagccatcacaggctgcaacaggtcaagatgctgcagctgagtcccggatcacagcaaaaaagaggtctgcagcaaaactctccatttcgacacctgagatggctgcaacctccaatgtcagacccaacttgaacattgggatggaactttggagtgattctccagttaaagcagagacctctggacagggtgaaatatatgctgctgcgccttcccagcttgacagcgctttgtcgatgatggatgagcgagaactgaaaagggagagaagaaaacaatctaacagagagtcagctaggagatcaagattgcgcaagcagcaagaatgtgaggaactagcgcagaaggtaactgaccttaccgccattaacggcacactcagatcagaactcgacgagcttaagaaggcctgtgaagacatggaagcagagaattcacaactaatgggtgaattggaacagttcgaggcacctagtgttgtaacaactttgagcatccagattgacacatcaaaggcacatcatagaagcagtgaccagcatggtaatagaaataacactgatagcaaggtgtag

SEQ ID NO: 9494 - protein, 354 aa, Sorghum bicolor
  misc_feature: Ceres ANNOT ID no. 6100543
  misc_feature (246)..(309): Pfam Id: bZIP_1 Pfam Desc: bZIP transcription factor
  misc_feature (246)..(300): Pfam Id: bZIP_2 Pfam Desc: Basic region leucine zipper
  misc_feature (1)..(144): Pfam Id: MFMR Pfam Desc: G-box binding protein MFMR
  misc_feature (152)..(352): NCBI GI: 56418453 NCBI Desc: abre-binding factor embp-2 [zea mays]
  misc_feature (1)..(337): NCBI GI: 469056 NCBI Desc: dna-binding protein
  misc_feature (1)..(337): NCBI GI: 119319 NCBI Desc: dna-binding embp-1 protein
  misc_feature (1)..(353): NCBI GI: 6523564 NCBI Desc: maize em binding protein-1a [zea mays]
  misc_feature (98)..(337): NCBI GI: 5926679 NCBI Desc: transcription factor hbp-1a(1) [triticum aestivum]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 839 in the 11/479,226US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 922 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO 839 in the 20070022495 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MASSTSATSGGDECPRAPTSDASAAAGTAPLTLPQAHVEWAASMQAYYAAGGQPYAWHTAQQHLMAAAAAAAGAPYGTPVPFHPAYYATHASMATSVPYPSAEPVAVAEGKGKRKSPGAPSVGCTSGSAGGSENSSDKRDASAHHKVLPSVKRRKSSGANVQGEPSQAATGQDAAAESRITAKKRSAAKLSISTPEMAATSNVRPNLNIGMELWSDSPVKAETSGQGEIYAAAPSQLDSALSMMDERELKRERRKQSNRESARRSRLRKQQECEELAQKVTDLTAINGTLRSELDELKKACEDMEAENSQLMGELEQFEAPSVVTTLSIQIDTSKAHHRSSDQHGNRNNTDSKV

SEQ ID NO: 9495 - DNA, 1134 bp, Sorghum bicolor
  misc_feature: Ceres ANNOT ID no. 6100547
  misc_feature: Encodes the peptide sequence at SEQ ID NO 9496
atgacaccaagaggcggacgtgcagcagctagttctggttctgaggatgaggaagaggaggctgggttctccaggagctacttcctggccaaggagaaggagccatcatctgggaagaagcgtgcccgtgccgccgcgggcaagctctccgacctcaacctcgttgacgagcaggtgttgcgtgcatcccttgcagagatccctccgaagcacgaagaagaggtggaagctctgactagaagctacaaggaccagtactgcaactggctgttcgaactaagatgcggttttggtctcctgatgtatgggtttggatctaagaagcaattgctcgaggattttgcctctgctacattgactgatttcactgtcattgtaataaatggctaccttccgtccatcaatttgaaacaggtcatagcaacaatagctgaaatgttctgggatcaaacaaaagctaaacgcaagagacagccaggaacaaggtcccagttgtcacaacagtttccatcacaatcaacagaggacatcatctcattcctaatgagacagacatccgatgatgtggatgatcctgtgtgccttcttattcataatgttgacgggcctgctttgcgtgatgctgaatcacaacagtgtctagcacaaatttcttgctgcccacaaatccgcattgttgcatcaatagaccatgttaatgcccctttattgtgggacaagaagatggtgcacaaacagttcaagtggagctggtaccatgtcccgacttttgcaccttacaaagtcgaaggcgtgttctacccattgatcctagctagtggtggtcatgcccaaaccacaaaaactgctctcgttgttcttcagagtctgacaccaaatgcacaaagtgttttcagagttcttgctgaatatcagttggcaaatgagaaggaggaaggtatgccagtcagcagtttgtatacaaaatgccgtgagcgctttctggtaagcagtcaagtgacattgaattcacacctgacggagtttaaagatcatgatctgattaagatcaggaagcactctgatgggcaagattgcctccgcattcctcttgtttctgacgcactggagaagttgctgcaagagttggcttga

SEQ ID NO: 9496 - protein, 377 aa, Sorghum bicolor
  misc_feature: Ceres ANNOT ID no. 6100547
  misc_feature (36)..(378): Pfam Id: ORC2 Pfam Desc: Origin recognition complex subunit 2
  misc_feature (1)..(377): NCBI GI: 15866776 NCBI Desc: origin recognition complex subunit 2 [zea mays]
  misc_feature (1)..(376): NCBI GI: 66153722 NCBI Desc: origin recognition complex subunit 2 [oryza sativa (japonica cultivar-group)]
  misc_feature (156)..(376): NCBI GI: 42571101 NCBI Desc: origin recognition complex subunit 2 (orc2) [arabidopsis thaliana]
  misc_feature (55)..(371): NCBI GI: 57529768 NCBI Desc: similar to horc2l [gallus gallus]
  misc_feature (136)..(374): NCBI GI: 54038187 NCBI Desc: orc2-a-prov protein [xenopus laevis]
MTPRGGRAAASSGSEDEEEEAGFSRSYFLAKEKEPSSGKKRARAAAGKLSDLNLVDEQVLRASLAEIPPKHEEEVEALTRSYKDQYCNWLFELRCGFGLLMYGFGSKKQLLEDFASATLTDFTVIVINGYLPSINLKQVIATIAEMFWDQTKAKRKRQPGTRSQLSQQFPSQSTEDIISFLMRQTSDDVDDPVCLLIHNVDGPALRDAESQQCLAQISCCPQIRIVASIDHVNAPLLWDKKMVHKQFKWSWYHVPTFAPYKVEGVFYPLILASGGHAQTTKTALVVLQSLTPNAQSVFRVLAEYQLANEKEEGMPVSSLYTKCRERFLVSSQVTLNSHLTEFKDHDLIKIRKHSDGQDCLRIPLVSDALEKLLQELA

SEQ ID NO: 9497 - DNA, 1401 bp, Sorghum bicolor
  misc_feature: Ceres ANNOT ID no. 6100548
  misc_feature: Encodes the peptide sequence at SEQ ID NO 9498
  misc_feature: Down-regulated in shoot tissues in response to methyl jasmonate treatment
atgctggcgggctacggcggtggtggccgcggcgtccatttctcctcccacaaggacctcctcctcgcccgcggcagccggagcttcctcttcggcaacacgtggtttctcctctccacctacccggcgcgcctcctgcacaccacggaccgccgcgcgcctgccgctttctttgccgccatcaaccgggcccccggcgtgcggtctcactgcgcagggcagggcctcctccagaggggcggcattgtcatggctgcctgcggatatgctcttcggcgagctgagctgggtgctgcaaagcgccagcagccggataaggatccatctgcagggacacgcgcctcgcgtattgcagccgtgggatcactgggcagtgctgcccggccagacgtctcttttaggtacagaggggtggagtcttgtaagaagattggtgtaagcttgaagtgccgtgagccatgggggaatagggcattctggacaaacgccgctgggccgggttggaagttgagctttgcagttgagccatggactaaggactttagcacgtcgtgtgcagcgccatattctgctggagccacagagcatcaattgtcgctggatgagaagatggataactcctccgttgcatctgatgggaagtcaccagtttctgaaaaattgaagttgctatctggttcatgttacttgcctcaccctgctaaggaggcaactggtggtgaggatgcacatttcattagcattgatgagcatgtgattggcgtagcagatggtgttggtggttgggcagatctcggtgtcgatgctggattatatgctaaggagctaatgagaaattcattgagtgctataaaagatgagccagaagggacgattgatccaaccagagttttggaaaaggcttatatgagcaccaaagcaaggggatcatctaccgcgtgtatcatcactcttaaagatcagggtatccatgctgtaaatcttggggatagtggcttcgtagtagtccgagatggccgcactgttctcaggtcaccctcacagcagcatgatttcaattttacttatcagcttgagagtggaggtggcagtgatcttcctagttccgcacaagtatttcactttccggttgccccgggtgatgttattgttgctggcacggatggactttttgacaatttatacaacaatgagataagtggtgttattgttgaagcactcagggttggacttgagcctcagattgcagcacaaaaaattgctgccctggctcgacaacgagctacagacaaaaataggcagtcaccattcgcatcagctgctcaagaagctgggtaccggtactatggtgggaagcttgatgacataacagttgtggtgtcatatgtgaagagtgcctga

SEQ ID NO: 9498 - protein, 466 aa, Sorghum bicolor
  misc_feature: Ceres ANNOT ID no. 6100548
  misc_feature (178)..(466): NCBI GI: 42573816 NCBI Desc: 5-azacytidine resistance protein -related [arabidopsis thaliana]
  misc_feature (147)..(466): NCBI GI: 140062518 NCBI Desc: protein phosphatase 2c-like [medicago truncatula]
  misc_feature (232)..(369): NCBI GI: 93009069 NCBI Desc: mitochondrial catalytic protein [coffea canephora]
  misc_feature (232)..(369): NCBI GI: 93009061 NCBI Desc: mitochondrial catalytic protein [petunia axillaris subsp. parodii]
  misc_feature (235)..(369): NCBI GI: 93009055 NCBI Desc: mitochondrial catalytic protein [physalis sp. ta1367]
  misc_feature: Down-regulated in shoot tissues in response to methyl jasmonate treatment
MLAGYGGGGRGVHFSSHKDLLLARGSRSFLFGNTWFLLSTYPARLLHTTDRRAPAAFFAAINRAPGVRSHCAGQGLLQRGGIVMAACGYALRRAELGAAKRQQPDKDPSAGTRASRIAAVGSLGSAARPDVSFRYRGVESCKKIGVSLKCREPWGNRAFWTNAAGPGWKLSFAVEPWTKDFSTSCAAPYSAGATEHQLSLDEKMDNSSVASDGKSPVSEKLKLLSGSCYLPHPAKEATGGEDAHFISIDEHVIGVADGVGGWADLGVDAGLYAKELMRNSLSAIKDEPEGTIDPTRVLEKAYMSTKARGSSTACIITLKDQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQIAAQKIAALARQRATDKNRQSPFASAAQEAGYRYYGGKLDDITVVVSYVKSA

SEQ ID NO: 9499 - DNA, 582 bp, Sorghum bicolor
  misc_feature: Ceres ANNOT ID no. 6100551
  misc_feature: Encodes the peptide sequence at SEQ ID NO 9500
atggggcgagcggcggcggaggagggtgacgtggagttcgtcgactacgaccaggacgacgaggacgccatggaggaggacggccgcgccgcgcgcgcgctccccgtgccccgcatcgtctcccccgccgtggtgcgcacccgcgggcgcttcgcgggtcgcagcccctccgttctcacttccagccactaccgcttcgactccatcaccaatgacggagaccatggtcccggcccgcagcgctctatcgaaggctggacaattcttgtttctggaattaaagaggacgctgaagaagatgatttttacaatgctttcagtgaatttggtcatgtcaaggacttgcatctcaatctagaacgccgcactggatatgccaagggatatgcgctgattgaatatgaaagctttgaggaagcacaagctgcgatcagagcaatgaacgggagtcagctgctcacaaaaactatctatgttgactgggctttcagcagaggtccaatacagaatttcaagagtacaaggccatcacgcccaagatctaggactcctccgcgtaggctagctgccttgaggccatag

SEQ ID NO: 9500 - protein, 193 aa, Sorghum bicolor
  misc_feature: Ceres ANNOT ID no. 6100551
  misc_feature (88)..(159): Pfam Id: RRM_1 Pfam Desc: RNA recognition motif. (a.k.a. RRM, RBD, or RNP domain)
  misc_feature (66)..(187): NCBI GI: 115461997 NCBI Desc: os05g0140500 [oryza sativa (japonica cultivar-group)]
  misc_feature (10)..(187): NCBI GI: 30524687 NCBI Desc: salt tolerance protein 4 [beta vulgaris]
  misc_feature (19)..(187): NCBI GI: 68037220 NCBI Desc: mrna transport factor [triticum aestivum]
  misc_feature (66)..(187): NCBI GI: 82798422 NCBI Desc: y14 protein [taiwania cryptomerioides]
  misc_feature (46)..(187): NCBI GI: 20804381 NCBI Desc: rna binding motif protein 8 [oryzias latipes]
  misc_feature: The sequence is a functional homolog of SEQ ID NO. 339 in the 11/188,298 US application
MGRAAAEEGDVEFVDYDQDDEDAMEEDGRAARALPVPRIVSPAVVRTRGRFAGRSPSVLTSSHYRFDSITNDGDHGPGPQRSIEGWTILVSGIKEDAEEDDFYNAFSEFGHVKDLHLNLERRTGYAKGYALIEYESFEEAQAAIRAMNGSQLLTKTIYVDWAFSRGPIQNFKSTRPSRPRSRTPPRRLAALRP

SEQ ID NO: 9501 - DNA, 1926 bp, Sorghum bicolor
  misc_feature: Ceres ANNOT ID no. 6100566
  misc_feature: Encodes the peptide sequence at SEQ ID NO 9502
atggcgggtgcgacgtccccggcggcggccgcgaatctggcgggcaagtcgggcgtgcgggtcgtcgtgatcggcgacccgggcaccggcaagtccagcctcatcgtcgccctcgccaccgagcagttccccgagaacgtgccccgcgtcatgccccccacacgcctccccgccgactacttccccgaccgcgtacccatcaccatcatcgacacgtcgtccagcccggagcagaagccgaagttgatcgcggagtgccaggccgccgatgcggtcgtgctcacctacgcctgcgaccggcccgccacgctggagcgtctcagttcgttctggcttcccgagctccggcgactccagttgaaggctccagttattgtggtggggtgcaagctggacctaagggacgaacagcaggttagccttgagcaggttatggcgcccatcatgcagtccttccgcgagattgagacctgcatcgagtgctccgctcttcggcagatccaggtgcctgaggtcttctactatgctcagaaggcagtacttcacccaactgccccactctttgatcaagagttacaatctctgaagcctcgatgtgtgagagcgttgaagcggatctttattatatgtgataatgacaaggatggcgctctcagtgatgtggagctcaatgaattccaggtccgatgctttagtgcccctctgcagcctactgaaatttcaggagttaagagagttgttcaggagaagatgcctgaaggcgtaaatgaaagcggtcttaccttgactgggttcctttttctgcatgccctctttattgaaaaaggtcgtttggaaactacatggactgtattgaggaaatttggttacgacaatgacatcaagcttagggatgatctccttgcaatgccaattaaaagagctcctgatcaaactctggaaatgacaagtgtagtggtcgaattcttgagagggatattcaccatgtttgacattgataatgatggagctttactacctactgagctggaagaccttttctcaacagcacctgaaaacccatggtcttccgatccatacaaagactgcgctgaaaagaacgtgttgggtggtctgtcacttgaagggtttctctcaaagtgggctctaatgacagttctagatccaacaaatagttatgccaaccttgtatatgttggctatcctggcgagttcagttctgcatttactgtcacaaggaaaagacgagtggatcgtaaaaagcaacagacacagagaaatgttttccagtgttatgttttcggtgccagaggctctggaaagacgtccttgctacaatcattcattggaaggcaaccttctgatgctctgccatctaacagcgaacgctttgcaacaaattctgtcgaaatggctgatggaactagaaagacactaatactgcgagagattcctgaaggtgatgtgagatccttactttctgacaaggaatcattggcgccgtgtgatgtagcagtatttgtttacgacagctgcgatgaatattcttggcaaagggctagagacttgcttgtgcaagtggctacacatggagaaaatactggctacgaagttccttgcttgatagttgctgcgaaagatgatcttgaccaatcttcacaagctctgcaagaatcaactagagtgagccaagacatgggaattgaaacaccaattccgatcagcgtgaagctgagagatttgaacaacattttctgcagaattatacatgctgcacagcagccccatttgagcattccagagactgaagctggcaaaacacgccggcaatatcggcaacttctaaaccgttcgctaatggttgtctctgttgttggattagctgcttaccgggtttatgcagctcggaagaactcgtcctcttga

SEQ ID NO: 9502 - protein, 641 aa, Sorghum bicolor
  misc_feature: Ceres ANNOT ID no. 6100566
  misc_feature (20)..(132): Pfam Id: Miro Pfam Desc: Miro-like protein
  misc_feature (430)..(548): Pfam Id: Miro Pfam Desc: Miro-like protein
  misc_feature (231)..(320): Pfam Id: EF_assoc_2 Pfam Desc: EF hand associated
  misc_feature (354)..(424): Pfam Id: EF_assoc_1 Pfam Desc: EF hand associated
  misc_feature (20)..(182): Pfam Id: Ras Pfam Desc: Ras family
  misc_feature (8)..(311): NCBI GI: 115440991 NCBI Desc: os01g0843300 [oryza sativa (japonica cultivar-group)]
  misc_feature (11)..(639): NCBI GI: 18412634 NCBI Desc: gtp-binding protein-related [arabidopsis thaliana]
  misc_feature (11)..(639): NCBI GI: 22655380 NCBI Desc: at3g63150/t20o10_250 [arabidopsis thaliana]
  misc_feature (81)..(640): NCBI GI: 144924480 NCBI Desc: calcium-binding ef-hand; ras small gtpase, rho type [medicago truncatula]
  misc_feature (333)..(639): NCBI GI: 92881852 NCBI Desc: calcium-binding ef-hand; ras small gtpase, rab type [medicago truncatula]
  misc_feature: The sequence is a functional homolog of SEQ ID NO. 400 in the 11/188,298 US application
MAGATSPAAAANLAGKSGVRVVVIGDPGTGKSSLIVALATEQFPENVPRVMPPTRLPADYFPDRVPITIIDTSSSPEQKPKLIAECQAADAVVLTYACDRPATLERLSSFWLPELRRLQLKAPVIVVGCKLDLRDEQQVSLEQVMAPIMQSFREIETCIECSALRQIQVPEVFYYAQKAVLHPTAPLFDQELQSLKPRCVRALKRIFIICDNDKDGALSDVELNEFQVRCFSAPLQPTEISGVKRVVQEKMPEGVNESGLTLTGFLFLHALFIEKGRLETTWTVLRKFGYDNDIKLRDDLLAMPIKRAPDQTLEMTSVVVEFLRGIFTMFDIDNDGALLPTELEDLFSTAPENPWSSDPYKDCAEKNVLGGLSLEGFLSKWALMTVLDPTNSYANLVYVGYPGEFSSAFTVTRKRRVDRKKQQTQRNVFQCYVFGARGSGKTSLLQSFIGRQPSDALPSNSERFATNSVEMADGTRKTLILREIPEGDVRSLLSDKESLAPCDVAVFVYDSCDEYSWQRARDLLVQVATHGENTGYEVPCLIVAAKDDLDQSSQALQESTRVSQDMGIETPIPISVKLRDLNNIFCRIIHAAQQPHLSIPETEAGKTRRQYRQLLNRSLMVVSVVGLAAYRVYAARKNSSS

SEQ ID NO: 9503 - DNA, 2268 bp, Sorghum bicolor
  misc_feature: Ceres ANNOT ID no. 6100570
  misc_feature: Encodes the peptide sequence at SEQ ID NO 9504
  misc_feature: Down-regulated in shoot tissues in response to aminocyclopropane carboxylic treatment
  misc_feature: Down-regulated in shoot tissues in response to salicylic acid treatment
atggcgacggccaccgcgctctccacctcactcccgcacctcccgccccgccgtgccgcctcatttccctccgccgccgccgtttccctccccgtctcctcccgcgccgcccggctgcgggaatcccgcctcgcggccgcggcacccgcggcctccgaggtcctcgagtccaccaacggcgccatccccaccgcggccaagggcggcgcggggcgtgggtacgggagggagtacttccccctggctgccgtcgtcgggcaggatgctatcaaaaccgctctgctgcttggggcgattgatcgtgagattggaggcattgccatctcagggaagcgtgggacggcaaagacggtgatggctcgtggcttgcatgctatgcttccacctattgaagtggttgttggctccattgcaaatgctgatcctagctccccagacgaatgggaggatggtttagctgatcaaatacagtatgactctgatggtaatgtcaaaactgagattgtgaaaacaccttttgtgcagattccacttggtgtgacagaggataggctcattggatcagttgatgttgaagcatctgtgagatcagggactactgtatttcaacctggtcttcttgctgaagcacatagaggtgttctttatgttgatgagataaatctattggatgatggcataagcaatctacttttgaatgtcttgacggagggagttaacattgtggaaagagagggcattagctttcgccatccctgcaaaccacttctaattgctacttacaacccagaggaaggatctgtgcgtgaacacttgcttgatcgtattgcaattaatttaagtgctgaccttccaatgagttttgatgaccgtgttgcagcagtggatattgcaacacggtttcaggagtctagcaaagaagttttcaaaatggtggaagaagaaactgaaactgcaaaaactcagataattttggcaagagagtatctgaaggatgttaacattagcacagagcagctcaaatatcttgtcatggaagctatacgaggtggctgtcaggggcatcgtgctgagttgtatgctgctcgagttgcaaaatgccttgctgctatggaaggacgtgaaaaagtatttgtggatgacctcaagaaagctgtagagctagtcattctacctcgctcgatcctatctgataacccacaggatcagcagcaagagcaaccacccccacccccgccgccaccacctccagaaaatcaagattcctcagaagaccaagacgaggaagacgatgaccaagaggatgatgatgaagaaaatgaacaacaagaccagcagatacctgaggagttcatctttgatgctgaaggtggtttagtagatgataaactccttttctttgctcagcaagcacaaagacgacgtggaaaagctgggcgagcaaagaatgtcatcttctcagaagataggggccgttacataaagcctatgcttccaaagggtccagtaaggaggttagctgttgatgccacgcttagagcagctgcaccataccaaaaactgcgcagagagaaagaacgtgacaaggcaagaaaggtttttgttgaaaagactgacatgagagccaaaagaatggctcgaaaagcaggtgctctagtcatatttgttgtggacgctagtggtagcatggctctgaatcgtatgcagaacgcgaaaggtgcggcattgaagttgcttgcagaaagctacaccagcagagatcaggtttcaattattccttttcgtggagattatgctgaggttttacttccaccatcaagatctatagcaatggcccggaaacgtcttgagaagctaccatgtggtggtggttctcctttagctcatggcctcagtacagctgtcagagtgggtttgaatgctgaaaagagtggcgatgtcgggcgtatcatgattgttgcaatcaccgatggaagagctaatgtatcactgaagagatccactgatccagaagctgctgctgcttcagatgcaccaagaccttcgtctcaagaactaaaggatgagatacttgaggtggctggcaaaatatacaaggcaggaatgtcccttcttgtcatcgacactgagaacaagtttgtatccacgggatttgccaaggaaattgcaagggttgcccaagggaaatattattatctgcccaatgcttcagatgctgtgatttctgctgccaccaagaccgctctgactgacttgaagagctcgtga

SEQ ID NO: 9504 - protein, 755 aa, Sorghum bicolor
  misc_feature: Ceres ANNOT ID no. 6100570
  misc_feature (81)..(291): Pfam Id: Mg_chelatase Pfam Desc: Magnesium chelatase, subunit ChlI
  misc_feature (2)..(754): NCBI GI: 71493349 NCBI Desc: chloroplast mg-chelatase subunit xantha-g precursor [hordeum vulgare]
  misc_feature (2)..(755): NCBI GI: 2239151 NCBI Desc: chld magnesium chelatase subunit [nicotiana tabacum]
  misc_feature (3)..(755): NCBI GI: 2318117 NCBI Desc: mg-chelatase subunit d [pisum sativum]
  misc_feature (23)..(436): NCBI GI: 25366241 NCBI Desc: protein t27g7.20 [imported] - arabidopsis thaliana
  misc_feature (23)..(755): NCBI GI: 12643848 NCBI Desc: magnesium-chelatase subunit chld, chloroplast precursor (mg-protoporphyrin ix chelatase) (mg-chelatase subunit d)
  misc_feature (2)..(755): SWISSPROT Homolog: EC 6.6.1.1 Magnesium-chelatase subunit chlD, chloroplast precursor
  misc_feature: Down-regulated in shoot tissues in response to aminocyclopropane carboxylic treatment
  misc_feature: Down-regulated in shoot tissues in response to salicylic acid treatment
MATATALSTSLPHLPPRRAASFPSAAAVSLPVSSRAARLRESRLAAAAPAASEVLESTNGAIPTAAKGGAGRGYGREYFPLAAVVGQDAIKTALLLGAIDREIGGIAISGKRGTAKTVMARGLHAMLPPIEVVVGSIANADPSSPDEWEDGLADQIQYDSDGNVKTEIVKTPFVQIPLGVTEDRLIGSVDVEASVRSGTTVFQPGLLAEAHRGVLYVDEINLLDDGISNLLLNVLTEGVNIVEREGISFRHPCKPLLIATYNPEEGSVREHLLDRIAINLSADLPMSFDDRVAAVDIATRFQESSKEVFKMVEEETETAKTQIILAREYLKDVNISTEQLKYLVMEAIRGGCQGHRAELYAARVAKCLAAMEGREKVFVDDLKKAVELVILPRSILSDNPQDQQQEQPPPPPPPPPPENQDSSEDQDEEDDDQEDDDEENEQQDQQIPEEFIFDAEGGLVDDKLLFFAQQAQRRRGKAGRAKNVIFSEDRGRYIKPMLPKGPVRRLAVDATLRAAAPYQKLRREKERDKARKVFVEKTDMRAKRMARKAGALVIFVVDASGSMALNRMQNAKGAALKLLAESYTSRDQVSIIPFRGDYAEVLLPPSRSIAMARKRLEKLPCGGGSPLAHGLSTAVRVGLNAEKSGDVGRIMIVAITDGRANVSLKRSTDPEAAAASDAPRPSSQELKDEILEVAGKIYKAGMSLLVIDTENKFVSTGFAKEIARVAQGKYYYLPNASDAVISAATKTALTDLKSS

SEQ ID NO: 9505 - DNA, 522 bp, Sorghum bicolor
  misc_feature: Ceres ANNOT ID no. 6100574
  misc_feature: Encodes the peptide sequence at SEQ ID NO 9506
atgggaggaaaaagttcacttgctacaagctccgtgcagatacattttgtgctcctcatcagcaggcaggggaaggtgaggctgacgaaatggtacactccatacccacaaaagcagagatccaagatcatcaaagagataagtacgctcgtcctgacaagaggccccaagctgtgcaattttgttgactggcaaggttacagagttgtgtacaagaggtatgctagcctttacttctgcatgtgcattgaccctgctgacaatgaactggaaacccttcaaatcatccatcactatgttgagatattggaccggtactttggcaacgtctgtgagcttgatctgatattcaattttcataaggcgtacttcatattggacgagattttgattgctggtgaacttcaagaatcaaacaagaaatcggtgctacgtctagtaactacacaggacgctttggtggaagccgcaaaggaggaggcaggctcattgaggaacataattgcacaggctaccaagtag

SEQ ID NO: 9506 - protein, 173 aa, Sorghum bicolor
  misc_feature: Ceres ANNOT ID no. 6100574
  misc_feature (13)..(154): Pfam Id: Clat_adaptor_s Pfam Desc: Clathrin adaptor complex small chain
  misc_feature (12)..(173): NCBI GI: 17149112 NCBI Desc: clathrin assembly protein ap19-like protein [oryza sativa]
  misc_feature (14)..(173): NCBI GI: 21537342 NCBI Desc: clathrin assembly small subunit protein ap19 [arabidopsis thaliana]
  misc_feature (14)..(173): NCBI GI: 2231700 NCBI Desc: clathrin assembly protein ap19 homolog [arabidopsis thaliana]
  misc_feature (14)..(173): NCBI GI: 1762309 NCBI Desc: ap-1 golgi-related complex component; clathrin coated vesicles; clathrin assembly protein
  misc_feature (14)..(164): NCBI GI: 82594963 NCBI Desc: clathrin assembly protein ap19, small subunit [plasmodium yoelii yoelii str. 17xnl]
MGGKSSLATSSVQIHFVLLISRQGKVRLTKWYTPYPQKQRSKIIKEISTLVLTRGPKLCNFVDWQGYRVVYKRYASLYFCMCIDPADNELETLQIIHHYVEILDRYFGNVCELDLIFNFHKAYFILDEILIAGELQESNKKSVLRLVTTQDALVEAAKEEAGSLRNIIAQATK

SEQ ID NO: 9507 - DNA, 804 bp, Sorghum bicolor
  misc_feature: Ceres ANNOT ID no. 6100575
  misc_feature: Encodes the peptide sequence at SEQ ID NO 9508
atgttcccggccgaggtatcggcgctcgcggcggcgagcggcgccggcgcggggcgtcaggctgcaggcgaggccgctggcggcggcgtcctcccgatgctgccgcctttcttcatgggctccatctggcccgctagctccgaggaagacgaggccgcggcggcggcggcggccgcggccgcccacgaccgagctctcgccgcgtcgcgcaaccaccgcgaggccgagaagcgccggcgcgagcgcatcaagtcgcacctcgaccgcctccgcaacgtcctcgcctgcgaccccaagatagacaaggcgtcgctgctggcgaaggcggtggagagggtgcgggacctgaagcagcgggcggcgggcgtcggggaggcggcgccggcgcacctgttcccgacggagcacgacgagatcgtggtgctcgcgtcgggcagcggcgccgtcttcgaggcctccgtctgctgcgacgaccgctccgacctcctcccggacctcatcgagacgctgcgcgcgctccgcctccgcacgctccgcgccgagatggccacactcggcggccgcgtccgcaacgtgctcgtcctggcgcgcgacgtcgccgacggcggtgtcgtcgtcacgggagatgatgacggctacggcggccgcgctgctgactcggtgggcgccacggacggcgccaacggcaccggtggcgacttcctcaaggaagccctcagggctctggtagagaggccgggcgccgccggagaccggcccaagaggcgacgggtctcgggcatgaacatgcaagcggcagcatag

SEQ ID NO: 9508 - protein, 267 aa, Sorghum bicolor
  misc_feature: Ceres ANNOT ID no. 6100575
  misc_feature (68)..(117): Pfam Id: HLH Pfam Desc: Helix-loop-helix DNA-binding domain
  misc_feature (101)..(267): NCBI GI: 115456141 NCBI Desc: os03g0811400 [oryza sativa (japonica cultivar-group)]
  misc_feature (51)..(198): NCBI GI: 140046492 NCBI Desc: helix-loop-helix dna-binding [medicago truncatula]
  misc_feature (22)..(257): NCBI GI: 18491261 NCBI Desc: at2g41130/t3k9.10 [arabidopsis thaliana]
  misc_feature (64)..(251): NCBI GI: 42409474 NCBI Desc: dna-binding protein-like [oryza sativa (japonica cultivar-group)]
  misc_feature (2)..(141): NCBI GI: 50252324 NCBI Desc: dna binding protein-like [oryza sativa (japonica cultivar-group)]
  misc_feature: The plant flowers significantly late compared to wild-type.
  misc_feature: The sequence is a functional homolog of SEQ ID NO 1897 in the 10/374,780US patent application
  misc_feature: The sequence is a functional homolog of SEQ ID NO 1898 in the 10/374,780US patent application
  misc_feature: The sequence is a functional homolog of SEQ ID NO 1899 in the 10/374,780US patent application
  misc_feature: The sequence is a functional homolog of SEQ ID NO 1900 in the 10/374,780US patent application
  misc_feature: The sequence is a functional homolog of SEQ ID NO 1901 in the 10/374,780US patent application
  misc_feature: Useful for making plants with modulated flowering time
  misc_feature: Useful for making plants with modulated growth and phenotype characteristics
  misc_feature: Functional homolog of the protein sequence given in SEQ ID NO 12931
  misc_feature: The sequence is a functional homolog of SEQ ID NO 1897 in the 20060162006 US patent application
  misc_feature: The sequence is a functional homolog of SEQ ID NO 1898 in the 20060162006 US patent application
  misc_feature: The sequence is a functional homolog of SEQ ID NO 1899 in the 20060162006 US patent application
  misc_feature: The sequence is a functional homolog of SEQ ID NO 1900 in the 20060162006 US patent application
  misc_feature: The sequence is a functional homolog of SEQ ID NO 1901 in the 20060162006 US patent application
MFPAEVSALAAASGAGAGRQAAGEAAGGGVLPMLPPFFMGSIWPASSEEDEAAAAAAAAAAHDRALAASRNHREAEKRRRERIKSHLDRLRNVLACDPKIDKASLLAKAVERVRDLKQRAAGVGEAAPAHLFPTEHDEIVVLASGSGAVFEASVCCDDRSDLLPDLIETLRALRLRTLRAEMATLGGRVRNVLVLARDVADGGVVVTGDDDGYGGRAADSVGATDGANGTGGDFLKEALRALVERPGAAGDRPKRRRVSGMNMQAAA

SEQ ID NO: 9509 - DNA, 945 bp, Sorghum bicolor
  misc_feature: Ceres ANNOT ID no. 6100580
  misc_feature: Encodes the peptide sequence at SEQ ID NO 9510
atgtcacgcacgacgccgtcgagcccgttgacgcgcgccacgcccccgctctccccgacggccggcggcactccgagtcgcctggccgtcgcgccggcctccccgtccaccccgcagtgcgctattccggcgtcgccccacacgccgggcagggccagggcgagcgctcccaccccgccgccggccacgccgcgcacaccgcgcccggagatcacgctccgtcagccggcgtcgcaggcgtcacagaagcgcgcgcccgccgccgtccggaagccgtcgcgagcgctccgcgcgatccgcgcgctgattcggtcgctgcccatcgtcgcacccgcggcgtgccgcccggcgtccgcgctcccgcgacgctacaccaagccgcacgacgggcacggcggcagcggcggcgcgcgcgtcaccggcacgttctacgggcaccgccgcgcgcgcatcaccctctccgtccaggagcgccccggcagcctcccgtcgcttgtgctcgagatcggcgtgcccacggggaaactcatgcaggagctttccgccggcgggcacgtccgcatcgccctcgagtgcgagaagaagtccaagaagtcgacgctgccggaaggcggcggcggcggcaacgtgagcctgctggaggaggcgatgtggacggcgtacgtgaacgggcggcgcgtggggtacgcggtgaggcgggaggcctcggagggcgacctcgccgtgatgcagctcctgagtacggtctcggtgggcgccggcgtgctacccggggacgtggtggacgcgccagccgggtcggaggccgacggcgaggtggcgtacatgcgcgccgggttcgacagggtggtcggaagcaaggactccgagtcgttctacatgattaacccggagggggttgccggcggtggcacggagctcagcatatttcttgtcagggtgtag

SEQ ID NO: 9510 - protein, 314 aa, Sorghum bicolor
  misc_feature: Ceres ANNOT ID no. 6100580
  misc_feature (109)..(314): NCBI GI: 115465611 NCBI Desc: os05g0577100 [oryza sativa (japonica cultivar-group)]
  misc_feature (50)..(314): NCBI GI: 21741231 NCBI Desc: osjnbb0034i13.25 [oryza sativa (japonica cultivar-group)]
  misc_feature (136)..(314): NCBI GI: 115438821 NCBI Desc: os01g0642600 [oryza sativa (japonica cultivar-group)]
  misc_feature (173)..(314): NCBI GI: 115448223 NCBI Desc: os02g0709600 [oryza sativa (japonica cultivar-group)]
  misc_feature (4)..(121): NCBI GI: 62132411 NCBI Desc: arabinogalactan protein [pinus nelsonii]
MSRTTPSSPLTRATPPLSPTAGGTPSRLAVAPASPSTPQCAIPASPHTPGRARASAPTPPPATPRTPRPEITLRQPASQASQKRAPAAVRKPSRALRAIRALIRSLPIVAPAACRPASALPRRYTKPHDGHGGSGGARVTGTFYGHRRARITLSVQERPGSLPSLVLEIGVPTGKLMQELSAGGHVRIALECEKKSKKSTLPEGGGGGNVSLLEEAMWTAYVNGRRVGYAVRREASEGDLAVMQLLSTVSVGAGVLPGDVVDAPAGSEADGEVAYMRAGFDRVVGSKDSESFYMINPEGVAGGGTELSIFLVRV

SEQ ID NO: 9511 - DNA, 606 bp, Sorghum bicolor
  misc_feature: Ceres ANNOT ID no. 6100581
  misc_feature: Encodes the peptide sequence at SEQ ID NO 9512
atggcgtccggcggagcggccatctcggcggggccgacgccaccgtcggcgacggcgacggcggtggagtggcaccagcggccgccgaacccgaagaaccccgtggtgttcttcgacgtgaccatcgggtccatccccgccggccgcatcaagatggagctcttcgccgacatcgcccccaagaccgcggagaacttccggcagttctgcactggggagcatagaaaaaatgctttgccacagggttataagggctgtcaattccatagagtgatcaaagatttcatgattcagggtggtgacttcttgaagaatgatggtactggatgcacatcaatctatggtaccaaatttgatgatgaaaattttattgcaaagcatacagggcctggactgctctcaatggcaaacagtggaattaactctaatggatctcagttctttataacatgtgcgaagtgtgactggcttgacaacaaacatgtggtatttgggagagtgcttggagacggtttgctcgtcgtgaggaagattgaaaatgttgcaactggagcgaataacaaaccaaagcttgcctgcattataagcgagtgcggtgaaatgtag

SEQ ID NO: 9512 - protein, 201 aa, Sorghum bicolor
  misc_feature: Ceres ANNOT ID no. 6100581
  misc_feature (35)..(201): Pfam Id: Pro_isomerase Pfam Desc: Cyclophilin type peptidyl-prolyl cis-trans isomerase/CLD
  misc_feature (2)..(201): NCBI GI: 94420699 NCBI Desc: cyclophilin3b [oryza sativa (indica cultivar-group)]
  misc_feature (20)..(201): NCBI GI: 92879371 NCBI Desc: peptidyl-prolyl cis-trans isomerase, cyclophilin type [medicago truncatula]
  misc_feature (17)..(201): NCBI GI: 4454307 NCBI Desc: cyclophilin [pseudotsuga menziesii]
  misc_feature (22)..(201): NCBI GI: 145355565 NCBI Desc: peptidyl-prolyl cis-trans isomerase, cyclophilin-type [ostreococcus lucimarinus cce9901]
  misc_feature (32)..(201): NCBI GI: 109892833 NCBI Desc: peptidyl-prolyl cis-trans isomerase h (ppiase h) (rotamase h)
  misc_feature (32)..(201): SWISSPROT Homolog: EC 5.2.1.8 Peptidyl-prolyl cis-trans isomerase H
MASGGAAISAGPTPPSATATAVEWHQRPPNPKNPVVFFDVTIGSIPAGRIKMELFADIAPKTAENFRQFCTGEHRKNALPQGYKGCQFHRVIKDFMIQGGDFLKNDGTGCTSIYGTKFDDENFIAKHTGPGLLSMANSGINSNGSQFFITCAKCDWLDNKHVVFGRVLGDGLLVVRKIENVATGANNKPKLACIISECGEM

SEQ ID NO: 9513 - DNA, 294 bp, Sorghum bicolor
  misc_feature: Ceres ANNOT ID no. 6100583
  misc_feature: Encodes the peptide sequence at SEQ ID NO 9514
atgaaggtccgcgcgtcggtgaagcgcctgtgcgggttctgcaaggtggtgaagcgccggggcatcgtcttcatccactgcaccgccaaccccaagcacaagcagcgccagggcttctccaccatcgccgaagccgccgccgcgtgcgtccacctgccgccgccaccgcccgccagcggttccgcctccgccgcagcgttcgcggaggcttcaaaggtggcgaggcaagagatgtctatgaagttcaattggccgctaggtttagctgccttgctcaagaatggagaaaaataa

SEQ ID NO: 9514 - protein, 97 aa, Sorghum bicolor
  misc_feature: Ceres ANNOT ID no. 6100583
  misc_feature (1)..(38): Pfam Id: Ribosomal_L36 Pfam Desc: Ribosomal protein L36
  misc_feature (1)..(38): NCBI GI: 16329920 NCBI Desc: 50s ribosomal protein l36 [synechocystis sp. pcc 6803]
  misc_feature (1)..(38): NCBI GI: 92393013 NCBI Desc: ribosomal protein l36 [psychrobacter cryohalolentis k5]
  misc_feature (1)..(38): NCBI GI: 85060235 NCBI Desc: 50s ribosomal protein l36 [sodalis glossinidius str. 'morsitans']
  misc_feature (1)..(38): NCBI GI: 71038065 NCBI Desc: ribosomal protein l36 [psychrobacter arcticum 273-4]
  misc_feature (1)..(38): NCBI GI: 16120568 NCBI Desc: 50s ribosomal protein l36 [yersinia pestis co92]
MKVRASVKRLCGFCKVVKRRGIVFIHCTANPKHKQRQGFSTIAEAAAACVHLPPPPPASGSASAAAFAEASKVARQEMSMKFNWPLGLAALLKNGEK

SEQ ID NO: 9515 - DNA, 1152 bp, Sorghum bicolor
  misc_feature: Ceres ANNOT ID no. 6100590
  misc_feature: Encodes the peptide sequence at SEQ ID NO 9516
atggatgaaggccagggagttaggtattggtgccacaggtgtgaggaggtgatagatcctatgcctgagatgaagtgcccaagctgtgacggtgggtttgttgaagagatgggctctgaagacttcgaggcagctacgaacgcaaggtctgatcgctccctctctctcttggctccactgctgtttggtatgttggggggttcgtcccgcagatcaagactcaggagggaggccatggctgacgatgatgctgatgaggatgacgaagaggatgattcagaccatgagcttgaagcttccagtaggaggcggaggaggaggggctcatcagcgcttttgaggatgctccagactatccgtgaccgtgatgacgtaaggggctcggatgacactgacagtgatacagagagagacctggagagagcgagaagggagaggatcgagaggcggatggcgagggagaggattcaggagcggatggagaggcagagagagagggcaaggcaaattgagagagtgagtgctcgtggcagagagaggacagaaagcctaatactgatcaactccaacaatgaggctattattctgcaaggaacatttggatctgatgacaatcaagaggactcaagcaacacaagttctggtgtatcacttggggattactttcttggtcctgccctagatactctcttgcagcgtttggcggagagtgacctcaatcgttctggcacaccacctgccaagaaggaagcagtagctgcgctgccaactgtgaacatcgaggaagtgttgggctgttcagtctgtcttgaggattttgagatgggagcagaagcaaagcagatgccctgtcagcataagttccactcccattgcatacttccatggctggagctccacagttcttgcccaatctgtcgatttcagttgcctactgaggagacgaagaatccatgtgaatcagccagcactgcaggggccatgaacagagatggagacaatgctgctgcaagcagtagtgatacagaaagtagtaaccgcaatggagacaaccattctgatagtcctatcttctctgctctgagcacactcttctctgatccattctcatctgatgatgatgaaagtgttccacactcatctgagaactga

SEQ ID NO: 9516 - protein, 383 aa, Sorghum bicolor
  misc_feature: Ceres ANNOT ID no. 6100590
  misc_feature (266)..(306): Pfam Id: zf-C3HC4 Pfam Desc: Zinc finger, C3HC4 type (RING finger)
  misc_feature (120)..(376): NCBI GI: 92888063 NCBI Desc: zinc finger, ring-type; ringv [medicago truncatula]
  misc_feature (121)..(348): NCBI GI: 38454178 NCBI Desc: at3g13430 [arabidopsis thaliana]
  misc_feature (200)..(332): NCBI GI: 23308365 NCBI Desc: at3g19950/mpn9_19 [arabidopsis thaliana]
  misc_feature (217)..(373): NCBI GI: 92868562 NCBI Desc: zinc finger, ring-type; ringv [medicago truncatula]
  misc_feature (219)..(330): NCBI GI: 31980967 NCBI Desc: rabring 7 [mus musculus]
  misc_feature: The sequence is a functional homolog of SEQ ID NO 1201 in the 10/374,780US patent application
  misc_feature: The sequence is a functional homolog of SEQ ID NO 1549 in the 11/479,226US patent application
  misc_feature: The sequence is a functional homolog of SEQ ID NO 1722 in the 11/479,226US patent application
  misc_feature: Useful for making plants with modulated growth and phenotype characteristics
  misc_feature: The sequence is a functional homolog of SEQ ID NO 1201 in the 20060162006 US patent application
  misc_feature: The sequence is a functional homolog of SEQ ID NO 1549 in the 20070022495 US patent application
  misc_feature: The sequence is a functional homolog of SEQ ID NO 1722 in the 20070022495 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
MDEGQGVRYWCHRCEEVIDPMPEMKCPSCDGGFVEEMGSEDFEAATNARSDRSLSLLAPLLFGMLGGSSRRSRLRREAMADDDADEDDEEDDSDHELEASSRRRRRRGSSALLRMLQTIRDRDDVRGSDDTDSDTERDLERARRERIERRMARERIQERMERQRERARQIERVSARGRERTESLILINSNNEAIILQGTFGSDDNQEDSSNTSSGVSLGDYFLGPALDTLLQRLAESDLNRSGTPPAKKEAVAALPTVNIEEVLGCSVCLEDFEMGAEAKQMPCQHKFHSHCILPWLELHSSCPICRFQLPTEETKNPCESASTAGAMNRDGDNAAASSSDTESSNRNGDNHSDSPIFSALSTLFSDPFSSDDDESVPHSSEN

SEQ ID NO: 9517 - DNA, 840 bp, Sorghum bicolor
  misc_feature: Ceres ANNOT ID no. 6100599
  misc_feature: Encodes the peptide sequence at SEQ ID NO 9518
atgtcggggctctacggccaggggttctcccctgcgcgaaacctctcccctcagattagaagcaatccggatgttgatagtcagtacttggccgagctgctggccgaacaccagaagctggggcctttcatgcaggtgctgcccatatgcaacaagctgctgagccaagagattatgcgggtatcaagcattgtccacaaccatggatttggcgatttcgacaggcatcggtttagaagtcctagtccgatgtcttctccaaaccctagagctaatctccctggcaatgggtttagtccttggagtggactacaagagagattaggttttcctcaaggaactagcatggactggcaaggagcaccaccaagtcctagctcccatgttgtaaagaagattcttcgtctggaggttccagttgattcttatccgaatttcaattttgtgggacgcattttaggacctagaggtaattctctaaagcgcgtagaagcatccactgggtgtcgtgttttcattagaggaaagggttccatcaaagatccagggaaggaggacaaactacgagggaaaccaggctatgagcacctgagtgatccgctgcatatcttgatagaggctgagttccctgccagtatcatcgatgcaagattgagacatgcacaggagattatagaagaattgcttaaaccagtggatgagtctcaagatttctacaaaaggcaacagctcagggagctggcaatgctaaactcaaccctgagagaggacagccctcatcctgggagtgtctctccattcagtaatggtgggatgaaacgtgcgaagacaggccagtag

SEQ ID NO: 9518 - protein, 279 aa, Sorghum bicolor
  misc_feature: Ceres ANNOT ID no. 6100599
  misc_feature (3)..(276): NCBI GI: 24060154 NCBI Desc: kh domain-like protein [oryza sativa (japonica cultivar-group)]
  misc_feature (1)..(276): NCBI GI: 115464523 NCBI Desc: os05g0481500 [oryza sativa (japonica cultivar-group)]
  misc_feature (4)..(232): NCBI GI: 92867398 NCBI Desc: facilitated glucose transporter; kh, type 1 [medicago truncatula]
  misc_feature (5)..(279): NCBI GI: 92893883 NCBI Desc: kh [medicago truncatula]
  misc_feature (8)..(277): NCBI GI: 19310523 NCBI Desc: at1g09660/f21m12_5 [arabidopsis thaliana]
MSGLYGQGFSPARNLSPQIRSNPDVDSQYLAELLAEHQKLGPFMQVLPICNKLLSQEIMRVSSIVHNHGFGDFDRHRFRSPSPMSSPNPRANLPGNGFSPWSGLQERLGFPQGTSMDWQGAPPSPSSHVVKKILRLEVPVDSYPNFNFVGRILGPRGNSLKRVEASTGCRVFIRGKGSIKDPGKEDKLRGKPGYEHLSDPLHILIEAEFPASIIDARLRHAQEIIEELLKPVDESQDFYKRQQLRELAMLNSTLREDSPHPGSVSPFSNGGMKRAKTGQ

SEQ ID NO: 9519 - DNA, 723 bp, Sorghum bicolor
  misc_feature: Ceres ANNOT ID no. 6100600
  misc_feature: Encodes the peptide sequence at SEQ ID NO 9520
atgggtacaaaccctctcctgcaagagctagccgctgtggtagtggcggcggcggattctgaaccaccacggccgcggccgcgcgtggtgcggatcctagtgcacgatgctgacgccaccgattcgtcctccagcgaggatgaggcgcggccgcctcctcggcggagggcgaggggtggcaacagcagcgtcggcgtgaggcgccacgttatggaaccggccggagcaagctcgtccgttcggttccgtggcgtccgtcggaggccgtgggggcgctgggctgcggagatccgcgacccgcacagccgccgccgactgtggctcggcaccttcaacaccgctgaggaggctgccaacgcctacgacgctgcgaacatccgctttcgcggtgccagcgcccctaccaacttccctgcggccagctactcgccgcctccagagccagccaagcctatcatctcgctgactcctgaacccggaaaggtgataaccttaccaccggtacctgtgaagcagaccttccctctgcaggtgaaggaagagggtgggagccgtgacggccaggtcaagggaggtagctcggaggtcaaggcccttccacccaagcgggtgtgggagatgatccccagcaagcgccagaagtatccgggctgtgctgatggctctggcctgcgtgccatccatgctgcctccctctatgtggaggaggttggtggggcctga

SEQ ID NO: 9520 - protein, 240 aa, Sorghum bicolor
  misc_feature: Ceres ANNOT ID no. 6100600
  misc_feature (80)..(131): Pfam Id: AP2 Pfam Desc: AP2 domain
  misc_feature (26)..(176): NCBI GI: 50510280 NCBI Desc: pathogenesis-related genes transcriptional activator pti6-like protein [oryza sativa (japonica cultivar-group)]
  misc_feature (26)..(176): NCBI GI: 115471237 NCBI Desc: os07g0227600 [oryza sativa (japonica cultivar-group)]
  misc_feature (61)..(146): NCBI GI: 38345793 NCBI Desc: osjnba0085i10.10 [oryza sativa (japonica cultivar-group)]
  misc_feature (28)..(141): NCBI GI: 2213785 NCBI Desc: pti6 [lycopersicon esculentum]
  misc_feature (51)..(165): NCBI GI: 115487530 NCBI Desc: os12g0168100 [oryza sativa (japonica cultivar-group)]
  misc_feature: The sequence is a functional homolog of SEQ ID NO 1157 in the 10/374,780US patent application
  misc_feature: The sequence is a functional homolog of SEQ ID NO 12 in the 10/225,068US patent application
  misc_feature: The sequence is a functional homolog of SEQ ID NO 1247 in the 11/479,226US patent application
  misc_feature: The sequence is a functional homolog of SEQ ID NO 136 in the 10/412,699US patent application
  misc_feature: The sequence is a functional homolog of SEQ ID NO 1360 in the 10/412,699US patent application
  misc_feature: The sequence is a functional homolog of SEQ ID NO 168 in the 10/374,780US patent application
  misc_feature: The sequence is a functional homolog of SEQ ID NO 1769 in the 10/374,780US patent application
  misc_feature: The sequence is a functional homolog of SEQ ID NO 1883 in the 10/374,780US patent application
  misc_feature: The sequence is a functional homolog of SEQ ID NO 1884 in the 10/374,780US patent application
  misc_feature: The sequence is a functional homolog of SEQ ID NO 2506 in the 10/374,780US patent application
  misc_feature: The sequence is a functional homolog of SEQ ID NO 325 in the 11/479,226US patent application
  misc_feature: The sequence is a functional homolog of SEQ ID NO 574 in the 10/412,699US patent application
  misc_feature: The sequence is a functional homolog of SEQ ID NO 620 in the 10/225,066US patent application
  misc_feature: The sequence is a functional homolog of SEQ ID NO 628 in the 11/435,388US patent application
  misc_feature: The sequence is a functional homolog of SEQ ID NO 678 in the 10/412,699US patent application
  misc_feature: The sequence is a functional homolog of SEQ ID NO 732 in the 10/225,066US patent application
  misc_feature: Useful for making plants with modulated growth and phenotype characteristics
  misc_feature: The sequence is a functional homolog of SEQ ID NO 136 in the 20040045049 US patent application
  misc_feature: The sequence is a functional homolog of SEQ ID NO 1360 in the 20040045049 US patent application
  misc_feature: The sequence is a functional homolog of SEQ ID NO 574 in the 20040045049 US patent application
  misc_feature: The sequence is a functional homolog of SEQ ID NO 678 in the 20040045049 US patent application
  misc_feature: The sequence is a functional homolog of SEQ ID NO 1769 in the 20060162006 US patent application
  misc_feature: The sequence is a functional homolog of SEQ ID NO 1883 in the 20060162006 US patent application
  misc_feature: The sequence is a functional homolog of SEQ ID NO 1884 in the 20060162006 US patent application
MGTNPLLQELAAVVVAAADSEPPRPRPRVVRILVHDADATDSSSSEDEARPPPRRRARGGNSSVGVRRHVMEPAGASSSVRFRGVRRRPWGRWAAEIRDPHSRRRLWLGTFNTAEEAANAYDAANIRFRGASAPTNFPAASYSPPPEPAKPIISLTPEPGKVITLPPVPVKQTFPLQVKEEGGSRDGQVKGGSSEVKALPPKRVWEMIPSKRQKYPGCADGSGLRAIHAASLYVEEVGGA

SEQ ID NO: 9521 - DNA, 1107 bp, Sorghum bicolor
  misc_feature: Ceres ANNOT ID no. 6100601
  misc_feature: Encodes the peptide sequence at SEQ ID NO 9522
atggagagggagctgctggagacgttcgatgcggccaagaaggcggccgacgctacggcagcggacggcgactcgccggaggctgaccgctgcctcgacgcgctgcgccggctgcgcgacatacgcgtcaacaccgacatcctcgtctccacgcaggttggcaaacgtctccgaccccttactaagcaccctcactcaggcatccaggcggtcgctgcagacctttttgggtactggaaaaaggttgtccttgaagagtcaggaaagaaaaatggtggctcagagaatgaaagatcaagtgactcttctggaaaggttgagaaggtgagacccatgaaggttgaaaagaattctgcatcagcaagcatgaaggttgagaaaagagatgtggatgttaggggtcagaagcctggcagtgtcaaagttgagaagaccgctagcaatggttccagaactcaatctgtgaaggtcgaaagggtatccaaagaagtcagtagaactccagatgcaaagaagccagcatccacccccagcggtgccccaaagcttacatctcttgtcaaatgcaatgatcctactcgagataaaatccgggaactacttgctgaagcttttgcaaaggtttccagagagactagtaatgatgaccgagatgaagtgagaaacatcttggatgaagttgatgcatgtgacccatacagagttgctgtgaaagtagagtctgcactatttgagaggcttggacgttccactggggctcacaagacaaagtacaggtcaatcatgttcaacctgagggctgaaaacaacactgatttccggagaagggttcttattggtgaagtgacgccagaggggcttccagacatatctcctgatgagatggctagtgatgcaaggaagcaagagaatatgcagattaaggagaaggctctgtttgagtgtgagcgggcaggagctccaaaggcaacgacggatcagttcaagtgtggcagatgtggtcagcggaagacaacttactatcagctgcagactcggagtgccgatgaaccaatgacgacattcgtcacgtgtgtgaactgcaacaatcattggaagttctgctga

SEQ ID NO: 9522 - protein, 368 aa, Sorghum bicolor
  misc_feature: Ceres ANNOT ID no. 6100601
  misc_feature (189)..(317): Pfam Id: TFIIS_M Pfam Desc: Transcription factor S-II (TFIIS), central domain
  misc_feature (328)..(366): Pfam Id: TFIIS_C Pfam Desc: Transcription factor S-II (TFIIS)
  misc_feature (1)..(93): Pfam Id: TFIIS Pfam Desc: Transcription elongation factor S-II protein N terminal
  misc_feature (1)..(368): NCBI GI: 115471257 NCBI Desc: os07g0229700 [oryza sativa (japonica cultivar-group)]
  misc_feature (151)..(368): NCBI GI: 119595574 NCBI Desc: transcription elongation factor a (sii), 2, isoform cra_a [homo sapiens]
  misc_feature (151)..(368): NCBI GI: 38505156 NCBI Desc: transcription elongation factor a protein 2 isoform b [homo sapiens]
  misc_feature (143)..(368): NCBI GI: 41055847 NCBI Desc: similar to transcription elongation factor a (sii), 2 [danio rerio]
  misc_feature (161)..(368): NCBI GI: 6678235 NCBI Desc: transcription elongation factor a protein 2 [mus musculus]
  misc_feature: Useful for making plants with altered terpenoid content
  misc_feature: GREAT-hit functional homolog of the protein sequence given in SEQ ID NO 13334
MERELLETFDAAKKAADATAADGDSPEADRCLDALRRLRDIRVNTDILVSTQVGKRLRPLTKHPHSGIQAVAADLFGYWKKVVLEESGKKNGGSENERSSDSSGKVEKVRPMKVEKNSASASMKVEKRDVDVRGQKPGSVKVEKTASNGSRTQSVKVERVSKEVSRTPDAKKPASTPSGAPKLTSLVKCNDPTRDKIRELLAEAFAKVSRETSNDDRDEVRNILDEVDACDPYRVAVKVESALFERLGRSTGAHKTKYRSIMFNLRAENNTDFRRRVLIGEVTPEGLPDISPDEMASDARKQENMQIKEKALFECERAGAPKATTDQFKCGRCGQRKTTYYQLQTRSADEPMTTFVTCVNCNNHWKFC

SEQ ID NO: 9523 - DNA, 1641 bp, Sorghum bicolor
  misc_feature: Ceres ANNOT ID no. 6100605
  misc_feature: Encodes the peptide sequence at SEQ ID NO 9524
atgacacaagctaagcctgcccctggtggcaagaggaactggagcagtagtgggactgccgctggaaggaagaacaaggatagaggagatgacaaagcaaaaggaaccagggttgctggttggaacaagggcgacaagaagaaagaagacagagggcgccaagtaagcgtgggatcgacgaggggacggagtgagggagtgccccgggttggtatgaagagggctgtgtctgggcttgacaggaggaaaaggaagatcgatgacgactcgtgggatggtggtggcggtggtggcaagaatgtttcgtcttccaaatcaaggttttccagaaagactgcttccacgataagccaccgaaaggtttctcctggaaaagatgacagattgaagtctcagagtttgtatgaggatgactaccgtgcagggaaaaggagtaccagcaaagtttctgatattagtagagggatcaagagtcgactggtgaactctgtagcatccaaagggaagaagttcgatgcaaccaaagaagtcaggcgtacaaagaagggtggtgctaaagaagttgatttggatgaggaagctgctgatagcaacaagtcagatgactcgggtcttattactgaagaagagaagcctcgccctcgcctaactcgagtactggaccggactgggaagaaaataaagcctgctaagaaggttgtagttcctgacattgaggaacctgctcctcctaagaagagaaagcgaatgaagctagatccttatgatacttcgaacaaaaggattgaagattctcctatccaggatgcgaaggttctcgtgaattgtacacctgaagaagagactgaaatgtcaataaatgcaaaatttcgtgctatacagccaagttcctcaatcctttcatatgtggaagataatttactaggtcgtaggcgtttaaatgagataaaaaatgctggctacaatgtcaagatttcttctcctctggataatgttcctttctcaaccagcacagaacgtgaacgcatagaagaaagtgagttcagaaataagctggagttctttgctgctgcaaagatctcttcctcattccccgctccaacgctcccagagatagcatttgcaggtgtatcaaatgttggtaaatcctcactcctcaattcacttacaagacagtggggtgttgtgcgaacatcagataagcctggacttactcagacaataaatttctttcgacttgcatcaaagttatgtcttgttgatttacctggatatggttttgcttatgcaaaggacgaagttaaggagtcgtgggaggagcttgtgaaggaatatgtttcgaccagagttggcctagaaagagtgtgccttcttgttcacactaaacgaggaatgaaaccattggactatgagcttgtagatttaatggaaaggcacaagacgccataccagattgtactgacaaagactgatttagttttcccaatagatgtcgctcgccgtgccatggaaatccaagagagcctgaagaggaacaagtcagtggtaaacccagtgatgatggtgagctctaaaacaggagctggcatccgcaacctgagaggggtgctgggaaagttagctcgcttcatcaaaccgtag

SEQ ID NO: 9524 - protein, 546 aa, Sorghum bicolor
  misc_feature: Ceres ANNOT ID no. 6100605
  misc_feature (370)..(491): Pfam Id: MMR_HSR1 Pfam Desc: GTPase of unknown function
  misc_feature (348)..(541): NCBI GI: 84704992 NCBI Desc: gtp-binding protein [parvularcula bermudensis htcc2503]
  misc_feature (338)..(546): NCBI GI: 58040259 NCBI Desc: probable gtp-binding protein engb [gluconobacter oxydans 621h]
  misc_feature (338)..(546): NCBI GI: 81556980 NCBI Desc: probable gtp-binding protein engb
  misc_feature (323)..(540): NCBI GI: 69933089 NCBI Desc: small gtp-binding protein domain:gtp-binding [paracoccus denitrificans pd1222]
  misc_feature (348)..(540): NCBI GI: 89361338 NCBI Desc: small gtp-binding protein domain:gtp-binding [xanthobacter autotrophicus py2]
MTQAKPAPGGKRNWSSSGTAAGRKNKDRGDDKAKGTRVAGWNKGDKKKEDRGRQVSVGSTRGRSEGVPRVGMKRAVSGLDRRKRKIDDDSWDGGGGGGKNVSSSKSRFSRKTASTISHRKVSPGKDDRLKSQSLYEDDYRAGKRSTSKVSDISRGIKSRLVNSVASKGKKFDATKEVRRTKKGGAKEVDLDEEAADSNKSDDSGLITEEEKPRPRLTRVLDRTGKKIKPAKKVVVPDIEEPAPPKKRKRMKLDPYDTSNKRIEDSPIQDAKVLVNCTPEEETEMSINAKFRAIQPSSSILSYVEDNLLGRRRLNEIKNAGYNVKISSPLDNVPFSTSTERERIEESEFRNKLEFFAAAKISSSFPAPTLPEIAFAGVSNVGKSSLLNSLTRQWGVVRTSDKPGLTQTINFFRLASKLCLVDLPGYGFAYAKDEVKESWEELVKEYVSTRVGLERVCLLVHTKRGMKPLDYELVDLMERHKTPYQIVLTKTDLVFPIDVARRAMEIQESLKRNKSVVNPVMMVSSKTGAGIRNLRGVLGKLARFIKP

SEQ ID NO: 9525 - DNA, 1578 bp, Sorghum bicolor
  misc_feature: Ceres ANNOT ID no. 6100621
  misc_feature: Encodes the peptide sequence at SEQ ID NO 9526
atgggcatggctgctccgcgcgcaccgctacctcttccccagttgctgctcctcgtcgtcgccgcgctcctcgccgccgctcccctccttcatagggcggccggggcggaggacttcgacgtccggcgccacctctccaccgtcaccaggtatgatgtggccagagagtccaggggtgtcatctccatgccgtcaatcccagacgggtgccgtgtcgttcacctcaatctagtggcaagacatgggactcgtgctcctaccaagaagcgaatcaaggagctggatagattggcagttcgactggaagcccttatgaaagaggcaaaccatggccttgatagtgattctctgaagaaaattccatcctggattaaaggctgggaatcacgttggaagggtaggactaaaggtggtgagctgattagtgaaggggaagaggagctgtacaatttagctacaagagtgagggagaggtttcaagatctacttgacgacgaatatcaccctgatgtatattcaataagagcaactcaggttcctcgagcatcagctagtgccgtggcatttggtttgggactactttctgggaaaggaaagcttggacaagggaagaaccgtgccttttctgttctgagtgagagtcgtgcaagtgatatttgtctgagattctttgacagctgtgagacatacaaggcatataggaaaaggaaggagcctgatgtagagaagcaaaaggaaccaattctagagcatgtcacagctgctcttgccaatcgttatcacctaaaatttacaactcaggatgtttcttccctctggtttctttgtaagcaggaagcatctttgttgaatataaccaatcaagcttgtgggcttttcaatgaagccgaggttcgttttctagagtggacagatgatttggagggttttgtcctaaaaggctatggtgagtcaattaactacaggatgggactgccattgctcaaggatgttgtccagtcaatggaagaagcaataatagctagagaagaaaaccaccctgatggtacgtatgaaaaggcaaggcttcgatttgcacatgcagaaactgttgttccttttagctgtcttctcggtctttttcttgaaggtccagactttgagaagatacagagggaggaagcgttggacctaccccctttgccgccacagggaagaaactggaagggcagtgttgttgcgccttttgctggtaacaacatgctggctttataccaatgcccaagcaaaatttcggatggcagcgcaacctctggaggccaaagtaactcatacttcattcaagttctacacaacgaagccccaatttcaatgcctgggtgcggcaacaaagatttctgtccattcgaggagttcaaggagaagattgtgaaaccgcacctgaagcacgactacaacatgatatgcaagatcaaatccccggcggcaagcgaggagcccgcctcgttcccctccagagtgtccagtttcttcgtaggactcttctcgcagagagggtaccacgccgtgggcgctgaaggcgtcaagaccgagctgtag

SEQ ID NO: 9526 - protein, 525 aa, Sorghum bicolor
  misc_feature: Ceres ANNOT ID no. 6100621
  misc_feature (71)..(445): Pfam Id: Acid_phosphat_A Pfam Desc: Histidine acid phosphatase
  misc_feature (3)..(525): NCBI GI: 116294385 NCBI Desc: multiple inositol polyphosphate phosphatase phyiic [triticum aestivum]
  misc_feature (3)..(525): NCBI GI: 116294379 NCBI Desc: multiple inositol polyphosphate phosphatase phyiia1 [triticum aestivum]
  misc_feature (3)..(525): NCBI GI: 116294383 NCBI Desc: multiple inositol polyphosphate phosphatase phyiib [triticum aestivum]
  misc_feature (3)..(525): NCBI GI: 116294381 NCBI Desc: multiple inositol polyphosphate phosphatase phyiia2 [triticum aestivum]
  misc_feature (8)..(525): NCBI GI: 116294375 NCBI Desc: multiple inositol polyphosphate phosphatase phyiia2 [hordeum vulgare]
MGMAAPRAPLPLPQLLLLVVAALLAAAPLLHRAAGAEDFDVRRHLSTVTRYDVARESRGVISMPSIPDGCRVVHLNLVARHGTRAPTKKRIKELDRLAVRLEALMKEANHGLDSDSLKKIPSWIKGWESRWKGRTKGGELISEGEEELYNLATRVRERFQDLLDDEYHPDVYSIRATQVPRASASAVAFGLGLLSGKGKLGQGKNRAFSVLSESRASDICLRFFDSCETYKAYRKRKEPDVEKQKEPILEHVTAALANRYHLKFTTQDVSSLWFLCKQEASLLNITNQACGLFNEAEVRFLEWTDDLEGFVLKGYGESINYRMGLPLLKDVVQSMEEAIIAREENHPDGTYEKARLRFAHAETVVPFSCLLGLFLEGPDFEKIQREEALDLPPLPPQGRNWKGSVVAPFAGNNMLALYQCPSKISDGSATSGGQSNSYFIQVLHNEAPISMPGCGNKDFCPFEEFKEKIVKPHLKHDYNMICKIKSPAASEEPASFPSRVSSFFVGLFSQRGYHAVGAEGVKTEL

SEQ ID NO: 9527 - DNA, 993 bp, Sorghum bicolor
  misc_feature: Ceres ANNOT ID no. 6100622
  misc_feature: Encodes the peptide sequence at SEQ ID NO 9528
atggcaagcggggaacaaggcaagggggagacggtgctggtcaccggcgccagcggcttcatcggctcgaccctcgtccgaggcctccttggccgcggctacaacgtccgcgccggcgtcctcaaccccgatgacagggcggagacggaccacctcctcgatctcgccgccggcgccggcgacggccgcctcagcttcttccgctgcgacctcctggacggcgccgcgctgctcgacgccgcgcgcgggtgctcgggtatcttccacctcgcgtcgccctgcaccgtcgaccccgtcaaggacccccagaatcagctgatggtgcccgcggtggaagggacgcggaacgtggtgcgcgcggccaaggacgccggcggagtgcggcgggtggtggtgacctcgtccatctcggccatggtgcccagccccgggtggcccgccggggaggtcctcgacgagcgttgctggaccgacatcgactactgcgagaagaacggggtttggtaccctgcttcgaaagcactggcagagaaggcagcgtggaagtttgcagaggagaacgggctagatgtggttgtggttaaccctgggactgtgctgggcccgatgattccaccagccatcaacgctagcatggccatgttttgtcgcctccttcaaggctgcacagaggagtatgccgatttcttcataggaccagtacacgtggaagacgttgccatggcgcatatcatggtgttcgagaacccatcggcgtcggggaggcatatgtgcgtccagtccatctgtcactggagcgacttcgcggtcaaggtcgccgagctctaccccaactacaaagtgcccaagttccctaaggacacccagcctgggctggtgagacaagaggtaggctccaagaagctcatcgcgctggggcttcagatcactcccatggagaagatcatcagggatgccgtggagagcctcgagagcagaggccacatctcctga

SEQ ID NO: 9528 - protein, 330 aa, Sorghum bicolor
  misc_feature: Ceres ANNOT ID no. 6100622
  misc_feature (12)..(260): Pfam Id: Epimerase Pfam Desc: NAD dependent epimerase/dehydratase family
  misc_feature (13)..(286): Pfam Id: 3Beta_HSD Pfam Desc: 3-beta hydroxysteroid dehydrogenase/isomerase family
  misc_feature (14)..(244): Pfam Id: NAD_binding_4 Pfam Desc: Male sterility protein
  misc_feature (10)..(151): Pfam Id: adh_short Pfam Desc: short chain dehydrogenase
  misc_feature (10)..(329): NCBI GI: 68159360 NCBI Desc: cinnamoyl-coa reductase [acacia mangium x acacia auriculiformis]
  misc_feature (1)..(329): NCBI GI: 92897570 NCBI Desc: lipocalin [medicago truncatula]
  misc_feature (105)..(329): NCBI GI: 115440809 NCBI Desc: os01g0828100 [oryza sativa (japonica cultivar-group)]
  misc_feature (2)..(329): NCBI GI: 31414896 NCBI Desc: cinnamoyl coa reductase [fragaria x ananassa]
  misc_feature (1)..(330): NCBI GI: 17978649 NCBI Desc: cinnamoyl-coa reductase [pinus taeda]
  misc_feature: Useful for making plants with altered cell wall content and/or composition
  misc_feature: GREAT-hit functional homolog of the protein sequence encoded by LOCUS at5g58490
  misc_feature: Useful for making plants with altered cell wall content and/or composition
  misc_feature: Functional homolog of the protein sequence given in SEQ ID NO 14052
MASGEQGKGETVLVTGASGFIGSTLVRGLLGRGYNVRAGVLNPDDRAETDHLLDLAAGAGDGRLSFFRCDLLDGAALLDAARGCSGIFHLASPCTVDPVKDPQNQLMVPAVEGTRNVVRAAKDAGGVRRVVVTSSISAMVPSPGWPAGEVLDERCWTDIDYCEKNGVWYPASKALAEKAAWKFAEENGLDVVVVNPGTVLGPMIPPAINASMAMFCRLLQGCTEEYADFFIGPVHVEDVAMAHIMVFENPSASGRHMCVQSICHWSDFAVKVAELYPNYKVPKFPKDTQPGLVRQEVGSKKLIALGLQITPMEKIIRDAVESLESRGHIS

SEQ ID NO: 9529 - DNA, 987 bp, Sorghum bicolor
  misc_feature: Ceres ANNOT ID no. 6100623
  misc_feature: Encodes the peptide sequence at SEQ ID NO 9530
atggcgggggagacggtgctggtcaccggcgccagcggcttcatcggctccaccctcgtccgcctcctcctcggccgtggctacaacgtccacgccggcgttctcaaccccgatgacaaggcggagacggagcacctgctcgccctggccgccggcgccggcgagggcgagggccgcctccgcatcttccgcggcgacctcctcgacggcgccgcgctgatcgacgccgcgcggggctgctcgggtgtcttccacctcgcctcgccctgcatcgtcgacgccgtcagcgacccccagaagcaactgatagtgccggcggtggaagggacgctgaacgtgctgcgcgccgccaaggaggccgggagcgtgcggcgggtggtggtcacctcgtccagctgcgccatcatgcccagccccgggtggcccgccggcgaggtccgggacgagcgctgctggactgacatcgactacagcgagaagaacggggtttggtaccctgtttccaagacgctggcagagaaggcagcgtggaaatttgcagaggagaacggagtagatgtggttgtggttaatccaacgtctgtcctgggcacgataatcccaccaaccatcaattctagcatgtccgtgcttctacgcctccttcaaggttgcacagaggagtacaaggacatatggatgggggcagtccatgtggaagacgttgccttggcccatctcctggtgttcgagaacccatcagcttccgggaggcacatctgcgccgagtccatcaatcacttgagcgacttcgcggccaaactcgccgagctctaccccagctacaaagtgcccaagttccccaaggatacccagcctgggcttgtgagagcagaagcggaggtggcggcgaaaaagctcgttgcactagggctgcagttcaggcccctggagaagatcatcagggatgccgtggagagcctcaagagcagaggttacatttcgtag

SEQ ID NO: 9530 - protein, 328 aa, Sorghum bicolor
  misc_feature: Ceres ANNOT ID no. 6100623
  misc_feature (6)..(255): Pfam Id: Epimerase Pfam Desc: NAD dependent epimerase/dehydratase family
  misc_feature (7)..(282): Pfam Id: 3Beta_HSD Pfam Desc: 3-beta hydroxysteroid dehydrogenase/isomerase family
  misc_feature (8)..(239): Pfam Id: NAD_binding_4 Pfam Desc: Male sterility protein
  misc_feature (4)..(151): Pfam Id: adh_short Pfam Desc: short chain dehydrogenase
  misc_feature (4)..(327): NCBI GI: 68159360 NCBI Desc: cinnamoyl-coa reductase [acacia mangium x acacia auriculiformis]
  misc_feature (4)..(327): NCBI GI: 92897570 NCBI Desc: lipocalin [medicago truncatula]
  misc_feature (101)..(327): NCBI GI: 115440809 NCBI Desc: os01g0828100 [oryza sativa (japonica cultivar-group)]
  misc_feature (3)..(328): NCBI GI: 57282092 NCBI Desc: cinnamoyl-coa reductase [linum album]
  misc_feature (1)..(326): NCBI GI: 60265618 NCBI Desc: cinnamyl alcohol dehydrogenase 1 [nicotiana tabacum]
  misc_feature: Useful for making plants with altered cell wall content and/or composition
  misc_feature: Functional homolog of the protein sequence encoded by LOCUS at2g02400
  misc_feature: Functional homolog of the protein sequence encoded by LOCUS at5g58490
  misc_feature: Useful for making plants with altered cell wall content and/or composition
  misc_feature: Functional homolog of the protein sequence given in SEQ ID NO 14052
MAGETVLVTGASGFIGSTLVRLLLGRGYNVHAGVLNPDDKAETEHLLALAAGAGEGEGRLRIFRGDLLDGAALIDAARGCSGVFHLASPCIVDAVSDPQKQLIVPAVEGTLNVLRAAKEAGSVRRVVVTSSSCAIMPSPGWPAGEVRDERCWTDIDYSEKNGVWYPVSKTLAEKAAWKFAEENGVDVVVVNPTSVLGTIIPPTINSSMSVLLRLLQGCTEEYKDIWMGAVHVEDVALAHLLVFENPSASGRHICAESINHLSDFAAKLAELYPSYKVPKFPKDTQPGLVRAEAEVAAKKLVALGLQFRPLEKIIRDAVESLKSRGYIS

SEQ ID NO: 9531 - DNA, 1197 bp, Sorghum bicolor
  misc_feature: Ceres ANNOT ID no. 6100635
  misc_feature: Encodes the peptide sequence at SEQ ID NO 9532
atggtgctggatctcaatgtagcgtcgccggcggactcgggcacgtcgagctcgtccgtcctcaactccgcgaacggcggcttccggttcggtctgctcgggagccccgtcgacgacgacgactgctccggcgagatggcgccgggcgcgtccacggggttcatgacgcggcagctcttcccgtccccgaccccgccggccgagccggagccggagccgccggcggcgccggtgccggtgtggcagccacggcgcgccgaggatctcggcgtggcacagaggccggtggcgcccgcgaagaagacgcggcgtgggccgaggtcgcgcagctcgcagtacaggggcgtcaccttctacaggaggacgggccgctgggagtcgcacatctgggcgtacgatcgagctgcgatcaagttccgcggcctcgaggcggacatcaacttcagtctgggcgactacgaggatgatttaaagcagatgaggaattggaccaaggaggaattcgtgcacatactccggcggcagagcacagggttcgcgaggggaagctcgaagtaccgtggcgtgacgctgcacaagtgcggccgctgggaagctaggatggggcaacttcttggcaagaagtacatctatcttgggctctttgacagtgaagttgaagcggcaagggcttatgacagggcagcccttcgcttcaatgggagggaagctgttactaactttgagcctagctcctacaatgcaggagacaatagcctgcctgacaccgaaactgaggcaattgttgatcgtgatgccattgatttggatttgcggatttcacaacctaatgtgcaagatcccaaaaggggactataccttaaccagcctccaccaatgagctcatcatccccatggcccgggtatcagcaaaacccagcagtgtcatctcaccatcagcatttgtactcgtcagcctgtcatggctcctttccgaaccaccaggtgcaggaaaggccaatggagcgaaggcctgagctgggtgcccagccattccccacctgggcatggcaaacgcagggctcccctcacgtgccgttgcaccactctgcagcatcatcaggattctcgaccgccgccggggcgaacggcggcatgccgctgccgtctcacccgccggcgccgttcccgactacaaacccgttcttcttcccctag

SEQ ID NO: 9532 - protein, 398 aa, Sorghum bicolor
  misc_feature: Ceres ANNOT ID no. 6100635
  misc_feature (184)..(235): Pfam Id: AP2 Pfam Desc: AP2 domain
  misc_feature (131)..(398): NCBI GI: 2944040 NCBI Desc: indeterminate spikelet 1 [zea mays]
  misc_feature (131)..(398): NCBI GI: 53830021 NCBI Desc: floral homeotic protein [triticum aestivum subsp. spelta]
  misc_feature (131)..(377): NCBI GI: 53801434 NCBI Desc: floral homeotic protein [triticum monococcum]
  misc_feature (131)..(377): NCBI GI: 53830033 NCBI Desc: floral homeotic protein [triticum urartu]
  misc_feature (131)..(377): NCBI GI: 53830029 NCBI Desc: floral homeotic protein [triticum aestivum]
  misc_feature: The sequence is a functional homolog of SEQ ID NO 467 in the 10/374,780US patent application
  misc_feature: Useful for making plants with altered alkaloid content
  misc_feature: Useful for making plants with modulated biomass
  misc_feature: Useful for making plants with modulated growth and phenotype characteristics
  misc_feature: Useful for making plants with modulated seed size
  misc_feature: Useful for making plants with modulated nitrogen use efficiency
  misc_feature: Functional homolog of the protein sequence given in SEQ ID NO 13222
  misc_feature: GREAT-hit functional homolog of the protein sequence given in SEQ ID NO 13414
  misc_feature: Functional homolog of the protein sequence given in SEQ ID NO 13481
  misc_feature: The sequence is a functional homolog of SEQ ID NO 467 in the 20060162006 US patent application
  misc_feature: Useful for making plants with modulated biomass
  misc_feature: Functional homolog of the protein sequence given in SEQ ID NO 13414
  misc_feature: Useful for biocontainment applications
  misc_feature: Functional homolog of the protein sequence given in SEQ ID NO 14008
  misc_feature: Useful for making plants with altered alkaloid content
  misc_feature: Functional homolog of the protein sequence given in SEQ ID NO 13222
  misc_feature: The sequence is a functional homolog of SEQ ID NO. 274 in the 11/188,298 US application
MVLDLNVASPADSGTSSSSVLNSANGGFRFGLLGSPVDDDDCSGEMAPGASTGFMTRQLFPSPTPPAEPEPEPPAAPVPVWQPRRAEDLGVAQRPVAPAKKTRRGPRSRSSQYRGVTFYRRTGRWESHIWAYDRAAIKFRGLEADINFSLGDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNSLPDTETEAIVDRDAIDLDLRISQPNVQDPKRGLYLNQPPPMSSSSPWPGYQQNPAVSSHHQHLYSSACHGSFPNHQVQERPMERRPELGAQPFPTWAWQTQGSPHVPLHHSAASSGFSTAAGANGGMPLPSHPPAPFPTTNPFFFP

SEQ ID NO: 9533 - DNA, 1590 bp, Sorghum bicolor
  misc_feature: Ceres ANNOT ID no. 6100659
  misc_feature: Encodes the peptide sequence at SEQ ID NO 9534
atggctgccaccggcgtggtcgccgagcccaagaccaagtacgatcgccagctcaggatatggggtgaccaaggccaggctgcactggaaaaggctagcatatgcttgcttaactgtggtcctactggaacagaagctttgaagaatcttgttcttggaggaataggaagtgtgactgttgttgatggctccaaagttgaagcatctgatctggggaacaattttctgttggatgaaggatgtttggggcaaccaagagctaaatctatatgttctttcctacaagagcttaatgacgctgttaaagccaagtttgttgaggagtttccagcgcatttgatagacactaacccctcgttcttttcccaatttactgttgtcattgctacccagcttccagagagttctttactgaagctagatgatatctgcaggaaagcagatattgttttggttgctgcacgttcatatggtctaaccggtttggtcagggttagcgtcaaggagcactgtgtcatagaatcaaaaccagaccacttcttggatgatttgcgacttcacaatccatggactgaactaaagcaatttgcaaaatcaattgacataaatgataaagatcctgttgtccacaaacatactccatacattgttatccttgtgagacttgcagaaaaatgggcagatgcacatgatggtaacatgccgtcaactaggcaagagaaaaaggaatttaaggacctaattcgagcccatatgcttaatatagatgaagaaaattacaaagaagctgtggactcttcgtataaagtctcagtcactccaggaatcagtaatgagatccgtcagataattgatgatgactctgcggaagtcaattcatcatcgtcagatttctggattttagtggctgctttaaaggaatttattgcaaaggagggcaatggtgagctacctctggagggaacaatacctgatatgacttcccttactgagtattatgtaagcctacaaaagatttaccaagctaaggcggaatttgactgtcttgccctggagcatcatgtaaaggaaatcttgaaacggattggcagagatccggattctatttcaagagcatatatcaaaacattttgtaaaaattctaggaaactaaggatttgtagatatcgtagtttcgaggaggaatttagctctccgatggtctctgagattcagaggtatttcaccgatgaagactacagttacgcaatgaacttctacattctactacgggctgttgatcgattggctgccaattatagcagattacctggagtcttcgacagtgagattgatgaggatatccctaggctgaagacagttgcggcttcagtgctaagtgagatgggtttgaacggagcatccttatccgaagacctgataaccgaaatgtgccggttcgggggtgcagaaatccatcctgtggctgcttttgtcggtggagtcgcttcgcaagaagtaattaagctggtcaccaagcagtttgtgcccttgcggggaacattcatatttaatggaatcgacctcaaatctcaagttttggtgctataa

SEQ ID NO: 9534 - protein, 529 aa, Sorghum bicolor
  misc_feature: Ceres ANNOT ID no. 6100659
  misc_feature (30)..(166): Pfam Id: ThiF Pfam Desc: ThiF family
  misc_feature (7)..(529): NCBI GI: 15215702 NCBI Desc: at1g05180/yup8h12_21 [arabidopsis thaliana]
  misc_feature (19)..(193): NCBI GI: 113205180 NCBI Desc: thif family protein [solanum demissum]
  misc_feature (7)..(414): NCBI GI: 79323968 NCBI Desc: catalytic [arabidopsis thaliana]
  misc_feature (113)..(529): NCBI GI: 42571341 NCBI Desc: auxin-resistance protein axr1 (axr1) [arabidopsis thaliana]
  misc_feature (113)..(518): NCBI GI: 79316761 NCBI Desc: axr1 (auxin resistant 1); ubiquitin-like activating enzyme [arabidopsis thaliana]
  misc_feature: Useful for making plants with modulated biomass
  misc_feature: Functional homolog of the protein sequence given in SEQ ID NO 14055
MAATGVVAEPKTKYDRQLRIWGDQGQAALEKASICLLNCGPTGTEALKNLVLGGIGSVTVVDGSKVEASDLGNNFLLDEGCLGQPRAKSICSFLQELNDAVKAKFVEEFPAHLIDTNPSFFSQFTVVIATQLPESSLLKLDDICRKADIVLVAARSYGLTGLVRVSVKEHCVIESKPDHFLDDLRLHNPWTELKQFAKSIDINDKDPVVHKHTPYIVILVRLAEKWADAHDGNMPSTRQEKKEFKDLIRAHMLNIDEENYKEAVDSSYKVSVTPGISNEIRQIIDDDSAEVNSSSSDFWILVAALKEFIAKEGNGELPLEGTIPDMTSLTEYYVSLQKIYQAKAEFDCLALEHHVKEILKRIGRDPDSISRAYIKTFCKNSRKLRICRYRSFEEEFSSPMVSEIQRYFTDEDYSYAMNFYILLRAVDRLAANYSRLPGVFDSEIDEDIPRLKTVAASVLSEMGLNGASLSEDLITEMCRFGGAEIHPVAAFVGGVASQEVIKLVTKQFVPLRGTFIFNGIDLKSQVLVL

SEQ ID NO: 9535 - DNA, 444 bp, Sorghum bicolor
  misc_feature: Ceres ANNOT ID no. 6100662
  misc_feature: Encodes the peptide sequence at SEQ ID NO 9536
atggcgaacgcggcgtccggcgtggcggtggcggaggagtgcgtggcgcggttccaggagctgcgcggcggccgcgcgcaccgcttcgtggtgttcaaggtcgacgacgcgctgcagcgtgtggtggtggacaaggtgggcgaacggggcgccgggttcggcgacctcaccgccagcctccccgccgacgactgccgctacgccgtgtacgaccacgacttcaccgtcgaggacgccaccgccaccggggaggcgcaggcggcgccgcgcagcaagatcttcttcgtggcctggtcccctgaggcggcggccgtgcggagcaagatggtgtacgctagctcctgcgacggcttcaggaaggagctggacggcgtgcaggtggacctccaggccaccgagcccagcgagctgacgctcgacgtcctcaacgaccacgcatcctga

SEQ ID NO: 9536 - protein, 147 aa, Sorghum bicolor
  misc_feature: Ceres ANNOT ID no. 6100662
  misc_feature (12)..(147): Pfam Id: Cofilin_ADF Pfam Desc: Cofilin/tropomyosin-type actin-binding protein
  misc_feature (1)..(147): NCBI GI: 75243286 NCBI Desc: actin-depolymerizing factor 3 (adf-3) (osadf3)
  misc_feature (1)..(147): NCBI GI: 11066101 NCBI Desc: actin depolymerization factor-like protein [lophopyrum elongatum]
  misc_feature (1)..(147): NCBI GI: 1381154 NCBI Desc: wcor719
  misc_feature (1)..(147): NCBI GI: 89276303 NCBI Desc: actin depolymerizing factor 6 [gossypium hirsutum]
  misc_feature (1)..(147): NCBI GI: 110681458 NCBI Desc: actin-depolymerizing factor [platanus x acerifolia]
  misc_feature: Useful for making plants with modulated time to senescence
  misc_feature: Functional homolog of the protein sequence given in SEQ ID NO 13287
MANAASGVAVAEECVARFQELRGGRAHRFVVFKVDDALQRVVVDKVGERGAGFGDLTASLPADDCRYAVYDHDFTVEDATATGEAQAAPRSKIFFVAWSPEAAAVRSKMVYASSCDGFRKELDGVQVDLQATEPSELTLDVLNDHAS

SEQ ID NO: 9537 - DNA, 777 bp, Sorghum bicolor
  misc_feature: Ceres ANNOT ID no. 6100664
  misc_feature: Encodes the peptide sequence at SEQ ID NO 9538
atgacttcatcaagaagcaacagcaggagcagaagtaggagccgcagtcgcagcaggagcaggagccgcagtcctcggcgaagagataggttgcgcagtgaacgtgcaccccgccgtagtcgcagtcgcagcaggagccgcagcccacaccgtcgcagagaacggcgtggctacagggatcttgtatgcaagaactgccggagacctgggcacttcgctaaggagtgcccatctgcgcctacgtgcaataactgtaaccttccaggccactttgcagcagaatgcacctcacaaactatttgctggaactgcaaagagtctgggcacattgccagtgagtgcaagaatgaggccctgtgccacacctgcaacaagacaggccacttggcacgtgattgccctacttcaggggctaacgttaagctatgcaacaaatgttttaaaccaggccacttcgctgttgactgcaccaatgaacgggcctgcaacaactgccgtcagccagggcacatagctcgggagtgcaagaatgacccggtttgcaacctgtgcaatgtctctggccatgttgcccgcgtctgtccaaagacgactctggcttcagagatacagggtggcccattccgtgatatcctttgccgcatctgtggtcagccagggcacatcagccgcaactgcattgcaaccatcatctgtgacacatgcggtgggagggggcacatgtcttatgagtgcccgtcggccaggatattcgatcgcgggctccgcaggttctga

SEQ ID NO: 9538 - protein, 258 aa, Sorghum bicolor
  misc_feature: Ceres ANNOT ID no. 6100664
  misc_feature (61)..(78): Pfam Id: zf-CCHC Pfam Desc: Zinc knuckle
  misc_feature (80)..(97): Pfam Id: zf-CCHC Pfam Desc: Zinc knuckle
  misc_feature (99)..(116): Pfam Id: zf-CCHC Pfam Desc: Zinc knuckle
  misc_feature (118)..(135): Pfam Id: zf-CCHC Pfam Desc: Zinc knuckle
  misc_feature (141)..(158): Pfam Id: zf-CCHC Pfam Desc: Zinc knuckle
  misc_feature (160)..(177): Pfam Id: zf-CCHC Pfam Desc: Zinc knuckle
  misc_feature (211)..(228): Pfam Id: zf-CCHC Pfam Desc: Zinc knuckle
  misc_feature (230)..(247): Pfam Id: zf-CCHC Pfam Desc: Zinc knuckle
  misc_feature (6)..(258): NCBI GI: 21537255 NCBI Desc: dna-binding protein [arabidopsis thaliana]
  misc_feature (24)..(258): NCBI GI: 9369368 NCBI Desc: f10a5.22 [arabidopsis thaliana]
  misc_feature (18)..(205): NCBI GI: 47026923 NCBI Desc: ring zinc finger protein [hyacinthus orientalis]
  misc_feature (63)..(226): NCBI GI: 44985305 NCBI Desc: afr646wp [eremothecium gossypii]
  misc_feature (63)..(226): NCBI GI: 45199165 NCBI Desc: afr646wp [eremothecium gossypii]
MTSSRSNSRSRSRSRSRSRSRSRSPRRRDRLRSERAPRRSRSRSRSRSPHRRRERRGYRDLVCKNCRRPGHFAKECPSAPTCNNCNLPGHFAAECTSQTICWNCKESGHIASECKNEALCHTCNKTGHLARDCPTSGANVKLCNKCFKPGHFAVDCTNERACNNCRQPGHIARECKNDPVCNLCNVSGHVARVCPKTTLASEIQGGPFRDILCRICGQPGHISRNCIATIICDTCGGRGHMSYECPSARIFDRGLRRF

SEQ ID NO: 9539 - DNA, 1425 bp, Sorghum bicolor
  misc_feature: Ceres ANNOT ID no. 6100666
  misc_feature: Encodes the peptide sequence at SEQ ID NO 9540
atggcgaatgcaagcaagcacttgcaaccttcaagcaatgcaggcaatgacaggaagtaccagggcacgttggtcgcttctccagcaaaggccattgcgcctaagtgtgtgaaccgcatcatgccatcgaagcaactgatcttgggtggggattcaataggccatgtggcatcatttctgattaaagtcgttgctcttgaggcagtcagaagagtttctaaagcaagatgccctttcatttggaattctgttcaagcattgcagatccttgtgtatcctccatttagttggatccaaagatgggcaccactcaaatttctcgtgcagggaattcagaaactatccatgccactgttgtttctgtcagtcacaacaacagtaagtgagctgtcttccaagcgcgacgatgaaccagataacaatacagaacattccgagacgccttctgaaacaaatgaagtggcatcaacttctggtacaagcgatgctgctgatggcacaaaggaaatcgtgcaagagaactggcttgtgttacttttcagggagcttgagaagcaaggcatcactttgcccgagaggtttactgaagatgagttacgcagattttatgtcgctgcaaatggtgacttttcaagtttactctcatcggttaagaagacaattcgttggagggaaacatttcacatacttacattgcaagaacttgataaatggtctcacttagtcttttggcatggatttgacacgatgcttcggccttgtttagtaattcgtctcggacttgcatgctccagcataccacctcgtgacagaccccgtttcgggcaagcagtagtttctcaaattgaccatggtgttgtaaatttgaccaatgaagaagattcaagaattaccgttttgctggattgccatgggatttctccattcagatttccaatgcaaatgatgaggtcatttatcactgtagttcaagaaaattacccgaatcgtcttggtgtattgtttgttatccgccttcctccagttgtcagagttattgcacagacatttcttcaagttttgaaaccatcaacaaagcagaagttacgtttcgagggagattcatacaagaagacattggcagagttcttgcaggttgtgccagcgtttctgggcggtaaatgcagctgcccacaatgtgagaagcctcgtaatagttcagtgatacaggctggggaagggagcaagagccagcctcgcttggtcagcgttgatgacggatcgcctgtcacagacttcgacttcgatgaagaagagatcccatcagcctatagctgcgagaacgccatcagggctgcaataattggcctgctgatgatgtgcatcttcgttgcgtttctggctgggatgaacgatcccacatctgtttcgcccagtgcccagtga

SEQ ID NO: 9540 - protein, 474 aa, Sorghum bicolor
  misc_feature: Ceres ANNOT ID no. 6100666
  misc_feature (241)..(414): Pfam Id: CRAL_TRIO Pfam Desc: CRAL/TRIO domain
  misc_feature (13)..(468): NCBI GI: 42572589 NCBI Desc: sec14 cytosolic factor family protein / phosphoglyceride transfer family protein [arabidopsis thaliana]
  misc_feature (244)..(394): NCBI GI: 51513365 NCBI Desc: sec14l1-prov protein [xenopus tropicalis]
  misc_feature (244)..(404): NCBI GI: 51950014 NCBI Desc: mgc81931 protein [xenopus laevis]
  misc_feature (244)..(404): NCBI GI: 49115203 NCBI Desc: mgc80554 protein [xenopus laevis]
  misc_feature (191)..(384): NCBI GI: 24656360 NCBI Desc: cg32485-pa [drosophila melanogaster]
MANASKHLQPSSNAGNDRKYQGTLVASPAKAIAPKCVNRIMPSKQLILGGDSIGHVASFLIKVVALEAVRRVSKARCPFIWNSVQALQILVYPPFSWIQRWAPLKFLVQGIQKLSMPLLFLSVTTTVSELSSKRDDEPDNNTEHSETPSETNEVASTSGTSDAADGTKEIVQENWLVLLFRELEKQGITLPERFTEDELRRFYVAANGDFSSLLSSVKKTIRWRETFHILTLQELDKWSHLVFWHGFDTMLRPCLVIRLGLACSSIPPRDRPRFGQAVVSQIDHGVVNLTNEEDSRITVLLDCHGISPFRFPMQMMRSFITVVQENYPNRLGVLFVIRLPPVVRVIAQTFLQVLKPSTKQKLRFEGDSYKKTLAEFLQVVPAFLGGKCSCPQCEKPRNSSVIQAGEGSKSQPRLVSVDDGSPVTDFDFDEEEIPSAYSCENAIRAAIIGLLMMCIFVAFLAGMNDPTSVSPSAQ

SEQ ID NO: 9541 - DNA, 375 bp, Sorghum bicolor
  misc_feature: Ceres ANNOT ID no. 6100671
  misc_feature: Encodes the peptide sequence at SEQ ID NO 9542
atggagccgccgccggcgaagacggggctgttcgtggggctgaacaagggccacgtcgtcaccaagcgcaagctccagcctcgcccttccacctacaaaggaaaagctaccaagagggcctgtttcgtaaggcacgtgattagggaaattgctggattagcaccatatgagaagcgcatcactgcgcttctgagggtttgtaaggacaagcgtgctcttaaggtggcgaaaagaaagcttgggacacacaagagagccaagaagaagcatgaagagatgctcaatcttcataggaggaagaggtacgcttctacttctcattcttgtatacttggggaaaattttattgaatttctgaagagaacctgcttttga

SEQ ID NO: 9542 - protein, 124 aa, Sorghum bicolor
  misc_feature: Ceres ANNOT ID no. 6100671
  misc_feature (5)..(103): Pfam Id: Ribosomal_L36e Pfam Desc: Ribosomal protein L36e
  misc_feature (1)..(103): NCBI GI: 57471698 NCBI Desc: ribosomal protein l36 [triticum aestivum]
  misc_feature (1)..(101): NCBI GI: 140060403 NCBI Desc: ribosomal protein l36e [medicago truncatula]
  misc_feature (1)..(101): NCBI GI: 21592383 NCBI Desc: 60s ribosomal protein l36-1 [arabidopsis thaliana]
  misc_feature (1)..(101): NCBI GI: 79314916 NCBI Desc: structural constituent of ribosome [arabidopsis thaliana]
  misc_feature (1)..(101): NCBI GI: 21554932 NCBI Desc: 60s ribosomal protein l36 homolog [arabidopsis thaliana]
MEPPPAKTGLFVGLNKGHVVTKRKLQPRPSTYKGKATKRACFVRHVIREIAGLAPYEKRITALLRVCKDKRALKVAKRKLGTHKRAKKKHEEMLNLHRRKRYASTSHSCILGENFIEFLKRTCF

SEQ ID NO: 9543 - DNA, 789 bp, Sorghum bicolor
  misc_feature: Ceres ANNOT ID no. 6100683
  misc_feature: Encodes the peptide sequence at SEQ ID NO 9544
atggcggcgatgccggcgctcctgctgctgctggtggccgcggcgatgatgctctccccagcgtccgcccgcattcccggcgtgtacggcggcggcggctggcagagcgcgcacgccacgttctacggcggcagtgacgcctcgggcaccatgggcggcgcgtgcggctatggcaacctgtacagccaggggtacggcgtgaacaacgcggcgctgagcacggcgctgttcaacgagggtctgagctgcggcgcgtgcttcgagctcaagtgcgagaaccagcccgggtggcggtggtgccgccccgggagcccctccatcctggtgacggccaccaacttctgcccgccaaactacgcgctcccctccgacgacggcggctggtgcaacccgccacgcccgcacttcgacctcgccatgcccatgttcctccacatcgccgagtaccgcgccggcatcgtccccgtctcctaccgccgggtgccatgccggaagtcaggcggcgtgcggttcaccatcaacggcttccggtacttcaacctggtgctgatcacgaacgtggccggcgcgggtgacatcgtgcgcgcgagcgtgaaggcgtccagcaccgggtggctgaccatgtcccggaactggggccagaactggcagtccaacgccatcctcgtcggccaggcgctctccttccgcgtcaccggcagcgatcgccgcacctccacatcctggaacgccgccccgcgcaactggcagttcggccagaccttcgagggcaagaacttcagggtctga

SEQ ID NO: 9544 - protein, 262 aa, Sorghum bicolor
  misc_feature: Ceres ANNOT ID no. 6100683
  misc_feature (69)..(158): Pfam Id: DPBB_1 Pfam Desc: Rare lipoprotein A (RlpA)-like double-psi beta-barrel
  misc_feature (169)..(246): Pfam Id: Pollen_allerg_1 Pfam Desc: Pollen allergen
  misc_feature (1)..(262): NCBI GI: 7407663 NCBI Desc: alpha-expansin osexpa7 [oryza sativa]
  misc_feature (1)..(262): NCBI GI: 75243647 NCBI Desc: expansin-a7 precursor (osexpa7) (alpha-expansin-7) (osexp7) (osaexpa1.26)
  misc_feature (2)..(262): NCBI GI: 44894794 NCBI Desc: expansin expa9 [triticum aestivum]
  misc_feature (4)..(262): NCBI GI: 732905 NCBI Desc: orf [pisum sativum]
  misc_feature (1)..(262): NCBI GI: 115334948 NCBI Desc: ripening-related expansin [cucumis melo]
  misc_feature: Useful for making plants with altered cell wall content and/or composition
  misc_feature: GREAT-hit functional homolog of the protein sequence encoded by LOCUS at2g28950
  misc_feature: Functional homolog of the protein sequence encoded by LOCUS at2g37640
  misc_feature: GREAT-hit functional homolog of the protein sequence encoded by LOCUS at2g39700
  misc_feature: GREAT-hit functional homolog of the protein sequence encoded by LOCUS at3g55500
  misc_feature: Functional homolog of the protein sequence encoded by LOCUS at5g02260
  misc_feature: Functional homolog of the protein sequence encoded by LOCUS at5g39270
  misc_feature: Functional homolog of the protein sequence encoded by LOCUS at5g39280
  misc_feature: Functional homolog of the protein sequence encoded by LOCUS at5g39290
  misc_feature: Useful for making plants with altered carbohydrate content
  misc_feature: Functional homolog of the protein sequence given in SEQ ID NO 14053
  misc_feature: Useful for making plants with altered cell wall content and/or composition
  misc_feature: Functional homolog of the protein sequence given in SEQ ID NO 14054
  misc_feature: Useful for making plants with altered lignin content
  misc_feature: Functional homolog of the protein sequence given in SEQ ID NO 12888
MAAMPALLLLLVAAAMMLSPASARIPGVYGGGGWQSAHATFYGGSDASGTMGGACGYGNLYSQGYGVNNAALSTALFNEGLSCGACFELKCENQPGWRWCRPGSPSILVTATNFCPPNYALPSDDGGWCNPPRPHFDLAMPMFLHIAEYRAGIVPVSYRRVPCRKSGGVRFTINGFRYFNLVLITNVAGAGDIVRASVKASSTGWLTMSRNWGQNWQSNAILVGQALSFRVTGSDRRTSTSWNAAPRNWQFGQTFEGKNFRV

SEQ ID NO: 9545 - DNA, 1119 bp, Sorghum bicolor
  misc_feature: Ceres ANNOT ID no. 6100691
  misc_feature: Encodes the peptide sequence at SEQ ID NO 9546
atggcgaaggatgggggccccgactggaacggcctgttcaagtggagcatcgcccacggagacggcaccaaaccgccgcgtgctctcagtgaggaagacagaaaatggttcatggaggctatgcaagccaacacgatagatgttgtcaagaggatgaaggagatcactcaggtgatgaaaactccagaagatgtcttgcagtctcagggtgtgaccccagagaacattgaagatatgttggatgagctacaggagcatgttgaatccattgacatggcaaatgatctacattctattggtgggttggatcctctacttggttacttgaaaaattcaaatgctggcatccgagcaaaggccgcagaagttgttagtacaattgtgcagaataatcccaagagtcagcaacttgtcatggaatccaatggactcgagccactgttgacgaacttcaaatcagatccaagtacaaatgcacgcacaaaagctttaggagccatatcttctctaattcgtcataaccagcctggaatttccgcatttcgcctgggaaatggctacgcgggattgaaggatgctcttggttctgatgatgccagacttcaaaggaaagctctcaatctcatacaatacctgctgcacaacaacaaggcagacaggagtgttgctacggagcttggtcttccaaagctgatgatgcaccttgcgtccagtgatgattccttggtgcgcgaagctgctctaagtggcctccttgagttggcacaagacaagacatctggtaacgttctacccgaccaagacaagctgaaagacattctcaagagccgaattgaaggaatcagcgtgatggattctgatgatctccatgctgctcgcgaagagcggcagctggtagactcgctctggaaggagtgctacaacgagccttcgtctctcagggagaagggcctcgttgtgcttcctggagaggatgcgccccaacagctgccaccagatgttgcaggaaagatgtttgagccgccgcttcgcgcgtgggcagctgcaagacctgctcaggaagatgattctgattctggcagcggaaagaaggatccaccattgatgcttaagttttga

SEQ ID NO: 9546 - protein, 372 aa, Sorghum bicolor
  misc_feature: Ceres ANNOT ID no. 6100691
  misc_feature (38)..(370): NCBI GI: 145332008 NCBI Desc: binding [arabidopsis thaliana]
  misc_feature (11)..(315): NCBI GI: 29436427 NCBI Desc: zgc:55259 protein [danio rerio]
  misc_feature (11)..(311): NCBI GI: 47939891 NCBI Desc: hsp70-interacting protein [rattus norvegicus]
  misc_feature (11)..(315): NCBI GI: 42415537 NCBI Desc: similar to riken cdna 1500019g21 gene [danio rerio]
  misc_feature (11)..(311): NCBI GI: 12803139 NCBI Desc: hspbp1 protein [homo sapiens]
MAKDGGPDWNGLFKWSIAHGDGTKPPRALSEEDRKWFMEAMQANTIDVVKRMKEITQVMKTPEDVLQSQGVTPENIEDMLDELQEHVESIDMANDLHSIGGLDPLLGYLKNSNAGIRAKAAEVVSTIVQNNPKSQQLVMESNGLEPLLTNFKSDPSTNARTKALGAISSLIRHNQPGISAFRLGNGYAGLKDALGSDDARLQRKALNLIQYLLHNNKADRSVATELGLPKLMMHLASSDDSLVREAALSGLLELAQDKTSGNVLPDQDKLKDILKSRIEGISVMDSDDLHAAREERQLVDSLWKECYNEPSSLREKGLVVLPGEDAPQQLPPDVAGKMFEPPLRAWAAARPAQEDDSDSGSGKKDPPLMLKF

SEQ ID NO: 9547 - DNA, 1590 bp, Sorghum bicolor
  misc_feature: Ceres ANNOT ID no. 6100703
  misc_feature: Encodes the peptide sequence at SEQ ID NO 9548
atggcggcgccggcgccgaagcaggaggagctgcagccgcacgccgtcagggaccagctgccctccgtatcctactgcctcaccagcccgcccccatggccggaggccgtactcctcggcttccagcactacctcgtcatgctcggcaccaccgtcatcatccccaccgcgctcgtcccccagatgggcggcggcaatgaggagaaggcgcgggtggtgcagacgctgctgttcgtggccgggatcaacacgctgatccagagcttcctcggcacgcgcctccccgccgtcatgggggcctcctacaccttcgtcgcgcccaccatctccatcatcctcgccggccgctacagcggcattgccgatccccacgagaaattcgtgcgcatcatgcggggcacgcaaggcgcgctcattgtggcctccaccctccaaatcatcatgggattcagtggcctttggcgcattgtcgtcaggctgctgagcccgctgtctgctgcccccttggtcgccctcgtcggattcgggctctatgaactggggtttccaagtgttgccaaatgtgtagagattggtcttccacagattttactgctggtggcactttctcagtacataccacatttggtccccttgctgagtactgcctttgagcggtttgctgtcataatgtccattaccctcatctggctttacgccttcttcctgacggttggcggtgcctataagaatgctgctccgaaaacccaattccattgccgcactgatcgatctggccttgttgggggtgctccatggataagtgtaccctatccatttcagtggggagcaccaacctttgatgctggtgaagcttttgctatgatggcagcttcttttgttgctcttgtagagtccaccggtgcatttattgccgtttcacggtatgccagtgcaacaccatgccctccttccatcatgagtcgtggcattgggtggcagggagttggcattttgctgagtggcttgtttggaacagctaatggaacctctgtatctgtcgaaaatgctgggctgctcggtttgtcacgcgttggtagtagacgcgttgtgcagatttctgctggatttatgatattcttctcaatccttgggaaatttggagctgtttttgcatcgattcctggcccaattatcgcagctatatactgtcttctctttgcatatgttggtatggcaggtgttgggttcctacagttctgcaacctgaatagcttccgaacaaagttcatcctaggattttctttgtttatgggtctgtcggtgccacagtatttcaatgaatacacttccgtcgcaggctttggtccagtgcacacgcatgcaagatggttcaatgatatgatcaatgtggtattctcctcgaaggcatttgttgccggggctgtggcgtattttctggacaacaccctgcataggcgagacggcaccgtgaggaaagaccgggggcaccatttctgggacaggttcaggtccttcaagactgacccgcgcagcgaggagttctactccctcccattcaacctcaacaagttcttcccatccttctga

SEQ ID NO: 9548 - protein, 529 aa, Sorghum bicolor
  misc_feature: Ceres ANNOT ID no. 6100703
  misc_feature (34)..(441): Pfam Id: Xan_ur_permease Pfam Desc: Permease family
  misc_feature (2)..(528): NCBI GI: 89330191 NCBI Desc: leaf permease 1 [oryza sativa (japonica cultivar-group)]
  misc_feature (3)..(528): NCBI GI: 30696385 NCBI Desc: xanthine/uracil permease family protein [arabidopsis thaliana]
  misc_feature (1)..(528): NCBI GI: 31711940 NCBI Desc: at5g49990 [arabidopsis thaliana]
  misc_feature (2)..(528): NCBI GI: 144923095 NCBI Desc: xanthine/uracil/vitamin c permease [medicago truncatula]
  misc_feature (47)..(528): NCBI GI: 9758398 NCBI Desc: permease [arabidopsis thaliana]
MAAPAPKQEELQPHAVRDQLPSVSYCLTSPPPWPEAVLLGFQHYLVMLGTTVIIPTALVPQMGGGNEEKARVVQTLLFVAGINTLIQSFLGTRLPAVMGASYTFVAPTISIILAGRYSGIADPHEKFVRIMRGTQGALIVASTLQIIMGFSGLWRIVVRLLSPLSAAPLVALVGFGLYELGFPSVAKCVEIGLPQILLLVALSQYIPHLVPLLSTAFERFAVIMSITLIWLYAFFLTVGGAYKNAAPKTQFHCRTDRSGLVGGAPWISVPYPFQWGAPTFDAGEAFAMMAASFVALVESTGAFIAVSRYASATPCPPSIMSRGIGWQGVGILLSGLFGTANGTSVSVENAGLLGLSRVGSRRVVQISAGFMIFFSILGKFGAVFASIPGPIIAAIYCLLFAYVGMAGVGFLQFCNLNSFRTKFILGFSLFMGLSVPQYFNEYTSVAGFGPVHTHARWFNDMINVVFSSKAFVAGAVAYFLDNTLHRRDGTVRKDRGHHFWDRFRSFKTDPRSEEFYSLPFNLNKFFPSF

SEQ ID NO: 9549 - DNA, 288 bp, Sorghum bicolor
  misc_feature: Ceres ANNOT ID no. 6100705
  misc_feature: Encodes the peptide sequence at SEQ ID NO 9550
atggagatggagacagaggcggcggcggcgaggcaggcgaaggagtccctggagctggcgttccagatgtcccagatcctcgacaccggcctcgaccgccacaccctgtcgctgctcatggcgctctgcgaccgtggagccaaccccgaggccctggccgccctcgtccgcgagctctcctccgctgctcctccaaccgccgcggcttcctcccccgtgagcaacggcgccgcggggctggccccggcaactgcgtcgatgttcccctccggccttcgccgtccctag

SEQ ID NO: 9550 - protein, 95 aa, Sorghum bicolor
  misc_feature: Ceres ANNOT ID no. 6100705
  misc_feature (7)..(74): NCBI GI: 115528744 NCBI Desc: similar to riken cdna 2410129h14 [homo sapiens]
  misc_feature (3)..(74): NCBI GI: 62858499 NCBI Desc: loc549135 [xenopus tropicalis]
  misc_feature (7)..(62): NCBI GI: 119600919 NCBI Desc: hcg32790 [homo sapiens]
  misc_feature: Useful for making plants with modulated nitrogen use efficiency
  misc_feature: Functional homolog of the protein sequence encoded by LOCUS at1g73790
  misc_feature: Useful for making plants with modulated nitrogen use efficiency
  misc_feature: Functional homolog of the protein sequence given in SEQ ID NO 14057
MEMETEAAAARQAKESLELAFQMSQILDTGLDRHTLSLLMALCDRGANPEALAALVRELSSAAPPTAAASSPVSNGAAGLAPATASMFPSGLRRP

SEQ ID NO: 9551 - DNA, 252 bp, Sorghum bicolor
  misc_feature: Ceres ANNOT ID no. 6100720
  misc_feature: Encodes the peptide sequence at SEQ ID NO 9552
atggctgggaaaggcgggccgaccaacttggagaaggagcagatgtttgggatggcagagaaggagatggagtacagagttgatcttttcaataggcttacacagacctgtttcgacaagtgcattgagaaaaggtataaagaagctgagctcaatatgggcgagaacagttgcattgatcgatgtgtttcaaagtattggcaggtgactaatttagttggtcagatgcttgggaaccgtcctcagatgtga

SEQ ID NO: 9552 - protein, 83 aa, Sorghum bicolor
  misc_feature: Ceres ANNOT ID no. 6100720
  misc_feature (14)..(80): Pfam Id: zf-Tim10_DDP Pfam Desc: Tim10/DDP family zinc finger
  misc_feature (1)..(83): NCBI GI: 115456309 NCBI Desc: os03g0825400 [oryza sativa (japonica cultivar-group)]
  misc_feature (1)..(83): NCBI GI: 38175439 NCBI Desc: small zinc finger-like protein [oryza sativa (japonica cultivar-group)]
  misc_feature (5)..(81): NCBI GI: 5107180 NCBI Desc: small zinc finger-like protein [lycopersicon esculentum]
  misc_feature (7)..(83): NCBI GI: 5107088 NCBI Desc: small zinc finger-like protein [pinus taeda]
  misc_feature (11)..(78): NCBI GI: 145344697 NCBI Desc: mpt family transporter: inner membrane translocase (import) tim10 [ostreococcus lucimarinus cce9901]
MAGKGGPTNLEKEQMFGMAEKEMEYRVDLFNRLTQTCFDKCIEKRYKEAELNMGENSCIDRCVSKYWQVTNLVGQMLGNRPQM

SEQ ID NO: 9553 - DNA, 1005 bp, Sorghum bicolor
  misc_feature: Ceres ANNOT ID no. 6100721
  misc_feature: Encodes the peptide sequence at SEQ ID NO 9554
atgggcagcttggcttatccgctcctccggctcccgtgccgctgctccctcacggcggcgccagcgtctcggctccccgcaccggtgtgcctatctgcttcagcttccgcggacgcagggggcgaggtgacggcacgggaaaagcgagcgcagcgtcgggagcggcgggagctgcgtgcgacggactggaaggaggaggtgcaggaccggctgatccacgagccggcacggcggcggaagaagactcctaagaggtcgtggagggaggatctcaacctcgacctcctcgccgagctggggccgcagtggtggctcgtgcgcgtctccatggcgcccggcaccgactacgtcgacctcctcaccaaggccatctcacgacgctacccggaagtcaccttcaagatttacaatccatccatccaagtaaagaggagactgaaaagtggtgcaatcagtgttaaatccaagcctctgcatcctgggttggtctttatgcattgtaccttaaacaaggagcttcatgacttcatcagagacactgagggttgttatggctttattggagctacagttggttcaatcaagaggcagattaaaaagccaaaacctattccaattgatgaagttgaatcaattattagagaagagaaggaggaacaagagagagttgacagagaatttgaggaaatggagaatatgggaaatgttgaacctttcagtaaacctgttgaagaatctgaacttatgttaatgaataagatcaagaaacagtttaagaaatcatccttaaatggtggcactagacacagtgctttttcgcctggtgcaacagttcatgttctctctgggccttttgaagacttcactggttccatcctggaagtgaatcgcaaaaacaagaaggccactgtccagttgatacttttcgggaaagagagctttgtggatcttgattttgatcaaattgaggcaattgaagtggatcacaatgatagtaaactatga

SEQ ID NO: 9554 - protein, 334 aa, Sorghum bicolor
  misc_feature: Ceres ANNOT ID no. 6100721
  misc_feature (101)..(209): Pfam Id: NusG Pfam Desc: Transcription termination factor nusG
  misc_feature (274)..(309): Pfam Id: KOW Pfam Desc: KOW motif
  misc_feature (21)..(322): NCBI GI: 92876119 NCBI Desc: nusg [medicago truncatula]
  misc_feature (33)..(322): NCBI GI: 22136582 NCBI Desc: at3g09210/f3l24_8 [arabidopsis thaliana]
  misc_feature (272)..(325): NCBI GI: 104779743 NCBI Desc: transcription antitermination protein nusg [pseudomonas entomophila l48]
  misc_feature (272)..(325): NCBI GI: 95108730 NCBI Desc: transcription antitermination protein nusg [pseudomonas entomophila l48]
  misc_feature (272)..(325): NCBI GI: 82739422 NCBI Desc: transcription antitermination protein nusg [pseudomonas putida f1]
MGSLAYPLLRLPCRCSLTAAPASRLPAPVCLSASASADAGGEVTAREKRAQRRERRELRATDWKEEVQDRLIHEPARRRKKTPKRSWREDLNLDLLAELGPQWWLVRVSMAPGTDYVDLLTKAISRRYPEVTFKIYNPSIQVKRRLKSGAISVKSKPLHPGLVFMHCTLNKELHDFIRDTEGCYGFIGATVGSIKRQIKKPKPIPIDEVESIIREEKEEQERVDREFEEMENMGNVEPFSKPVEESELMLMNKIKKQFKKSSLNGGTRHSAFSPGATVHVLSGPFEDFTGSILEVNRKNKKATVQLILFGKESFVDLDFDQIEAIEVDHNDSKL

SEQ ID NO: 9555 - DNA, 1734 bp, Sorghum bicolor
  misc_feature: Ceres ANNOT ID no. 6100728
  misc_feature: Encodes the peptide sequence at SEQ ID NO 9556
atggccacaaccagcctcgcgctctcgctgcgcctcacgccgtcgtcgcggccgctcagcctccgtcgtcggggggccgccgtcgtcacctgtcgcgccaccaccgccacgttccaccagctcgatgccgtcgcggtgagggaggaggagtccaagttccggatggcagcagcggagggctgcaacctcttaccgctcacgaggtgcatcttctccgatcatctgacgccggttctcgcgtaccggtgcctcgtcaaggaggacgaccgcgaggcgcctagctttctcttcgagtccgtcgagcagggctctgagggcaccaatgtggggaggtatagcgtagtcggggcgcagcctgccatggagatcgtggccaaggctaaccatgtgacagtgatggaccatgagatgaagtcgaggagggagcacttcgtgcctgatccaatgaagatccctaggacaatcatggagcagtggaacccacagattgccgacggcctccctaatgcattttgtggaggatgggttggattcttctcatatgatacagtacgttatgttgaaacaaagaagcttccttttagtaaggcaccacttgacgatagaaaccttcctgacatccatttaggcctctacagtgatgtcattgtgtttgatcatgttgaaaagaaaacacatgttattcattgggtgagaacagattgttataattctattgatgaagcatatgaagatggaacaactcgacttgaagctttgttatcaagattacattgcctcaatatcccaatgctttcttctggttctataaaacttaatgttggaaacactgggtcagtaatgcaaaattcaacgatgtcaagagaagaatataaaaatatagttgtccaagctaaagaacacatcttagctggtgacatttttcaagtagttctaagccaacgttttgagagacgaacatttgccgacccctttgaaatctatcgtgcattgcgcatcgtaaatcctagtccatatatggcctatctacaggcacgaggttgtattctcgtggcatcaagtcctgaaattcttactcgagtgcaaaagaggacagtagtcaatcgaccacttgctggaaccataagaagaggcaaaacaaaagcagaagataaagttttagaacaattgcttttaagtgatgaaaagcagcgtgctgaacatattatgctaatagatcttggccgaaatgatgttggaaaggtgtctaaaccaggttcagtaaaggtggagaaattgatgaatattgaacgatattctcatgtcatgcacatcagctctactgtcactggagagctacgtgatgatcttacgtgttgggatgcactacgagctgcattaccagttggaacagttagtggcgctccaaaggtgagagcaatggagttgattgatcagctagaagtgaatatgcgtggaccgtatagtggtggctttggagggatttccttttgtggggatatggacattgcactcgctcttcgcactatcgtcttccccaccacatctcgatttgacaccatgtactcctacacggacaaaaagtcacggcaagagtgggtcgctcatctccaggctggagctggcatagttgctgatagtaaaccagacgacgagcaccaagagtgcctaaacaaggcagcaggtgctgctcgtgccattgaccttgccgaatctacatttctagaagagtag

SEQ ID NO: 9556 - protein, 577 aa, Sorghum bicolor
  misc_feature: Ceres ANNOT ID no. 6100728
  misc_feature (287)..(567): Pfam Id: Chorismate_bind Pfam Desc: chorismate binding enzyme
  misc_feature (66)..(227): Pfam Id: Anth_synt_I_N Pfam Desc: Anthranilate synthase component I, N terminal region
  misc_feature (5)..(577): NCBI GI: 5360657 NCBI Desc: anthranilate synthase alpha 1 subunit [oryza sativa (japonica cultivar-group)]
  misc_feature (9)..(577): NCBI GI: 960289 NCBI Desc: anthranilate synthase alpha subunit
  misc_feature (48)..(577): NCBI GI: 12830362 NCBI Desc: anthranilate synthase alpha subunit [catharanthus roseus]
  misc_feature (11)..(577): NCBI GI: 52631037 NCBI Desc: anthranilate synthase alpha 1 [camptotheca acuminata]
  misc_feature (7)..(576): NCBI GI: 320553 NCBI Desc: anthranilate synthase (ec 4.1.3.27) alpha-2 chain - arabidopsis thaliana
  misc_feature (7)..(576): SWISSPROT Homolog: EC 4.1.3.27 Anthranilate synthase component I-2, chloroplast precursor
MATTSLALSLRLTPSSRPLSLRRRGAAVVTCRATTATFHQLDAVAVREEESKFRMAAAEGCNLLPLTRCIFSDHLTPVLAYRCLVKEDDREAPSFLFESVEQGSEGTNVGRYSVVGAQPAMEIVAKANHVTVMDHEMKSRREHFVPDPMKIPRTIMEQWNPQIADGLPNAFCGGWVGFFSYDTVRYVETKKLPFSKAPLDDRNLPDIHLGLYSDVIVFDHVEKKTHVIHWVRTDCYNSIDEAYEDGTTRLEALLSRLHCLNIPMLSSGSIKLNVGNTGSVMQNSTMSREEYKNIVVQAKEHILAGDIFQVVLSQRFERRTFADPFEIYRALRIVNPSPYMAYLQARGCILVASSPEILTRVQKRTVVNRPLAGTIRRGKTKAEDKVLEQLLLSDEKQRAEHIMLIDLGRNDVGKVSKPGSVKVEKLMNIERYSHVMHISSTVTGELRDDLTCWDALRAALPVGTVSGAPKVRAMELIDQLEVNMRGPYSGGFGGISFCGDMDIALALRTIVFPTTSRFDTMYSYTDKKSRQEWVAHLQAGAGIVADSKPDDEHQECLNKAAGAARAIDLAESTFLEE

SEQ ID NO: 9557 - DNA, 1629 bp, Sorghum bicolor
  misc_feature: Ceres ANNOT ID no. 6100729
  misc_feature: Encodes the peptide sequence at SEQ ID NO 9558
  misc_feature: Up-regulated in root tissues in response to methyl jasmonate treatment
  misc_feature: Up-regulated in shoot tissues in response to salicylic acid treatment
atggtcgccgcggcccgccgcgaccccgggacgcgcctcctggtggcgctcctgctgctggcgctggtcgtctccgggcactgcctggacgcgcaccaccgcgggctgaagcgccggcggcgaaagcacgagatccactccccggtcaagacggtggtggtggtggttatggagaaccgcagcttcgaccacatcctcggctggctcagccgcacccgccccgacatcgacggcctcacgggccgcgagtccaaccgcctcaacgcctccgacccctcctccccggagatcttcgtcaccgacgaggccggctacgtcgactccgaccccggccacggcttcgaggacatccgggagcagatcttcggctccgccgacacctccgcggtgccgccccccatgtccggcttcgcccagaacgcgcgcggcatgggcctcggcatgccgcagaacgtcatgagcgggttcaagcccgacgccgtccccgtctacgcctccctcgccgacgagttcgccgtgttcgaccgctggttcgcctccgtgcccacctccacgcagcccaaccgcctgttcgtccactcggcgacatcccatggcctcaccttcaacgcccgcaaggacctcatccatggcttcccgcagaagaccatctttgacagcctcgaggagaacggcttgtcttttggcatctactaccagaacatcccggccacgctcttctaccagagcctccgccgcctaaagcacctcgtcaagttccaccagtacagccttaaattcaagctgcacgccaagttggggaagctgccaaattatgtggtgattgagcagaggtactttgattgcgagatgttcccagcaaacgatgatcatccgtcacatgatgtggcaaggggacagaggttcgtgaaagaggtgtatgagacactgagggccagtcctcagtggaacgagacggccctgattatcacatacgatgagcatggcggattctacgaccatgtccctacaccggttgtcggagtgccccaacctgatggaatagttgggcctgatccatactacttcaagttcgaacggcttggggtgcgtgttcccacctttctcatctcaccttggatcgagaagggcactgtgattcatgcaccgaatggtccacaggaaacctcgcaatatgagcattcatccattcctgcaacagtaaagaagctattcaatttacattctaactttctgacaaagagagacgcatgggctgggacctttgagaactaccttaaaatccggaaaacaccaagaactgactgtccagagaagctgcccgaggtgacaaagtcactgcgaccatttggtcccaaggaagattcatctctctcggaatttcaagtggagttgattcaacttgcctcacagcttaacggtgatcatgtactgaacacgtacccagatattggcaggaccatgactgtcgggaaagctaaccgctatgcagaggatgctgtcgccagattcctggaagctggtcggattgctttgagagctggtgcaaatgaatctgctttggtgacgatgaggcctgctctcaccagcagggcctcattgtcctctggtttatcatcagagctctaa

SEQ ID NO: 9558 - protein, 542 aa, Sorghum bicolor
  misc_feature: Ceres ANNOT ID no. 6100729
  misc_feature (49)..(408): Pfam Id: Phosphoesterase Pfam Desc: Phosphoesterase family
  misc_feature (123)..(542): NCBI GI: 115456329 NCBI Desc: os03g0826600 [oryza sativa (japonica cultivar-group)]
  misc_feature (12)..(537): NCBI GI: 58652062 NCBI Desc: at1g07230 [arabidopsis thaliana]
  misc_feature (43)..(531): NCBI GI: 24417137 NCBI Desc: phosphatidylglycerol specific phospholipase c [arabidopsis thaliana]
  misc_feature (49)..(533): NCBI GI: 115486109 NCBI Desc: os11g0593000 [oryza sativa (japonica cultivar-group)]
  misc_feature (131)..(445): NCBI GI: 89306848 NCBI Desc: phosphoesterase family protein [tetrahymena thermophila sb210]
  misc_feature: Up-regulated in root tissues in response to methyl jasmonate treatment
  misc_feature: Up-regulated in shoot tissues in response to salicylic acid treatment
MVAAARRDPGTRLLVALLLLALVVSGHCLDAHHRGLKRRRRKHEIHSPVKTVVVVVMENRSFDHILGWLSRTRPDIDGLTGRESNRLNASDPSSPEIFVTDEAGYVDSDPGHGFEDIREQIFGSADTSAVPPPMSGFAQNARGMGLGMPQNVMSGFKPDAVPVYASLADEFAVFDRWFASVPTSTQPNRLFVHSATSHGLTFNARKDLIHGFPQKTIFDSLEENGLSFGIYYQNIPATLFYQSLRRLKHLVKFHQYSLKFKLHAKLGKLPNYVVIEQRYFDCEMFPANDDHPSHDVARGQRFVKEVYETLRASPQWNETALIITYDEHGGFYDHVPTPVVGVPQPDGIVGPDPYYFKFERLGVRVPTFLISPWIEKGTVIHAPNGPQETSQYEHSSIPATVKKLFNLHSNFLTKRDAWAGTFENYLKIRKTPRTDCPEKLPEVTKSLRPFGPKEDSSLSEFQVELIQLASQLNGDHVLNTYPDIGRTMTVGKANRYAEDAVARFLEAGRIALRAGANESALVTMRPALTSRASLSSGLSSEL

SEQ ID NO: 9559 - DNA, 2238 bp, Sorghum bicolor
  misc_feature: Ceres ANNOT ID no. 6100740
  misc_feature: Encodes the peptide sequence at SEQ ID NO 9560
atggcgtccctcctcacgctccccgccctcgccctctccaaccccgccaccgcctccgacgccgtcaggctacgctccgcggccttccgctgctgggcgctccggcggcgcgggtgggcggcggtggccgccgtggcctcgcccaactccgtgctcagcgagcacgccttcaagcggcttcagctcgggagcgacgacgaggacgaggaggggacctacgggagcgacgccaacgaggggttcgaggccggggaggggttccagggggacgaggaggagctcgccattgccaggctcggcctgcctgacgagctcgtcgccacgctcgagaagcgcgggattacgcacctgttccccatccagagggctgtgttgattcccgctcttgagggccgtgacctgattgctagagcaaagactggaaccggaaagacactagcctttggtattcccatgatcaagcaattaattgagcaagacaatggtcaaattacaaggcgaggtcgcactcctcgggttctggttctagcacctaccagagaattagccaaacaagtcgagaaggaaataaaggaatcagcacccaagctcggcacagtgtgtgtttatggtggtgtctcgtataatgtccagcagaatgcactctcccgtggtgtcgatgttgttgttggaacacctggccgcataattgatttgataaatggcggaagcctccagttgggagaagttcagtatttagtcctggatgaggctgaccaaatgcttgcagtggggtttgaagaagatgttgaaacaatattacaacagcttcctgcgaacaggcaaagcatgctgttctctgcaacgatgcctagttgggtgaagaaactgtccaggcggtacttgaacaaccctttgacaattgacttggttggtgatcaagatgaaaagcttgctgaaggaatcaaactctatgctatcccactcacagctacatcaaagcgcaccattcttagtgatctaattacggtttatgcaaagggtgggaaaaccattgttttcactcgtacgaagaaagatgcagatgaggtatcattggcactgacaaacagtattgcttctgaggcacttcatggtgatatttcacagcatcagcgtgagcggacactaaatggatttcgtcaagggaaatttactgttctagtagctacagatgttgctgctcgtggtcttgatataccaaacgttgatttggttatccattacgaattgccaaatgatccagaaacttttgtccatcgttctggacgcactggacgtgctgggaaagcaggaactgcaatcttgatgtttaccagcagccagaaaaggacagttaagtctcttgagcgtgatgttggttgcaagtttgagtttataagccctccgtccatgggagaagtgctggagtcatctgctgagcatgtcattgctacattgcgaggggtgcacccagagtcaactcagtactttcttggagcagctgagaaattaacagaagaattaggacctcatgctcttgcttctgcactggcacatctgagtgggttttctcagccaccttcttcacgttctctgatcagtcatgagcagggatgggtcacattgcaactaactagagaacaaggatatggcagaggcttcttttctcctagatcagttactggttttctgtctgatgtttattcagctgctgcagatgaagttggcaaaatatacctaatagcagatgagaacgtccaaggagcagtcttcgatttgcctgaggaaatttccaaggacctgcttgctatggagctccccccaggaaacaccttaatgaaaatatcaaagctgcctgcgttgcaagatgatggtcctgccactgatagctatggtcgtttttccaacgaccgaggttccaggaacaggggtggaggcgctgcaagaggccggggtggttgggacactgacagtgaggatcgattccgccgtggtggcaggagctttaggtctgacaacgatagttggtcagatgatgactggtcaagcggtgggagaaaatcaaaccgttcctcgtcctttggtagccgctcatcatcttatggcagccgtggctcaccatccttcggtggtcgctcatcatccttcggtggtagggagagtaacagaagcttcagtggcgcttgtttcaactgcggtgaatccggtcaccgtgcatcagactgcccaaacaagtag

SEQ ID NO: 9560 - protein, 745 aa, Sorghum bicolor
  misc_feature: Ceres ANNOT ID no. 6100740
  misc_feature (118)..(290): Pfam Id: DEAD Pfam Desc: DEAD/DEAH box helicase
  misc_feature (522)..(623): Pfam Id: GUCT Pfam Desc: GUCT (NUC152) domain
  misc_feature (359)..(435): Pfam Id: Helicase_C Pfam Desc: Helicase conserved C-terminal domain
  misc_feature (727)..(744): Pfam Id: zf-CCHC Pfam Desc: Zinc knuckle
  misc_feature (114)..(285): Pfam Id: ResIII Pfam Desc: Type III restriction enzyme, res subunit
  misc_feature (35)..(745): NCBI GI: 115456345 NCBI Desc: os03g0827700 [oryza sativa (japonica cultivar-group)]
  misc_feature (1)..(727): NCBI GI: 47827092 NCBI Desc: atp-dependent rna helicase [hordeum vulgare subsp. vulgare]
  misc_feature (43)..(745): NCBI GI: 20856975 NCBI Desc: at5g26743 [arabidopsis thaliana]
  misc_feature (43)..(745): NCBI GI: 3775987 NCBI Desc: rna helicase [arabidopsis thaliana]
  misc_feature (43)..(745): NCBI GI: 22135801 NCBI Desc: at5g26740 [arabidopsis thaliana]
MASLLTLPALALSNPATASDAVRLRSAAFRCWALRRRGWAAVAAVASPNSVLSEHAFKRLQLGSDDEDEEGTYGSDANEGFEAGEGFQGDEEELAIARLGLPDELVATLEKRGITHLFPIQRAVLIPALEGRDLIARAKTGTGKTLAFGIPMIKQLIEQDNGQITRRGRTPRVLVLAPTRELAKQVEKEIKESAPKLGTVCVYGGVSYNVQQNALSRGVDVVVGTPGRIIDLINGGSLQLGEVQYLVLDEADQMLAVGFEEDVETILQQLPANRQSMLFSATMPSWVKKLSRRYLNNPLTIDLVGDQDEKLAEGIKLYAIPLTATSKRTILSDLITVYAKGGKTIVFTRTKKDADEVSLALTNSIASEALHGDISQHQRERTLNGFRQGKFTVLVATDVAARGLDIPNVDLVIHYELPNDPETFVHRSGRTGRAGKAGTAILMFTSSQKRTVKSLERDVGCKFEFISPPSMGEVLESSAEHVIATLRGVHPESTQYFLGAAEKLTEELGPHALASALAHLSGFSQPPSSRSLISHEQGWVTLQLTREQGYGRGFFSPRSVTGFLSDVYSAAADEVGKIYLIADENVQGAVFDLPEEISKDLLAMELPPGNTLMKISKLPALQDDGPATDSYGRFSNDRGSRNRGGGAARGRGGWDTDSEDRFRRGGRSFRSDNDSWSDDDWSSGGRKSNRSSSFGSRSSSYGSRGSPSFGGRSSSFGGRESNRSFSGACFNCGESGHRASDCPNK

SEQ ID NO: 9561 - DNA, 2460 bp, Sorghum bicolor
  misc_feature: Ceres ANNOT ID no. 6100743
  misc_feature: Encodes the peptide sequence at SEQ ID NO 9562
atggccggcggcggggatgaggcggcggcgctgtgcgcggcgccgatgaaggcgacgtcggaggggttgtggcagggggacaacccgctgcacttctcgctgccgctcatcatcctgcaggtctgcgtcgtgctcgtcctcacccggggcctcgccctcgcgctccgcccgctccgccaaccccgcgtcatcgccgagatcatcggcggcatcctcctcggcccgtcggcgcttggccggaacaaggccttcctcaaccacgtcttcccgacggagagcctcaccgtgctcgacacgctggccaacatcggcctgctcctgttcctcttcctcgtcggcctggagctggacccggcctcgctccgccgcacgggtagccgcgcactcgccatcgccgtggccggcatctccctccccttcgcgttcggcgtcggctcctcactggcgctgcgcgccgccatcgctcccgacgcgccgcgcggcccgctcatcgtcttcatgggcgtcgcgctctccattactgcgttcccggtgctcgcgcgcatcctcgccgagctcaagctcctgaccaccgacctgggccgcatggccatgtccgccgcggcggtcaacgacgtcaccgcgtggatactgctcgcgctggccatcgcgctgtcgggctccggctcgccgttcgtttcggtctacgtcctcctctgcggcgtcggcttcgtcgcggcggccaccttcctcgtgcggccggtgctggtctacatggcgcgcctgtccccggccggcgagcccgtcaaggagtcgttcgtctgcgccactctcggcatcgtgctcgctgccggcttcgtcacggacgccatcggcatccacgctctgttcggagcgttcgtcatcggcgtcctgatccccaaggaaggcgcctacgccggcgcgctcactgagaagatggaggacctggtgtcgtcgctgttcctgccgctgtacttcgtgtccagcgggctcaagaccaacgtgggcaccatctccggtgccaagtcctggggcttcctcgtgctcgtcatcacgacggcgtgcgccggcaagatcggcggcacggtgctggcgtcgctgctgatgcgcgtgccgccgcgcgaggcgctcgctctggggctgctcatgaacaccaaggggctcgtggagctcatcgtgctcaacatcggccgcgaccgcaaggttctcaacgaggaggcgttcgccatcctggtgctcatggcgctcaccaccaccttcatgaccaccccggccgtcaccgccgtgtacaaaccggcgcggcgtggcgcggcgtcgtacaagcaccggaccgtggagcgcggcggcggtggcggcgaggccgacagcgagctgcgggtgctggcgtgcttccacgccagccgcggcatcccgacgctgatcaatctggtggaggcctcgcgcggcacgcggcggagcaagctcaccatgtacgccatgcacctcgtggagctctcggagcggtcgtcggccatctccatggtgcagcgcgcgcgccgcaacgggctgccgttctcgggccggcgcgggcgcgacggcggcggtgaggtggtggtggcgttcgaggcgttccggcgcctgagcgccgtggtggtgaagccgatgacggccatctccgacctcagcactatccacgaggacatcgtggcgtcggcggtcaacaagcgcgccgcgctcgtggtgctgccgttccacaagatgctgtgccacgacggcaccatggagcccgtggaccgcgcctaccaccacgctaacgtccgcgtgctccagagtgcgccctgctccgtcgctgtcctcgtggaccgcgtcctcggcggcgcggcgcaggtctccgcgccggacgtctcctacgccgtgctggtcctcttcttcggcgggcccgacgaccgcgaggcgctcgcgtacgcggcccgcatgggcgagcaccccggcatcgagctcaccgtcgcccgcttcatcacggccgcggcggcgaaacccaacgccgacggcggcaacctcgagctcgagctcgccaaggacgaggaagccctgcagaagtacgtcacctgggcgctcaagtccggggacgggtccgtcaggtatgaggaggtaacggcggcggcagagcgggaggagttgacacccgccatcaggacgctcgggaggggcaagaacctggtcgtggcgggacggtcggcgccggcgcctgcgctggtggagaagagcgactgcccggagctgggccccgtggggagctacctggcgacgccggagttctcgacgacggcgtccgtgctggtcgtgcaacggtacaacccgcggagcgaccccacgcgcgaaaggccggcgatggagagggacgtggaggaggccgtcgtgccgttcccgtcgtcgtctcggtcggcggagtccgaatcagagtcgcggcacagcacgtga

SEQ ID NO: 9562 - protein, 819 aa, Sorghum bicolor
  misc_feature: Ceres ANNOT ID no. 6100743
  misc_feature (42)..(427): Pfam Id: Na_H_Exchanger Pfam Desc: Sodium/hydrogen exchanger family
  misc_feature (12)..(796): NCBI GI: 9294151 NCBI Desc: na+/h+ exchangeing protein-like [arabidopsis thaliana]
  misc_feature (12)..(779): NCBI GI: 61658325 NCBI Desc: cation/h+ exchanger [arabidopsis thaliana]
  misc_feature (11)..(792): NCBI GI: 92870446 NCBI Desc: na+/h+ antiporter-like protein [medicago truncatula]
  misc_feature (69)..(805): NCBI GI: 115489590 NCBI Desc: os12g0616500 [oryza sativa (japonica cultivar-group)]
  misc_feature (8)..(792): NCBI GI: 92870445 NCBI Desc: na+/h+ antiporter-like protein [medicago truncatula]
  misc_feature: Useful for making plants with modulated heat sensitivity
  misc_feature: Functional homolog of the protein sequence given in SEQ ID NO 13975
MAGGGDEAAALCAAPMKATSEGLWQGDNPLHFSLPLIILQVCVVLVLTRGLALALRPLRQPRVIAEIIGGILLGPSALGRNKAFLNHVFPTESLTVLDTLANIGLLLFLFLVGLELDPASLRRTGSRALAIAVAGISLPFAFGVGSSLALRAAIAPDAPRGPLIVFMGVALSITAFPVLARILAELKLLTTDLGRMAMSAAAVNDVTAWILLALAIALSGSGSPFVSVYVLLCGVGFVAAATFLVRPVLVYMARLSPAGEPVKESFVCATLGIVLAAGFVTDAIGIHALFGAFVIGVLIPKEGAYAGALTEKMEDLVSSLFLPLYFVSSGLKTNVGTISGAKSWGFLVLVITTACAGKIGGTVLASLLMRVPPREALALGLLMNTKGLVELIVLNIGRDRKVLNEEAFAILVLMALTTTFMTTPAVTAVYKPARRGAASYKHRTVERGGGGGEADSELRVLACFHASRGIPTLINLVEASRGTRRSKLTMYAMHLVELSERSSAISMVQRARRNGLPFSGRRGRDGGGEVVVAFEAFRRLSAVVVKPMTAISDLSTIHEDIVASAVNKRAALVVLPFHKMLCHDGTMEPVDRAYHHANVRVLQSAPCSVAVLVDRVLGGAAQVSAPDVSYAVLVLFFGGPDDREALAYAARMGEHPGIELTVARFITAAAAKPNADGGNLELELAKDEEALQKYVTWALKSGDGSVRYEEVTAAAEREELTPAIRTLGRGKNLVVAGRSAPAPALVEKSDCPELGPVGSYLATPEFSTTASVLVVQRYNPRSDPTRERPAMERDVEEAVVPFPSSSRSAESESESRHST

SEQ ID NO: 9563 - DNA, 1464 bp, Sorghum bicolor
  misc_feature: Ceres ANNOT ID no. 6100744
  misc_feature: Encodes the peptide sequence at SEQ ID NO 9564
atggcgaaggccaagccacggccggcggcggccatccttcttctgctcatcagcttcctggccgccgccgcggctggtggtggctcggacgccgagacgacgggcggcggcggcggcatggtgggcgtggacggcacgcggttcgtggtggacgatggcaggcccatctacttcagcgggttcaacgcctactggctgatgctggtggcgtcggacccggcgcggaggggcaaggtggtggcggcgttccggcaggcggccgaccacgggctcaacctcgcgcggacctgggcgttcagcgacggcggcgacacgccgctgcaggcggcgccgggcgtctacgacgaggccatgttccagggtctggacttcgtggtcgccgaagccaggcggcacggcatctacctcctcctctgcctcacaaacaacttccacgacttcggcggcaagcggcagtacgtgcagtgggccagggacgccggccaccgcctcgccaccgacgacgacttcttcaacagcaccgtcgtcaaggactactacaagaaccacgtcaagacggtgctgacgcgcgtgaacaccctcaccggcgtggcgtacaaggacgaccccaccatcctcggctgggagctcatgaacgagccccgctgcgacgccgagcctaccggcgccatggtgcaggcgtgggtggaggagatggcgccgtacgtgaagtccatcgacggcgagcacctggtgacggcggggctggagggcttctacggcgccggcgcgcacgagagcaaggacctcaacccgtggggcatctactacggcaccaacttcgtcgagacgcaccgcgcgcggggcgtcgacttcgccaccatccacctctacccggacgtctggctctggggctccgccgccgacgcgcagctcgccttcctccgcaactggacgcgctcccacgcccgcgacgccgacctctacctgcgcaagccgctgctcgtcaccgagtacggcaagttcctctgggagggcgtcgccggcgccaaccgcacccagagggactacttcctccgcctcgtcctcgactccatctacgactccgccgcacggggagggccgctcgtcggcggcgcgttctggcagctgctcgacggcggcatggacacgctcagggatggatacgagatcatactccccgaggatcgactcgccgccaccatcatcggtaaccactcccgccagctggcccagctcagcctcgtcaccttcaccggggaggacgtcgacatcgaagcggcggcgcttcgccggaggagcaggagaagcccgcatagcaacaggaagatacgcgtacgcagcgtgggtggtcctagtgatagtgatagttattatacacaaacacaacggttgttgcacatactcttggttcgtttcatgtctttgttcacatcaatttcttcattgttcagtagtgtatag

SEQ ID NO: 9564 - protein, 487 aa, Sorghum bicolor
  misc_feature: Ceres ANNOT ID no. 6100744
  misc_feature (47)..(374): Pfam Id: Cellulase Pfam Desc: Cellulase (glycosyl hydrolase family 5)
  misc_feature (5)..(482): NCBI GI: 125951512 NCBI Desc: mannan endo-1,4-beta-mannosidase 3 precursor (beta-mannanase 3) (endo-beta-1,4-mannanase 3) (osman3)
  misc_feature (37)..(482): NCBI GI: 125951537 NCBI Desc: mannan endo-1,4-beta-mannosidase 4 (beta-mannanase 4) (endo-beta-1,4-mannanase 4) (osman4)
  misc_feature (14)..(414): NCBI GI: 125951434 NCBI Desc: mannan endo-1,4-beta-mannosidase 1 precursor (beta-mannanase 1) (endo-beta-1,4-mannanase 1) (osman1)
  misc_feature (13)..(414): NCBI GI: 10178872 NCBI Desc: (1-4)-beta-mannan endohydrolase [coffea arabica]
  misc_feature (14)..(372): NCBI GI: 115439011 NCBI Desc: os01g0663300 [oryza sativa (japonica cultivar-group)]
  misc_feature (5)..(482): SWISSPROT Homolog: EC 3.2.1.78 Mannan endo-1,4-beta-mannosidase 3 precursor
  misc_feature: The sequence is a functional homolog of SEQ ID NO 2 in US patent 7148399
MAKAKPRPAAAILLLLISFLAAAAAGGGSDAETTGGGGGMVGVDGTRFVVDDGRPIYFSGFNAYWLMLVASDPARRGKVVAAFRQAADHGLNLARTWAFSDGGDTPLQAAPGVYDEAMFQGLDFVVAEARRHGIYLLLCLTNNFHDFGGKRQYVQWARDAGHRLATDDDFFNSTVVKDYYKNHVKTVLTRVNTLTGVAYKDDPTILGWELMNEPRCDAEPTGAMVQAWVEEMAPYVKSIDGEHLVTAGLEGFYGAGAHESKDLNPWGIYYGTNFVETHRARGVDFATIHLYPDVWLWGSAADAQLAFLRNWTRSHARDADLYLRKPLLVTEYGKFLWEGVAGANRTQRDYFLRLVLDSIYDSAARGGPLVGGAFWQLLDGGMDTLRDGYEIILPEDRLAATIIGNHSRQLAQLSLVTFTGEDVDIEAAALRRRSRRSPHSNRKIRVRSVGGPSDSDSYYTQTQRLLHILLVRFMSLFTSISSLFSSV

SEQ ID NO: 9565 - DNA, 561 bp, Sorghum bicolor
  misc_feature: Ceres ANNOT ID no. 6100758
  misc_feature: Encodes the peptide sequence at SEQ ID NO 9566
atggaggaggccaaggttgtggagtccaaggatggaacgatctccgttgcttcagcatttgctggtcatcaggaagctgtacaagacagggatcataaatttttatcaaaagcagttgaggaagcataccgaggagttgactgcggtgacgggggaccatttggtgcagttgttgtccacaatgatgaagtaatagccagttgccataacatggttttgaagaacaccgatccaactgcgcacgctgaagtaactgcgataagagaggcttgcaaaaagcttgggaaaattgagctgtcggattgtgaaatttatgcatcctgtgagccatgcccaatgtgttttggtgctgttcatctatcccggattaagaggctggtgtatggagccaaggcagaagctgcaattgccattggatttgacgatttcattgctgatgctctcagaggaactgggttctaccagaaggccaacatggagataaagcaggcagatggaaatggagccatgattgctgaacaagtatttgagaagactaaagagaagttccaaatgtattga

SEQ ID NO: 9566 - protein, 186 aa, Sorghum bicolor
  misc_feature: Ceres ANNOT ID no. 6100758
  misc_feature (28)..(130): Pfam Id: dCMP_cyt_deam_1 Pfam Desc: Cytidine and deoxycytidylate deaminase zinc-binding region
  misc_feature (6)..(186): NCBI GI: 115471365 NCBI Desc: os07g0245100 [oryza sativa (japonica cultivar-group)]
  misc_feature (1)..(186): NCBI GI: 18266045 NCBI Desc: deoxycytidine deaminase [brassica oleracea]
  misc_feature (1)..(186): NCBI GI: 22137296 NCBI Desc: at5g28050/f15f15_120 [arabidopsis thaliana]
  misc_feature (7)..(186): NCBI GI: 79328917 NCBI Desc: hydrolase/ zinc ion binding [arabidopsis thaliana]
  misc_feature (1)..(146): NCBI GI: 114703609 NCBI Desc: cytidine deaminase [paspalum simplex]
  misc_feature (31)..(144): SWISSPROT Homolog: EC 3.5.4.3 Guanine deaminase
MEEAKVVESKDGTISVASAFAGHQEAVQDRDHKFLSKAVEEAYRGVDCGDGGPFGAVVVHNDEVIASCHNMVLKNTDPTAHAEVTAIREACKKLGKIELSDCEIYASCEPCPMCFGAVHLSRIKRLVYGAKAEAAIAIGFDDFIADALRGTGFYQKANMEIKQADGNGAMIAEQVFEKTKEKFQMY

SEQ ID NO: 9567 - DNA, 1380 bp, Sorghum bicolor
  misc_feature: Ceres ANNOT ID no. 6100759
  misc_feature: Encodes the peptide sequence at SEQ ID NO 9568
  misc_feature: Down-regulated in shoot tissues in response to salicylic acid treatment
atggttgagatccagtggtccaccgtatccagcatatactgcaaggacatgccgccgaatgtatatcggcctcacagtgtcacaataactgaatttggtgccattggggatggtgtgaccctcaatacaaaggcattccagaatgcaatcttctatctcaattcattcgcggacaagggtggtgcgcagctcttcgtgcctgctggaaggtggctgacagggagttttaatcttatcagccatctcactttatcactggacaaggatgcggtaataattggatctccggattcatctcattggccagttattgatcctcttccatcctatggacgaggtagagagcttcctggaaaaaggcatcagagtctgatttttggattaaatctgacggatgtaattataactggtgctaatggttccattgatggtcaaggagctatttggtggggctggttccgcaaccacacattgaattatactagaccacatcttgttgagttgatgtattctaccaatgttgtcatatctaatctaaccttcaagaactcgccgttttggaatatccaccctgtatactgcagccaagtgcttgtccagcatgtcacaatccttgcgcctttgaattcaccaaacacagatggtgttagtccagactcctccacgaatgtgtgcatcaatcattgctatgtaagaaatggtgacgatgttattgtcattaaaagtggctgggatgagtacggcatttcatttgctcaaccaagctccaatatcagcataagcgacatcacaggggagacaaggggtggtgcagggattgcctttggaagtgagatgtcaggtggcatatcagaagtccgggctgtgggcctccgcattgtcaactcccttcatgggatcagaatcaagacagccccagggcgtggagggtacgtgaagaatgtgtacatagccgatgtgagcatggacaatgtttcaatggccatcaggatcactggaaactatggtgaacatcctgatgacaaatatgacaggactgctctccctgtgataagcaatattacaatcaaggatgtggttggcgttaacattggcgttgctggtatattggaaggcattcagggggacaatttcagcaacatttgtctgtccaatgtttccctcagtgtacaatctgcacatccatggaattgttcacttattgaaggatattctaactcagtgatcccagaatcatgcgaacagctcaaaagcaattgtagacagacacccatttgctacgatggaagcggttcttcagcaatgcatgtgcagcaaccaagacatacatcgagcaccagccggttgctaaatcctttactggagttggcttcattttag

SEQ ID NO: 9568 - protein, 459 aa, Sorghum bicolor
  misc_feature: Ceres ANNOT ID no. 6100759
  misc_feature (59)..(413): Pfam Id: Glyco_hydro_28 Pfam Desc: Glycosyl hydrolases family 28
  misc_feature (23)..(427): NCBI GI: 115489012 NCBI Desc: os12g0554800 [oryza sativa (japonica cultivar-group)]
  misc_feature (23)..(433): NCBI GI: 7939578 NCBI Desc: polygalacturonase-like protein [arabidopsis thaliana]
  misc_feature (23)..(427): NCBI GI: 81074755 NCBI Desc: polygalacturonase-like protein-like [solanum tuberosum]
  misc_feature (23)..(424): NCBI GI: 30692538 NCBI Desc: polygalacturonase-like protein [fragaria x ananassa]
  misc_feature (1)..(428): NCBI GI: 92878953 NCBI Desc: glycoside hydrolase, family 28 [medicago truncatula]
  misc_feature: Useful for making plants with altered cell wall content and/or composition
  misc_feature: GREAT-hit functional homolog of the protein sequence encoded by LOCUS at3g62110
  misc_feature: Useful for making plants with altered carbohydrate content
  misc_feature: Functional homolog of the protein sequence given in SEQ ID NO 13672
  misc_feature: Useful for making plants with altered cell wall content and/or composition
  misc_feature: Functional homolog of the protein sequence given in SEQ ID NO 14056
  misc_feature: Down-regulated in shoot tissues in response to salicylic acid treatment
  misc_feature: The sequence is a functional homolog of SEQ ID NO. 450 in the 11/188,298 US application
MVEIQWSTVSSIYCKDMPPNVYRPHSVTITEFGAIGDGVTLNTKAFQNAIFYLNSFADKGGAQLFVPAGRWLTGSFNLISHLTLSLDKDAVIIGSPDSSHWPVIDPLPSYGRGRELPGKRHQSLIFGLNLTDVIITGANGSIDGQGAIWWGWFRNHTLNYTRPHLVELMYSTNVVISNLTFKNSPFWNIHPVYCSQVLVQHVTILAPLNSPNTDGVSPDSSTNVCINHCYVRNGDDVIVIKSGWDEYGISFAQPSSNISISDITGETRGGAGIAFGSEMSGGISEVRAVGLRIVNSLHGIRIKTAPGRGGYVKNVYIADVSMDNVSMAIRITGNYGEHPDDKYDRTALPVISNITIKDVVGVNIGVAGILEGIQGDNFSNICLSNVSLSVQSAHPWNCSLIEGYSNSVIPESCEQLKSNCRQTPICYDGSGSSAMHVQQPRHTSSTSRLLNPLLELASF

SEQ ID NO: 9569 - DNA, 2910 bp, Sorghum bicolor
  misc_feature: Ceres ANNOT ID no. 6100763
  misc_feature: Encodes the peptide sequence at SEQ ID NO 9570
atggaggccgccaggttcggcacgcaaagcagccacttgtacggcggcgggctgggcgagcttgacctcaacaggcgggagaacagggtgtttggctgggacctcaacgactggagctgggacagtcagcgctttgttgccacaccggtgcctgctcaggcggcgaatggctcaggattgaacagctcaccgtcatcgtctgaggaagctgaggaagatgtggctagaaatggtggcttgagaggtgacactgataagaggaaaagggttgtggtcatcgatgatgatgagacagaggatcaggacacggtcgtgaatggtggcgggtcgctcagcttgagaattgggggtactgctgttggtgttgaagcgatggagaacagcgatgtaaacgaggatgagaggaatggaaagaagatcagggtgcaaggaggcggctcaagtgggccagcatgtcaggttgagggctgtggagcagatctgactgcagcaaaggattaccaccgtcggcacaaggtctgcgagatgcatgctaaggccagcaccgctgtggttgggaacaccgtccagaggttctgccagcaatgtagtagatttcaccttcttcaagaattcgatgaagggaagcgaagttgccggcggcgcttagcaggccacaatagacgcaggaggaaaacccgccctgatactgcagttggtgggactgcttcaattgaggacaaagtcagcaattatttgttgttgagtcttattggaatctgtgctaatttgaactctgacaatgttcagcattcaaacagccaggagttgctatccactcttttaaagaacctagggtctgttgccaaatcactggagccaaaagaactatgtaaactcctggaggcataccaaagcctgcaaaatggatcgaatgctggaacctctggaacagctaatgttgcagaagaagctgcagggccatctaactctaagttgccttttgtgaatggtagtcactgtggacaggcatcatcatctgttgtgccagtacaatcaaaggctaccatggtggtaactccagagcctgcatcatgcaagcttaaggattttgatctgaatgacacttgcaatgatatggaaggctttgaggatgggcaagaaggttcacctacacctgcctttaagacagctgactctcctaactgtgcatcatggatgcagcaagattctactcaaagtccaccacagactagtggcaactcagattcaacatcaacacaatcattgtcaagctcaaatggagacactcagtgccgaactgataagattgtcttcaagcttttcgataaagttcccggtgacttacctccagttttgcgatcacagattcttggttggttgtcgagtagccctactgatatagaaagccatattagacctggctgtattattctaacagtatatcttcggttagttgagtctgcatggcaagagctttctgagaatatgagcctacacctggataagcttttgagtagctccactgatgacttttgggcatctggcttggtatttgtgatggttcgacgccacttagcttttatgctcaatggtcaaattatgttggacagacccctggcacccagttctcatgattactgcaagattttatgtgtcaaacctgttgctgcaccttattctgcaacaataaatttcagagtcgaaggttttaacctactcagtacttcctcaaggctaatttgttcatttgaaggacgttgtatattccaggaagacacggactttatagcagagaatgctgagtgtgaggatagggatatcgaatgcctcagtttttgttgttctgttcctggtccaagaggaagaggatttatagaggttgaagatagtggttttagcaatggcttcttccccttcataattgctgagaaggatgtatgctctgaggtttctgagctggagagcatatttgagtcctccagtaacgaacatgcaaatgttaatgatgatgctagggaccaagctctggagtttataaatgagctgggttggcttcttcatagagcgaacagaatgtctaaagaggatgaaactgatacgtctctagctgcccttaacatgtggagattcaggaatcttggtgtatttgccatggagcgggagtggtgtgctgtgatcaaaatgctgttagatttcttatttattggccttgttgatgtgggatcccgatctccagaagatgtggtgctttcagaaaatttgttgcatgctgctgtacggaggaagtctgttaacatggttagatttctgctgagatacaaaccaaataaaaactcgaagggaactgcacagacatacttatttagacctgatgctctgggcccttcaacgattacccccctccatatagcagctgccacaagtgatgcagaggatgtgttggatgtgctgaccgatgatcctgggctgattggaattagtgcttggagcaatgcacgggacgaaacaggttttaccccagaagactatgctcggcagagaggcaatgatgcttacctgaatctggtccaaaagaagattgataagcatcttggcaaaggccatgttgtcctcggtgttccgagcagtatatgctctgtaataactgatggtgttaagcctggcgatgttagcctcgagatctgcaggccaatgtctgcagcagtgccaagttgcctcctctgcagccgtcaggcacgggtgtatccaaattctaccacaaaaaccttcctttataggccagcaatgttgactgtgatgggagtcgctgtggtttgtgtctgcgtgggcatactccttcacacctttcccagggtttatgctgcacccacattcagatgggaatcgttggagcgtggagccatgtaa

SEQ ID NO: 9570 - protein, 969 aa, Sorghum bicolor
  misc_feature: Ceres ANNOT ID no. 6100763
  misc_feature (151)..(229): Pfam Id: SBP Pfam Desc: SBP domain
  misc_feature (360)..(953): NCBI GI: 92894378 NCBI Desc: sbp [medicago truncatula]
  misc_feature (255)..(967): NCBI GI: 67461551 NCBI Desc: squamosa-promoter binding-like protein 1
  misc_feature (255)..(967): NCBI GI: 5931653 NCBI Desc: squamosa promoter binding protein-like 1 [arabidopsis thaliana]
  misc_feature (226)..(967): NCBI GI: 140055592 NCBI Desc: ankyrin [medicago truncatula]
  misc_feature (384)..(969): NCBI GI: 92870364 NCBI Desc: sbp [medicago truncatula]
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO 1120 in the 10/225,066 US patent application
  misc_feature: The sequence is a functional homolog of SEQ ID NO 1912 in the 10/412,699 US patent application
  misc_feature: The sequence is a functional homolog of SEQ ID NO 432 in the 10/374,780 US patent application
  misc_feature: The sequence is a functional homolog of SEQ ID NO 958 in the 10/412,699 US patent application
  misc_feature: The sequence is a functional homolog of SEQ ID NO. 452 in the 11/188,298 US application
MEAARFGTQSSHLYGGGLGELDLNRRENRVFGWDLNDWSWDSQRFVATPVPAQAANGSGLNSSPSSSEEAEEDVARNGGLRGDTDKRKRVVVIDDDETEDQDTVVNGGGSLSLRIGGTAVGVEAMENSDVNEDERNGKKIRVQGGGSSGPACQVEGCGADLTAAKDYHRRHKVCEMHAKASTAVVGNTVQRFCQQCSRFHLLQEFDEGKRSCRRRLAGHNRRRRKTRPDTAVGGTASIEDKVSNYLLLSLIGICANLNSDNVQHSNSQELLSTLLKNLGSVAKSLEPKELCKLLEAYQSLQNGSNAGTSGTANVAEEAAGPSNSKLPFVNGSHCGQASSSVVPVQSKATMVVTPEPASCKLKDFDLNDTCNDMEGFEDGQEGSPTPAFKTADSPNCASWMQQDSTQSPPQTSGNSDSTSTQSLSSSNGDTQCRTDKIVFKLFDKVPGDLPPVLRSQILGWLSSSPTDIESHIRPGCIILTVYLRLVESAWQELSENMSLHLDKLLSSSTDDFWASGLVFVMVRRHLAFMLNGQIMLDRPLAPSSHDYCKILCVKPVAAPYSATINFRVEGFNLLSTSSRLICSFEGRCIFQEDTDFIAENAECEDRDIECLSFCCSVPGPRGRGFIEVEDSGFSNGFFPFIIAEKDVCSEVSELESIFESSSNEHANVNDDARDQALEFINELGWLLHRANRMSKEDETDTSLAALNMWRFRNLGVFAMEREWCAVIKMLLDFLFIGLVDVGSRSPEDVVLSENLLHAAVRRKSVNMVRFLLRYKPNKNSKGTAQTYLFRPDALGPSTITPLHIAAATSDAEDVLDVLTDDPGLIGISAWSNARDETGFTPEDYARQRGNDAYLNLVQKKIDKHLGKGHVVLGVPSSICSVITDGVKPGDVSLEICRPMSAAVPSCLLCSRQARVYPNSTTKTFLYRPAMLTVMGVAVVCVCVGILLHTFPRVYAAPTFRWESLERGAM

SEQ ID NO: 9571 - DNA, 2151 bp, Sorghum bicolor
  misc_feature: Ceres ANNOT ID no. 6100767
  misc_feature: Encodes the peptide sequence at SEQ ID NO 9572
atggcacgaaaaggaaatcaaagcaagagtggccccaatcatgcttcaccgaactggcaaactacaactgatggtgatgtattaagtacaccagaaaggggtgctgcagacagtgaaaatccaagttcacatgttcaaggcagatcaaagggtcctggaggaagcagtgagaagaaaggaagcagcagcaaaaggaacagcagaaacaatggcatatcatcctttggaaaaaagcaacaaatggataccagttttgatataagcagttcagaagaaaatgagctttcggtaagaggtactaaaaatagaagaggtagcaagaaagcctctaggcgcggttttggtagaagttcttcgattgagcaaacaacatcgtctggattggcaggaaatgttttggagaagaccaggtgcattgcttgcatggctgcatccattattagagcttccatgatatatctagttgaggaaggtaaaagatttatcgacaaaagaaggccaacaatcaacgcttacatggctattgtgaacaaagggcatgcctatgtcttaagcaaaactgcatatgtttatcctatagttcgagcttggatgcttaatgctggaaggttgatgttgctcttgttgacggtttggctagactgcaatctaaggggctttgattctttgctacggttggggacaaactccctcctagcagtactttggtgcagcatgctgtcaacttttgcaatgattgggataaaaaagatgctcatattcatggcgattgctgcttctgtgattgccttcataggtctaggttttgctatcctgcttatctcagtgcttgcagtggtaatcttatggttttatggaagtttttggatgacaacttgtgtaataattcatggaggtgttctcattttcgtgaaacgtgaacgaatagctctcctcgttgcctgtttatattcaatgtattgtgcgagatgctatgttggatggctcgggttgcttttgggcctgaacttatctttcttttctagtgatgttctagtgcagttcctaagggacaatgtagataataagaaattcaatggttcttcaaggaactcggagcaaagctcaggtagacaaggcaatatctttgaagaatttcagccatcagcagatagcgcctcccaagccagatatgctccagcttcagatcgaggtcctggtgatccttcaacaagtggacttgagaaagagctgacctctgaagatgaagtggctcgtttactgaactgcactgaccactattcagcattaggtttccgtcgatatgagaacatagatgtatcatctcttaagagagaatacaagaaaaaggctatgttagtccatcctgataagaatatgggcaacgataaagctgctgatgcatttaaaaagcttcaaaatgcatatgagattcttcttgattcactgaaacgcaagacatatgatgatgagttgaggagggaggatctcctgaattacttcaggcagagtgtttctcaaaagaatggaagaaacagtactttccaacatgggttcagcccttcagaaggtgttgatgaaggtccttatggtctttccagaagaatagcttgcaaaaagtgcggcgacttgcatctttggatttatactggaagagctaaatcacaagctagatggtgtcaggactgcaaggagttccatcaagctaaagatggcgatggatgggttgaacagtcctttcaatctgttctatttggcatgctgcggaagcttgatttacctcatgcatatgtttgtgcagaaagctacatatttgatgtcactgagtggttcaactgtcagggaatgagatgcccggcgaacactcacaaggcaacctttcatgtcaatgccaacatggcaaggcagagtagtggcaaggggagtacctcagcacagaggggtggtaaggccccaagtggtgtaaacatggatggaggactgaacgaggaagagttcttcgagtggttccagaatgcagtcaactctggaatgtttgaaactgcattcggggcacaaggtgacccggcttctcctggtagcggaagcaatgcgaagagtagcagtagcaatagtagtaggaaaaagaagaagggaaagaaacagtggtaa

SEQ ID NO: 9572 - protein, 716 aa, Sorghum bicolor
  misc_feature: Ceres ANNOT ID no. 6100767
  misc_feature (425)..(489): Pfam Id: DnaJ Pfam Desc: DnaJ domain
  misc_feature (1)..(714): NCBI GI: 124361108 NCBI Desc: heat shock protein dnaj [medicago truncatula]
  misc_feature (452)..(716): NCBI GI: 115456409 NCBI Desc: os03g0832900 [oryza sativa (japonica cultivar-group)]
  misc_feature (478)..(705): NCBI GI: 29371958 NCBI Desc: dnaj-like protein [oryza sativa (japonica cultivar-group)]
  misc_feature (409)..(682): NCBI GI: 3152572 NCBI Desc: contains homology to dnaj heatshock protein gbu32803 from haemophilus influenzae. [arabidopsis thaliana]
  misc_feature (154)..(679): NCBI GI: 77556586 NCBI Desc: s-locus protein 5 [oryza sativa (japonica cultivar-group)]
MARKGNQSKSGPNHASPNWQTTTDGDVLSTPERGAADSENPSSHVQGRSKGPGGSSEKKGSSSKRNSRNNGISSFGKKQQMDTSFDISSSEENELSVRGTKNRRGSKKASRRGFGRSSSIEQTTSSGLAGNVLEKTRCIACMAASIIRASMIYLVEEGKRFIDKRRPTINAYMAIVNKGHAYVLSKTAYVYPIVRAWMLNAGRLMLLLLTVWLDCNLRGFDSLLRLGTNSLLAVLWCSMLSTFAMIGIKKMLIFMAIAASVIAFIGLGFAILLISVLAVVILWFYGSFWMTTCVIIHGGVLIFVKRERIALLVACLYSMYCARCYVGWLGLLLGLNLSFFSSDVLVQFLRDNVDNKKFNGSSRNSEQSSGRQGNIFEEFQPSADSASQARYAPASDRGPGDPSTSGLEKELTSEDEVARLLNCTDHYSALGFRRYENIDVSSLKREYKKKAMLVHPDKNMGNDKAADAFKKLQNAYEILLDSLKRKTYDDELRREDLLNYFRQSVSQKNGRNSTFQHGFSPSEGVDEGPYGLSRRIACKKCGDLHLWIYTGRAKSQARWCQDCKEFHQAKDGDGWVEQSFQSVLFGMLRKLDLPHAYVCAESYIFDVTEWFNCQGMRCPANTHKATFHVNANMARQSSGKGSTSAQRGGKAPSGVNMDGGLNEEEFFEWFQNAVNSGMFETAFGAQGDPASPGSGSNAKSSSSNSSRKKKKGKKQW

SEQ ID NO: 9573 - DNA, 1509 bp, Sorghum bicolor
  misc_feature: Ceres ANNOT ID no. 6100770
  misc_feature: Encodes the peptide sequence at SEQ ID NO 9574
atggccacgttgcccggcagcgcccccgccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtgaatctgatcggggagcacatcgactacgagggctactcggtgctgcccatggccatccgccaggacatgatcgtcgccatccggagggccgacggcggccaggtgcgggtcgccaatgtcgacgacaagtaccccctgtgcgtctaccccgccgacccagataaggaaattgacataaaaaatcacaaatgggggcactatttcatgtgtggatacaagggagtttacgaatactgtagatcaaacgggatagatctgggcaaacctgttgcacttgatgttgttgttgatggcacagttcctcaaggctctggattgtcaagctcagcagcttttgtctgttcagcaacaattgctatcatgggagtccttgagaaaaactttccaaagaaagaagttgctcaattcacttgtctgtctgagcgccacattggaacacagtctggaggcatggatcaggctatatctatcatggccaaacctggattcgctgagttgatagattttaatccaattcatgcaactgatgtccaactacctccaggtggtacatttgtgatcgcccattgtttggcagagtccaagaaagcagagacagctgcaacaaattataataaccgtgttgtggagtgtcgcttagcagcgattgttcttgccatcaaactagggatggataggaaaaaagctgtctcctctgttacaaccctctccgatgttgagggtctatgcgtttcttttgctgggaaagaaggttcatctgatcctgcaatagctgtgaagaaacttttgcatgagaatccatatacagctgaagaaatagagaaaattacaggtgaaagcctgacatctgtcttccagagctctcaaacttccttggatgttataaaagctgcaaagcactacaagctatttcagcgtgcgactcatgtctactctgaagcaaggagggtttacgctttcagggatactgtctcctcaaaactcagtgaggaagataagcttaagaaacttggtgatcttatgaacgaaagccattacagctgcagcgtgctatatgagtgcagttgccctgagctggaggagcttgtgaaagtctgtagagacaatggagcactgggagcacgtctcacaggagctgggtggggtggctgtgcggttgctctggtcaaggagcccatcgtccctcagttcattctgaatctaaaggaaatgtactacaaatcaaggattgagaggggagtaatccagcagggtgatctgggcctgtatgttttcgcgtcgaagccatcgagcggcgcagccatattgacgttgtag

SEQ ID NO: 9574 - protein, 502 aa, Sorghum bicolor
  misc_feature: Ceres ANNOT ID no. 6100770
  misc_feature (393)..(471): Pfam Id: GHMP_kinases_C Pfam Desc: GHMP kinases C terminal
  misc_feature (157)..(224): Pfam Id: GHMP_kinases_N Pfam Desc: GHMP kinases N terminal domain
  misc_feature (10)..(499): NCBI GI: 53747925 NCBI Desc: galactokinase [pisum sativum]
  misc_feature (9)..(502): NCBI GI: 2736186 NCBI Desc: galactose kinase [arabidopsis thaliana]
  misc_feature (9)..(502): NCBI GI: 34098869 NCBI Desc: at3g06580 [arabidopsis thaliana]
  misc_feature (9)..(502): NCBI GI: 6537164 NCBI Desc: galactokinase gal1 [arabidopsis thaliana]
  misc_feature (16)..(499): NCBI GI: 92874540 NCBI Desc: mevalonate and galactokinase [medicago truncatula]
  misc_feature (9)..(502): SWISSPROT Homolog: EC 2.7.1.6 Galactokinase
MATLPGSAPAEAAELVPTLSSLEPVYGAGAQLDEARLRFARLGDRFHAVYGARPALFARSPGRVNLIGEHIDYEGYSVLPMAIRQDMIVAIRRADGGQVRVANVDDKYPLCVYPADPDKEIDIKNHKWGHYFMCGYKGVYEYCRSNGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPPGGTFVIAHCLAESKKAETAATNYNNRVVECRLAAIVLAIKLGMDRKKAVSSVTTLSDVEGLCVSFAGKEGSSDPAIAVKKLLHENPYTAEEIEKITGESLTSVFQSSQTSLDVIKAAKHYKLFQRATHVYSEARRVYAFRDTVSSKLSEEDKLKKLGDLMNESHYSCSVLYECSCPELEELVKVCRDNGALGARLTGAGWGGCAVALVKEPIVPQFILNLKEMYYKSRIERGVIQQGDLGLYVFASKPSSGAAILTL

SEQ ID NO: 9575 - DNA, 1149 bp, Sorghum bicolor
  misc_feature: Ceres ANNOT ID no. 6100774
  misc_feature: Encodes the peptide sequence at SEQ ID NO 9576
atgctgggcccgctcctcaggctcctctcggcgtgcggcggggtctggcccacctcgccggcccctggcgccgccggcgccgcggcctcggcctcctcctcctccggggacgactctgagggccgcgacggcctgctctggtggcgcgacctcgcgcgctgccacgctggcgacgtctccgtcgccgtcgcccaggccaaccaggtgctcgaggaccagtgccgcctcgactccgccccgcccctcggcaccgtcgtcggcgtcttcgacggccacggcggccccgacgccgcccgcttcgcctgcgaccacctcgtccccaacctccgagaggcgtcctcaggcccgcggggcgtcaccgcggacgccatcagggaggcgttcctggccacagaggaaggcttcctcgcgctcgtgtcaagcctctgggaggcccagccggacatcgccacggccgggacgtgctgcctcgtcggcgtcgtgcacaacaggacccttttcgtcgccaacctcggcgattcccgggctgttctcgggaagaaggtgggccgcgccgggcagattaccgcggagcagttgtgcagcgagcacaatgccaatcaggaggctgtcaggcaggagctcaaggctcaacacccagatgatgcgcagatagttgcactcaagcatggggtctggagagtgaggggcctcatacaggtgtctagatcaatcggcgatgtatacctgaaacatgcaaagtataacacagagcgaatcaaacccaagttcaggctttctgaatcattcagcaagccattgttgagtgctgatccagctatcatctcccgcaatcttgaaccaaatgactgtttcatcatattcgcgtcagatggtttgtgggaacacctgagcaatcaggaagctgttgagattgttcacaaccatcaacatgctggaagtgcaagaagactcataaaagccgctctacaagaagcagcgcggaagcgtgagatgcgttactcggaccttacaaagatcgataagaaagttcgcaggcattttcatgatgacattactgtcatcgtcttatttataaaccatgacctattattgaaaggtgctccgcaaggacaacccctctccatcagatgtgccctagattattga

SEQ ID NO: 9576 - protein, 382 aa, Sorghum bicolor
  misc_feature: Ceres ANNOT ID no. 6100774
  misc_feature (49)..(331): Pfam Id: PP2C Pfam Desc: Protein phosphatase 2C
  misc_feature (1)..(382): NCBI GI: 18401370 NCBI Desc: protein phosphatase 2c family protein / pp2c family protein [arabidopsis thaliana]
  misc_feature (25)..(382): NCBI GI: 7670033 NCBI Desc: protein phosphatase 2c-like protein [arabidopsis thaliana]
  misc_feature (29)..(377): NCBI GI: 4206122 NCBI Desc: protein phosphatase 2c homolog [mesembryanthemum crystallinum]
  misc_feature (1)..(377): NCBI GI: 10177123 NCBI Desc: protein phosphatase 2c-like protein [arabidopsis thaliana]
  misc_feature (1)..(379): NCBI GI: 59958308 NCBI Desc: at4g38520 [arabidopsis thaliana]
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: The sequence is a functional homolog of SEQ ID NO. 406 in the 11/188,298 US application
  misc_feature: The sequence is a functional homolog of SEQ ID NO. 386 in the 11/188,298 US application
  misc_feature: The sequence is a functional homolog of SEQ ID NO. 448 in the 11/188,298 US application
  misc_feature: The sequence is a functional homolog of SEQ ID NO. 363 in the 11/188,298 US application
MLGPLLRLLSACGGVWPTSPAPGAAGAAASASSSSGDDSEGRDGLLWWRDLARCHAGDVSVAVAQANQVLEDQCRLDSAPPLGTVVGVFDGHGGPDAARFACDHLVPNLREASSGPRGVTADAIREAFLATEEGFLALVSSLWEAQPDIATAGTCCLVGVVHNRTLFVANLGDSRAVLGKKVGRAGQITAEQLCSEHNANQEAVRQELKAQHPDDAQIVALKHGVWRVRGLIQVSRSIGDVYLKHAKYNTERIKPKFRLSESFSKPLLSADPAIISRNLEPNDCFIIFASDGLWEHLSNQEAVEIVHNHQHAGSARRLIKAALQEAARKREMRYSDLTKIDKKVRRHFHDDITVIVLFINHDLLLKGAPQGQPLSIRCALDY

SEQ ID NO: 9577 - DNA, 1281 bp, Sorghum bicolor
  misc_feature: Ceres ANNOT ID no. 6100776
  misc_feature: Encodes the peptide sequence at SEQ ID NO 9578
atggcgatcctcgagaggtcgtcgtcccccgccgcggcctccgtcgccgtcgcggccctgatcgcgctcgcgtccgtcgccggcgtcgccggcgaggtcttcttccaggagaagtttgacgatggatgggaggatcgatgggtcaagtccgactggaagaaggacgacaacacggcaggcgagtggaaccacacatctggcaaatggaacggagatgccgacgacaaaggaatccagacctctgaagactacaggttctacgccatttcagcgcagtaccctgagttcagcaacaaggataagaccctggtgctgcagttctcggtgaagcatgagcagaagctcgactgtggcggtggctatttgaaattgcttgggtctgatgttgatcagaagaagtttggtggcgacaccccatacagcatcatgtttgggccggatatctgcgggtatgccaccaagaaggtccacgctatccttactaagaacggcaagaaccatttgatcaagaaggaggtgccatgcgagacagaccagctgacacatgtttacaccctgatcatccggcctgatgccacatacagcattctcattgataacgatgagaagcaatctggtagcatctatgatgattgggatattcttcctccaaagaagatcaaagaccctgaagccaagaagccagaagactgggatgataaggaatacattcctgatcctgaggacaagaagccagagggttatgatgatattcccaaggaaattcctgaccctgatgcaaagaagccagaggattgggatgatgaggaagatggtgaatggactgccccaaccattcctaacccagagtacaaaggaccatggaagcaaaagaaaatcaagaatccagactacaagggcaagtggaaggcccctttgattgacaacccagatttcaaggacgatccttacatctacgcttttgacagtttgaagcacattggcattgagctgtggcaggttaaatcaggaactttgttcgacaacattttgataactgatgaccctgagtacgccaagaagttagcagtggatacctggggcaagcagaaagatgctgagaaggctgccttcgacgaggctgagaaaaagaggcttgaggaggaatctgcaagcagtaaggacgacgatgacgacttagatgtagatgaggatgaggatgatgcggacgatgacaaggctgatcatagtgatactgatgaggccgaggacagcgaagaggctaaacatgatgagctctag

SEQ ID NO: 9578 - protein, 426 aa, Sorghum bicolor
  misc_feature: Ceres ANNOT ID no. 6100776
  misc_feature (33)..(345): Pfam Id: Calreticulin Pfam Desc: Calreticulin family
  misc_feature (1)..(426): NCBI GI: 84028192 NCBI Desc: calreticulin precursor
  misc_feature (13)..(426): NCBI GI: 577612 NCBI Desc: calcium-binding protein [zea mays]
  misc_feature (13)..(426): NCBI GI: 6014707 NCBI Desc: calreticulin [zea mays]
  misc_feature (19)..(426): NCBI GI: 439586 NCBI Desc: calreticulin
  misc_feature (1)..(426): NCBI GI: 6682833 NCBI Desc: calcium-binding protein [oryza sativa]
MAILERSSSPAAASVAVAALIALASVAGVAGEVFFQEKFDDGWEDRWVKSDWKKDDNTAGEWNHTSGKWNGDADDKGIQTSEDYRFYAISAQYPEFSNKDKTLVLQFSVKHEQKLDCGGGYLKLLGSDVDQKKFGGDTPYSIMFGPDICGYATKKVHAILTKNGKNHLIKKEVPCETDQLTHVYTLIIRPDATYSILIDNDEKQSGSIYDDWDILPPKKIKDPEAKKPEDWDDKEYIPDPEDKKPEGYDDIPKEIPDPDAKKPEDWDDEEDGEWTAPTIPNPEYKGPWKQKKIKNPDYKGKWKAPLIDNPDFKDDPYIYAFDSLKHIGIELWQVKSGTLFDNILITDDPEYAKKLAVDTWGKQKDAEKAAFDEAEKKRLEEESASSKDDDDDLDVDEDEDDADDDKADHSDTDEAEDSEEAKHDEL

SEQ ID NO: 9579 - DNA, 696 bp, Sorghum bicolor
  misc_feature: Ceres ANNOT ID no. 6100777
  misc_feature: Encodes the peptide sequence at SEQ ID NO 9580
atgccggcggccatggcggctgcggcggcgcagaggctcctcgcggcgagcacgaaaatcatcggcgttgggcgcaactacgtagcccacgccaaggagctcggcaacccggtcccaaaggagcccgtcctgttcctgaagccgacctcgtcgttcctccatgctggagttgccaccgccgccgtggagatcccggagccgctcgagtcgctgcaccacgaggtagagctcgccgtcgtcatctcccagcgcgggcgcgacgttcctgaggcgtccgccatggacttcgtcggaggttatgcacttgctttggacatgacagcaagggaccttcaatctgttgctaagtctgcaggccttccatggactttggctaaaggacaagacaccttcactccaattagtgcagtagttccaaaatcggctgtcactaatcccgatgatctcgagctctggctaaaggtagatgatgaactaaggcagaaaggaccgacaagtgacatgctattcaagattccttttctgatcagctatatcagttccttcatgacattaatggagggtgatgtgatactaacaggtacccctgagggtgtgggtcctgtccgagtaggtcagaagatcacagctggtgtaactgacctaattgatgtcgagtttgatgttcagaggcgcaatcggtcattttccacatga

SEQ ID NO: 9580 - protein, 231 aa, Sorghum bicolor
  misc_feature: Ceres ANNOT ID no. 6100777
  misc_feature (34)..(204): Pfam Id: FAA_hydrolase Pfam Desc: Fumarylacetoacetate (FAA) hydrolase family
  misc_feature (5)..(230): NCBI GI: 21593651 NCBI Desc: isomerase like protein [arabidopsis thaliana]
  misc_feature (7)..(231): NCBI GI: 71040689 NCBI Desc: isomerase-like protein [arachis hypogaea]
  misc_feature (5)..(230): NCBI GI: 7268342 NCBI Desc: isomerase like protein [arabidopsis thaliana]
  misc_feature (19)..(228): NCBI GI: 28829830 NCBI Desc: similar to arabidopsis thaliana (mouse-ear cress). at4g15940/dl4011w (isomerase like protein) [dictyostelium discoideum]
  misc_feature (5)..(224): NCBI GI: 62901958 NCBI Desc: dkfzp566j2046 [synthetic construct]
MPAAMAAAAAQRLLAASTKIIGVGRNYVAHAKELGNPVPKEPVLFLKPTSSFLHAGVATAAVEIPEPLESLHHEVELAVVISQRGRDVPEASAMDFVGGYALALDMTARDLQSVAKSAGLPWTLAKGQDTFTPISAVVPKSAVTNPDDLELWLKVDDELRQKGPTSDMLFKIPFLISYISSFMTLMEGDVILTGTPEGVGPVRVGQKITAGVTDLIDVEFDVQRRNRSFST

SEQ ID NO: 9581 - DNA, 1002 bp, Sorghum bicolor
  misc_feature: Ceres ANNOT ID no. 6100779
  misc_feature: Encodes the peptide sequence at SEQ ID NO 9582
atggcggcgatgacggtgaggcaccggcagctggaggccaacggcatatcgatgcacgtggcggaggccggccccgtggacgcctccgcgccggcggtgctgttcgtgcacggcttcccggagctctggtactcgtggcgccaccagatggactacctcgccgcgcgcggctaccgctgcgtggcgcccgacctccggggctacggcgggaccaccgcgccgccggagccgtcgtcgtacaccgccttccacatcgtcggcgacctcgtcgcgctcctggacgccctccacctcccgcaggtgttcgttgtgggccacgactggggcgccatcgtgtcgtggaacctctgcctgctgcggccggatcgggtgcgcgcgctcgtcaacctcagcgttgccttcatgccccggaaccccggcgtcaagcctcttgagtacttccgcgccgcatacggcgatgactactacgtctgccgattccaggaacctggacttgaagcagaatttgctgcttttgacctgaagagtttcttcaaattggcattgactcttcgggccacaggttcttcagtcatggaccttagaaaaatgcaaacatacgctaagcaaatagagctaccttcttggctctctgaggaagatgtcaattaccttgcaagtgtgtactcaaaaactggatttgctggtggagtaaattactaccgctgcttggacctgaactgggaactgatggcgccatggacaagagcaaaggtgcaagtgccgactaagttcatcgttggggacggtgacctggcataccatcacccgggagtgaagagctacatccacaagggtgggctcaagagggacgtgcccatgcttgaggaggtggtggttatcaagggcgctgggcacttcatccagcaggaaagggctcaggaaatcagtgagcacatccatgactacatcaagaagtttgaagctggtgttctgccaccactaagagtttcaaagctgtga

SEQ ID NO: 9582 - protein, 333 aa, Sorghum bicolor
  misc_feature: Ceres ANNOT ID no. 6100779
  misc_feature (58)..(315): Pfam Id: Abhydrolase_1 Pfam Desc: alpha/beta hydrolase fold
  misc_feature (8)..(320): NCBI GI: 25044843 NCBI Desc: epoxide hydrolase [ananas comosus]
  misc_feature (6)..(320): NCBI GI: 46090793 NCBI Desc: soluble epoxide hydrolase [citrus jambhiri]
  misc_feature (6)..(320): NCBI GI: 407940 NCBI Desc: epoxide hydrolase
  misc_feature (6)..(320): NCBI GI: 27960680 NCBI Desc: soluble epoxide hydrolase [euphorbia lagascae]
  misc_feature (6)..(320): NCBI GI: 407944 NCBI Desc: epoxide hydrolase
MAAMTVRHRQLEANGISMHVAEAGPVDASAPAVLFVHGFPELWYSWRHQMDYLAARGYRCVAPDLRGYGGTTAPPEPSSYTAFHIVGDLVALLDALHLPQVFVVGHDWGAIVSWNLCLLRPDRVRALVNLSVAFMPRNPGVKPLEYFRAAYGDDYYVCRFQEPGLEAEFAAFDLKSFFKLALTLRATGSSVMDLRKMQTYAKQIELPSWLSEEDVNYLASVYSKTGFAGGVNYYRCLDLNWELMAPWTRAKVQVPTKFIVGDGDLAYHHPGVKSYIHKGGLKRDVPMLEEVVVIKGAGHFIQQERAQEISEHIHDYIKKFEAGVLPPLRVSKL

SEQ ID NO: 9583 - DNA, 984 bp, Sorghum bicolor
  misc_feature: Ceres ANNOT ID no. 6100780
  misc_feature: Encodes the peptide sequence at SEQ ID NO 9584
atggcggcgatccggcaccggacggtggaggcgaacggcatctcgatgcacgtggcggagtcgggcgccgaaggggaccccgcggttgtgttcctgcacggcttcccggagctctggtactcgtggcgccaccagatggcgcacctggccgcgcggggctaccgctgcgtggcgcccgacctccgcggctacggcggcaccgccgcgccgaccgacgtcgcgtcctacaccgccttccacgtcgtcggcgacgtcgtggcgctgctcgacgcgctcggcatccaaaaggtgttcgtggtgggtcacgactggggcgccatcatcgcgtggtacctgtgcctgttccggccggaccgggtcacggcgctcgtcaacaccagcgtcgccttcatgcgccatgtcttcatccgcgccggcgcctccgccgtcaagcccaccgactacttctgccgcaactacgggcccacctactacatctgccgcttccaggagcctggtgtcgcagagaaggagttctcgccggcgaccgcccggtacctgatgaagccgatcctgtgcaaccgcttcacctcctcggcggcaggcggcgagaagccagcagacacggcggcgcccgccgcccccgtcgaggaaccgctgccgccgtggctgacggaggaggacgtgggccactttgtgtcggagttcgagcggacgggcttcacggggcccatcaactactaccgcaacatggaccgcaactgggagctggcggcgccgtgggcggacgccaaggtgcaggtgcccaccaggttcatcgtcggcgacggcgacctcacctaccactacccgggcatccaggactacatccacaagggcgggttccaggccgacgtaccggggctcgacagcgtcgtcgtcatccccggcgccggccacttcgtccagcaggagaaggccgacgaggttagccagcatatctacgacttcatctccaagttctga

SEQ ID NO: 9584 - protein, 327 aa, Sorghum bicolor
  misc_feature: Ceres ANNOT ID no. 6100780
  misc_feature (54)..(322): Pfam Id: Abhydrolase_1 Pfam Desc: alpha/beta hydrolase fold
  misc_feature (1)..(327): NCBI GI: 25044843 NCBI Desc: epoxide hydrolase [ananas comosus]
  misc_feature (1)..(327): NCBI GI: 46090793 NCBI Desc: soluble epoxide hydrolase [citrus jambhiri]
  misc_feature (1)..(327): NCBI GI: 124360004 NCBI Desc: epoxide hydrolase [medicago truncatula]
  misc_feature (1)..(327): NCBI GI: 124360008 NCBI Desc: epoxide hydrolase [medicago truncatula]
  misc_feature (1)..(327): NCBI GI: 92895845 NCBI Desc: epoxide hydrolase [medicago truncatula]
MAAIRHRTVEANGISMHVAESGAEGDPAVVFLHGFPELWYSWRHQMAHLAARGYRCVAPDLRGYGGTAAPTDVASYTAFHVVGDVVALLDALGIQKVFVVGHDWGAIIAWYLCLFRPDRVTALVNTSVAFMRHVFIRAGASAVKPTDYFCRNYGPTYYICRFQEPGVAEKEFSPATARYLMKPILCNRFTSSAAGGEKPADTAAPAAPVEEPLPPWLTEEDVGHFVSEFERTGFTGPINYYRNMDRNWELAAPWADAKVQVPTRFIVGDGDLTYHYPGIQDYIHKGGFQADVPGLDSVVVIPGAGHFVQQEKADEVSQHIYDFISKF

SEQ ID NO: 9585 - DNA, 3165 bp, Sorghum bicolor
  misc_feature: Ceres ANNOT ID no. 6100781
  misc_feature: Encodes the peptide sequence at SEQ ID NO 9586
atggctgataatggtaatgccaaaggcggatctggtgcctatacaattaatctcgagaacttcagtaagcggctgaaggtattctatgaccattggaaggagcacaagtctgatctttggagttcatctgatgctattgccattgctaccccacctccttcggatgatcttcgttatttgaaatcatcagccctggatatttggttacttggatatgaatttccagaaacgataattgtcttcatgcacaagcaaatacatgttctatgcagtcagaagaaagcaaatcttatcgggaccctcaagaaggctgcaaatgagtctgttggtgttgacattgtgttgcatgtgaaaaccaagaatggtgatggtgctgacttgatggatcacatagtgcaggctgctcgtaatcaatcgaaatcagacaagccagttgttggacacatcgccaaagaggtacctgagggtaagcttcttgaaacatggacagaaaagttatctgggtcaggcgtacggcttacagatgtaacaaacggcttctctgagctctttgctgtgaaggacaccacagaggtgacatgtgtgaagaaggctgcttacttaacttcatctgttctgaaaaattttgtggttccaaagttggagaaggttattgatgaggagaagaaagtctcacactcatcgttgatggatgacacagagaaggctattcttgatcccctgaaggtcaaggtgaagttgaagcctgacaatgttgatatatgctaccctccagtatttcaaagtgggggtaagtttgatctgaagcctggtgcgtctagcaacgacgagtacctgtattatgattcagcaagtgttatcatctgtgcaattggttccaaatatagtagctattgttcaaatgttgctcggacatatcttattgatgctacccctaaacaaagtaaagcatatgagacccttttgaaagctcatgaagctgctgttcaagaagtgaaaccaggcaatcagatgagtgcggtttatcaagctgcagttgcagtgattgagaaggatgcccctgaactacttcctaatctaacaaagtcagctggaactggaataggccttgaattccgagaatctggcttaaatctgaatgccaagaatgatcgtaagataaagcagggaatggtttttaatgtctcccttggtttgcataacgtccaggcagaaaccaccagtgagaagacaaagcagttttcactgttattagctgatacagttttagttaatgaaagaggacacgacatcttaacagcaccttgctccaaggcagtcaaagatgttgcttattcgttcaatgaagatgatgaagatgttgctgaggtgaagatggagtcgaagaccatagatgtcatgccaaccaaggcaactctcaggtcagacaaccaggaaatgtcgaaggaagagctccggagacagcaccaggctgaacttgctcgtcaaaagaatgaagagactgctagaaggcttgctggggttggttctggatctggtgatggacgtggtcctgcaagggcttcaaatgagcttgttgcatacaagaatgttaatgatgtaccatttgtgagagatttggtgatccaagtagatcagaaaaatgaagctgtcctcttacctatttatggcagcatggttcctttccatgtttctactgtcaagagtgtgaccagccaccaggacaaccgcacctgcactatccgcatcttcttcaatgtgcctggaatgccattctcaaatgatagcaaactaaattctcaaggcgctatctatctcaaagaaattacattccgctcaaaagatccacggcatagcagtgaagttgttcagcagatcaaaacgttgaggaggcaagttgcttcaagggagtcagagagagctgaaagggcaactcttgttacccaggagaaacttcagataggaaacaacagaatgaagatgatgagactttctgatgtgtggatacgacctgcattcggtggtcgtgggaggaagctcactggaaatcttgaggctcatttcaatggtttcagatattctacttcaaggtctgatgagcgcgtggacatcatgtttggaaatataaagcatgcgtttttccagcctgcagagaaagaaatgattactctccttcatttccatctgcacaaccatatcatggttggaaacaaaaagacaaaggatgtccagttctatgttgaagtgatggatgttgtccagactcttggtggcagtagaagatcggcacttgatcctgatgagattgaagaagagcagcgtgagagggataggaagaacagaattaacatggatttccagaactttgtgaacaaggttaatgaccactggtcgcaaccacagttcaaggggcttgacctggagtttgatgtcccccttagggagcttgggttttatggtgtcccatataaagcttctgctttcatcattccaacttctacttgtttggttgagctgattgagaaccccttcctggtggtgagcctgagtgagatagagattgttaacctggagagggtgggctttggaacgaagaactttgacatggctattgtgttcaaggacttcaagaaggatgttctccgcattgattccatcccttcagcatcgctcgacgcgataaaggagtggctggacacaactgacctcaagtactacgagagcaggctgaatctgaactggcgtcctatcctgaaaactataatcgatgatcctcagaagttcattgacgatggcggctgggagttccttaacatggaagcgagtgactcagagactgaggacacagaggagtcagaccaaggctatgtgccttctgatgctgagcctgagtccgagtcagaagatgatgactctgacagcgagtccttggtggaatctgatgatgatgatgaagagtcagacgaggactcagaggaggagaagggcaagacctgggaggagctggagcgcgaggcaagcaatgcggaccgtgagcacggtgcagagtcggacagtgaggaagagaggaggcgccgcaaggcgaagaccttcagcaagtcacgtgcacctgaacgcagcagcttcaagggagcgccgccctccaagaagccaaagtttaggtga

SEQ ID NO: 9586 - protein, 1054 aa, Sorghum bicolor
  misc_feature: Ceres ANNOT ID no. 6100781
  misc_feature (542)..(693): Pfam Id: SPT16 Pfam Desc: FACT complex subunit (SPT16/CDC68)
  misc_feature (833)..(992): Pfam Id: Rtt106 Pfam Desc: Histone chaperone Rttp106-like
  misc_feature (193)..(434): Pfam Id: Peptidase_M24 Pfam Desc: metallopeptidase family M24
  misc_feature (1)..(1054): NCBI GI: 24021798 NCBI Desc: global transcription factor group c 102 [zea mays]
  misc_feature (1)..(1054): NCBI GI: 75295962 NCBI Desc: fact complex subunit spt16 (facilitates chromatin transcription complex subunit spt16)
  misc_feature (1)..(1054): NCBI GI: 38346977 NCBI Desc: osjnbb0062h02.2 [oryza sativa (japonica cultivar-group)]
  misc_feature (1)..(1054): NCBI GI: 92868642 NCBI Desc: peptidase m24 [medicago truncatula]
  misc_feature (10)..(1045): NCBI GI: 77555238 NCBI Desc: contains similarity to the n terminal domain of the e1 protein [oryza sativa (japonica cultivar-group)]
MADNGNAKGGSGAYTINLENFSKRLKVFYDHWKEHKSDLWSSSDAIAIATPPPSDDLRYLKSSALDIWLLGYEFPETIIVFMHKQIHVLCSQKKANLIGTLKKAANESVGVDIVLHVKTKNGDGADLMDHIVQAARNQSKSDKPVVGHIAKEVPEGKLLETWTEKLSGSGVRLTDVTNGFSELFAVKDTTEVTCVKKAAYLTSSVLKNFVVPKLEKVIDEEKKVSHSSLMDDTEKAILDPLKVKVKLKPDNVDICYPPVFQSGGKFDLKPGASSNDEYLYYDSASVIICAIGSKYSSYCSNVARTYLIDATPKQSKAYETLLKAHEAAVQEVKPGNQMSAVYQAAVAVIEKDAPELLPNLTKSAGTGIGLEFRESGLNLNAKNDRKIKQGMVFNVSLGLHNVQAETTSEKTKQFSLLLADTVLVNERGHDILTAPCSKAVKDVAYSFNEDDEDVAEVKMESKTIDVMPTKATLRSDNQEMSKEELRRQHQAELARQKNEETARRLAGVGSGSGDGRGPARASNELVAYKNVNDVPFVRDLVIQVDQKNEAVLLPIYGSMVPFHVSTVKSVTSHQDNRTCTIRIFFNVPGMPFSNDSKLNSQGAIYLKEITFRSKDPRHSSEVVQQIKTLRRQVASRESERAERATLVTQEKLQIGNNRMKMMRLSDVWIRPAFGGRGRKLTGNLEAHFNGFRYSTSRSDERVDIMFGNIKHAFFQPAEKEMITLLHFHLHNHIMVGNKKTKDVQFYVEVMDVVQTLGGSRRSALDPDEIEEEQRERDRKNRINMDFQNFVNKVNDHWSQPQFKGLDLEFDVPLRELGFYGVPYKASAFIIPTSTCLVELIENPFLVVSLSEIEIVNLERVGFGTKNFDMAIVFKDFKKDVLRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESDEDSEEEKGKTWEELEREASNADREHGAESDSEEERRRRKAKTFSKSRAPERSSFKGAPPSKKPKFR

SEQ ID NO: 9587 - DNA, 480 bp, Sorghum bicolor
  misc_feature: Ceres ANNOT ID no. 6100783
  misc_feature: Encodes the peptide sequence at SEQ ID NO 9588
atgtatccagctaagccctgcgcgccggccgggatggcggcggcgccagtggtcggcttccccgtcgccggagctctcaggcagcaatggtcgtcgggcctcttcgactgcttggacgactgccacatctgctgcctgacgtactggtgcccgtgcatcacgttcgggcggatcgcggagatggtggaccgcggcgcgacgtcgtgcgggacgagcggggcactgtacgcggtcatcgcctgcctcacggcgtcgcagtgcacctgggtctactcctgcacctaccgcgccatgatgcgcgcgcagttcggcctccccgaggcgccatgcgccgactgcctcgtccacctctgctgcgagccctgcgcgctctgccagcagtacagggagctcacggcgcgcggcctcgaccccgtccatggctgggacttcaacgccgccatgtacccgccgcccacgcaggggatgcgacgacgctga

SEQ ID NO: 9588 - protein, 159 aa, Sorghum bicolor
  misc_feature: Ceres ANNOT ID no. 6100783
  misc_feature (30)..(131): Pfam Id: PLAC8 Pfam Desc: PLAC8 family
  misc_feature (16)..(147): NCBI GI: 144924422 NCBI Desc: uncharacterized cys-rich domain [medicago truncatula]
  misc_feature (30)..(145): NCBI GI: 115458794 NCBI Desc: os04g0461600 [oryza sativa (japonica cultivar-group)]
  misc_feature (14)..(151): NCBI GI: 92871574 NCBI Desc: uncharacterized cys-rich domain [medicago truncatula]
  misc_feature (29)..(145): NCBI GI: 144924419 NCBI Desc: uncharacterized cys-rich domain [medicago truncatula]
  misc_feature (30)..(145): NCBI GI: 4105794 NCBI Desc: pgps/d12 [petunia x hybrida]
MYPAKPCAPAGMAAAPVVGFPVAGALRQQWSSGLFDCLDDCHICCLTYWCPCITFGRIAEMVDRGATSCGTSGALYAVIACLTASQCTWVYSCTYRAMMRAQFGLPEAPCADCLVHLCCEPCALCQQYRELTARGLDPVHGWDFNAAMYPPPTQGMRRR

SEQ ID NO: 9589 - DNA, 522 bp, Sorghum bicolor
  misc_feature: Ceres ANNOT ID no. 6100787
  misc_feature: Encodes the peptide sequence at SEQ ID NO 9590
atgtatccggccaagcccaccgccgccgcagccagcgcgcctgtggtcgggatggcgccgccggtgaccggcgtccccatctccagccccggccccgtcgcggccaccgagtggtcctccggcctctgcgcctgcttcgacgactgcggcctctgctgcctgacgtgctggtgcccgtgcatcacgttcggtcggatcgcggagatcgtggaccgcggcgcgacgtcgtgcggcgccgcgggcgccatctacacggtgctggcctgcttcacggggtgccagtggatctactcctgcacgtaccgctccaagatgcgcgcgcagctcggcctccccgacgtcggctgctgcgactgctgcgtccacttctgctgcgagccctgcgcgctctgccagcagtacagggagctcaaggcccgcggcttccaccccgacctcggctgggacgtcaacgcccagaaggcggcggccaacgccgctgccggcatgtacccgccggcagcgcaggggatgggccgctaa

SEQ ID NO: 9590 - protein, 173 aa, Sorghum bicolor
  misc_feature: Ceres ANNOT ID no. 6100787
  misc_feature (38)..(137): Pfam Id: PLAC8 Pfam Desc: PLAC8 family
  misc_feature (20)..(173): NCBI GI: 144924422 NCBI Desc: uncharacterized cys-rich domain [medicago truncatula]
  misc_feature (9)..(165): NCBI GI: 115458794 NCBI Desc: os04g0461600 [oryza sativa (japonica cultivar-group)]
  misc_feature (19)..(173): NCBI GI: 92871574 NCBI Desc: uncharacterized cys-rich domain [medicago truncatula]
  misc_feature (5)..(173): NCBI GI: 144924419 NCBI Desc: uncharacterized cys-rich domain [medicago truncatula]
  misc_feature (14)..(173): NCBI GI: 27414015 NCBI Desc: fw2.2 [lycopersicon hirsutum]
MYPAKPTAAAASAPVVGMAPPVTGVPISSPGPVAATEWSSGLCACFDDCGLCCLTCWCPCITFGRIAEIVDRGATSCGAAGAIYTVLACFTGCQWIYSCTYRSKMRAQLGLPDVGCCDCCVHFCCEPCALCQQYRELKARGFHPDLGWDVNAQKAAANAAAGMYPPAAQGMGR

SEQ ID NO: 9591 - DNA, 1959 bp, Sorghum bicolor
  misc_feature: Ceres ANNOT ID no. 6100797
  misc_feature: Encodes the peptide sequence at SEQ ID NO 9592
atggcgggcggcggcgatcgccagggcgcgaagaagcgcaagcgcgagcatgcggaagggaaggccaagcctcggccgcaagttaagggaggtggggacggagggaagcggaagaagcactcggccgcagatggcggggccggagaggctgtggcgaggaagaagactccggttacccacaaggagaagcgcatcgcggccaaggaaatgtcggaggccaggaagatgaagaggaaacggcattacagccttgagaaggaactaacgaaactgtgggaaaagatgagatgtcacgatgtgagcaaagaagagaggtccaaggtagtaagtgaggctatcaagaaaatggatgggaaatatttggatattgccacatcacatattactgcacgtgttcttcaaacatgtgtaaagtggtgctcgcagtcagagagggatgctatttttgatgttctacatccacatttgctcgatctttctcgcaagaaatatgctgttttccttgtaaagaagcttatagaactcgcctctaaaaaacagtttgccagtttcatctcttctcttcatggtcgtgttgccaaacttcttcatcatactataggagctgcagttgttgattatgcatttcagcggggaacaaaacgtcagaaaaaacagttgttgctggaactgtactccactgaacttcagctattccaggatctgactttgcaaagttcctgctgtttgatagatacaatttccaagcttgggttgcagttatcatctgtcctgcagtacatgactattgtgattcataaaatcttggagaaaggtactgttgagtattcaatagtgcacacggccatattggagtactttacaattgcagataagacctcagcctcggacgttatttgtcaacttatcccccttcttactcaaggagcattaatcatagatggagatgaaccatcaaatgctccggagctaccaaagaaaacaaaagctaagaagaaaaggtcgaaagagccacttatcgttaggatcatgcagacaagggaaggtttaaaactaggaattggttgcctcaagcatggcagtgcaaaggacaggaagaagatcattaaaagtttgaaggggcacattctgaagcttgctctaagtgattttggatgccttttccttatctgcattctttccattgttgatgacacaaagcttgtttctaagattgtcattcaagagctggcaaaacatttaaagcaactcatttttgacaagaatgggagacggccattgctgcaactactaaaccctctttgctcacgctatctttctccggatgatctggcttgtctgaactacaatgtgccgtctcttagtccaaaagagggtgacacatcagaaaacgtagtaaatggtatgactgatgaagaccctaatggcttagtagtcatgcaaattgtgtctgagagcaagaaggatccattacaaaggcgacatgaactgttggtgaaaactgagctggctgaggctctcatccaatcatgccttgaaaatgttggagaattacttcgaacaaattttggcaaagaaatattatatgagattgttgttggtggtaaagacaatattttggagggcctcactgataggatccacatgttgcatgatgcaatagtgtctgatgcagcccaaccgaagactgaagatattgaacatgcatttgagaatttcttttccagtcgtgtaatcagaagaatgataattgactgtccagcatttgcagtcactctctggagaaaggttcttgaaggaaagtgcaagatatgggctgaaggatacagctcgaaggtggttgcaggtttcctggaatcgccaagtaaggaggtcaaggatcttgcaaaacctgagctgcagccactggttgatgctggcatccttaaagtgccagaccctaaggttgttcagaaataa

SEQ ID NO: 9592 - protein, 652 aa, Sorghum bicolor
  misc_feature: Ceres ANNOT ID no. 6100797
  misc_feature (7)..(299): NCBI GI: 81170662 NCBI Desc: protein kiaa0020
  misc_feature (103)..(299): NCBI GI: 50510329 NCBI Desc: mkiaa0020 protein [mus musculus]
  misc_feature (36)..(299): NCBI GI: 44984889 NCBI Desc: afr342cp [eremothecium gossypii]
  misc_feature (36)..(299): NCBI GI: 45198860 NCBI Desc: afr342cp [eremothecium gossypii]
  misc_feature (7)..(439): NCBI GI: 81175177 NCBI Desc: protein kiaa0020 (protein 5 transactivated by hepatitis b virus x antigen)
MAGGGDRQGAKKRKREHAEGKAKPRPQVKGGGDGGKRKKHSAADGGAGEAVARKKTPVTHKEKRIAAKEMSEARKMKRKRHYSLEKELTKLWEKMRCHDVSKEERSKVVSEAIKKMDGKYLDIATSHITARVLQTCVKWCSQSERDAIFDVLHPHLLDLSRKKYAVFLVKKLIELASKKQFASFISSLHGRVAKLLHHTIGAAVVDYAFQRGTKRQKKQLLLELYSTELQLFQDLTLQSSCCLIDTISKLGLQLSSVLQYMTIVIHKILEKGTVEYSIVHTAILEYFTIADKTSASDVICQLIPLLTQGALIIDGDEPSNAPELPKKTKAKKKRSKEPLIVRIMQTREGLKLGIGCLKHGSAKDRKKIIKSLKGHILKLALSDFGCLFLICILSIVDDTKLVSKIVIQELAKHLKQLIFDKNGRRPLLQLLNPLCSRYLSPDDLACLNYNVPSLSPKEGDTSENVVNGMTDEDPNGLVVMQIVSESKKDPLQRRHELLVKTELAEALIQSCLENVGELLRTNFGKEILYEIVVGGKDNILEGLTDRIHMLHDAIVSDAAQPKTEDIEHAFENFFSSRVIRRMIIDCPAFAVTLWRKVLEGKCKIWAEGYSSKVVAGFLESPSKEVKDLAKPELQPLVDAGILKVPDPKVVQK

SEQ ID NO: 9593 - DNA, 249 bp, Sorghum bicolor
  misc_feature: Ceres ANNOT ID no. 6100803
  misc_feature: Encodes the peptide sequence at SEQ ID NO 9594
atgaggggcctgcaggaggagttccggggcggcgtgcaggtgcagccgccggcgtcgtcgcacggcggcggcggcggcggcagcgacggtcgcgcgctgtcgtggtggtcgggcgaccccgaggcgaagcgccggcggagggtggccgggtacaagtcgtacgccgtggaggcaagggtcaaggcgtccatccgcaagggcttccgatggatcaaggaccgctgcaccggcctcgtgcgccgctactga

SEQ ID NO: 9594 - protein, 82 aa, Sorghum bicolor
  misc_feature: Ceres ANNOT ID no. 6100803
  misc_feature (16)..(80): NCBI GI: 115436172 NCBI Desc: os01g0306200 [oryza sativa (japonica cultivar-group)]
  misc_feature: Useful for making plants with modulated biomass
  misc_feature: Useful for making plants with modulated nitrogen use efficiency
  misc_feature: Functional homolog of the protein sequence given in SEQ ID NO 14058
MRGLQEEFRGGVQVQPPASSHGGGGGGSDGRALSWWSGDPEAKRRRRVAGYKSYAVEARVKASIRKGFRWIKDRCTGLVRRY

SEQ ID NO: 9595 - DNA, 1065 bp, Sorghum bicolor
  misc_feature: Ceres ANNOT ID no. 6100807
  misc_feature: Encodes the peptide sequence at SEQ ID NO 9596
atggcggcgatgctggtgggcgcgctgcggaggggaagtggatgccacggcggctcgcgcctcctcgcccagtcgcttcgcagattcgtgagcacgctggtcgtagcggagcatgaaggcgggttcgtcaagccgtcgtcgctgagcgcattggcagctgcagaggcgattgccaaggagaacaaaatctccgtcctgctgggtggttccgggccgtcgcttcacaaggctgccgaccatgccgcgtccagccatccactggtgtctgaggtgctcgtggccgattcggaagccttggcgcatcctctggctgaaccctgggccgacctactccgttctgttcagcagaaaggaggctactctcatgtcatagcttcgtccacgtctttcgggaagaatttgcttccacgtgctgcggctcttcttgatgtctcccctgttactgatgtcactgctgtaaaggagccacgggtctttgtgaggccgatttatgctgggaatgcactttgtactgtgaaatatactggagaggatccttgcatgatgagtattagatcaacttcattttccccaactactgaggctatgtctgaaacaaaggttgcacctatcacccaggttgatctctctttcctcagtgaagggaaatcttcatgggtgaatctgacatcccaagacacagagcggcctgatcttgcaaatgcacgtgtagtagtcactggaggcagaggtttaaaaagtgctgaaaattttaaattgttagagcagcttgctgagaaacttggcgcagcagtgggtgcgactagggctgctgttgatgcaggttatgttccaaatgaccttcaggttgggcagacagggaaaattgtcgcaccggagctttatatggcttttggagtatccggagcaatacaacacttggcaggaatgagagactcgaaggttattgtggctgtcaataaagatgctgatgcccccatatttcaggttgcagattacggactggttgctgatctgttcgaggttctggatgagttattgaagaagatcccagagaagaaataa

SEQ ID NO: 9596 - protein, 354 aa, Sorghum bicolor
  misc_feature: Ceres ANNOT ID no. 6100807
  misc_feature (229)..(314): Pfam Id: ETF_alpha Pfam Desc: Electron transfer flavoprotein FAD-binding domain
  misc_feature (31)..(216): Pfam Id: ETF Pfam Desc: Electron transfer flavoprotein domain
  misc_feature (33)..(350): NCBI GI: 88938476 NCBI Desc: electron transfer flavoprotein alpha subunit-like [acidiphilium cryptum jf-5]
  misc_feature (30)..(346): NCBI GI: 23014716 NCBI Desc: cog2025: electron transfer flavoprotein, alpha subunit [magnetospirillum magnetotacticum ms-1]
  misc_feature (20)..(350): NCBI GI: 37681799 NCBI Desc: electron-transfer-flavoprotein, alpha polypeptide [danio rerio]
  misc_feature (25)..(353): NCBI GI: 62857853 NCBI Desc: loc549492 [xenopus tropicalis]
  misc_feature (30)..(346): NCBI GI: 83577322 NCBI Desc: electron transfer flavoprotein [rhodospirillum rubrum atcc 11170]
MAAMLVGALRRGSGCHGGSRLLAQSLRRFVSTLVVAEHEGGFVKPSSLSALAAAEAIAKENKISVLLGGSGPSLHKAADHAASSHPLVSEVLVADSEALAHPLAEPWADLLRSVQQKGGYSHVIASSTSFGKNLLPRAAALLDVSPVTDVTAVKEPRVFVRPIYAGNALCTVKYTGEDPCMMSIRSTSFSPTTEAMSETKVAPITQVDLSFLSEGKSSWVNLTSQDTERPDLANARVVVTGGRGLKSAENFKLLEQLAEKLGAAVGATRAAVDAGYVPNDLQVGQTGKIVAPELYMAFGVSGAIQHLAGMRDSKVIVAVNKDADAPIFQVADYGLVADLFEVLDELLKKIPEKK

SEQ ID NO: 9597 - DNA, 1467 bp, Sorghum bicolor
  misc_feature: Ceres ANNOT ID no. 6100810
  misc_feature: Encodes the peptide sequence at SEQ ID NO 9598
atgcagcagctgcaaccgaagcagatgcactgggtgagggccgactcctccgacttcgggttcgggggcgaccgccccgccccccgcagcgggcacactgcggtgagcattggcaagtccaaggtggtcgtcttcggcggattcgccgacaagcgcttcctcgctgacgtatccgtctatgacgtcgagaataagctgtggtacactcctgagtgcactggtaatgggtcggatgggcaggccggcccaagcccaagggcatttcacatagctgttgtcattgactgcaacatgttcatctttggtggccgttctgggggcaagcgtttaggtgatttctggatgctagacactgacttatggcaatggtcggagatgactggctttggtgatttgccgtcaccacgagagtatggtggatgggatggcaaaaagtggctttcagatgtatacgtcatggacacaatgtcactagagtggaccgaattagctgttactggatctgtgccacctccaagatgtgggcattccgcaaccatgattgagaagagactgcttatatttggaggcagaggtggagcagggccaataatgggtgatttatgggctttaaagggtattactgaagaagacaatgagacgccaggttggacacagttgaaacttccagggcaatcaccctcaccacgatgcggtcattcagtaacatctggtggaccttatctcttgctgtttggaggacatggaactggcggttggctaagtagatatgacgtgtactacaatgaatgcattattttagacagggtgtctgttcaatggaagcgcctaccaacaagcaatgaacctcctccacctcgggcatatcattccatgacttccatagggtctcgatttcttttatttggtggctttgatggaaagaatacatttggtgatttgtggtggcttgttcctgaagatgatcctattgcgaaacggaacatagttcttaacatcgattcaaacagcaaacctagcactgtgaccggtgataaccagcaatccaacttaaaggagtcacaagctctggagaatccagtaacagaattggccaaacgaatgggaattccactttctgaggaagtttcggcaagttttattgacgaagtcaatgataaagaacttgcggaattgtcatccaggcttgctggtcaatcgcttccagctactgaccaggttgcatcaattcaggtacttcgtgatcattggaaaagttctccagcaagctcactacaactgcaggaactaggacctttgctgagggactatcaacgtctcatcctgcagcgctattcgggaaatccattgccagcttttcatgaaatggaagctctccgttttttccatttgaaaagtgcttcacagttgcgcatggatgacattcccgtcttgttgagcgagtatggaaggctgctttccacatga

SEQ ID NO: 9598 - protein, 488 aa, Sorghum bicolor
  misc_feature: Ceres ANNOT ID no. 6100810
  misc_feature (28)..(74): Pfam Id: Kelch_1 Pfam Desc: Kelch motif
  misc_feature (28)..(74): Pfam Id: Kelch_2 Pfam Desc: Kelch motif
  misc_feature (85)..(130): Pfam Id: Kelch_1 Pfam Desc: Kelch motif
  misc_feature (85)..(130): Pfam Id: Kelch_2 Pfam Desc: Kelch motif
  misc_feature (229)..(281): Pfam Id: Kelch_1 Pfam Desc: Kelch motif
  misc_feature (286)..(331): Pfam Id: Kelch_2 Pfam Desc: Kelch motif
  misc_feature (2)..(306): NCBI GI: 146185369 NCBI Desc: kelch motif family protein [tetrahymena thermophila sb210]
  misc_feature (23)..(304): NCBI GI: 14495224 NCBI Desc: p0682b08.13 [oryza sativa (japonica cultivar-group)]
  misc_feature (138)..(317): NCBI GI: 15221823 NCBI Desc: kelch repeat-containing protein [arabidopsis thaliana]
  misc_feature (150)..(309): NCBI GI: 42572263 NCBI Desc: acyl-coa binding family protein [arabidopsis thaliana]
  misc_feature (32)..(282): NCBI GI: 89287731 NCBI Desc: kelch motif family protein [tetrahymena thermophila sb210]
  misc_feature: The sequence is a functional homolog of SEQ ID NO. 354 in the 11/188,298 US application
MQQLQPKQMHWVRADSSDFGFGGDRPAPRSGHTAVSIGKSKVVVFGGFADKRFLADVSVYDVENKLWYTPECTGNGSDGQAGPSPRAFHIAVVIDCNMFIFGGRSGGKRLGDFWMLDTDLWQWSEMTGFGDLPSPREYGGWDGKKWLSDVYVMDTMSLEWTELAVTGSVPPPRCGHSATMIEKRLLIFGGRGGAGPIMGDLWALKGITEEDNETPGWTQLKLPGQSPSPRCGHSVTSGGPYLLLFGGHGTGGWLSRYDVYYNECIILDRVSVQWKRLPTSNEPPPPRAYHSMTSIGSRFLLFGGFDGKNTFGDLWWLVPEDDPIAKRNIVLNIDSNSKPSTVTGDNQQSNLKESQALENPVTELAKRMGIPLSEEVSASFIDEVNDKELAELSSRLAGQSLPATDQVASIQVLRDHWKSSPASSLQLQELGPLLRDYQRLILQRYSGNPLPAFHEMEALRFFHLKSASQLRMDDIPVLLSEYGRLLST

SEQ ID NO: 9599 - DNA, 456 bp, Sorghum bicolor
  misc_feature: Ceres ANNOT ID no. 6100811
  misc_feature: Encodes the peptide sequence at SEQ ID NO 9600
atgtcgaccagcacatttgctacttcctgcacgctgttgggcaatgttagaacacaggcctcccagacagcggtgaagagcccttcatctcttagcttcttcagccatgttatgaaggttccaagcctgaagacctccaagaaactcgatgtctctgcgatggctgtctacaaggtgaagcttgtcacgcctgaaggtcaagagcacgagtttgatgctccagatgacacctacatacttgatgccgctgagactgccggtgtggagttgccgtactcgtgccgtgctggggcttgctccacctgtgctggcaaaatcgagtctggtgcagttgaccagtcggatggatccttccttgatgacgggcagcaggaggagggctatgtgctgacatgcgtctcctacccaaagtccgactgcgtcatccacacccacaaggaaggtgacctgtactag

SEQ ID NO: 9600 - protein, 151 aa, Sorghum bicolor
  misc_feature: Ceres ANNOT ID no. 6100811
  misc_feature (62)..(138): Pfam Id: Fer2 Pfam Desc: 2Fe-2S iron-sulfur cluster binding domain
  misc_feature (1)..(151): NCBI GI: 119958 NCBI Desc: ferredoxin iii, chloroplast precursor (fd iii)
  misc_feature (25)..(151): NCBI GI: 109390460 NCBI Desc: ferredoxin iii [musa acuminata]
  misc_feature (1)..(151): NCBI GI: 68137465 NCBI Desc: heterotrophic ferredoxin 2 [helianthus annuus]
  misc_feature (24)..(151): NCBI GI: 53981560 NCBI Desc: ferredoxin [oryza sativa (japonica cultivar-group)]
  misc_feature (1)..(150): NCBI GI: 1360725 NCBI Desc: non-photosynthetic ferredoxin [citrus sinensis]
MSTSTFATSCTLLGNVRTQASQTAVKSPSSLSFFSHVMKVPSLKTSKKLDVSAMAVYKVKLVTPEGQEHEFDAPDDTYILDAAETAGVELPYSCRAGACSTCAGKIESGAVDQSDGSFLDDGQQEEGYVLTCVSYPKSDCVIHTHKEGDLY

SEQ ID NO: 9601 - DNA, 1743 bp, Sorghum bicolor
  misc_feature: Ceres ANNOT ID no. 6100816
  misc_feature: Encodes the peptide sequence at SEQ ID NO 9602
atggaggcgctgcgggcgtggagggcctcctccaatctcattggattcgcggcctcccgcgccgccgcttcaaggacccttggcctccgcatccgctgctgttccgcggccgccgccaccacgaacccgccggcgcagcctcaggaccgccgacgccgtagtgcctcctcatccgcctctacctctgaccgcgactccatccgcgccatccgcctcaaaaaagttgaggagctcagagcgaaggggcatgagccgtacgcgtacaagtgggacaggactcacacgaccaaggagcttcaggagcagtacgctcatcttgtgaatggtgaagtctgcgaggacgtgtcggtgtccgttgctggcaggattgttgcccgaagggcatttggaaagcttgtttttatgactgtaagagatgactctgggactatgcagctttattgcgagaaagacagccttacggaggaccaatttgagcaactgaaggcatttattgacattggtgatatattaggtgcaagtggatccattaaaaagacagagaaaggggagctatctgtttatgtgaaaaattttgaaattctcacaaaatccttactcccactaccagacaagtatcatggattaactgatgttgacaaacgatatcgtcaaaggtatgttgacatgattgcaaatcctaaggttgctgatgtattccgaactagggcaaaggtggtttctgagatccgcaagacaatggaatcatttggttttattgaagttgaaactccagttctacagggagcagcaggtggtgctgaagctagaccctttataacctaccataactcacttcaaagagatctttacttgaggattgcaacagagctgcatttgaaaaggatgttggttggagggcttgagaaggtctatgagattggaagaatattccggaatgaaggcatttctactcgtcataatcctgaatttaccactattgagatgtatgaagcatattcagactatgagagcatgatgaatatggctgaagaaattgttactcgatgtgctatggctactcatggcaagcttaaggttgattatgagggaactgaaatctcgcttgaaagaccatggaggagggagaccatgcattctcttgtcaaagaagcaacaggaatcgactttaacagcttcggcgatgttgaatctgcaaaaagagctgttaaggggctgccaggtttcgaagtaggaaacaatgaaagtacttcgttgcaagcctgttcatctgttggacatgttctcaacgaggtttttgagacttttgttgaatctactcttgtacaaccaacatttgtccttgactacccagttgagatatcaccattggcaaaaccacatcggagtcatgttggccttactgagcgattcgaacttttcatctgtggtcgtgagattggcaatgcgttttctgaactcacagacccaatcgatcagaggagccgttttgaaaatcaaataaaacagcacaatgttaagcgagctgcaatggctaaggaggtgaaatctactgagggtgatggagatgatgattattcctatgaagtttctttagatgaagacttcttgacttcattagaatacggaatgccaccagcatcaggaatgggccttggtattgaccggttagtaatgcttttgacaaactcttctagcataagggatgttattgcctttcctgtcttgaagattcagcaatag

SEQ ID NO: 9602 - protein, 580 aa, Sorghum bicolor
  misc_feature: Ceres ANNOT ID no. 6100816
  misc_feature (211)..(578): Pfam Id: tRNA-synt_2 Pfam Desc: tRNA synthetases class II (D, K and N)
  misc_feature (117)..(195): Pfam Id: tRNA_anti Pfam Desc: OB-fold nucleic acid binding domain
  misc_feature (60)..(521): NCBI GI: 126658229 NCBI Desc: lysyl-trna synthetase [cyanothece sp. ccy0110]
  misc_feature (67)..(503): NCBI GI: 34222748 NCBI Desc: lysyl-trna synthetase (lysine--trna ligase) (lysrs)
  misc_feature (67)..(503): NCBI GI: 22297756 NCBI Desc: lysyl-trna synthetase [thermosynechococcus elongatus bp-1]
  misc_feature (60)..(521): NCBI GI: 67920132 NCBI Desc: lysyl-trna synthetase, class-2 [crocosphaera watsonii wh 8501]
  misc_feature (56)..(521): NCBI GI: 16330075 NCBI Desc: lysyl-trna synthetase [synechocystis sp. pcc 6803]
  misc_feature (67)..(503): SWISSPROT Homolog: EC 6.1.1.6 Lysyl-tRNA synthetase
MEALRAWRASSNLIGFAASRAAASRTLGLRIRCCSAAAATTNPPAQPQDRRRRSASSSASTSDRDSIRAIRLKKVEELRAKGHEPYAYKWDRTHTTKELQEQYAHLVNGEVCEDVSVSVAGRIVARRAFGKLVFMTVRDDSGTMQLYCEKDSLTEDQFEQLKAFIDIGDILGASGSIKKTEKGELSVYVKNFEILTKSLLPLPDKYHGLTDVDKRYRQRYVDMIANPKVADVFRTRAKVVSEIRKTMESFGFIEVETPVLQGAAGGAEARPFITYHNSLQRDLYLRIATELHLKRMLVGGLEKVYEIGRIFRNEGISTRHNPEFTTIEMYEAYSDYESMMNMAEEIVTRCAMATHGKLKVDYEGTEISLERPWRRETMHSLVKEATGIDFNSFGDVESAKRAVKGLPGFEVGNNESTSLQACSSVGHVLNEVFETFVESTLVQPTFVLDYPVEISPLAKPHRSHVGLTERFELFICGREIGNAFSELTDPIDQRSRFENQIKQHNVKRAAMAKEVKSTEGDGDDDYSYEVSLDEDFLTSLEYGMPPASGMGLGIDRLVMLLTNSSSIRDVIAFPVLKIQQ

SEQ ID NO: 9603 - DNA, 654 bp, Sorghum bicolor
  misc_feature: Ceres ANNOT ID no. 6100817
  misc_feature: Encodes the peptide sequence at SEQ ID NO 9604
atggcgttctacgagggctggtgcagcggcaagaacggcggaggctgctgctccgactgcagctggacgcggatcgccatctggaccgtcgccatcctcgtcgtgtgcgccgtcatcatcgtcctcgtgctggccttcggcgtggtgcgcccacccaaggccaccgccgacgacgccgtgctgcagcggttcgctctgtccccggccgacccggcgtccaactccaccgtctcctacaacctcaccgccacggtgtcgctccggaaccccaacatgtaccgcgccatcgactacggcgcgctcgccgtggccttctccttcaacggcacccgcttcgacgactccgcgtccgtcccggcgttccagcacaagccacggaagacggcgacggtgcgcgtgaccgtcggcggcgtcgacaagcccatcaagctcgcgaaggccggggtgggggagttccggacggagaacgacacgggcaagttcgccgtggagatgcggctcgacacggtgctccagtacaagggccggtccgccaagtgcccgctcgtcgtcatctgcccgcttcagctccagctcgtcgaccctgacgtcgctgccaccgcgttccagcggaccaagtgcaccatcctccgggccaagaagtccggctgctag

SEQ ID NO: 9604 - protein, 217 aa, Sorghum bicolor
  misc_feature: Ceres ANNOT ID no. 6100817
  misc_feature (47)..(186): Pfam Id: Hin1 Pfam Desc: Harpin-induced protein 1 (Hin1)
  misc_feature (14)..(215): NCBI GI: 115471401 NCBI Desc: os07g0251200 [oryza sativa (japonica cultivar-group)]
  misc_feature (16)..(209): NCBI GI: 90399146 NCBI Desc: h0913c04.11 [oryza sativa (indica cultivar-group)]
  misc_feature (16)..(209): NCBI GI: 32488714 NCBI Desc: osjnba0088h09.15 [oryza sativa (japonica cultivar-group)]
  misc_feature (16)..(209): NCBI GI: 115461434 NCBI Desc: os04g0685300 [oryza sativa (japonica cultivar-group)]
  misc_feature (16)..(209): NCBI GI: 2801538 NCBI Desc: harpin induced gene 1 homolog [oryza sativa]
MAFYEGWCSGKNGGGCCSDCSWTRIAIWTVAILVVCAVIIVLVLAFGVVRPPKATADDAVLQRFALSPADPASNSTVSYNLTATVSLRNPNMYRAIDYGALAVAFSFNGTRFDDSASVPAFQHKPRKTATVRVTVGGVDKPIKLAKAGVGEFRTENDTGKFAVEMRLDTVLQYKGRSAKCPLVVICPLQLQLVDPDVAATAFQRTKCTILRAKKSGC

SEQ ID NO: 9605 - DNA, 645 bp, Sorghum bicolor
  misc_feature: Ceres ANNOT ID no. 6100819
  misc_feature: Encodes the peptide sequence at SEQ ID NO 9606
atgtgtgacgactgcgagtgctgctgcgcctgcttcgccccgcggtaccaacgcttcgcgtgcggcttctgcatcggcctcgccatcatcgcggcggtcgccgtcatcgtcgtcctcgtcctcggctacgggcacgccgcgcagcccacgttcgaggtggacgacgcctcgctcacgcgcttcgccgtcgccatctcccccgccaccgccatctcctacaacctcacgctcacgctcgccgtccgcaaccgcaactgggccatgggcgccgccttccggtccctccaggccgactacctcttcgaggaccagcggttcgaccgcgtcgacgtcgtcgcctcgcccacctacgtcctgcccgccaggaagaccgccgtgttccgcctctccagcggcgccgacgccgtgaacgccatgctcggcagcgccggcgtcagggcgtacaggaagcagagcgccaagggggcgttcgacatcgaggtgaagctctccggccaggtcaagtaccagctgcacagcacgtggtgcaggctcgaggccaagtgcccgctcaacctgcagctcggatcgccggacggtggcggcgccgtcgtcttccagaagaccagctgcgaggtgctccggtcatcgcagaaggggtgctga

SEQ ID NO: 9606 - protein, 214 aa, Sorghum bicolor
  misc_feature: Ceres ANNOT ID no. 6100819
  misc_feature (45)..(182): Pfam Id: Hin1 Pfam Desc: Harpin-induced protein 1 (Hin1)
  misc_feature (3)..(214): NCBI GI: 115471401 NCBI Desc: os07g0251200 [oryza sativa (japonica cultivar-group)]
  misc_feature (5)..(206): NCBI GI: 90399146 NCBI Desc: h0913c04.11 [oryza sativa (indica cultivar-group)]
  misc_feature (5)..(206): NCBI GI: 32488714 NCBI Desc: osjnba0088h09.15 [oryza sativa (japonica cultivar-group)]
  misc_feature (5)..(206): NCBI GI: 115461434 NCBI Desc: os04g0685300 [oryza sativa (japonica cultivar-group)]
  misc_feature (5)..(206): NCBI GI: 2801538 NCBI Desc: harpin induced gene 1 homolog [oryza sativa]
MCDDCECCCACFAPRYQRFACGFCIGLAIIAAVAVIVVLVLGYGHAAQPTFEVDDASLTRFAVAISPATAISYNLTLTLAVRNRNWAMGAAFRSLQADYLFEDQRFDRVDVVASPTYVLPARKTAVFRLSSGADAVNAMLGSAGVRAYRKQSAKGAFDIEVKLSGQVKYQLHSTWCRLEAKCPLNLQLGSPDGGGAVVFQKTSCEVLRSSQKGC

SEQ ID NO: 9607 - DNA, 1212 bp, Sorghum bicolor
  misc_feature: Ceres ANNOT ID no. 6100822
  misc_feature: Encodes the peptide sequence at SEQ ID NO 9608
atggcagcgacggcggcagcgctggcgcgggagctcctggacgcggcgcgcgcgccggagttcgcggagtggcagctcggcgtgcggcgccggatccaccagcacccggagctggcgttccaggagcaccgcaccagcgcgctcgtgcgcgcggagctggacgcgctcggcgtcccgtacgcctggcccgtcgctcggacgggtgtcgtggccaccgtcgccggcgccgcctcgggccccgtgttcgcgctccgggccgacatggacgcgctccctctccaggaattggtagagtgggagttcaagagcaaggaggacggtaagatgcacgcctgtggccatgatgctcacgtggcaatgctactcggagctgctaggctgcttcagtctaggagggaccttttcaagggtacagtaaagctcgtgttccagccggccgaggagggccacgccggcgggtactatgtcctcaaggaaggcgtcctggacgacgtgcacaccatcttcgccgtgcacgtggacactgccctaccggtgggcaccgtcggctctaggccgggcccgttcctcgccgggtcagctcggttcacggcgaccatcaccgggaaaggcggccacgcggcggggccccagctcgtcgtcgacccgatcgtcgcggcctcctccgccgtgctgagcctccagcagctcgtcgcccgcgagatcgaccccctgcagggcgctgtggtgtccgtgaccttcatcagaggaggcgaagctttcaacgtcattccagagtctgtgaccctgggtggcacctgccggagcatgacaactgaaggcctgtcctacctcatgaagagaatccgagaggtggtacaagggcaggccgccgtggggcggtgcacggcggtcgtcgacttcatggaggagaagatgaagccatatccagccaccgtgaatgacgaggcagtgtacggccacgccaaggcggtggccgagagcatgatcggggaggccaacgtgaggttgtgcccccagttcatggcggccgaagacttcggcttctactcgcagcggatcccagcggcattcttcagcgtcggcgtccgcaacgccgagacggggaagatccaccacgtgcactcgccgcacctcgacatcgacgaggccgcgctccccatcggagccgcgctccacgccgccgtggcgatcgagtacctgaacaaatag

SEQ ID NO: 9608 - protein, 403 aa, Sorghum bicolor
  misc_feature: Ceres ANNOT ID no. 6100822
  misc_feature (83)..(399): Pfam Id: Peptidase_M20 Pfam Desc: Peptidase family M20/M25/M40
  misc_feature (188)..(294): Pfam Id: M20_dimer Pfam Desc: Peptidase dimerisation domain
  misc_feature (7)..(403): NCBI GI: 92878648 NCBI Desc: peptidase m20 [medicago truncatula]
  misc_feature (7)..(403): NCBI GI: 6728974 NCBI Desc: iaa-amino acid hydrolase (ilr1) [arabidopsis thaliana]
  misc_feature (7)..(403): NCBI GI: 21554648 NCBI Desc: iaa-amino acid hydrolase (ilr1) [arabidopsis thaliana]
  misc_feature (7)..(403): NCBI GI: 887785 NCBI Desc: ilr1
  misc_feature (7)..(403): NCBI GI: 18652314 NCBI Desc: iaa-amino acid hydrolase [arabidopsis suecica]
MAATAAALARELLDAARAPEFAEWQLGVRRRIHQHPELAFQEHRTSALVRAELDALGVPYAWPVARTGVVATVAGAASGPVFALRADMDALPLQELVEWEFKSKEDGKMHACGHDAHVAMLLGAARLLQSRRDLFKGTVKLVFQPAEEGHAGGYYVLKEGVLDDVHTIFAVHVDTALPVGTVGSRPGPFLAGSARFTATITGKGGHAAGPQLVVDPIVAASSAVLSLQQLVAREIDPLQGAVVSVTFIRGGEAFNVIPESVTLGGTCRSMTTEGLSYLMKRIREVVQGQAAVGRCTAVVDFMEEKMKPYPATVNDEAVYGHAKAVAESMIGEANVRLCPQFMAAEDFGFYSQRIPAAFFSVGVRNAETGKIHHVHSPHLDIDEAALPIGAALHAAVAIEYLNK

SEQ ID NO: 9609 - DNA, 1182 bp, Sorghum bicolor
  misc_feature: Ceres ANNOT ID no. 6100823
  misc_feature: Encodes the peptide sequence at SEQ ID NO 9610
atggcgcggagcaggcgcggcggcttcggcggcggcggcggcaacgtgaaggtgacgccgaacctggcgtgggaccgggaggggacgcggatgctcaacctcagcgtgctgcggcgactcgaccccggcgtcgccgacatcctcatcaccgccgcgcacgtcgtcgcgtacagcttcgacgagggccagggggagtggacccggaagcctgtggaggggtcgctcttcgtcgtcaagaggaacacccagcccagattccaatttatcatcatgaatcgtataaacacagaaaatctagtcgaagatctcttgacgagttttgaggttgaggtgcaaagcccctacttgatgtaccgtaatgctgctgatgaaatcattggaatttggttctatgatccacaggaatgtcaagaagttgcacatctttttagcaggatagcatatgcatattcaagggcgtcacccaagacaaatctttcttccaaaagtgtatttgaagaaccagaagcagcatctgggccatatgctctacctgtagttgaagatactctacaacagccacctaccacggatgatgacgatgttgaagagttcttcctaaccccttcgaaggcggccacatgtgtacatacaattggtggaacaggcgcagtacaaccaaaccaatctttcagggctatcccttctccaggtcatggatcacataattctactgcagcacactcttcttccctgcacagtctgcttccttcacgaacttcatcagttactctgagggcctttgatgttcatagacccaatagctctaccaccattcagcctacaagtcttttagattcaaaaccaccactacttgcaccgatggctactacgcagtcaacagtagctaaagctgcttcgtcactgcctactgttcctccacttcatcctccctttgctgatcagcaaccaaaaagtgctcccttgctccaccccttttcactaccccctgtgccccctgttccaccatatggcatgcccttgcttcaaccattcccacctcctaatccgctgccattgcttaccccagcatcttatagccaggtggtaacaagagagcaagtaggcgctgcactgctgaggcttgcacagaatgataatttcatcgacatggtttaccgggagatggctaagagaccgtaa

SEQ ID NO: 9610 - protein, 393 aa, Sorghum bicolor
  misc_feature: Ceres ANNOT ID no. 6100823
  misc_feature (25)..(147): Pfam Id: DCP1 Pfam Desc: Dcp1-like decapping family
  misc_feature (15)..(389): NCBI GI: 18390886 NCBI Desc: hydroxyproline-rich glycoprotein family protein [arabidopsis thaliana]
  misc_feature (15)..(389): NCBI GI: 3169719 NCBI Desc: similar to yeast dcp1 [arabidopsis thaliana]
  misc_feature (76)..(389): NCBI GI: 6664305 NCBI Desc: t27g7.7 [arabidopsis thaliana]
  misc_feature (217)..(392): NCBI GI: 115456457 NCBI Desc: os03g0837000 [oryza sativa (japonica cultivar-group)]
  misc_feature (30)..(157): NCBI GI: 40548403 NCBI Desc: decapping enzyme dcp1b [homo sapiens]
MARSRRGGFGGGGGNVKVTPNLAWDREGTRMLNLSVLRRLDPGVADILITAAHVVAYSFDEGQGEWTRKPVEGSLFVVKRNTQPRFQFIIMNRINTENLVEDLLTSFEVEVQSPYLMYRNAADEIIGIWFYDPQECQEVAHLFSRIAYAYSRASPKTNLSSKSVFEEPEAASGPYALPVVEDTLQQPPTTDDDDVEEFFLTPSKAATCVHTIGGTGAVQPNQSFRAIPSPGHGSHNSTAAHSSSLHSLLPSRTSSVTLRAFDVHRPNSSTTIQPTSLLDSKPPLLAPMATTQSTVAKAASSLPTVPPLHPPFADQQPKSAPLLHPFSLPPVPPVPPYGMPLLQPFPPPNPLPLLTPASYSQVVTREQVGAALLRLAQNDNFIDMVYREMAKRP

SEQ ID NO: 9611 - DNA, 3273 bp, Sorghum bicolor
  misc_feature: Ceres ANNOT ID no. 6100826
  misc_feature: Encodes the peptide sequence at SEQ ID NO 9612
  misc_feature: Down-regulated in root tissues in response to aminocyclopropane carboxylic treatment
  misc_feature: Down-regulated in shoot tissues in response to aminocyclopropane carboxylic treatment
atggaggccagcgccgggctggtcgccggctcgcacaaccggaacgagctcgtcgtcatccgccgcgatggcgagccagggccgaagccgatggaccagcggaacggccaggtgtgccagatttgcggcgacgacgtggggcgcaacccggacggggagcccttcgtggcctgcaacgagtgcgccttccccatctgccgggactgctacgagtacgagcgacgcgagggcacgcagaactgcccccagtgcaagacccgcttcaagcgcctcaaggggtgcgcgcgcgtgcccggggacgaggaggaggacggcgtcgacgacctggagaacgagttcaactggagcgacaagcacgactcccagtacgtcgccgagtccatgctccacgcccacatgagctacggccgcggcgccgacctcgacggcgtgccgcaaccattccagcccatccctaatgttcctctcctcaccaacggacagatggtcgatgacatcccgccggagcagcacgcacttgtgccctcgttcatgggtggtggtgggaagaggattcaccctcttccgtacgcggatcccaaccttcctgtgcaaccaaggtctatggacccttccaaggatctcgccgcatatggctacggcagtgtagcgtggaaggagaggatggagagctggaagcagaagcaggagaggatgcaccaggcgaggaacgacggtggtggtaacgatgatggcgatgatgcagatctaccactaatggatgaagctagacagccattgtccagaaagattccgcttccttcaagccaaatcaacccctataggatgattatcataattcggctagtggttttggggttcttcttccactaccgagtgatgcatccggtgcctgatgcatttgctttatggctcatatctgtgatctgtgaaatttggtttgccatgtcttggattcttgatcagtttccaaagtggtttcctatcgagagggaaacctatcttgaccggctgactttgaggtttgacaaggaagggcagccttctcaactcgcccctattgatttctttgtcagtacggttgatcccttgaaggaacctccattagtcacagcaaatactgttctatctatcctttcggtggattatccagttgataaggtttcatgctatgtttctgatgatggtgctgccatgctgacatttgaagcattgtctgaaacatctgaatttgcaaagaaatgggttcctttctgcaaaaggtatagccttgagcctcgtgctccagagtggtatttccaacagaagatagactacctgaaagacaaggtggcgccaaacttcgttagagaacggagagcaatgaagagagagtacgaggaattcaaggttagaatcaatgccttggttgctaaagcccaaaaggtacctgaggaaggatggacaatgcaggatgggacaccatggcctggaaacaatgttcgtgatcatcctggaatgattcaggtttttcttggtcaaagtggtggccatgacgtggaaggaaatgagctgcctcgattggtttacgtttcaagagaaaaacggccaggctatgaccatcataagaaggctggtgctatgaatgcattggtccgagtctctgctgtactaactaatgcaccttatttgctgaacttggattgtgatcactacatcaataatagtaaggctataaaggaagcaatgtgttttatgatggatcctttgcttggaaagaaagtttgctatgtgcagtttcctcaaagattcgatgggattgatcgtcatgatcgatatgctaacagaaatgttgtctttttcgatatcaacatgaaaggtttggatggtatccaaggccccatttacgttggtacaggatgtgtcttcaggaggcaggcattatatggctatgacgcacccaaaacaaagaagccaccatcaaggacttgcaactgctggccaaagtggtgcatttgctgttgctgttttggtaacaggaagaccaagaagaagactaagacctctaaacctaaatttgagaagataaagaaactttttaagaaaaaggaaaaccaagcccctgcgtatgctcttggtgaaattgatgaagctgctccaggagctgaaaatgaaaaggctagtattgtaaatcaacaaaagttggaaaagaaatttggccagtcttcagtttttgttgcatccacacttcttgagaatggtggaaccctgaagagtgccagtccagcttctcttctgaaggaagctatacatgtcatcagttgcggctatgaagacaagacagattggggaaaagatattggttggatttatggatcagttacagaagatattcttactgggtttaagatgcactgccatggttggcggtcaatttactgcatacctaaacgggccgctttcaaaggttctgcacctctcaatctttccgatcgtcttcaccaggttcttcggtgggctcttggttcaattgaaattttcttcagcaaccactgccctctttggtatgggtatggtggtggattaaagtgcctggaaaggttttcatacattaactccatcgtatacccttggacatctatcccgctcttggcctattgcacattgcctgccatctgcttgctgacagggcaatttatcacgccagagcttaacaatgttgccagcctctggttcatgtcactttttatctgcatttttgctacgagcatcctggaaatgagatggagtggtgtaggcatcgatgattggtggagaaatgagcagttttgggtcattggcggtgtgtcttcacatctctttgctgtgttccaaggactcctcaaggtcatagctggtgtagacacgagcttcactgtgacatccaagggtggagacgacgaggagttctcagagctgtacacattcaaatggacaacccttctgatacctccgaccaccctgcttctactgaatttcattggagtagtagctggcgtttccaatgcaatcaacaatggatatgaatcatgggggcccctgttcgggaagctcttctttgcattttgggtgattgtccatctttacccattcctcaagggtctggttgggaggcagaacagaacgccaacaattgtcattgtctggtccatcctcttggcttcaatcttctcgctgctctgggtccggatagatcctttccttgcgaaggatgatggtcccctgttggaggaatgcggtttggattgcaactag

SEQ ID NO: 9612 - protein, 1090 aa, Sorghum bicolor
  misc_feature: Ceres ANNOT ID no. 6100826
  misc_feature (259)..(1084): Pfam Id: Cellulose_synt Pfam Desc: Cellulose synthase
  misc_feature (31)..(1090): NCBI GI: 9622884 NCBI Desc: cellulose synthase-6 [zea mays]
  misc_feature (1)..(1090): NCBI GI: 9622886 NCBI Desc: cellulose synthase-7 [zea mays]
  misc_feature (1)..(1090): NCBI GI: 9622888 NCBI Desc: cellulose synthase-8 [zea mays]
  misc_feature (1)..(1090): NCBI GI: 67003917 NCBI Desc: cellulose synthase 6 [eucalyptus grandis]
  misc_feature (1)..(1090): NCBI GI: 37781495 NCBI Desc: cellulose synthase 6 [populus tremuloides]
  misc_feature (1)..(1089): SWISSPROT Homolog: EC 2.4.1.12 Cellulose synthase A catalytic subunit 6 [UDP-forming]
  misc_feature: Useful for making plants with altered cell wall content and/or composition
  misc_feature: GREAT-hit functional homolog of the protein sequence given in SEQ ID NO 13363
  misc_feature: GREAT-hit functional homolog of the protein sequence given in SEQ ID NO 13364
  misc_feature: GREAT-hit functional homolog of the protein sequence given in SEQ ID NO 13365
  misc_feature: GREAT-hit functional homolog of the protein sequence encoded by LOCUS at2g21770
  misc_feature: GREAT-hit functional homolog of the protein sequence encoded by LOCUS at4g39350
  misc_feature: Functional homolog of the protein sequence encoded by LOCUS at5g05170
  misc_feature: GREAT-hit functional homolog of the protein sequence encoded by LOCUS at5g09870
  misc_feature: GREAT-hit functional homolog of the protein sequence encoded by LOCUS at5g64740
  misc_feature: Useful for making plants with altered carbohydrate content
  misc_feature: Functional homolog of the protein sequence given in SEQ ID NO 13628
  misc_feature: Useful for making plants with altered cell wall content and/or composition
  misc_feature: Useful for making plants with modulated biomass
  misc_feature: Functional homolog of the protein sequence given in SEQ ID NO 14059
  misc_feature: The sequence is a functional homolog of SEQ ID NO 26 in US patent 7312377
  misc_feature: Useful for making plants with modulated plant growth and development
  misc_feature: Functional homolog of the protein sequence given in SEQ ID NO 13629
  misc_feature: Down-regulated in root tissues in response to aminocyclopropane carboxylic treatment
  misc_feature: Down-regulated in shoot tissues in response to aminocyclopropane carboxylic treatment
MEASAGLVAGSHNRNELVVIRRDGEPGPKPMDQRNGQVCQICGDDVGRNPDGEPFVACNECAFPICRDCYEYERREGTQNCPQCKTRFKRLKGCARVPGDEEEDGVDDLENEFNWSDKHDSQYVAESMLHAHMSYGRGADLDGVPQPFQPIPNVPLLTNGQMVDDIPPEQHALVPSFMGGGGKRIHPLPYADPNLPVQPRSMDPSKDLAAYGYGSVAWKERMESWKQKQERMHQARNDGGGNDDGDDADLPLMDEARQPLSRKIPLPSSQINPYRMIIIIRLVVLGFFFHYRVMHPVPDAFALWLISVICEIWFAMSWILDQFPKWFPIERETYLDRLTLRFDKEGQPSQLAPIDFFVSTVDPLKEPPLVTANTVLSILSVDYPVDKVSCYVSDDGAAMLTFEALSETSEFAKKWVPFCKRYSLEPRAPEWYFQQKIDYLKDKVAPNFVRERRAMKREYEEFKVRINALVAKAQKVPEEGWTMQDGTPWPGNNVRDHPGMIQVFLGQSGGHDVEGNELPRLVYVSREKRPGYDHHKKAGAMNALVRVSAVLTNAPYLLNLDCDHYINNSKAIKEAMCFMMDPLLGKKVCYVQFPQRFDGIDRHDRYANRNVVFFDINMKGLDGIQGPIYVGTGCVFRRQALYGYDAPKTKKPPSRTCNCWPKWCICCCCFGNRKTKKKTKTSKPKFEKIKKLFKKKENQAPAYALGEIDEAAPGAENEKASIVNQQKLEKKFGQSSVFVASTLLENGGTLKSASPASLLKEAIHVISCGYEDKTDWGKDIGWIYGSVTEDILTGFKMHCHGWRSIYCIPKRAAFKGSAPLNLSDRLHQVLRWALGSIEIFFSNHCPLWYGYGGGLKCLERFSYINSIVYPWTSIPLLAYCTLPAICLLTGQFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 9613 - DNA, 615 bp, Sorghum bicolor
  misc_feature: Ceres ANNOT ID no. 6100842
  misc_feature: Encodes the peptide sequence at SEQ ID NO 9614
atgttggcgaaaccaccagcaataacccttgagcgcttgcttctcaattcctcctttcagcgcaatgtctcgagtgcaatggtggtgaagctttcagataacaaatgtggaggaaaattgagtgtcgggcgaaacatcgagcctgggaaaagccgtcgggaatggcgggcgctatcggccgaccaagcgcaagcttctgtcatggatgtcgatgaggagtgcaaacaagtcctcacttcattggatttctccagcgaagacgctgagaagatgttgaagaaggcctttggctggatccactcctcgtattggagcgaggagagaaagaaggaggttccgaattccgaggttgtaactggagtgctgaactacatcaggagcctcgggctatccgacgaagaccttcacaagttgctgaagaagttcccggaggttcttgggtgcgatcttgacagcgaggtgaagctgaatgtgagcaagctggacagtgactgggggataaatgggaaaactctgaggagccttctcctgaggaatccaaaggttttgggatacaatattgactgcagaggggattgcatggcccagtgcacccgctgttgggttaggttctaa

SEQ ID NO: 9614 - protein, 204 aa, Sorghum bicolor
  misc_feature: Ceres ANNOT ID no. 6100842
MLAKPPAITLERLLLNSSFQRNVSSAMVVKLSDNKCGGKLSVGRNIEPGKSRREWRALSADQAQASVMDVDEECKQVLTSLDFSSEDAEKMLKKAFGWIHSSYWSEERKKEVPNSEVVTGVLNYIRSLGLSDEDLHKLLKKFPEVLGCDLDSEVKLNVSKLDSDWGINGKTLRSLLLRNPKVLGYNIDCRGDCMAQCTRCWVRF

SEQ ID NO: 9615 - DNA, 2217 bp, Sorghum bicolor
  misc_feature: Ceres ANNOT ID no. 6100844
  misc_feature: Encodes the peptide sequence at SEQ ID NO 9616
  misc_feature: Down-regulated in shoot tissues in response to salicylic acid treatment
atggggacttcggtgcaggtgacgcctctcagtggggcgtacggggagggtcccctgtgctacctgctcgctgtcgacggcttccgcttcctcctcgactgcggatggacggacctctgcgatacctcgcaacttcaacccctcgccaaggttgcaccaactgtagatgctgttcttctgtcacatcctgacatgatgcatctaggagctttgccttatgctatgaaacatcttgggctctctgcaccagtttatgcaacagaacccgtgtttagacttggccttttgaccatgtacgaccatttcctatctcgatggcaagtttcagactttgacttgtttactttggatgatgttgatgctgcattccaaaatgttgtgagattgaaatactcacaaaattaccttctgaatgataaaggtgaagggattgttattgctccacatgtggctgggcatcttttggggggtacagtgtggaagattacaaaagatggggaggatgttgtgtatgctgttgacttcaaccatcggaaagagaggcatttgaatggcaccgttcttggatctttcgtgcggccagctgttcttataaccgatgcttacaatgctttgaacaatcaaggctatagaaaaaagcaagatcaagatttcattgattcattaattaaagttctagcaactggtggaagtgtgctacttcctgttgatacggctggtagagtgttggaacttcttttgttattggatacgtactgggatgaacggcgattgcagtatcctatctactttctgacaaatgtgtcgacaagtactgttgactatgtcaagagttttcttgaatggatgcgtgatcagatagcaaaatcttttgaaagcaatagagccaatgccttcttgttgaaaaaggtaatgctgataattaacaaagaagagcttgagaaattgggagatgctccaaaggtggttctagcatccatggcaagtttggaggttggcttttctcatgacatatttgttgagatggcaaatgaagcaagaaatctagtgctctttactgagaagggacagtttgggacactggctcgaatgctccaagtggacccaccccctaaagctgtaaaggtcactatgagcaagcgcattcctttggtgggtgatgaactaaaggcttatgaagaagaacaggaacggataaaaaaagaaaaagcgctaaaggctagccttgtcaaagaagaggagctgaaggcttctcttggatcaaatgccaaggcttctgacccaatggtcattgatgcaagctcatctcgaaaatctgcgaatgctggttcacattttggtgggaacactgatattctcattgatggatttgtacctccttcaaccagtgttgctccaatgtttcccttttttgaaaacactgctgaatgggatgactttggtgaggtcatcaaccctgatgattatatgatgaaacaagaagaaatggataatactctgatgcttggtcctggagatggtttagatggtaagattgatgatggctcagcacgcctgcttctcgattcaacaccctcaaaagtcatttccaatgagatgactgttcaagtgaaatgctcattggtttatatggactttgaaggtcgctctgatgggcgttctgtaaaatcagttattgctcatgtggctccactgaaacttgttctggtgcatggatcagcggaagcaactgaacatttgaaaatgcattgcacaaagaatttagaccttcatgttcatgctcctcagattgaggaaacaattgatgtaacatcggatttatgtgcttataaggtccaactttcagagaagttaatgagtaacatcatttctaagaagttgggtgagcatgaaattgcttgggtggatgcagaagttggaaaagaagatgagaagcttattttgctccccccatcatcaacaccgccaccccacaagccagttcttgtgggtgatttaaaattgtccgattttaaacagtttttggaaaataaaggctggcaggttgaatttgccggaggtgctttgcggtgtggcgaatacatcatggtgcgcaagattggagattctagccaaaagggcagcacagggtctcagcagatcgtcattgagggcccactctgcgaggactattacaagatcagggagcttctgtactcgcagttctacttgctgtga

SEQ ID NO: 9616 - protein, 738 aa, Sorghum bicolor
  misc_feature: Ceres ANNOT ID no. 6100844
  misc_feature (533)..(575): Pfam Id: RMMBL Pfam Desc: RNA-metabolising metallo-beta-lactamase
  misc_feature (17)..(205): Pfam Id: Lactamase_B Pfam Desc: Metallo-beta-lactamase superfamily
  misc_feature (1)..(738): NCBI GI: 75253249 NCBI Desc: cleavage and polyadenylation specificity factor 100 kda subunit (cpsf 100 kda subunit)
  misc_feature (1)..(738): NCBI GI: 9082326 NCBI Desc: polyadenylation cleavage/specificity factor 100 kda subunit [arabidopsis thaliana]
  misc_feature (1)..(648): NCBI GI: 119601886 NCBI Desc: cleavage and polyadenylation specific factor 2, 100kda, isoform cra_a [homo sapiens]
  misc_feature (1)..(648): NCBI GI: 47125306 NCBI Desc: cleavage and polyadenylation specific factor 2 [homo sapiens]
  misc_feature (1)..(648): NCBI GI: 4927240 NCBI Desc: cleavage and polyadenylation specificity factor 100 kda subunit [xenopus laevis]
  misc_feature: Down-regulated in shoot tissues in response to salicylic acid treatment
MGTSVQVTPLSGAYGEGPLCYLLAVDGFRFLLDCGWTDLCDTSQLQPLAKVAPTVDAVLLSHPDMMHLGALPYAMKHLGLSAPVYATEPVFRLGLLTMYDHFLSRWQVSDFDLFTLDDVDAAFQNVVRLKYSQNYLLNDKGEGIVIAPHVAGHLLGGTVWKITKDGEDVVYAVDFNHRKERHLNGTVLGSFVRPAVLITDAYNALNNQGYRKKQDQDFIDSLIKVLATGGSVLLPVDTAGRVLELLLLLDTYWDERRLQYPIYFLTNVSTSTVDYVKSFLEWMRDQIAKSFESNRANAFLLKKVMLIINKEELEKLGDAPKVVLASMASLEVGFSHDIFVEMANEARNLVLFTEKGQFGTLARMLQVDPPPKAVKVTMSKRIPLVGDELKAYEEEQERIKKEKALKASLVKEEELKASLGSNAKASDPMVIDASSSRKSANAGSHFGGNTDILIDGFVPPSTSVAPMFPFFENTAEWDDFGEVINPDDYMMKQEEMDNTLMLGPGDGLDGKIDDGSARLLLDSTPSKVISNEMTVQVKCSLVYMDFEGRSDGRSVKSVIAHVAPLKLVLVHGSAEATEHLKMHCTKNLDLHVHAPQIEETIDVTSDLCAYKVQLSEKLMSNIISKKLGEHEIAWVDAEVGKEDEKLILLPPSSTPPPHKPVLVGDLKLSDFKQFLENKGWQVEFAGGALRCGEYIMVRKIGDSSQKGSTGSQQIVIEGPLCEDYYKIRELLYSQFYLL

SEQ ID NO: 9617 - DNA, 576 bp, Sorghum bicolor
  misc_feature: Ceres ANNOT ID no. 6100845
  misc_feature: Encodes the peptide sequence at SEQ ID NO 9618
atgagctcctcctcctcggcgtcggccgtgccgccggaggacgacgtctgctccgtctgccacgaccgcttccggatcccgtgccaggcgaactgctcccattggttttgtggagagtgcatcatccgtgtttggcatcatggccctgctgtacatgcttgcaagtgtcccatttgtcgccgccttataaatctgctagtgcctgctgctttatcagagcaggaggatgatccacaagctcaccgtattttaggagagattcaacactataactgtatatttggtggagcaccacgcagcctgactcagaggttgcaagacctacccttcttcattcgaagactgttcagagaactaatggatccccagcgaactctcccacttgtgttcagggcacggatgatgatgatggtcgcattgagtgcaatttatgtgctgagccctgtcgacattcttcctgaaagtatgctggggctccttggattcgttgatgacctgctcatcctgctgatcgtgttcctccaccttgccgctgtttaccggtcattgctcctataccgccacggcggccagtag

SEQ ID NO: 9618 - protein, 191 aa, Sorghum bicolor
  misc_feature: Ceres ANNOT ID no. 6100845
  misc_feature (14)..(187): NCBI GI: 62857749 NCBI Desc: loc549626 [xenopus tropicalis]
  misc_feature (8)..(181): NCBI GI: 18418331 NCBI Desc: zinc finger (c3hc4-type ring finger) family protein [arabidopsis thaliana]
  misc_feature (40)..(187): NCBI GI: 119583606 NCBI Desc: ring finger protein 170, isoform cra_b [homo sapiens]
  misc_feature (16)..(184): NCBI GI: 89293232 NCBI Desc: zinc finger protein [tetrahymena thermophila sb210]
  misc_feature (15)..(174): NCBI GI: 55251118 NCBI Desc: novel zinc finger protein [danio rerio]
MSSSSSASAVPPEDDVCSVCHDRFRIPCQANCSHWFCGECIIRVWHHGPAVHACKCPICRRLINLLVPAALSEQEDDPQAHRILGEIQHYNCIFGGAPRSLTQRLQDLPFFIRRLFRELMDPQRTLPLVFRARMMMMVALSAIYVLSPVDILPESMLGLLGFVDDLLILLIVFLHLAAVYRSLLLYRHGGQ

SEQ ID NO: 9619 - DNA, 615 bp, Sorghum bicolor; identical to SEQ ID NO: 9613
  misc_feature: Ceres ANNOT ID no. 6100847
  misc_feature: Encodes the peptide sequence at SEQ ID NO 9620

SEQ ID NO: 9620 - protein, 204 aa, Sorghum bicolor; identical to SEQ ID NO: 9614
  misc_feature: Ceres ANNOT ID no. 6100847

SEQ ID NO: 9621 - DNA, 2217 bp, Sorghum bicolor; identical to SEQ ID NO: 9615
  misc_feature: Ceres ANNOT ID no. 6100849
  misc_feature: Encodes the peptide sequence at SEQ ID NO 9622
  misc_feature: Down-regulated in shoot tissues in response to salicylic acid treatment

SEQ ID NO: 9622 - protein, 738 aa, Sorghum bicolor; identical to SEQ ID NO: 9616
  misc_feature: Ceres ANNOT ID no. 6100849
  misc_feature (533)..(575): Pfam Id: RMMBL Pfam Desc: RNA-metabolising metallo-beta-lactamase
  misc_feature (17)..(205): Pfam Id: Lactamase_B Pfam Desc: Metallo-beta-lactamase superfamily
  misc_feature (1)..(738): NCBI GI: 75253249 NCBI Desc: cleavage and polyadenylation specificity factor 100 kda subunit (cpsf 100 kda subunit)
  misc_feature (1)..(738): NCBI GI: 9082326 NCBI Desc: polyadenylation cleavage/specificity factor 100 kda subunit [arabidopsis thaliana]
  misc_feature (1)..(648): NCBI GI: 119601886 NCBI Desc: cleavage and polyadenylation specific factor 2, 100kda, isoform cra_a [homo sapiens]
  misc_feature (1)..(648): NCBI GI: 47125306 NCBI Desc: cleavage and polyadenylation specific factor 2 [homo sapiens]
  misc_feature (1)..(648): NCBI GI: 4927240 NCBI Desc: cleavage and polyadenylation specificity factor 100 kda subunit [xenopus laevis]
  misc_feature: Down-regulated in shoot tissues in response to salicylic acid treatment

SEQ ID NO: 9623 - DNA, 576 bp, Sorghum bicolor; identical to SEQ ID NO: 9617
  misc_feature: Ceres ANNOT ID no. 6100850
  misc_feature: Encodes the peptide sequence at SEQ ID NO 9624

SEQ ID NO: 9624 - protein, 191 aa, Sorghum bicolor; identical to SEQ ID NO: 9618
  misc_feature: Ceres ANNOT ID no. 6100850
  misc_feature (14)..(187): NCBI GI: 62857749 NCBI Desc: loc549626 [xenopus tropicalis]
  misc_feature (8)..(181): NCBI GI: 18418331 NCBI Desc: zinc finger (c3hc4-type ring finger) family protein [arabidopsis thaliana]
  misc_feature (40)..(187): NCBI GI: 119583606 NCBI Desc: ring finger protein 170, isoform cra_b [homo sapiens]
  misc_feature (16)..(184): NCBI GI: 89293232 NCBI Desc: zinc finger protein [tetrahymena thermophila sb210]
  misc_feature (15)..(174): NCBI GI: 55251118 NCBI Desc: novel zinc finger protein [danio rerio]

SEQ ID NO: 9625 - DNA, 1548 bp, Sorghum bicolor
  misc_feature: Ceres ANNOT ID no. 6100852
  misc_feature: Encodes the peptide sequence at SEQ ID NO 9626
atgctctccaggcgaagatgcttcgcggcggcggtgaaccggatccggccgctcgccagggccttctgcgacgcgccggactccggggcgcgcaggtcgcaggatcacaccgagaaggttgctggcgtgaaggctccgcctgatgtgctcgacgttgctattgttggtggaggcatggtgggcttggcagtcgcttgtgcactgtccaatatgccattaacaaaacatcttagagtcgctattatcgatagcaatccagcgttgaagtcaagaggttacctggataaaaacagtatacccgattctagggtcagtactgttacccctgcaaccatgtccttcttcaaagatattggtgcctgggagcatgttcaacagcaaagacatgctttctttggtaaaatgcaggtgtgggattacactgggcttggatacacgaggtataatgcaagagatgtgggcaaagaataccttggatgtgtggtggagaacaaggtgctttgcaactcgctgctcttacgtttacaggaagaattggatgatattgaaaatgtgatatatcctaccagattggtgtctcttactttcccgttgaagagcagacaagcaggaatgaaaccaacgtcaagtgaaccattatctgttggtcatactacagaagagttacatcgcagtaatttagttaaacttgacctcagtgatggacagagtttatattccaaattggtgataggagctgatggttcaaagtccaatgttagacagattgcaggcataaaaacaactgggtggaattatccgcaaagtgcaattatctgtacagtagagcatgttgtggaaaatgattgtgcatggcagaggtttctcccttctggtccaattgcactacttccgataggcaacaacttcagcaacattgtatggacaatgagcccagaggaatcactgcgccataagtcaatgagccctgaagagtttgtgaagtcggtgaatcacgcattggattttggttatggtccacatcctcgctctactgctcttgaccgttacatggaacagttcttttctggcattgggaacactgcagcatctacaagggaatgctttgaagtaccaccgaaagcaaccggtgtagtttctgagagaatggcatttccgttgtcattgatgcattcccatgattatgtttccaaaaggctagcattagttggagacgctgctcatactgtccaccccttagccggccaaggcgtcaacttgggctttggtgatgctgctgctttagcaaaagttattgctgaaggagtttctgtgggctcagatgttggggacctgactttgctacaacggtatgagaaggaccggaaggctgccaatgtggcgatgacagcagtgctagatggtttccagaagatgtactctgtggattttgggccccttaatgtagtgagagctgctgcgttccacggtgcccagtacatatcaccactgaaaaagaacatcatctcttatgcaatgggtgacaccaaatggccactatttcggtga

SEQ ID NO: 9626 - protein, 515 aa, Sorghum bicolor
  misc_feature: Ceres ANNOT ID no. 6100852
  misc_feature (49)..(464): Pfam Id: FAD_binding_3 Pfam Desc: FAD binding domain
  misc_feature (21)..(514): NCBI GI: 115456479 NCBI Desc: os03g0839100 [oryza sativa (japonica cultivar-group)]
  misc_feature (51)..(514): NCBI GI: 79416711 NCBI Desc: monooxygenase/ oxidoreductase [arabidopsis thaliana]
  misc_feature (51)..(514): NCBI GI: 79313357 NCBI Desc: monooxygenase/ oxidoreductase [arabidopsis thaliana]
  misc_feature (51)..(514): NCBI GI: 51968852 NCBI Desc: monooxygenase, putatve [arabidopsis thaliana]
  misc_feature (228)..(505): NCBI GI: 4680659 NCBI Desc: cgi-10 protein [homo sapiens]
MLSRRRCFAAAVNRIRPLARAFCDAPDSGARRSQDHTEKVAGVKAPPDVLDVAIVGGGMVGLAVACALSNMPLTKHLRVAIIDSNPALKSRGYLDKNSIPDSRVSTVTPATMSFFKDIGAWEHVQQQRHAFFGKMQVWDYTGLGYTRYNARDVGKEYLGCVVENKVLCNSLLLRLQEELDDIENVIYPTRLVSLTFPLKSRQAGMKPTSSEPLSVGHTTEELHRSNLVKLDLSDGQSLYSKLVIGADGSKSNVRQIAGIKTTGWNYPQSAIICTVEHVVENDCAWQRFLPSGPIALLPIGNNFSNIVWTMSPEESLRHKSMSPEEFVKSVNHALDFGYGPHPRSTALDRYMEQFFSGIGNTAASTRECFEVPPKATGVVSERMAFPLSLMHSHDYVSKRLALVGDAAHTVHPLAGQGVNLGFGDAAALAKVIAEGVSVGSDVGDLTLLQRYEKDRKAANVAMTAVLDGFQKMYSVDFGPLNVVRAAAFHGAQYISPLKKNIISYAMGDTKWPLFR

SEQ ID NO: 9627 - DNA, 360 bp, Sorghum bicolor
  misc_feature: Ceres ANNOT ID no. 6100870
  misc_feature: Encodes the peptide sequence at SEQ ID NO 9628
atggcggaggcgcccgagaccgccgctcccaccccgcccccgtcgccgccagcgccggtgacttcgtccccgcctcccaagtcggggatcccgccgcggtacgacctggacgccaagtgggacgcgtgcctcgacctctccatccgccgcgtcgcctactcctccctcgctggcgccttcgcgggtctcctcctcttccgtagccctactactcgctgggcatcagttgcccttggagctggtgtggggataggagctgcatacactgaatgctcatacttattcaatggtgctcctccaaagtggtcacccaaagtctcaactattccttctgctcactctgaaggaggagacaagtaa

SEQ ID NO: 9628 - protein, 119 aa, Sorghum bicolor
  misc_feature: Ceres ANNOT ID no. 6100870
  misc_feature (2)..(32): NCBI GI: 24762385 NCBI Desc: cg11300-pa [drosophila melanogaster]
MAEAPETAAPTPPPSPPAPVTSSPPPKSGIPPRYDLDAKWDACLDLSIRRVAYSSLAGAFAGLLLFRSPTTRWASVALGAGVGIGAAYTECSYLFNGAPPKWSPKVSTIPSAHSEGGDK

SEQ ID NO: 9629 - DNA, 1785 bp, Sorghum bicolor
  misc_feature: Ceres ANNOT ID no. 6100877
  misc_feature: Encodes the peptide sequence at SEQ ID NO 9630
atggccgcctcggcattggccttccgcgcgctgcggcctccacacggccgccacgctgccgccccttcgccgcgcccgcgcccgcgtgcgtgctcggcaaccgccgctgctccaagggcgcgctgccgcgcggtggctgcggacgagcgccccgccgaccccgcgttccccgagggccagaaccgcgggatttccggggcggtggagaggccggaggcggacgtcgttgttataggcagcgggctcggcggtctgtgctgcgccggcctcctggcgaggtacggccaggacgtgctggtgctcgagagccatgaccgcccgggaggcgccgcgcactcgttcgatatcaagggattcagcttcgattcagggccatccttgttctctgggttccagtccagaggcccccaggcaaatccacttgctcaggtccttgatgcgttaggccaatcagtcccttgcgcgtcttatgactcttggatggtttatgtacctgaaggacaattcctctcacggataggaccaactgaattcctcaaggaccttgagatgtttgttggtgttgatgctgtccaggagtggaaaaaacttcttgatgcagttattcctatgtctgcagctgcaatggctttgcctccactttccattcgaggcgatctgggcattctatctacagctgctggtagatatgctccttcgttattgaaatcattcatacaaatgggacctcaaggagctctgggcgctacaaaactgctacgtccattcaaagaaattgttgattcgctggggctgaaaaatccctttgttcgtaactggatcgatctcctgtgctttctacttgctggagttaaatctgatggtgctctttctgcagaaatggtttatatgtttgcagaatggtacaaaccaggatgcttgcttgagtatcctctgggtggaactggagcgatcatagatgccctcgtgagtggtattgaaaaatttggtggcagacttgctcttcgttctcatgttgaaaagatcttaatcgagaatggtcgagcagttggtgtcaagctacaaagtggacaagttgtccgtgcaaagaaagcggttgttagcaatgcatctatgtgggatactttggatctcctaccaccaaatgttgtcccaaaatcatatgaagatagagtgaaagcaactccacaatgtgaatcgtttatgcatctccaccttggttttgatgcaaagaatgctagagaggaccttgggatccatcacattgtggttgacgattggagcaaaggagttgatggtgaacaaaatgttgtgttgatatctgttcctagtgttcttagtaaggacctggcaccaccaggaaaacacattcttcatgcatatactccagggacggaacctttcagtttgtgggagggattggacaggaaaagtgcagaatatcgaagattgaaggaagaacgttctgaggtgatgtggaaagctgtggagcttgctcttggcccaaaatttagccgtgaaagatgcgacgtgaaattggtcgggacaccactaacgcacaagagatttctcagaaggaataggggaacctatggtccagccataaaagctggagaagccactttccctgggcaagcaacaccaatcccccagctcttctgctgcggtgactcgacttttccagggattggagtgccggcggtcgcggccagcggtgcaatcgtcgcgaacacgctggttccggtgtcgcagcattcagagcttcttgatgctgttggaatttga

SEQ ID NO: 9630 - protein, 594 aa, Sorghum bicolor
  misc_feature: Ceres ANNOT ID no. 6100877
  misc_feature (82)..(580): Pfam Id: Amino_oxidase Pfam Desc: Flavin containing amine oxidoreductase
  misc_feature (74)..(578): Pfam Id: DAO Pfam Desc: FAD dependent oxidoreductase
  misc_feature (72)..(594): NCBI GI: 113478302 NCBI Desc: fad dependent oxidoreductase [trichodesmium erythraeum ims101]
  misc_feature (72)..(594): NCBI GI: 75907094 NCBI Desc: amine oxidase [anabaena variabilis atcc 29413]
  misc_feature (74)..(592): NCBI GI: 23125459 NCBI Desc: cog1233: phytoene dehydrogenase and related proteins [nostoc punctiforme pcc 73102]
  misc_feature (74)..(592): NCBI GI: 67920584 NCBI Desc: amine oxidase family [crocosphaera watsonii wh 8501]
  misc_feature (74)..(593): NCBI GI: 119487241 NCBI Desc: amine oxidase [lyngbya sp. pcc 8106]
MAASALAFRALRPPHGRHAAAPSPRPRPRACSATAAAPRARCRAVAADERPADPAFPEGQNRGISGAVERPEADVVVIGSGLGGLCCAGLLARYGQDVLVLESHDRPGGAAHSFDIKGFSFDSGPSLFSGFQSRGPQANPLAQVLDALGQSVPCASYDSWMVYVPEGQFLSRIGPTEFLKDLEMFVGVDAVQEWKKLLDAVIPMSAAAMALPPLSIRGDLGILSTAAGRYAPSLLKSFIQMGPQGALGATKLLRPFKEIVDSLGLKNPFVRNWIDLLCFLLAGVKSDGALSAEMVYMFAEWYKPGCLLEYPLGGTGAIIDALVSGIEKFGGRLALRSHVEKILIENGRAVGVKLQSGQVVRAKKAVVSNASMWDTLDLLPPNVVPKSYEDRVKATPQCESFMHLHLGFDAKNAREDLGIHHIVVDDWSKGVDGEQNVVLISVPSVLSKDLAPPGKHILHAYTPGTEPFSLWEGLDRKSAEYRRLKEERSEVMWKAVELALGPKFSRERCDVKLVGTPLTHKRFLRRNRGTYGPAIKAGEATFPGQATPIPQLFCCGDSTFPGIGVPAVAASGAIVANTLVPVSQHSELLDAVGI

SEQ ID NO: 9631 - DNA, 1545 bp, Sorghum bicolor
  misc_feature: Ceres ANNOT ID no. 6100881
  misc_feature: Encodes the peptide sequence at SEQ ID NO 9632
atggaagccgacatcgcttcgaggtatgagatccctcggaccgctcagttccttcgcgactgcgcctacaacagggtcgcgctccagttccccgacgagatgctcaaggacgccgcggcggtggcgagggcgctgcggcgggagcttgcctccggcggggccggtggtggggtcagggtgttcgtgatggccgacacggcgtacaactcctgctgcgtcgacgaggtgggcgcgtcccacatcgatgcgcagtgcgtcgtccattacggccacgcctgcatgagcccaacatcaaatttgccagcttactttgtattcgggaaggcacagttggatatccacgcatgtgccagcacattgcttgagtgctcaagaacaagcaataagcgcattctggttttatatggactagagtacgcatatgcattggatgatcttagacaagctttcatggagtcatgcaaatcaaattcttgcaatcctgaagtccagtatgcagaagttctgtgttcagttatgagtccatcatcaagtactacagaagaaaacacaattcctcagtcgagtggcacctcttgtaacagagatatcacaagaaacagcgatgtagcaacattcctggacaatcattatggcatgaaatgttccagttctacacaaaagtacagccttggtggcattacatgggatatttcagttgatgaaaaaatggaggactatttgatattttggattggacaagataactcagcatttgccaacatagtccttaccttcaataaatgtgaaatagttagatatgacgcaatagaaaatcaactcacagctgacatctctcatctgatgaaaattcttaggcgaagatattaccttgtggagaaggcgaaggatgcaaatattattggcattttggtgggaactctgggtgctgctggttatcttcatataatcgaacaaatgaaagaactgatcaaggctgctggaaagaaatcttatacattggtcatgggcaggcctaattctgcaaaacttgcgaattttccagagtgcgaagtttttatttatgtttcttgtgcccaaaccgctctgctggatagcaaggattttttagctccagttattacaccttttgaagctgtactagcttttagcaggggaagagagtggactggagaatatcttttggatttcaaggatttgatcactttagagaaacaagaagttgtgagcacaacagaagaagcacgtttttcttttatcaaaggtgtctatgtggaagataattgcccccaagaaaatgaggagcaatcagaaacatcgctcgcactggctgaggtaacagaaaaggcactaagcatccaaaaccagcacaacgacgctgtcctttacaaaggaggagcaatgtcctcaatcgactacctcaaggcacgttcataccgtggtctaactggagaatatgaaggtccagtgcctaattcaatcttggtaggcagaaccggcagggcggctggttacagtgatgagaaaaccgagaacgcacaataa

SEQ ID NO: 9632 - protein, 514 aa, Sorghum bicolor
  misc_feature: Ceres ANNOT ID no. 6100881
  misc_feature (30)..(398): Pfam Id: Diphthamide_syn Pfam Desc: Putative diphthamide synthesis protein
  misc_feature (4)..(309): NCBI GI: 140042701 NCBI Desc: diphthamide biosynthesis protein 2, related [medicago truncatula]
  misc_feature (238)..(508): NCBI GI: 50417478 NCBI Desc: mgc81125 protein [xenopus laevis]
  misc_feature (236)..(509): NCBI GI: 74681945 NCBI Desc: diphthamide biosynthesis protein 2
  misc_feature (239)..(505): NCBI GI: 74584779 NCBI Desc: diphthamide biosynthesis protein 2
  misc_feature (285)..(507): NCBI GI: 74670996 NCBI Desc: diphthamide biosynthesis protein 2
MEADIASRYEIPRTAQFLRDCAYNRVALQFPDEMLKDAAAVARALRRELASGGAGGGVRVFVMADTAYNSCCVDEVGASHIDAQCVVHYGHACMSPTSNLPAYFVFGKAQLDIHACASTLLECSRTSNKRILVLYGLEYAYALDDLRQAFMESCKSNSCNPEVQYAEVLCSVMSPSSSTTEENTIPQSSGTSCNRDITRNSDVATFLDNHYGMKCSSSTQKYSLGGITWDISVDEKMEDYLIFWIGQDNSAFANIVLTFNKCEIVRYDAIENQLTADISHLMKILRRRYYLVEKAKDANIIGILVGTLGAAGYLHIIEQMKELIKAAGKKSYTLVMGRPNSAKLANFPECEVFIYVSCAQTALLDSKDFLAPVITPFEAVLAFSRGREWTGEYLLDFKDLITLEKQEVVSTTEEARFSFIKGVYVEDNCPQENEEQSETSLALAEVTEKALSIQNQHNDAVLYKGGAMSSIDYLKARSYRGLTGEYEGPVPNSILVGRTGRAAGYSDEKTENAQ

SEQ ID NO: 9633 - DNA, 1146 bp, Sorghum bicolor
  misc_feature: Ceres ANNOT ID no. 6100883
  misc_feature: Encodes the peptide sequence at SEQ ID NO 9634
atggatcagttggtgaacgcggtgatggacctggtggtgccgccggcgagcatggtgatgctggcgttcgcgtggccgacgctgtcgttcctgcgcggcgtcgagtgggcgctcaagaccctcaccaaggaggacatgctgggaaaggtcgtcgtcatcaccggcgcatcctccgccatcggcgagcaaatcgcgtacgagtacgcgcggcggaacgcgaacctggtgctggtggcgcggcgggagcagcggctgttcgggatccgcgacaacgcgcggcagctgggcgccggccaggtcctcgtcatcgccgccgacgtcgtcaaggaagaggactgccggaggctcgtcgccgacaccgtcagctacttcgggcagctgaaccatctggtgaacaccgtgagcttgagccacgacttcagcttcgaggaggccggcgacaccacggccttccctcacctcatggacatcaacttctggggcaacgtgtacccgacctacgccgcgctgccctacctccggcgaagccacggccgcgtcgtcgtcaacgcgtccgtcgagagctggctgcccatgcccaggatgagcctctactctgcggcgaaggcggcagtggtggacttctacgagacgctccggtacgaggtgaaggatgaggtgggcgtgaccgtggcgacgcacggctgggtcggcggcgacgccggcggcggcaagttcacgctggaccaccatcatcaggaaggcgcggcggaggtgcagcagtggaagcaggaagagcgcgaggcggcggcggcggcggcgctgccggggggagcgcacgtggaggcgtacgcgcgggcgctggtggccggcgcctgccgcggcgacgcctacgtgaagcgccccagctggtacgacgtcttcctcgtcttccgcgtcttcgcgcccgacgtcctcgcatggaccttccgcctcctgctgtcgtcgtccacgcccgtcgccgccgccgccgccggcccgaccacgaccacgaccacgagcgcgatcaccgcacgtcgtccccctcctgccgcgctgccggcgccgccggtccgcccgctgctcgagtacacgccgccgccaccggcgtcccggaggccctcgtcccagatgcagaaactggaatga

SEQ ID NO: 9634 - protein, 381 aa, Sorghum bicolor
  misc_feature: Ceres ANNOT ID no. 6100883
  misc_feature (49)..(217): Pfam Id: adh_short Pfam Desc: short chain dehydrogenase
  misc_feature (1)..(322): NCBI GI: 61658208 NCBI Desc: sto-1 [coffea canephora]
  misc_feature (1)..(356): NCBI GI: 21311775 NCBI Desc: steroleosin-b [sesamum indicum]
  misc_feature (1)..(355): NCBI GI: 16033752 NCBI Desc: steroleosin [sesamum indicum]
  misc_feature (4)..(348): NCBI GI: 21742781 NCBI Desc: osjnba0055c08.3 [oryza sativa (japonica cultivar-group)]
  misc_feature (3)..(325): NCBI GI: 124107990 NCBI Desc: short-chain dehydrogenase reductase [brassica napus]
  misc_feature: The sequence is a functional homolog of SEQ ID NO. 389 in the 11/188,298 US application
MDQLVNAVMDLVVPPASMVMLAFAWPTLSFLRGVEWALKTLTKEDMLGKVVVITGASSAIGEQIAYEYARRNANLVLVARREQRLFGIRDNARQLGAGQVLVIAADVVKEEDCRRLVADTVSYFGQLNHLVNTVSLSHDFSFEEAGDTTAFPHLMDINFWGNVYPTYAALPYLRRSHGRVVVNASVESWLPMPRMSLYSAAKAAVVDFYETLRYEVKDEVGVTVATHGWVGGDAGGGKFTLDHHHQEGAAEVQQWKQEEREAAAAAALPGGAHVEAYARALVAGACRGDAYVKRPSWYDVFLVFRVFAPDVLAWTFRLLLSSSTPVAAAAAGPTTTTTTSAITARRPPPAALPAPPVRPLLEYTPPPPASRRPSSQMQKLE

SEQ ID NO: 9635 - DNA, 1134 bp, Sorghum bicolor
  misc_feature: Ceres ANNOT ID no. 6100886
  misc_feature: Encodes the peptide sequence at SEQ ID NO 9636
atggcggggaagggagccaaggccacggccgccaagtcgtcggacaaggacaaggggaagaaggccggcggccccgtctcgcgctcctcccgcgccgcacctcaggagaaggagaagtcagctccgaagaaagatgtttatcaattgttcgctgagaaggttagggataacaaacaactggaatcgagatgggcaatcatgcaagaaactcgtgtggagtattttcgtggaaaagatttcaataccttcatcaagaatcatccagaagtcagggaaattttggggccagataaggatttagaagtggaagacattgtcaacactttgctgaccaagaaccttgtgataaggtgtgatcgagttatgaaaactgtgaggcctggcaagaaaaagctatcatcatggcctgctcatttggagatacataatgaacaagtgttcactgaaaatgatggtttttttgcttggatgtttctgaaaaggcggaccttgtggcagacaattctttcatttgtttggcctctttttgcactggcagtctgcttatttccagtttacccataccaatgcaagattgttgtactgtattcatgtgctggagctctacttttcatcgtctccattcttttgctaagagctgctatctttggcatattatgggttctccttgggaaacgcgtgtggttctttcccaacataaatgcagaggagacaacatttagagaacttgttcgtttttggcctgagaaggatgaaggggagcggccaaagtggacatcaagacttttctatgctcttgttgctctattggtgatattactgcttaggcaccatgctcctgacgaagctgctagagccaggtaccaaaagaaggtttctaacataattgatgatgttcttgaatggtctccgaagttagctatttctggaatgattgaaaaacacaccggggctaacattacagaagaaagcaattacaccagcagggctgcgagtagtcatgtgcctccttccaccgaaggcaaagcttcagaaggtggcccagatatggatgttgatggggataatggggctaacttagatgaaacccaagataatgaatatgctgatgatacaagatcaagcgaagcttag

SEQ ID NO: 9636 - protein, 377 aa, Sorghum bicolor
  misc_feature: Ceres ANNOT ID no. 6100886
  misc_feature (69)..(260): Pfam Id: Sec62 Pfam Desc: Translocation protein Sec62
  misc_feature (1)..(376): NCBI GI: 51536186 NCBI Desc: translocation protein-related-like [oryza sativa (japonica cultivar-group)]
  misc_feature (14)..(376): NCBI GI: 79313309 NCBI Desc: protein transporter [arabidopsis thaliana]
  misc_feature (109)..(327): NCBI GI: 145348047 NCBI Desc: nscc2 family transporter: translocation proteinsec62 [ostreococcus lucimarinus cce9901]
  misc_feature (129)..(248): NCBI GI: 56427968 NCBI Desc: translocation protein 1 [drosophila yakuba]
  misc_feature (129)..(248): NCBI GI: 56427966 NCBI Desc: translocation protein 1 [drosophila santomea]
  misc_feature: Useful for making plants with modulated drought sensitivity
  misc_feature: GREAT-hit functional homolog of the protein sequence given in SEQ ID NO 13181
  misc_feature: Useful for making plants with modulated drought sensitivity
  misc_feature: Useful for making plants with modulated water use efficiency
  misc_feature: Functional homolog of the protein sequence given in SEQ ID NO 13181
MAGKGAKATAAKSSDKDKGKKAGGPVSRSSRAAPQEKEKSAPKKDVYQLFAEKVRDNKQLESRWAIMQETRVEYFRGKDFNTFIKNHPEVREILGPDKDLEVEDIVNTLLTKNLVIRCDRVMKTVRPGKKKLSSWPAHLEIHNEQVFTENDGFFAWMFLKRRTLWQTILSFVWPLFALAVCLFPVYPYQCKIVVLYSCAGALLFIVSILLLRAAIFGILWVLLGKRVWFFPNINAEETTFRELVRFWPEKDEGERPKWTSRLFYALVALLVILLLRHHAPDEAARARYQKKVSNIIDDVLEWSPKLAISGMIEKHTGANITEESNYTSRAASSHVPPSTEGKASEGGPDMDVDGDNGANLDETQDNEYADDTRSSEA

SEQ ID NO: 9637 - DNA, 1131 bp, Sorghum bicolor
  misc_feature: Ceres ANNOT ID no. 6100890
  misc_feature: Encodes the peptide sequence at SEQ ID NO 9638
atggatgcgttccggaagcagctggacgtgctcatgggcgcaaaccgcaacggcgacgtcgaggaggtgaaccgcaactactacgaccgcgacgtctgccgcctcttcctcgcgggcctttgcccccatgacctcttccagctcacggtaacctcgttttcccctttgatgtttgctgttggtagttatgaagaagcgaaagcaaagggaacagagaattttgacagagaactcgaggatatgatagaaaggctcattgtggagtgcgacaggaaaattcagagggccctgaaacggcttgcggatgatgatgccaaggctgctattgcaatatctgtctctgaggttactctgctgtcaaaacagatcaaagaaaaaatgatagaagtcgatgcctttgattttgaagggagaactgatgacaaaataaaggcccaggaagtagtggaagaactcagagctaaaagagctgatatgcaggctaccctcttgcttgatgcttttaacaaggacagagcttcattaactcagcctgttccacctcctccactggcagcagtgccaccaccgcctccacctgatgctcgtactcaagaaatgatcaatgaaaagcttaagaaagctgaagagcttggtgaacaaggcatggttgatgaagctcagaaagctttggaagaggcagaagctctgaaaaagactgatcaaaagttacgcctctgtgacatatgtggagcatttctgagtgtatatgacaatgatcgacgtcttgctgaccattttggagggaaactacacctaggctacatgctgattcgtgagaaacagaaagaacttcaggagcagagaaacaaaaggaggacgggcaaaactgaagatgatagacgatcaagagagcacagcaaggatcgcaacggtcggtcatccagggatagagattcagaaaggagagacagagttgagtctcgagatggtagaagagattatgatagagatcgtgatagacgtcacgatagggaccgtcgccatgaccgtgatcgggatagggattatgaccgttcccgcggacatgattcaaggagaagagagcgttcacgctccagggagcgcagcaggcgccatgagagatactaa

SEQ ID NO: 9638 - protein, 376 aa, Sorghum bicolor
  misc_feature: Ceres ANNOT ID no. 6100890
  misc_feature (1)..(311): Pfam Id: LUC7 Pfam Desc: LUC7 N_terminus
  misc_feature (1)..(375): NCBI GI: 68035255 NCBI Desc: pre-mrna processing factor [triticum aestivum]
  misc_feature (1)..(375): NCBI GI: 17380624 NCBI Desc: at5g17440/k3m16_10 [arabidopsis thaliana]
  misc_feature (1)..(375): NCBI GI: 30678827 NCBI Desc: luc7 n_terminus domain-containing protein [arabidopsis thaliana]
  misc_feature (1)..(375): NCBI GI: 119935927 NCBI Desc: at3g03340 [arabidopsis thaliana]
  misc_feature (214)..(376): NCBI GI: 4929617 NCBI Desc: cgi-74 protein [homo sapiens]
MDAFRKQLDVLMGANRNGDVEEVNRNYYDRDVCRLFLAGLCPHDLFQLTVTSFSPLMFAVGSYEEAKAKGTENFDRELEDMIERLIVECDRKIQRALKRLADDDAKAAIAISVSEVTLLSKQIKEKMIEVDAFDFEGRTDDKIKAQEVVEELRAKRADMQATLLLDAFNKDRASLTQPVPPPPLAAVPPPPPPDARTQEMINEKLKKAEELGEQGMVDEAQKALEEAEALKKTDQKLRLCDICGAFLSVYDNDRRLADHFGGKLHLGYMLIREKQKELQEQRNKRRTGKTEDDRRSREHSKDRNGRSSRDRDSERRDRVESRDGRRDYDRDRDRRHDRDRRHDRDRDRDYDRSRGHDSRRRERSRSRERSRRHERY

SEQ ID NO: 9639 - DNA, 1554 bp, Sorghum bicolor
  misc_feature: Ceres ANNOT ID no. 6100902
  misc_feature: Encodes the peptide sequence at SEQ ID NO 9640
atggaggaggagccgccggcctcggacctggcggcgcgcggcgacctgcgctcggcgcttcccttcctccccgtcgtcctccgcggcggcgcgctcttctggccgcccgcggcgcaggagtcgctccgggcgctggcgctcggccccgacgtcagccgcgtcgcctcgggggacgtcctcgccgacgcgctcaccgacctccgcctcgcgctcgccctgcccgcgctgccccagcgcgctgccgacggcctggcgctcttctttgacgacctcctctcccgggcccaggcgcggggctggttcgccgaggtcgtccccaacctcgcacgcctcctcctccgcctccccactctgctcgaggaccactacgccaaggccggccacggcgcctccgggctccgggtcctggcgtcgcaggacgcgggccttgtgctcctcagccaggagcttgtcgccgcgctgctcacctgcgcgctcttctgcctcttccccacggccggtagggcccaggcgtgccttcccaccatcaatttcgatggcctgttcacggcgctgattcaccgatcgcagagccaggagcagaaagtgaggtgccttgttcactatttcgagagggtgactgattctacgcctgctggtttcgtttcgtttgagcgcaaagttcttccccgccaacctgtctctgatggcattacctatcctgacatccatgcgtggttggcatctagtgcacccctctgccaattccgggtattttcctcaggttttatagaagatgaggaacaagaagcccttcaagttgactttgcaaataaatatttgggaggaggtgccctttccaggggttgtgtgcaggaagagatacgcttcatgataaaccccgaattgattttgggtatgctattcatggcttctatggaagataatgaggctatagaaatttttggtgcagaacggttctcacagtatatgggttatggttcctcctttcgctttgtcggtgactatttagataccaaaccctttgattcggtgggtagacggaggactaggatagtggcaattgatgctttggactgtccagctaggttacactatgaatctgattgtctcctaagggaagtgaacaaggctttttgtggatttttcgatcaatcaaaatgccagctttatgtgaagcttttccaggattcacacaacaaggataactttccaagtatcaattccaatgagtacataggagtttcaacaggaaattggggttgcggtgcttttggtggaaaccctgaaatcaagagcatgattcagtggattgctgcatcacaggctctccggccttttgttaattactacacttttgaggatgcatctctggaaagattagaggaggtgatccagtggatactacgccatggctggacggtcagtgagttgtggcatatgctcatcgaatactcgtctcagaggctgagaggagaaacgtacaagggtttttttgcttggctacttcccagcaacaggcccaacaatgaagtgcattacatgtctgaatag

SEQ ID NO: 9640 - protein, 517 aa, Sorghum bicolor
  misc_feature: Ceres ANNOT ID no. 6100902
  misc_feature (101)..(463): Pfam Id: PARG_cat Pfam Desc: Poly (ADP-ribose) glycohydrolase (PARG)
  misc_feature (13)..(411): NCBI GI: 140039404 NCBI Desc: poly glycohydrolase [medicago truncatula]
  misc_feature (13)..(402): NCBI GI: 145330328 NCBI Desc: tej (sanskrit for 'bright') [arabidopsis thaliana]
  misc_feature (13)..(402): NCBI GI: 62321654 NCBI Desc: poly(adp-ribose) like glycohydrolase [arabidopsis thaliana]
  misc_feature (13)..(417): NCBI GI: 42571009 NCBI Desc: poly (adp-ribose) glycohydrolase (parg) family protein [arabidopsis thaliana]
  misc_feature (251)..(517): NCBI GI: 115456535 NCBI Desc: os03g0843900 [oryza sativa (japonica cultivar-group)]
MEEEPPASDLAARGDLRSALPFLPVVLRGGALFWPPAAQESLRALALGPDVSRVASGDVLADALTDLRLALALPALPQRAADGLALFFDDLLSRAQARGWFAEVVPNLARLLLRLPTLLEDHYAKAGHGASGLRVLASQDAGLVLLSQELVAALLTCALFCLFPTAGRAQACLPTINFDGLFTALIHRSQSQEQKVRCLVHYFERVTDSTPAGFVSFERKVLPRQPVSDGITYPDIHAWLASSAPLCQFRVFSSGFIEDEEQEALQVDFANKYLGGGALSRGCVQEEIRFMINPELILGMLFMASMEDNEAIEIFGAERFSQYMGYGSSFRFVGDYLDTKPFDSVGRRRTRIVAIDALDCPARLHYESDCLLREVNKAFCGFFDQSKCQLYVKLFQDSHNKDNFPSINSNEYIGVSTGNWGCGAFGGNPEIKSMIQWIAASQALRPFVNYYTFEDASLERLEEVIQWILRHGWTVSELWHMLIEYSSQRLRGETYKGFFAWLLPSNRPNNEVHYMSE

SEQ ID NO: 9641 - DNA, 2277 bp, Sorghum bicolor
  misc_feature: Ceres ANNOT ID no. 6100911
  misc_feature: Encodes the peptide sequence at SEQ ID NO 9642
atggccatggcccggcgttctgcctcccatctcctatcctccttccgccccttttccctcctcctccagccgcacctcgctgactccccctcgccggcggccgcggccgcggcggcgtcagctcggcgggcgatgtcggcggcgtcggccctacgtgcacgggacgagaaggatgtggcgcggtggcgggagtcgatggcccggatgcggaatatcggcatctccgcgcacatcgactctgggaagacgacgctcacagagcgggtcctctactacaccggcaggatccacgagatccacgaggtgcgcggccgtgacggcgtcggcgctaagatggactccatggacctcgagcgcgaaaaggggattaccattcagtctgctgccacctactgcacctggaaggattaccagattaatattattgatactccaggtcacgtggatttcaccattgaggttgaaagggcactccgtgttcttgatggtgctatacttgtgctatgtagtgttggtggtgtacaaagtcagtcgatcactgttgatcggcaaatgagaagatatgacatcccaagggttgctttcattaacaagttggaccgtatgggagctgatccatggaaggttcttaaccaggcgcgatccaagctccgtcaccacaatgcagctgtacaagtacccataggattagaagaggagtttgagggccttgttgaccttgtagaaatgaaggcttataagttcgagggttctagtggccagaatgtaactgcttctgatattccattgaacatggaggatttagtcactgagaagcgtcgtgaacttattgaagttgtttctgaagtagatgatcagcttgctgaagcttttctcaatgatgagccaataacagctaatcagcttaaggctgctattcgaagagctacagtggcacagaagttcataccagtatacatgggaagtgcattcaaaaataagggtgttcaaccgcttcttgatggcgtgctggattatctaccatgcccgttggaggttgataactacgcccttgatcaaaacaaatccgaagagaaggtactattggctggaactccagctgaaccacttgtggcattagcgtttaagctagaggaaggtcgttttggtcagctgacctatctaagaatctatgatggtgttataaggaagggtgacttcatatacaatgtcaatacagggaagaaaatcaaagttcctcgcttggtaaggatgcactctaatgagatggaggatattcaagaagcatatgctggccaaattgttgctgtttttggtgttgattgtgcatcaggcgatacatttacggatggaacagtgaaatatactatgacttcaatgaatgtccctgaacctgtgatgtccttggcagtttcacctatatctaaagactctggaggacaattttcgaaagctctgaatcgcttccaaaaggaggatcctactttccgtgtgggtttggatgctgagagtggccagacaattatttcagggatgggtgagctgcatctggatatatatgttgaacgtattaagagagagtacaaggtggatgcaaaggtaggaaaacctcgtgttaacttcagggaaacaatcacccagcgtgctgaatttgattatttgcacaaaaagcaatctggcggtcaaggtcagtatggacgagtttgtgggtacattgagcctcttccatcaggttctgatggtaaattcgaatttgataacatgattattggacaagcaattccttcaaactttataccagcaatagagaagggttttagggaagcttgcaattcgggttcattgatcggtcatcctgttgaaaatttaagaattgtactgactgatggggcttcacatcaggtggattccagtgaacttgcttttaagctagctgctatctatgcttttcgacagtgttacacttctgccaaacctgtaatattagaacctgtgatgaaggtggaactcaaatttccaacagagttccagggcaccgtaactggtgatatgaacaagagaaaagggatcattgttggaaatgagcaggaaggtgacgacaccattgtagtttgccatgttccgctaaacaatatgtttggatatgcaacagctattcgatcagtgactcaggggaaaggtgaatttacgatggagtacctggagcataatgttgtctcgcaggatgtacagatgcaattagtgaactcatacaaggcggccaagggcacagagtga

SEQ ID NO: 9642 - protein, 758 aa, Sorghum bicolor
  misc_feature: Ceres ANNOT ID no. 6100911
  misc_feature (67)..(342): Pfam Id: GTP_EFTU Pfam Desc: Elongation factor Tu GTP binding domain
  misc_feature (537)..(658): Pfam Id: EFG_IV Pfam Desc: Elongation factor G, domain IV
  misc_feature (660)..(747): Pfam Id: EFG_C Pfam Desc: Elongation factor G C-terminus
  misc_feature (383)..(449): Pfam Id: GTP_EFTU_D2 Pfam Desc: Elongation factor Tu domain 2
  misc_feature (1)..(758): NCBI GI: 109940076 NCBI Desc: elongation factor g, mitochondrial precursor (mef-g)
  misc_feature (1)..(758): NCBI GI: 10129887 NCBI Desc: mitochondrial elongation factor g [oryza sativa (japonica cultivar-group)]
  misc_feature (213)..(758): NCBI GI: 144924553 NCBI Desc: elongation factor tu, domain 2 [medicago truncatula]
  misc_feature (68)..(758): NCBI GI: 115375838 NCBI Desc: translation elongation factor g [stigmatella aurantiaca dw4/3-1]
  misc_feature (68)..(758): NCBI GI: 108763323 NCBI Desc: translation elongation factor g [myxococcus xanthus dk 1622]
MAMARRSASHLLSSFRPFSLLLQPHLADSPSPAAAAAAASARRAMSAASALRARDEKDVARWRESMARMRNIGISAHIDSGKTTLTERVLYYTGRIHEIHEVRGRDGVGAKMDSMDLEREKGITIQSAATYCTWKDYQINIIDTPGHVDFTIEVERALRVLDGAILVLCSVGGVQSQSITVDRQMRRYDIPRVAFINKLDRMGADPWKVLNQARSKLRHHNAAVQVPIGLEEEFEGLVDLVEMKAYKFEGSSGQNVTASDIPLNMEDLVTEKRRELIEVVSEVDDQLAEAFLNDEPITANQLKAAIRRATVAQKFIPVYMGSAFKNKGVQPLLDGVLDYLPCPLEVDNYALDQNKSEEKVLLAGTPAEPLVALAFKLEEGRFGQLTYLRIYDGVIRKGDFIYNVNTGKKIKVPRLVRMHSNEMEDIQEAYAGQIVAVFGVDCASGDTFTDGTVKYTMTSMNVPEPVMSLAVSPISKDSGGQFSKALNRFQKEDPTFRVGLDAESGQTIISGMGELHLDIYVERIKREYKVDAKVGKPRVNFRETITQRAEFDYLHKKQSGGQGQYGRVCGYIEPLPSGSDGKFEFDNMIIGQAIPSNFIPAIEKGFREACNSGSLIGHPVENLRIVLTDGASHQVDSSELAFKLAAIYAFRQCYTSAKPVILEPVMKVELKFPTEFQGTVTGDMNKRKGIIVGNEQEGDDTIVVCHVPLNNMFGYATAIRSVTQGKGEFTMEYLEHNVVSQDVQMQLVNSYKAAKGTE

SEQ ID NO: 9643 - DNA, 1101 bp, Sorghum bicolor
  misc_feature: Ceres ANNOT ID no. 6100913
  misc_feature: Encodes the peptide sequence at SEQ ID NO 9644
atgctggtggcgtcgctcaggccggggccttcgctcgcggccttccccgcttccgcccggaggagcccagttcccttcctccccttccctgcccgcctgcaccaccggtccctgctgctctccgcaaccgccgagggaaccggcgcccccgccggccagggtgacgcctcggatgcgccagtcgacgaggcgcgcctgccgcagttcgctgtggactgggaagctgcgcgcacttacaaggaccaggggaacattctcacgctgccggtgctgagggccaatagcggcgggcttatcgtcaggttcaactccctgcaggggttcgtgcccaaccctctcctcagccccgcgcactggtgtgaagaccccaaaaggcccatccaagatattacaaaagacctagtaggaacgtccatttctgtcaaggttgctgaagtgaatgaggaggaaaggaagcttgtcttctctgagaaggatgctagttggtcaacatactcttctctaataaagattggcgacatctatgatggaattgtgggctcagtgtttccctatggtgcatttgttcacctgcgatttcctgatggactatatcatcttactggtcttgtacatatctccgaggtgtcttgggatcttgtccaagacgtccaggattttctaaacgaaggggacgctgtcaaggtcatagttgtgaacattgatacggcaaagtcaaggatagctttatctatcagacaactggaggaagatcctctattggagacattggacaaagttatccctttggaagctgatcaatcacctgatcgtatgatgtccccttcagaagttgaacttctgccaggacttgatggtatatgtaatgaactattgcaagaggatggtataacagatgtacagtttgggcgccaagcatcggagaaacgtgttgtttcacaagatttggagctttggctttccaatgctccagctaaggataacaagttcacacttcttgcacgagctgggaggcaggtccaggaagtgtatttgaccacttcgctagaccaggagggcataaagaaagctgtgcaaagagtattagggcgtgttccttga

SEQ ID NO: 9644 - protein, 366 aa, Sorghum bicolor
  misc_feature: Ceres ANNOT ID no. 6100913
  misc_feature (168)..(246): Pfam Id: S1 Pfam Desc: S1 RNA binding domain
  misc_feature (68)..(315): NCBI GI: 118048378 NCBI Desc: rna binding s1 [chloroflexus aggregans dsm 9485]
  misc_feature (68)..(259): NCBI GI: 106891436 NCBI Desc: rna binding s1 [roseiflexus sp. rs-1]
  misc_feature (68)..(259): NCBI GI: 118062331 NCBI Desc: rna binding s1 [roseiflexus castenholzii dsm 13941]
  misc_feature (73)..(252): NCBI GI: 40641370 NCBI Desc: ribosomal protein s1 homologue [chlamydomonas reinhardtii]
  misc_feature (61)..(312): NCBI GI: 118046914 NCBI Desc: rna binding s1 [chloroflexus aggregans dsm 9485]
MLVASLRPGPSLAAFPASARRSPVPFLPFPARLHHRSLLLSATAEGTGAPAGQGDASDAPVDEARLPQFAVDWEAARTYKDQGNILTLPVLRANSGGLIVRFNSLQGFVPNPLLSPAHWCEDPKRPIQDITKDLVGTSISVKVAEVNEEERKLVFSEKDASWSTYSSLIKIGDIYDGIVGSVFPYGAFVHLRFPDGLYHLTGLVHISEVSWDLVQDVQDFLNEGDAVKVIVVNIDTAKSRIALSIRQLEEDPLLETLDKVIPLEADQSPDRMMSPSEVELLPGLDGICNELLQEDGITDVQFGRQASEKRVVSQDLELWLSNAPAKDNKFTLLARAGRQVQEVYLTTSLDQEGIKKAVQRVLGRVP

SEQ ID NO: 9645 - DNA, 1128 bp, Sorghum bicolor
  misc_feature: Ceres ANNOT ID no. 6100914
  misc_feature: Encodes the peptide sequence at SEQ ID NO 9646
  misc_feature: Down-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Down-regulated in shoot tissues in response to salicylic acid treatment
atgacgcccctcgtgcgcaagcgcatcgtcggcgcccgcgtccacctcatggtcatggacctgggctgccgcagccgcacgcgccggctcggcaacaacacccaccgccgccgaacaagtactactagcaccaccctaaagcagctcctcctcgccttcctcctcatcctcgtcttcttgatccccagctccgtcttgttgcccccagctcggcctcggatcatgtcgtcctctgcttccgactctgcctcgtccgcggcgccgttcgagaagcccagggccgtggtcaagaagctcctcgcggagtcgcagcccgaggggcagggcgcaaccgtccgcaggagcatcggcaggcatgaactccggaacctggatcccttcctcatgctcgacgagttctcagtctccaagcccgccggattccccgaccacccacacagaggattcgagaccgtcacctacatgctcgagggcgccttcacccaccaggacttcgccggccacaagggcaccatcaaaacaggcgacgtccaatggatgacggcggggcgcggcatcgtgcactcggagatgccggcgggggacggcgtgcagaaggggctacagctctggatcaacctctccgccaaggacaagatgatcgagccgcggtaccaggagctggagagcaaggacatcagccgcggggagagagacggcgtggaggcgcgcgtcatcgccggggaggccctgggcgcggcgtcgcccgtgtacacgcggacgcccaccatgtacgtcgacttcaccatgcgccccgggtcacgcctccaccagccggtgcccgaagggtggaacgccttcgtctacgtcgtcgacggcgagggcgtgttcgggcgggacaaggccgcgcccaccgccgcgcaccactgcctcgtgcttggacccggcgacgggctcagcgtgtggaatcggtctgacaggccgctcaggttcgtgctcgtcgccgggaagccgcttggtgagcccgtggtgcagcatgggcccttcgtcatgaactcgcgcgccgagatccagcaggccatggaggactactactatggcaagaatggattcgagagggccagccagtggagctcctcctccgcctga

SEQ ID NO: 9646 - protein, 375 aa, Sorghum bicolor
  misc_feature: Ceres ANNOT ID no. 6100914
  misc_feature (109)..(205): Pfam Id: Pirin Pfam Desc: Pirin
  misc_feature (258)..(363): Pfam Id: Pirin_C Pfam Desc: Pirin C-terminal cupin domain
  misc_feature (84)..(372): NCBI GI: 6651245 NCBI Desc: pirin [lycopersicon esculentum]
  misc_feature (90)..(374): NCBI GI: 115479843 NCBI Desc: os09g0484800 [oryza sativa (japonica cultivar-group)]
  misc_feature (58)..(372): NCBI GI: 115476096 NCBI Desc: os08g0364900 [oryza sativa (japonica cultivar-group)]
  misc_feature (93)..(372): NCBI GI: 50540166 NCBI Desc: zgc:92778 [danio rerio]
  misc_feature (93)..(372): NCBI GI: 54696038 NCBI Desc: pirin [homo sapiens]
  misc_feature: Down-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Down-regulated in shoot tissues in response to salicylic acid treatment
MTPLVRKRIVGARVHLMVMDLGCRSRTRRLGNNTHRRRTSTTSTTLKQLLLAFLLILVFLIPSSVLLPPARPRIMSSSASDSASSAAPFEKPRAVVKKLLAESQPEGQGATVRRSIGRHELRNLDPFLMLDEFSVSKPAGFPDHPHRGFETVTYMLEGAFTHQDFAGHKGTIKTGDVQWMTAGRGIVHSEMPAGDGVQKGLQLWINLSAKDKMIEPRYQELESKDISRGERDGVEARVIAGEALGAASPVYTRTPTMYVDFTMRPGSRLHQPVPEGWNAFVYVVDGEGVFGRDKAAPTAAHHCLVLGPGDGLSVWNRSDRPLRFVLVAGKPLGEPVVQHGPFVMNSRAEIQQAMEDYYYGKNGFERASQWSSSSA

SEQ ID NO: 9647 - DNA, 933 bp, Sorghum bicolor
  misc_feature: Ceres ANNOT ID no. 6100917
  misc_feature: Encodes the peptide sequence at SEQ ID NO 9648
atggcggctgcagtcgcggcggtcgcggctgcgacgacggcggaagacgaggcgcgcctgctgcgcctggaggagcaggcggagcacggcggcggcggcgcctgggagtacctctgcctcgcccgccggctccgcgcccgccgccccgcccacgtcctccgcgtcggcctcgccctcctcaacaacgcctccgcgcgctccggcctcgccgcagaacagtggacgctctacgagcaggtggccatggcggccatggattgccagcgtctcgatgtggcaaaggactgtattggagtcctttcaaagcaatttcctggcagcacacgggttgcccggctagaagctcttctatttgaagcgaaaggtgaatggactgaagctgaaagagcctacgcgctaatcctggaaaacaatccatttgaccagattgtccacaagaggaaaattgctattgcaaaagcacaaggtgatatgtcgatagtggttgattatctcaataagtatctggaattatttatggcagatcatgatgcctggagagaacttgctgaaacatacgttttcttacaaatgtacaagcaagctgccttttgttatgaggagctaatattagcccaaccaactattccactctatcatatagcctatgctgaggtactgtacactatgggtggcttggaaaatcttcagacagctaagaagtactatgcatcaacaatccagttgactggaggcaagaatacaagagccctctttggtgtatgtctgtgtacgtcggcaatcaatcagttaaccaaaggaaggaataaagaggaagagggctcagagctgcagagattagctgcagaagtactgttgaagaattacaagcaacaggctccatcaaaggtgccgcttatcagcaccatgttgaagaacatgaaactcagctga

SEQ ID NO: 9648 - protein, 310 aa, Sorghum bicolor
  misc_feature: Ceres ANNOT ID no. 6100917
  misc_feature (99)..(309): NCBI GI: 10799830 NCBI Desc: o-linked glcnac transferase like [nicotiana tabacum]
  misc_feature (47)..(305): NCBI GI: 47938643 NCBI Desc: mgc81111 protein [xenopus laevis]
  misc_feature (42)..(296): NCBI GI: 14193698 NCBI Desc: kiaa0103 protein [mus musculus]
  misc_feature (47)..(310): NCBI GI: 37681847 NCBI Desc: kiaa0103-like protein [danio rerio]
  misc_feature (42)..(296): NCBI GI: 7661910 NCBI Desc: kiaa0103 [homo sapiens]
MAAAVAAVAAATTAEDEARLLRLEEQAEHGGGGAWEYLCLARRLRARRPAHVLRVGLALLNNASARSGLAAEQWTLYEQVAMAAMDCQRLDVAKDCIGVLSKQFPGSTRVARLEALLFEAKGEWTEAERAYALILENNPFDQIVHKRKIAIAKAQGDMSIVVDYLNKYLELFMADHDAWRELAETYVFLQMYKQAAFCYEELILAQPTIPLYHIAYAEVLYTMGGLENLQTAKKYYASTIQLTGGKNTRALFGVCLCTSAINQLTKGRNKEEEGSELQRLAAEVLLKNYKQQAPSKVPLISTMLKNMKLS

SEQ ID NO: 9649 - DNA, 2205 bp, Sorghum bicolor
  misc_feature: Ceres ANNOT ID no. 6100939
  misc_feature: Encodes the peptide sequence at SEQ ID NO 9650
atgggccaggagacggaggtggcggagaaggaggtgttgcagtcggtaagcgacctcccggtgcaggacccgccaggagaggagttctccgctgccgacctcacgtgggtcaagtacgcaagttccgagcaccaccgggacgacgttgctctcatcccctacgaccggatggaggccttcatcggcggcgagagcaacaaccccgagtgccccactcgattccacatcgagcgcggccgcaagcgtgagaggggcagcctcagggagtaccggagcgacgagtacctcctctacaggatgtacgtcttccctgccttgtattggtgctcgtttggccctgagaattatggggagggaggaacaatcttgcctagcagaaagtacaggctcaacacgaggaaccgtgccgcgcgcccgcagtccatgcgtggctgtacctgccattttaccgtcaagaggctctatgcccgcccttccttgttgctcatcatctaccacgagaggcgccatgtcaacaagtccggcttcatatgccacgggcccctcgacagggatgccatcgggcctggcgctaggaaaatgccctacattgggagtgaaatccagcagcagaccatgtcattgatctacctcggtgtcccagaagagaacatactgcagacacatatagaaggcatacagcgctactgtagtgcagatgcccaggttgataaccttgcttcgcagtatgtccagaaactagggatgatcatcaagagatcgacacatgagttggatctggatgaccaagctagcatcaggatgtgggttgacagaaataagaaatctgtattcttctaccaggattcaactgaggcagatgccttcatcctggggattcagacagaatggcaattgcagcaaatgatgcgctttggtcatcagagtcttttggcttctcattcctcatttggtgtaagcaagctaaagtatccattgcacacgcttcttgtatttgactcaaggcagcatgctcttcctgttgcatgggtcataacccgctcagttactaacaaggatacactgaaatggatgagggcacttactgatagaatacattctatagattccacctggagaattggtggttttatcattgatgacccggcttcagagctgggtccgatcagggaggtattcgcctgcccagttttgttctctgtgtggcatatcagaagaacctggcttaaaaatgtaatcaagaaatgcagcaatgttgaggtgcagcgggaaattttcatccaacttggcaaaatcatatacagtatctggagtgagaagaaccctatggatgccctagggaagttgtttcaagactttgttgatcaaacaacgttcataaaatatttcaaatcattttgggttcccaaattggagatgtggattgactccatcagaaatctgccattagcaagtcaggaatcatgcggtgccattgaaggttaccatctgaagctgaaggtaaaagcatacgatgatgtgcagctggatgctcttcaacgggtggactggttagtgcataagctcacaacagaactgcattcgagctactggatcaacttatttgcagatgaaagcggatcatttcctgaggtgaaagcagactatattgcatccacgtcatggcaaagggcattgcagatacctgatgctgctgttacctttgatgacaaagagcctcttttagccagagtggtcagccagaaggataccagtcagacgcggactgtatggaatcccggttctgaattctctctctgcgattgctcatggtcaatgcagggtaacctatgcaagcatgtgctaaaggtcaacatgatgtgtggagcacgcaaagattttcagccctcgctgtctttccagtcatatcagcacgtcctgcttgatctatggcaaaaaccattggatgattcgttctcgcttgacctctcggtagcatgggtcatgcagatgcaggagaagatcaaacatgtagctgagcttgccacctccggtggtattgtccaagttgcagggaaattgccgattcaatggacaaaaaagagagggagaagagtagccgccaaacgcccattacttcttcctcattctaacggcagtttgcagaaggagacgaccccaaagaagagcaagaagaggaagaggctatctaggtttctggggtaa

SEQ ID NO: 9650 - protein, 734 aa, Sorghum bicolor
  misc_feature: Ceres ANNOT ID no. 6100939
  misc_feature (11)..(728): NCBI GI: 19715655 NCBI Desc: at1g60560/f8a5_10 [arabidopsis thaliana]
  misc_feature (11)..(516): NCBI GI: 42571927 NCBI Desc: swim zinc finger family protein [arabidopsis thaliana]
  misc_feature (19)..(678): NCBI GI: 115471239 NCBI Desc: os07g0227700 [oryza sativa (japonica cultivar-group)]
  misc_feature (197)..(500): NCBI GI: 93003122 NCBI Desc: tpa: zinc finger protein [ciona intestinalis]
MGQETEVAEKEVLQSVSDLPVQDPPGEEFSAADLTWVKYASSEHHRDDVALIPYDRMEAFIGGESNNPECPTRFHIERGRKRERGSLREYRSDEYLLYRMYVFPALYWCSFGPENYGEGGTILPSRKYRLNTRNRAARPQSMRGCTCHFTVKRLYARPSLLLIIYHERRHVNKSGFICHGPLDRDAIGPGARKMPYIGSEIQQQTMSLIYLGVPEENILQTHIEGIQRYCSADAQVDNLASQYVQKLGMIIKRSTHELDLDDQASIRMWVDRNKKSVFFYQDSTEADAFILGIQTEWQLQQMMRFGHQSLLASHSSFGVSKLKYPLHTLLVFDSRQHALPVAWVITRSVTNKDTLKWMRALTDRIHSIDSTWRIGGFIIDDPASELGPIREVFACPVLFSVWHIRRTWLKNVIKKCSNVEVQREIFIQLGKIIYSIWSEKNPMDALGKLFQDFVDQTTFIKYFKSFWVPKLEMWIDSIRNLPLASQESCGAIEGYHLKLKVKAYDDVQLDALQRVDWLVHKLTTELHSSYWINLFADESGSFPEVKADYIASTSWQRALQIPDAAVTFDDKEPLLARVVSQKDTSQTRTVWNPGSEFSLCDCSWSMQGNLCKHVLKVNMMCGARKDFQPSLSFQSYQHVLLDLWQKPLDDSFSLDLSVAWVMQMQEKIKHVAELATSGGIVQVAGKLPIQWTKKRGRRVAAKRPLLLPHSNGSLQKETTPKKSKKRKRLSRFLG

SEQ ID NO: 9651 - DNA, 2247 bp, Sorghum bicolor
  misc_feature: Ceres ANNOT ID no. 6100943
  misc_feature: Encodes the peptide sequence at SEQ ID NO 9652
atggcggatctcgccgccgccgcggcggcccctccgccggccacggacctcttcggtgagccgatcgaggcgcaccctccctggttcaagcccgacgccttcctccgcgccggcttcgacccggacgcctacgtcgccgagctccgctcctacgtcccgctcgagagcctcgccgccgagctccgcgcccacctcgccgcgctccgcgccgagctcgtcggcctcatcaaccgcgactacgccgactttgtcggactcagcgcccgcctcaagggcgtcgacgccgccgccgcaaggatgcgcgccccgctcgccgacctcagggacaaggtcgccgccttccgcgccggggcatccgccgcgctcgccgcgctacgggcggggctcgagcagcgggccgccgcaaccgccgcgcgcgagctgctcgagctcctgctcgacacctcccacgtcgtctccaaggttgagaaattgatcaaggaactaccaactgcaccatcagattcatcgaatgccgaagttcctaacaatgacactggaatgccaaatggggaggctgggacaggtgtcagagaaacacaaagcattctcttagaaagaattgccagtgagatgaaccggcttaaattctacatcagtcatgcacagaacatcccttttattgagaacatagagaagagggtccaaggtgctacaaaactgcttgatggtagcttggagcgctgctttgtggatggtctggaacaccgtgatgctaaagttatatacaactgtttgcgtgcttatgctgcaattgacaatacatcatcagccgaagagcttttccgtacaacagtggtgtctccattgattcagaaaatagtccctcaaaattatgcgagggctgttgctggggcatcatctgatgaactggaagatgattatcaacagataaaagaatgtgttaaaaaagattgcaaattcatattggaaatatcttcatcagaaaactctggattgcatgtttttgattttctgggcaattcaatactcaaagaagtcctttctgcaatccagaaaggcaagcctggggccttttctcctggaaagcctaaagaattcttgaggaactacaaagcaagcttaggatttcttgattttcttgaaggttactgcctctccaagtctgctgtaacgaagttccgcgctgagcctgcttacacagatttcatgcgacaatggaatgttggtgtctacttttcgttgcgatttcaggaaattgcgggtggccttgattctactcttacaaacacctttagtcctactggatcgaatgaggctcaagggaagcaattgctcttgaagcaaagtattaagctcttagaaagtttggagtcatgttggagtgacgaggttcttttattctctcactgtgataagttcctccgtttgtccttgcagcttatttcaaggtatacaacatggctttcatctggtttatctgcacgtaaagcttctgatgggagcccaaattcacctgcagatgctgaatgggcactgtctacacctattgaagatttcatatatataatgcatgatgtgcatgctgtaattggtgagctttcagaatcaggcagctttattggacatgtgaatcagttactaggatcatgccccattgaagtacttaaccttgtcaaacaaagtatactgcaagctgtcgaacctttaaaggaggtgttgcctgcaataatgaatgtcatgattggaatcatagttaagaagtctaatgaggacctgaagcacctgaaaggaataacagcgacatataggatgacgaataagcttccagtgaggcattctccatatgtatcaggaattttacatccactgaaggtgtttcttgaaggggagcgtatacactatctatcagaagatgataaaactaggttgtgtcgagggtctacagataagattactgcaatttactatgacttggtctctgaagttgtcactgtggcaaggaaaaccgagtcttcattgcaaagactgcgccaaggtgcacaaaggcgagtaggggctagtacagatgcctcagataacatcatatctgatacagacaagatctgtatgcagctatttcttgatattcaggagtatgcacgaaaccttcgtgcgataggaatagatgcgagagaaattgattcctacagagctctatggcagtgtgttgccccaaaagacaaacaagagaacattcagttttga

SEQ ID NO: 9652 - protein, 748 aa, Sorghum bicolor
  misc_feature: Ceres ANNOT ID no. 6100943
  misc_feature (1)..(748): Pfam Id: COG2 Pfam Desc: COG (conserved oligomeric Golgi) complex component, COG2
  misc_feature (1)..(746): NCBI GI: 20147143 NCBI Desc: at4g24840/f6i7_50 [arabidopsis thaliana]
  misc_feature (1)..(711): NCBI GI: 4678263 NCBI Desc: brefeldin a-sensitive golgi protein-like [arabidopsis thaliana]
  misc_feature (29)..(742): NCBI GI: 17921980 NCBI Desc: component of oligomeric golgi complex 2 [mus musculus]
  misc_feature (29)..(737): NCBI GI: 122889832 NCBI Desc: novel protein similar to human and mouse component of oligomeric golgi complex 2 (cog2) [danio rerio]
  misc_feature (29)..(737): NCBI GI: 47087011 NCBI Desc: component of oligomeric golgi complex 2 [danio rerio]
MADLAAAAAAPPPATDLFGEPIEAHPPWFKPDAFLRAGFDPDAYVAELRSYVPLESLAAELRAHLAALRAELVGLINRDYADFVGLSARLKGVDAAAARMRAPLADLRDKVAAFRAGASAALAALRAGLEQRAAATAARELLELLLDTSHVVSKVEKLIKELPTAPSDSSNAEVPNNDTGMPNGEAGTGVRETQSILLERIASEMNRLKFYISHAQNIPFIENIEKRVQGATKLLDGSLERCFVDGLEHRDAKVIYNCLRAYAAIDNTSSAEELFRTTVVSPLIQKIVPQNYARAVAGASSDELEDDYQQIKECVKKDCKFILEISSSENSGLHVFDFLGNSILKEVLSAIQKGKPGAFSPGKPKEFLRNYKASLGFLDFLEGYCLSKSAVTKFRAEPAYTDFMRQWNVGVYFSLRFQEIAGGLDSTLTNTFSPTGSNEAQGKQLLLKQSIKLLESLESCWSDEVLLFSHCDKFLRLSLQLISRYTTWLSSGLSARKASDGSPNSPADAEWALSTPIEDFIYIMHDVHAVIGELSESGSFIGHVNQLLGSCPIEVLNLVKQSILQAVEPLKEVLPAIMNVMIGIIVKKSNEDLKHLKGITATYRMTNKLPVRHSPYVSGILHPLKVFLEGERIHYLSEDDKTRLCRGSTDKITAIYYDLVSEVVTVARKTESSLQRLRQGAQRRVGASTDASDNIISDTDKICMQLFLDIQEYARNLRAIGIDAREIDSYRALWQCVAPKDKQENIQF

SEQ ID NO: 9653 - DNA, 648 bp, Sorghum bicolor
  misc_feature: Ceres ANNOT ID no. 6100950
  misc_feature: Encodes the peptide sequence at SEQ ID NO 9654
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
atggctccgatgaagctgtacggtgcgacggtgtcgtggaacgtgacccggtgcgtggtggcgctggaggaggccggcgccgagtaccagatcgtacctatcgatttcgccaccgccgagcacaagagccccgaacacctcgcccgcaacccgttcggtcaagttccagctttccaagatggcgatctccacctatgggaatcgcgtgcgatttgcaagtacgttgcccgcaagaacaaggcagcagagctgctgagggaaggcaacctccaggagtcagccatggtggacgtgtggctggaggtggagtccaaccagtacaccgccgccctgaaccctatcctgtacgagtgcctcgtcagccctatgttcggcggcaccaccgaccagaaagtggtggaggagaacctggagaagctgaagaaggtgctggaggtgtacgaggcgcggctcgccaagcacaagtacctcgccggagacttcctcagcctcgccgacctcaaccacgtctccgtcacgctttgcctgctcgcgacgccccatgcttctgtgctcaacgcgtaccctcacgtcaaggcatggtgggatggcctcatggccaggccgtctgtccagaaggtcgccgcgctcatgaagccgtctgcttga

SEQ ID NO: 9654 - protein, 215 aa, Sorghum bicolor
  misc_feature: Ceres ANNOT ID no. 6100950
  misc_feature (2)..(77): Pfam Id: GST_N Pfam Desc: Glutathione S-transferase, N-terminal domain
  misc_feature (107)..(202): Pfam Id: GST_C Pfam Desc: Glutathione S-transferase, C-terminal domain
  misc_feature (1)..(215): NCBI GI: 554565 NCBI Desc: glutathione s-transferase
  misc_feature (1)..(215): NCBI GI: 168491 NCBI Desc: glutathione s-transferase i
  misc_feature (1)..(215): NCBI GI: 56412207 NCBI Desc: glutathione s-transferase [pennisetum glaucum]
  misc_feature (2)..(215): NCBI GI: 3891708 NCBI Desc: chain d, glutathione s-transferase i from mais in complex with atrazine glutathione conjugate
  misc_feature (2)..(211): NCBI GI: 3891608 NCBI Desc: chain b, structure of glutathione s-transferase-i bound with the ligand lactoylglutathione
  misc_feature (1)..(215): SWISSPROT Homolog: EC 2.5.1.18 Glutathione S-transferase I
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
MAPMKLYGATVSWNVTRCVVALEEAGAEYQIVPIDFATAEHKSPEHLARNPFGQVPAFQDGDLHLWESRAICKYVARKNKAAELLREGNLQESAMVDVWLEVESNQYTAALNPILYECLVSPMFGGTTDQKVVEENLEKLKKVLEVYEARLAKHKYLAGDFLSLADLNHVSVTLCLLATPHASVLNAYPHVKAWWDGLMARPSVQKVAALMKPSA

SEQ ID NO: 9655 - DNA, 1701 bp, Sorghum bicolor
  misc_feature: Ceres ANNOT ID no. 6100973
  misc_feature: Encodes the peptide sequence at SEQ ID NO 9656
atggcggaggcgctgcggttcccgggggtagtcgcgggggagtctctggacgcgcccatcgccgcctccaagctcggaagggagcggcactcggtctccgcgagcgcgaggccgggagcgcaatgctggaggcggaggaagggtctggcggtgagctgccagacgggcgccgccccggctgttctcaggacggaggagaccacggccgcggcggcggcggggagcaatgctcaggcggagttcaccgttgtcatgaagttcggcggctcttcgctcgcgtcggccgagcggatgcgggaggtggccgatctcatccttagcttccccgacgagacccccgtcgtcgtcctctccgccatggggaagaccaccaataacctcctcctggccggagagaaggcggtgagctgcggcgcccccaaggcgtccgaaatccctgagctcgccgtcatcaaggacctgcatcttaggacggttgatgagctcgggttagataggtcgattgtttcaggtttattggatgaattggagcaacttcttaaaggagttgctatgatgaaagagctgactcttaggacaagagattatcttgtttcctttggtgaatgtatgtctacaagaatatttgctgcatatttgaataaacttgggaaaaaggcacgccagtatgatgcatttgatattggctttataaccactgatgatttcacaaatgcggatattcttgaagtcacttatcctactgttgcaaagaggctacatagagactggatggataaccctgctattcctatagtcactggttttcttgggaagggatgtaaatcatgtgctgtcaccactttaggcaggggtggtagtgacttgacagctacaaccattggcaaagccttgggattaagagaaatccaggtttggaaggatgtagatggtgtgttgacgtgtgatcctaatatttatgcaaatgctatacccgtgccctacttgacttttgatgaagctgctgagcttgcctactttggggcacaggttttgcatccccaatcaatgcgaccggctagggatggtgatataccagtgagagttaagaactcatacaatcgtcatgcacctggtactgtcatcactaaatccagagatatgagcaagagcatattgaccagcattgtgttgaaatcaaatgttaccatgctggatatagtgagcacacggatgcttggccagtacggatttttagcaaaggtcttctcaatatttgaagatttgggcatctctgttgatgttgtggctactagtgaagtcagcatctcgttgactctagatccatcaaaactatggagccgtgaactgatccagcaggaacttgatcatgttgttgaagagcttgaaaaattttctgttgttcatctgctccagcgtagatcaatcatctcactgatagggaatgtacagagatcatcattggttcttgaaaaggcattcaatgttctacgtagaaatggtgttaatgtccagatgatctcacaaggggcgtccaaggtgaacatttccttggtagtcaatgacagtgaggcaaaacagtgtgtacaagccctccattcggcattctttgagaatggcttcttgtcagaagtagagggagctgatgttccccagaacggctcctctctgaactcaaatggcgctatctatgcaaactag

SEQ ID NO: 9656 - protein, 566 aa, Sorghum bicolor
  misc_feature: Ceres ANNOT ID no. 6100973
  misc_feature (81)..(364): Pfam Id: AA_kinase Pfam Desc: Amino acid kinase family
  misc_feature (15)..(566): NCBI GI: 126257055 NCBI Desc: monofunctional aspartate kinase 1 [zea mays]
  misc_feature (39)..(566): NCBI GI: 115456611 NCBI Desc: os03g0850400 [oryza sativa (japonica cultivar-group)]
  misc_feature (43)..(555): NCBI GI: 5305740 NCBI Desc: precursor monofunctional aspartokinase [glycine max]
  misc_feature (60)..(545): NCBI GI: 23308185 NCBI Desc: at5g13280/t31b5_100 [arabidopsis thaliana]
  misc_feature (60)..(545): NCBI GI: 109157293 NCBI Desc: chain b, crystal structure of arabidopsis thaliana aspartate kinase complexed with lysine and s-adenosylmethionine
  misc_feature (60)..(545): SWISSPROT Homolog: EC 2.7.2.4 Aspartokinase 1, chloroplast precursor
  misc_feature: Useful for making plants with altered alkaloid content
  misc_feature: Useful for making plants with modulated nitrogen use efficiency
  misc_feature: GREAT-hit functional homolog of the protein sequence given in SEQ ID NO 13262
  misc_feature: Useful for making plants with altered alkaloid content
  misc_feature: Useful for making plants with modulated nitrogen use efficiency
  misc_feature: Functional homolog of the protein sequence given in SEQ ID NO 13262
MAEALRFPGVVAGESLDAPIAASKLGRERHSVSASARPGAQCWRRRKGLAVSCQTGAAPAVLRTEETTAAAAAGSNAQAEFTVVMKFGGSSLASAERMREVADLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEVTYPTVAKRLHRDWMDNPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDVVATSEVSISLTLDPSKLWSRELIQQELDHVVEELEKFSVVHLLQRRSIISLIGNVQRSSLVLEKAFNVLRRNGVNVQMISQGASKVNISLVVNDSEAKQCVQALHSAFFENGFLSEVEGADVPQNGSSLNSNGAIYAN

SEQ ID NO: 9657 - DNA, 477 bp, Sorghum bicolor
  misc_feature: Ceres ANNOT ID no. 6100978
  misc_feature: Encodes the peptide sequence at SEQ ID NO 9658
atgaacaaggagaggctcatgaagatggccggcgccgtccgcaccggcgggaagggaaccgtgcgcaggaagaagaaggctgtccacaagacgggcacgaccgacgacaagaggctgcagagcacgctcaagagagtaggggtcaacaccatccctgcaatcgaggaggtgaacatcttcaaggacgatctcgtcatccagttcttgaatcccaaagtgcaagcttctatcgcggcaaacacatgggtggtcagtggatctccacagacgaaaaagctacaagatgttctgcctgggatcatcaaccaacttggcccggacaacatggaacatctgaagaggattgctgaggagatgcagaagcaggtggctgctgccggtgctgcggcgcaggtcaaggaagaaaacgatgatgatgttccagagcttgttcctggagagacttttgaagaagtagctcaggaggcaaaagcctga

SEQ ID NO: 9658 - protein, 158 aa, Sorghum bicolor
  misc_feature: Ceres ANNOT ID no. 6100978
  misc_feature (34)..(92): Pfam Id: NAC Pfam Desc: NAC domain
  misc_feature (1)..(158): NCBI GI: 49616929 NCBI Desc: btf3b-like transcription factor [musa acuminata]
  misc_feature (1)..(155): NCBI GI: 33945882 NCBI Desc: transcription factor homolog btf3-like protein [lotus corniculatus var. japonicus]
  misc_feature (9)..(157): NCBI GI: 92886523 NCBI Desc: nascent polypeptide-associated complex nac [medicago truncatula]
  misc_feature (1)..(155): NCBI GI: 16323127 NCBI Desc: at1g17880/f2h15_10 [arabidopsis thaliana]
  misc_feature (1)..(155): NCBI GI: 90823167 NCBI Desc: btf3 [nicotiana benthamiana]
  misc_feature: The plant is abnormally large.
  misc_feature: The sequence is a functional homolog of SEQ ID NO 1614 in the 11/479,226US patent application
  misc_feature: The sequence is a functional homolog of SEQ ID NO 1617 in the 11/479,226US patent application
  misc_feature: The sequence is a functional homolog of SEQ ID NO 784 in the 10/412,699US patent application
  misc_feature: The sequence is a functional homolog of SEQ ID NO 786 in the 10/412,699US patent application
  misc_feature: Useful for making plants with modulated biomass
  misc_feature: Useful for making plants with modulated growth and phenotype characteristics
  misc_feature: Functional homolog of the protein sequence given in SEQ ID NO 13061
  misc_feature: The sequence is a functional homolog of SEQ ID NO 784 in the 20040045049 US patent application
  misc_feature: The sequence is a functional homolog of SEQ ID NO 786 in the 20040045049 US patent application
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: Useful for making plants with modulated biomass
  misc_feature: Functional homolog of the protein sequence given in SEQ ID NO 13061
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
MNKERLMKMAGAVRTGGKGTVRRKKKAVHKTGTTDDKRLQSTLKRVGVNTIPAIEEVNIFKDDLVIQFLNPKVQASIAANTWVVSGSPQTKKLQDVLPGIINQLGPDNMEHLKRIAEEMQKQVAAAGAAAQVKEENDDDVPELVPGETFEEVAQEAKA

SEQ ID NO: 9659 - DNA, 1362 bp, Sorghum bicolor
  misc_feature: Ceres ANNOT ID no. 6100985
  misc_feature: Encodes the peptide sequence at SEQ ID NO 9660
  misc_feature: Down-regulated in shoot tissues in response to salicylic acid treatment
atggcttccgccgcggtgctccggaacgccggctcccgccggctcttctcctacccagccctgcgggcgaccgcgatctcgggtcccgccgcgctacccgatgcgcccgcggcggcggcggcggcgccggcccagccgccgcctatggccgggaccctctgggcgaggtccatggccacctttacgcgcacgaagcctcacgtgaacgtcggcaccattgggcacgtcgatcacggcaaaaccacgctcactgctgccattaccaaggttcttgccgaggcagggaaagccaaagccgttgctttcgacgagatcgacaaggctccggaagagaaagccagaggaatcaccattgcaacggctcatgtcgagtatgagacggctaaaaggcattatgctcatgttgattgcccaggtcacgcagattatgtcaagaacatgatcactggagctgctcaaatggacggtggtattcttgttgtgtcagctcctgatggcccgatgccacaaacaaaggagcatattcttcttgcccgtcaggttggtgtaccttcgcttgtgtgcttcttgaacaaagttgatgctgttgatgacccagagctactggaacttgtagagatggagcttcgggagctcctcactttctacaagttccccggtgatgagattccgatcattcgtggatcggccttgtctgctttgcaagggaacaatgatgagattggaaagaatgccattttgaaactaatggatgcagttgatgagtacatccctgatcctgtgaggcagcttgataagcctttcttgatgccaattgaagatgtgttctctatccagggtcgtggaactgttgttactgggcgtgttgaacagggaacaattaaaactggtgaagatgttgagatcttgggtttgacacagagtggtcccttgaagactacagttactggtgttgagatgttcaaaaagatactggaccatggagaggctggtgacaacgttggtcttcttcttcgtggtcttaagcgtggtgatgttgagcgtggccaggtggtgtgtaaacctggtagtctgaagacatacaaaaagtttgaggcagaaatatacgtcctgacaaaggatgagggtggccgccacactcactttatgacaaactacagtccccaattctacttcaggactgctgatgtcactggaaaggttgagttgcttggtgaaacgaagatggttttgcccggtgacaatgttactgcgaattttgagttgatatcacctgttcctcttgaacctgggcaaagatttgcactgagggaaggagggagaacagttggtgcaggagttgtctccaaagttattagctaa

SEQ ID NO: 9660 - protein, 453 aa, Sorghum bicolor
  misc_feature: Ceres ANNOT ID no. 6100985
  misc_feature (65)..(259): Pfam Id: GTP_EFTU Pfam Desc: Elongation factor Tu GTP binding domain
  misc_feature (358)..(452): Pfam Id: GTP_EFTU_D3 Pfam Desc: Elongation factor Tu C-terminal domain
  misc_feature (282)..(353): Pfam Id: GTP_EFTU_D2 Pfam Desc: Elongation factor Tu domain 2
  misc_feature (1)..(453): NCBI GI: 11181616 NCBI Desc: translational elongation factor ef-tum [zea mays]
  misc_feature (1)..(453): NCBI GI: 21685576 NCBI Desc: elongation factor tu [oryza sativa]
  misc_feature (52)..(453): NCBI GI: 1149571 NCBI Desc: mitochondrial elongation factor tu [arabidopsis thaliana]
  misc_feature (62)..(452): NCBI GI: 145347309 NCBI Desc: translation elongation factor, mitochondrial [ostreococcus lucimarinus cce9901]
  misc_feature (59)..(451): NCBI GI: 114327216 NCBI Desc: protein translation elongation factor tu (ef-tu) [granulobacter bethesdensis cgdnih1]
  misc_feature: Useful for making plants with modulated oxidative stress sensitivity
  misc_feature: GREAT-hit functional homolog of the protein sequence given in SEQ ID NO 13085
  misc_feature: Useful for making plants with modulated oxidative stress sensitivity
  misc_feature: Functional homolog of the protein sequence given in SEQ ID NO 13085
  misc_feature: Down-regulated in shoot tissues in response to salicylic acid treatment
MASAAVLRNAGSRRLFSYPALRATAISGPAALPDAPAAAAAAPAQPPPMAGTLWARSMATFTRTKPHVNVGTIGHVDHGKTTLTAAITKVLAEAGKAKAVAFDEIDKAPEEKARGITIATAHVEYETAKRHYAHVDCPGHADYVKNMITGAAQMDGGILVVSAPDGPMPQTKEHILLARQVGVPSLVCFLNKVDAVDDPELLELVEMELRELLTFYKFPGDEIPIIRGSALSALQGNNDEIGKNAILKLMDAVDEYIPDPVRQLDKPFLMPIEDVFSIQGRGTVVTGRVEQGTIKTGEDVEILGLTQSGPLKTTVTGVEMFKKILDHGEAGDNVGLLLRGLKRGDVERGQVVCKPGSLKTYKKFEAEIYVLTKDEGGRHTHFMTNYSPQFYFRTADVTGKVELLGETKMVLPGDNVTANFELISPVPLEPGQRFALREGGRTVGAGVVSKVIS

SEQ ID NO: 9661 - DNA, 762 bp, Sorghum bicolor
  misc_feature: Ceres ANNOT ID no. 6100987
  misc_feature: Encodes the peptide sequence at SEQ ID NO 9662
atggccgctgcgagaatggcgttcgcctcttgcgcccgcctcctcccgtcctcatcctctccgctcaccctcgcaaggccccgcgccggcgccgtctcgttcctggctgcccgaccgtcgccgagatccggcaggaatcttgctctcttctgctcttcatcaccgacgtcgctaccgctaacggatgcggtggaggagacgaagcccccggtgccgagcggggacgacaaggcggaaccgaccgtggaggacctagtgggcttgctggacgtccgggtgggccgggtgttgaaggcgtggaggcacccggaggcggacacgctctatgttgaggaggtggacgtaggcgaggcggagccccggaccatctgcagcggcctcgtcaacttcatccccatccaagacctccaggacagcaacgtgattgttcttgctaacctcaaaccaaggaacatgcgtggcatcaagtcaaatggcatgctcatggctgcctctgatgcttcccatgagaatgtggagctgctcatccctccagaaggttccttgcctggtgaaagagtatggtttggttcagaagaagaaaagcatcgtcaatctgaccctgcatcaccaaatcaggtccaaaagaagaagatctgggaagctgttcagcctcatcttagaacaacagataactgcattgtggttcttggtgataaacaaatgcgtacctctgcaggcccaattttctgcaaatcgcttcagggtgcaagagtgtcataa

SEQ ID NO: 9662 - protein, 253 aa, Sorghum bicolor
  misc_feature: Ceres ANNOT ID no. 6100987
  misc_feature (91)..(186): Pfam Id: tRNA_bind Pfam Desc: Putative tRNA binding domain
  misc_feature (2)..(253): NCBI GI: 115457626 NCBI Desc: os04g0303900 [oryza sativa (japonica cultivar-group)]
  misc_feature (68)..(253): NCBI GI: 123249051 NCBI Desc: tyrosyl-trna synthetase [mus musculus]
  misc_feature (68)..(253): NCBI GI: 27806349 NCBI Desc: tyrosyl-trna synthetase [bos taurus]
  misc_feature (70)..(253): NCBI GI: 62898948 NCBI Desc: tyrosyl-trna synthetase variant [homo sapiens]
  misc_feature (70)..(253): NCBI GI: 119627911 NCBI Desc: tyrosyl-trna synthetase, isoform cra_a [homo sapiens]
MAAARMAFASCARLLPSSSSPLTLARPRAGAVSFLAARPSPRSGRNLALFCSSSPTSLPLTDAVEETKPPVPSGDDKAEPTVEDLVGLLDVRVGRVLKAWRHPEADTLYVEEVDVGEAEPRTICSGLVNFIPIQDLQDSNVIVLANLKPRNMRGIKSNGMLMAASDASHENVELLIPPEGSLPGERVWFGSEEEKHRQSDPASPNQVQKKKIWEAVQPHLRTTDNCIVVLGDKQMRTSAGPIFCKSLQGARVS

SEQ ID NO: 9663 - DNA, 1854 bp, Sorghum bicolor
  misc_feature: Ceres ANNOT ID no. 6101002
  misc_feature: Encodes the peptide sequence at SEQ ID NO 9664
atgatactccgccgcctgcatgtacgcgtctcccgcctatccctcgcgtccgccgccctcctcgatgtggcgccgcgcgccttgccctccgcgggcctcttccgtgcccgtggcctccacggcgcggcgggggacgacggcgcctcctcggagcacggacgcaaacccgcaggtcctcttacgctctacaggaatctagtaagccaagggaagctcacgcatgatagttaccaggaaaatgtagcttctgaattagacaacttacttagtaggcttcaacagtacgagatggaaatggaggattatcataacaagctgtacatctgggagaatagcagggagaaagagcggcggaagcttcttgtccaagaagctgaagataagcagcgtgatggtgtatggatagatgagaaaagaggatttcttgacaagttggttacacggagaagaagaggaaacatagaacctggagttggtaagtgggtctcgtacctgaaccgagagaagaaactagatacattggtaggccatagaccagtcgctcctgttgctcctaaaggattgtatctctatggaaatgttggaagtggcaagacaatgttgatggacatgttctatggggccactgaaggtgtcatcaaacacaggagaaggtttcactttcatgaggccatgcttgaaatacacgatcatatgcatgatgtatggaagagacgtgatgatgacaaatctattcactcaagtgccttcaattggatatcaagccttccatttgatgtgaaaattaaggagtggttgattggcgaagagaagtacaaacaacagacgcaggaaaagcacatccttttggcagttgctgacaagtttttggttgatagacaggcaaataaaactggagcaagcattctatgctttgatgagatacagactatcgatgtttttgcagttgtagcactttctggcattctaagcaggttgttaagcacagggacagtacttgtagcaaccagtaataaagcaccagaagatctgaatcaggatggaatgcaaagggacatcttccttgagttattatcaaaattggatgaaaactgcaataagattcttgtgggtactgaaaaggattatcgtcgcctaattccgacagaaggctcaactgaggttcactatttttggcctgctacttctgacgctcgcagcatgtatgaggctatgtggtatgacataactaacaaatcaggaggaaatattatttctgtcaccattcctgtaatgtttgggaggtctattgagattcctcaaagctgtaatggcgtcgcaaggtttgacttcgaatatctatgcggtcgcccagtcggagctgcagattatatagcaatagctaggagctaccatacaattttcatatcagacattccagctatgagtatgaagatccgtgacaaggcaagaaggtttatcactcttatcgatgagttgtacaaccatcactgccgccttatatgcctagctgcctcatccattgatgatcttttccaaggaactgaggaaggacctctttttgatttagagagttttcagttcgaaaccgagtccgaagggacaaagctgaggagggatgttttagcaggaggcaatgttggcttaggaccgtctacgaccggacttgtggcaatattgtctggtcaagaagagatgtttgcattccgcagggcgatatctcggcttatcgaaatgcagacaccgctgtatctggagcgtgtgcaggatgtgcatccctcattccggctgcagtgtcctcctggtcttgcaagcaataggactgcagttcctcagcctgctccggcggtttga

SEQ ID NO: 9664 - protein, 617 aa, Sorghum bicolor
  misc_feature: Ceres ANNOT ID no. 6101002
  misc_feature (145)..(545): Pfam Id: AFG1_ATPase Pfam Desc: AFG1-like ATPase
  misc_feature (58)..(472): NCBI GI: 140057118 NCBI Desc: afg1-like atpase [medicago truncatula]
  misc_feature (58)..(451): NCBI GI: 140063025 NCBI Desc: protein afg1, related [medicago truncatula]
  misc_feature (301)..(512): NCBI GI: 59808703 NCBI Desc: lactation elevated 1 [mus musculus]
  misc_feature (301)..(512): NCBI GI: 21668096 NCBI Desc: lactation elevated 1 [mus musculus]
  misc_feature (300)..(584): NCBI GI: 119568761 NCBI Desc: lactation elevated 1, isoform cra_b [homo sapiens]
MILRRLHVRVSRLSLASAALLDVAPRALPSAGLFRARGLHGAAGDDGASSEHGRKPAGPLTLYRNLVSQGKLTHDSYQENVASELDNLLSRLQQYEMEMEDYHNKLYIWENSREKERRKLLVQEAEDKQRDGVWIDEKRGFLDKLVTRRRRGNIEPGVGKWVSYLNREKKLDTLVGHRPVAPVAPKGLYLYGNVGSGKTMLMDMFYGATEGVIKHRRRFHFHEAMLEIHDHMHDVWKRRDDDKSIHSSAFNWISSLPFDVKIKEWLIGEEKYKQQTQEKHILLAVADKFLVDRQANKTGASILCFDEIQTIDVFAVVALSGILSRLLSTGTVLVATSNKAPEDLNQDGMQRDIFLELLSKLDENCNKILVGTEKDYRRLIPTEGSTEVHYFWPATSDARSMYEAMWYDITNKSGGNIISVTIPVMFGRSIEIPQSCNGVARFDFEYLCGRPVGAADYIAIARSYHTIFISDIPAMSMKIRDKARRFITLIDELYNHHCRLICLAASSIDDLFQGTEEGPLFDLESFQFETESEGTKLRRDVLAGGNVGLGPSTTGLVAILSGQEEMFAFRRAISRLIEMQTPLYLERVQDVHPSFRLQCPPGLASNRTAVPQPAPAV

SEQ ID NO: 9665 - DNA, 1152 bp, Sorghum bicolor
  misc_feature: Ceres ANNOT ID no. 6101188
  misc_feature: Encodes the peptide sequence at SEQ ID NO 9666
atggggcggaaaaggaacgagtccggctatctgacggcggctctagaggagcgagaagaggccgaggaacagactgaggaaggcgacgaggaagagggggaggaacagacggaggaggggtcttgtggggaggatcaggccgaggctgaggcggagacgctggcacaggaagccgtggagccgccgaagctggccgagggcttctacgagattgaggccatccgccgccgccgtctccgcaggggccagcttcagtacctcgtcaagtggcgtgggtggccggagagtgcgaacacatgggaaccccttgaaaacctgaaggcctgttctgacattgttgatgctttcaataagcggtcaaggtcgcccaggtcctctcgaaagcgaaagcgtaagactgcaacaactccaacatccgatcctaacccttctcgtggcaaacgtggtcgaccacctcggtcggaggcccggagcatgcaagggatacatgcctcagaagtgaagaaactgccctgcagaacaagtagtaggagagcaaataatcatagtaataagacctcacctgggggccttgatgcatcagtgaacttgcttgggcaaagagtagtaaaggagggtagttctggtgtggtctcagttgggtttctgtctcaaggggctccattatctgttagcttaactgaccaacaagatgtgcagcaccctgctaatggttcattgaaggtggacaattcaacacgagcaaccccacctcagggtggacaggtaacaggtgccaagaagcgcaagtctggatgtgtcagaaggttcaagcaggatgaagtaacacaggagcaaggagatatccgtgatcgcacaggtgacaagccaggcaatgagactgttgattccacagaaggagaaactggtgataagaacaagggggaggactctggtaaccaaattcatatgcctaagatcattaagatcattaagccagttcgttactttgccacagttatggatggtgtacagcaagttgcaataacattcaaggcactcaggtctgacggagaggaggtattcgtggatgacaagcagttgaaagctaaggagcccctggtgcttattaattactatgagcaacatcttcgctataaccccacctcgtga

SEQ ID NO: 9666 - protein, 383 aa, Sorghum bicolor
  misc_feature: Ceres ANNOT ID no. 6101188
  misc_feature (69)..(119): Pfam Id: Chromo Pfam Desc: 'chromo' (CHRromatin Organisation MOdifier) domain
  misc_feature (1)..(383): NCBI GI: 22135459 NCBI Desc: chromdomain-containing protein crd101 [zea mays]
  misc_feature (16)..(383): NCBI GI: 110810411 NCBI Desc: probable protein like heterochromatin protein1 (lhp1)
  misc_feature (16)..(370): NCBI GI: 115481516 NCBI Desc: os10g0324900 [oryza sativa (japonica cultivar-group)]
  misc_feature (4)..(382): NCBI GI: 66854107 NCBI Desc: heterochromatin protein 1-like protein [lycopersicon esculentum]
  misc_feature (3)..(380): NCBI GI: 3107903 NCBI Desc: polycomb-like protein [daucus carota]
MGRKRNESGYLTAALEEREEAEEQTEEGDEEEGEEQTEEGSCGEDQAEAEAETLAQEAVEPPKLAEGFYEIEAIRRRRLRRGQLQYLVKWRGWPESANTWEPLENLKACSDIVDAFNKRSRSPRSSRKRKRKTATTPTSDPNPSRGKRGRPPRSEARSMQGIHASEVKKLPCRTSSRRANNHSNKTSPGGLDASVNLLGQRVVKEGSSGVVSVGFLSQGAPLSVSLTDQQDVQHPANGSLKVDNSTRATPPQGGQVTGAKKRKSGCVRRFKQDEVTQEQGDIRDRTGDKPGNETVDSTEGETGDKNKGEDSGNQIHMPKIIKIIKPVRYFATVMDGVQQVAITFKALRSDGEEVFVDDKQLKAKEPLVLINYYEQHLRYNPTS

SEQ ID NO: 9667 - DNA, 3447 bp, Sorghum bicolor
  misc_feature: Ceres ANNOT ID no. 6102246
  misc_feature: Encodes the peptide sequence at SEQ ID NO 9668
atgtcaaacccgccgcaaaagaaggcgatccgtaatcccggcgccggcgccggcgggccggcgggcggctcgcggggaccggcggggaacacggtgaagttcgcgcggcggacggcgagcgggcggtacgtgagcctgtccagggaggacatcgacatggagggtgagctgggggcggactacaccaactacacggtgcagatcccgccgacgcccgacaaccagccgatgatggaccaggcgtccgtggccatgaaggccgaggagcagtacgtctccaattcgctcttcaccggcgggttcaacagcgtcacgcgcgcccacctcatggacaaggtcatcgagtccgaggtgacacacccgcagatggccggctccaggggctcccgctgcgccatgcccgcctgcgacggcaaggtcatgcgcaacgagcgtggcgaggacatcgacccctgcgagtgcaggttcaagatttgccgcgactgctacctggacgcgcagaaggacggctgcatctgccccgggtgcaaggagcactacaagatcggcgagtacgccgaggacgaccccaacgacgcgtcgtcgggcaagcactacctcccggggccgggcggcggcatgatgaacaacagcaagtctctgctggcacggaaccagaacggcgagttcgaccacaaccggtggctcttcgagagctcgggcacctacggctacggcaacgcctactggcccaagggcggcatgtacgacgacgacctggacgacgaaggcggccccggcggcggcgccggcgacggcatgctccccgagcagaagccgttcaagccgctgacccgcaagatacccatgccgacgtccatcatcagcccctaccggatctttatcgtcatccgaatgttcgtgctcctcttctacctcacgtggcgcgtccgcaaccccaacatggaggcgctctggctctggggcatgtccatcgtgtgcgagctctggttcgccttctcctggctgctggacatgctccccaaggtgaaccccgtgaaccggagcacggacctcgcagtgctcaaggagaagttcgagacgccgtcgccgtccaacccgcacggccgctccgacctgccggggctggacgtgttcgtgtccacggccgacccggagaaggagcccgtgctcaccacggccaccaccatcctgtccatcctggcagccgactacccagtggagaagctggcgtgctacgtgtccgacgacggcggcgcgctgctcaccttcgaggccatggccgaggcggccagcttcgccaacatctgggtgcccttctgcaagaagcacgacatcgagccccggcagccggacagctacttcagtatcaagggcgacccgaccaagggcaagcggcggtcggacttcgtcaaggaccggcgcaaggtgaagcgggagttcgacgagttcaaggtgcgcatcaacggcctgccggactccatccgccggcgctccgacgccttcaacgcccgcgaggacatgaagatgctcaagcacctccgggagagcggcgccgacccggcggagcaacccaaggtgaagaaggcgacgtggatggcggacggcacgcactggccggggacctgggccgtgtcagcgccggaccacgcaaagggaaaccacgccggcatcctacaggtgatgctgaagcctccttcccccgaccctctgtacgggatgcacgacgaggagcagctgatcgacttcagcgacgtggacatccgtctcccgatgctggtgtacatgtcccgcgagaagcgtcccgggtacgaccacaacaagaaggccggcgccatgaacgccctggtgcgctgctccgccgtgatgtccaacgggcccttcatcctcaacttcgactgcgaccactacatcaacaacgcgcaggcgatccgcgaggccatgtgcttcgtgatggaccgcggcggcgagcgcatcgcctacatccagttcccacagcgcttcgagggcatcgacccctctgaccgctacgccaacaacaacaccgtcttcttcgacggcaacatgcgcgcgctggacggcctgcagggccccatgtacgtcggcacgggctgcatgttccgccgcttcgccctctacggcttcgacccgccgcgcaccaccgagtacaccggcttgctcttcaagaagaagaaggtgacgctgagcacggcgggcgagacgacggacacgcagtcgctcaaccaccacaagcagcagggtggggcggcagacttcgacgccgagctcacgtcgatgcttgtgcccaggcggttcggcaactcgtcggcgctgatggcgtccatccccgtggccgaattccaggcccggccgctggcggaccacacggccgtgctgcacgggcggccccccgggtcgctgacggtgccgcgtcccccgctggacccgccgaccgtggcggaggccgtgtccgtcatctcctgctggtacgaggacaagacggagtggggggaccgcgtgggctggatctacggctccgtgacggaggacgtggtgagcggctaccgcatgcacaaccgcgggtggcgctccgtctactgcatccccaagcgcgacgcgttcctgggcacggcgcccatcaacatgacggaccgcctccaccaggtgctgcgctgggccacgggttctgtggagatcttcttctcccggaacaacgccttcctggcgtcgcggaggctcatgtttctgcagcgggtggcctacctcaacgtcggcatctaccccttcacctccatcttcctgctggtctactgcttcatcccggcgctgtccctcttctcgggcttcttcatcgtgcagacgctcaacgtcgccttcctctgctacctgctcaccatcaccatcaccctcatcgcgctgggaattctcgaggtcaagtggtccggcatcgagcttgaggactggtggcgcaacgagcagttctggctcatctcggggacgagcgcgcacctgtacgcagtggtgcaggggctgctcaaggtgatggccggcatcgagatctccttcacgctcacggccaaggcggcggcggaagacaacgaggacatctacgccgacctctacgtggtgaagtggtcatctctgctcatcccgcccatcaccatcggcatgatcaacctcatcgccattgccttcgccttcgcgcgcaccgtctacagcgacaacccgcgctggggcaagttcatcggcggcggcttcttcagcttctgggtgctggcgcacctctaccccttcgccaagggcctcatgggccgccgcggcaagacgcccaccatcgtcttcgtttggtcgggactcatctccatcaccatctccctgctctgggttgccatcagcccgccggaggccagcgccagcggccgcggcgctggcttccagttcccttga

SEQ ID NO: 9668 - protein, 1148 aa, Sorghum bicolor
  misc_feature: Ceres ANNOT ID no. 6102246
  misc_feature (276)..(1146): Pfam Id: Cellulose_synt Pfam Desc: Cellulose synthase
  misc_feature (1)..(1148): NCBI GI: 34419230 NCBI Desc: tpa: cellulose synthase-like d3 [oryza sativa]
  misc_feature (41)..(1148): NCBI GI: 27372782 NCBI Desc: cellulose synthase-like protein d4 [populus tremuloides]
  misc_feature (25)..(1148): NCBI GI: 9755692 NCBI Desc: cellulose synthase catalytic subunit-like protein [arabidopsis thaliana]
  misc_feature (54)..(1148): NCBI GI: 114509162 NCBI Desc: cellulose synthase-like d4 [physcomitrella patens]
  misc_feature (54)..(1148): NCBI GI: 114509154 NCBI Desc: cellulose synthase-like d1 [physcomitrella patens]
  misc_feature (590)..(1140): SWISSPROT Homolog: EC 2.4.1.12 Cellulose synthase A catalytic subunit 3 [UDP-forming]
  misc_feature: Useful for making plants with altered cell wall content and/or composition
  misc_feature: GREAT-hit functional homolog of the protein sequence encoded by LOCUS at4g38190
  misc_feature: Useful for making plants with altered cell wall content and/or composition
  misc_feature: Functional homolog of the protein sequence given in SEQ ID NO 14060
  misc_feature: Useful for making plants with modulated biomass
  misc_feature: Functional homolog of the protein sequence given in SEQ ID NO 14061
  misc_feature: The sequence is a functional homolog of SEQ ID NO 6 in US patent 7285702
  misc_feature: Useful for making plants with altered carbohydrate content
  misc_feature: Functional homolog of the protein sequence given in SEQ ID NO 13628
  misc_feature: Useful for making plants with modulated plant growth and development
  misc_feature: Functional homolog of the protein sequence given in SEQ ID NO 13629
MSNPPQKKAIRNPGAGAGGPAGGSRGPAGNTVKFARRTASGRYVSLSREDIDMEGELGADYTNYTVQIPPTPDNQPMMDQASVAMKAEEQYVSNSLFTGGFNSVTRAHLMDKVIESEVTHPQMAGSRGSRCAMPACDGKVMRNERGEDIDPCECRFKICRDCYLDAQKDGCICPGCKEHYKIGEYAEDDPNDASSGKHYLPGPGGGMMNNSKSLLARNQNGEFDHNRWLFESSGTYGYGNAYWPKGGMYDDDLDDEGGPGGGAGDGMLPEQKPFKPLTRKIPMPTSIISPYRIFIVIRMFVLLFYLTWRVRNPNMEALWLWGMSIVCELWFAFSWLLDMLPKVNPVNRSTDLAVLKEKFETPSPSNPHGRSDLPGLDVFVSTADPEKEPVLTTATTILSILAADYPVEKLACYVSDDGGALLTFEAMAEAASFANIWVPFCKKHDIEPRQPDSYFSIKGDPTKGKRRSDFVKDRRKVKREFDEFKVRINGLPDSIRRRSDAFNAREDMKMLKHLRESGADPAEQPKVKKATWMADGTHWPGTWAVSAPDHAKGNHAGILQVMLKPPSPDPLYGMHDEEQLIDFSDVDIRLPMLVYMSREKRPGYDHNKKAGAMNALVRCSAVMSNGPFILNFDCDHYINNAQAIREAMCFVMDRGGERIAYIQFPQRFEGIDPSDRYANNNTVFFDGNMRALDGLQGPMYVGTGCMFRRFALYGFDPPRTTEYTGLLFKKKKVTLSTAGETTDTQSLNHHKQQGGAADFDAELTSMLVPRRFGNSSALMASIPVAEFQARPLADHTAVLHGRPPGSLTVPRPPLDPPTVAEAVSVISCWYEDKTEWGDRVGWIYGSVTEDVVSGYRMHNRGWRSVYCIPKRDAFLGTAPINMTDRLHQVLRWATGSVEIFFSRNNAFLASRRLMFLQRVAYLNVGIYPFTSIFLLVYCFIPALSLFSGFFIVQTLNVAFLCYLLTITITLIALGILEVKWSGIELEDWWRNEQFWLISGTSAHLYAVVQGLLKVMAGIEISFTLTAKAAAEDNEDIYADLYVVKWSSLLIPPITIGMINLIAIAFAFARTVYSDNPRWGKFIGGGFFSFWVLAHLYPFAKGLMGRRGKTPTIVFVWSGLISITISLLWVAISPPEASASGRGAGFQFP

SEQ ID NO: 9669 - DNA, 1887 bp, Sorghum bicolor
  misc_feature: Ceres ANNOT ID no. 6102844
  misc_feature: Encodes the peptide sequence at SEQ ID NO 9670
atgaacgccgacttcggcgcacccaaggagctcgcggggggctgcagcgtcgacgggccctctaccagcctcccctcccgccatgggccgacggtgagggccgagtacggcgacgcgaccaccaccatcgaccccacctgtgcccaagccgtcgcgcaggccttcccgcacaccttcggccagccgctcgtcagctttgtcgcaccgtccgccgacgccgcagctgctgaggagcgccacccgatcagggtgggcgtggtgttctctgggaggcagtcgccgggagggcacaacgtcgtctggggcctccatgacgcactcaaagcctacaatcctcagagcgtgctctacggatttgtcggtggcacggagggactgtttgcaaacaagacgttggtgctcacagacgatgttcttgcttcctataagaaccaaggtggcttcgatttgctcggtaggagtatcgatcagatccgcactactaagcaagtgaatgctgcaatgacaacatgccgcagtctgaacttggatgggttggtcatcattggaggagtgacctccaattcagatgctgcacagcttgcagagacccttatacagaataactgtaagaccaaggtcgttggtgtgccagtttcattgaatggtgacctcaagaaccagttcgttgaaacaacagttggatttgatacagtgtgcaaggttaattcacagcttgtaagcaatgtttgcctcgatgcaatctcagctggaaagtactattattttgttcgtctgatgggacggaaagcatctcatgttgcctttgaatgtgcacttcagtcacacccaaacatgctcatcttaggagaggaagtagcattgtcaaaactcactctgatggaaattataaacaagatatgcgatggtgtacaagcaagggcagaattagggaaatatcatggtgtgcttgtaattcccgaaggacttatagaaagcattccagaaatgtatgctattattcaggaaatcaatatccttcacaacaataatgttccggtggctgagatgtcatcacaactgtctccatgggcagctgctctgttccagttcttgccacccttcatcagaagagagctgctgctccaccaagaatcagataactctgcacagttgtcccagattgacacggagcaactgttagcccatctagtagaaacagaaatgataaagagaacaaaagaaggaagatacaagggaaggaagttcagttcagtttgtcatttctttggatatccggctcgaggatctataccgtcaaattttgactgtgactatgcttatgctcttggacgtatctccctgcatatgatcacagttggattgactgggtacatggcaagtgtggctaacctgaaagacccagttgacaaatggagatgtgctgctgctcctttaactgcgatgatgagtgtcaagaggcatttacgtggccctggagcaatccctataggaagaccttccattcatccttcccccattgacctaaaagggaaggcttatgagttgctgcgagagaaggcttcaagcttcctcctcgacgacttctacaggactccaggaggcattcagttcgaagggcctggttcagacgcaaagcccatcacactgaccattgagaaccaggactacatgggtgacattgagatactgaaagagtatcttggcaaggtcctaacattgacatgcccaacgatgatgcgctgccatgttaggaccatggtgaagccagggtgctcccgggagatcctgaaggcagcaatcagctccatggtgtcggttacggatgtgcttaccgtgatgtcccaccccctcaacaccgagctgcccctctaccatttcaagtga

SEQ ID NO: 9670 - protein, 628 aa, Sorghum bicolor
  misc_feature: Ceres ANNOT ID no. 6102844
  misc_feature (83)..(363): Pfam Id: PFK Pfam Desc: Phosphofructokinase
  misc_feature (1)..(624): NCBI GI: 483547 NCBI Desc: pyrophosphate-dependent phosphofructokinase alpha subunit [ricinus communis]
  misc_feature (1)..(617): NCBI GI: 115467858 NCBI Desc: os06g0326400 [oryza sativa (japonica cultivar-group)]
  misc_feature (1)..(615): NCBI GI: 3790102 NCBI Desc: pyrophosphate-dependent phosphofructokinase alpha subunit [citrus x paradisi]
  misc_feature (1)..(623): NCBI GI: 169538 NCBI Desc: pyrophosphate-fructose 6-phosphate 1-phosphotransferase alpha-subunit
  misc_feature (1)..(615): NCBI GI: 30725422 NCBI Desc: at1g20950 [arabidopsis thaliana]
  misc_feature (1)..(624): SWISSPROT Homolog: EC 2.7.1.90 Pyrophosphate--fructose 6-phosphate 1-phosphotransferase alpha subunit
MNADFGAPKELAGGCSVDGPSTSLPSRHGPTVRAEYGDATTTIDPTCAQAVAQAFPHTFGQPLVSFVAPSADAAAAEERHPIRVGVVFSGRQSPGGHNVVWGLHDALKAYNPQSVLYGFVGGTEGLFANKTLVLTDDVLASYKNQGGFDLLGRSIDQIRTTKQVNAAMTTCRSLNLDGLVIIGGVTSNSDAAQLAETLIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIINKICDGVQARAELGKYHGVLVIPEGLIESIPEMYAIIQEINILHNNNVPVAEMSSQLSPWAAALFQFLPPFIRRELLLHQESDNSAQLSQIDTEQLLAHLVETEMIKRTKEGRYKGRKFSSVCHFFGYPARGSIPSNFDCDYAYALGRISLHMITVGLTGYMASVANLKDPVDKWRCAAAPLTAMMSVKRHLRGPGAIPIGRPSIHPSPIDLKGKAYELLREKASSFLLDDFYRTPGGIQFEGPGSDAKPITLTIENQDYMGDIEILKEYLGKVLTLTCPTMMRCHVRTMVKPGCSREILKAAISSMVSVTDVLTVMSHPLNTELPLYHFK

SEQ ID NO: 9671 - DNA, 1413 bp, Sorghum bicolor
  misc_feature: Ceres ANNOT ID no. 6103891
  misc_feature: Encodes the peptide sequence at SEQ ID NO 9672
atggagttcacggaggcgttcaagcagacgggcccgtgctccttctcccccgactcgcgcttcctcgctattgccgtagactaccgcctcgtcgtccgggacgtcgtctcactgaaggtggtacaattattttcatgtgtggacaagataagctctgtggagtgggcaccggattcagaatatattctatgtggactttacaagcggcccatggtgcaggcttggtcgctgagccagcctgactggacctgcaagatcgatgaaggtcctgcagggattgcatatgctcgctggagccctgacagtcgtcatatactcactacgtccgagtttcagctccgtctcactgtgtggtctctcgtaaatacagcatgcgtgcatgtccagtggccaaagcatggttctaaaggtgtttcttttaccaaggatgggaagtttgctgcaatctgtaccaggcgtgattgcaaggattacataaatttgctctcatgtcactcctgggagataatgactgtctttgccgttgacacggtagacttagctggtgttgaatggtcaccagatgatagtgctattgtcgtctgggattcacttcttgaatacaagattctgatatattcaccagacggaaggtgcttgttcaagtatctagcttatgaaagtgggttaggtgtgaaaactgttgcttggtcaccatgtggacagtttttagcagtgggcagctatgatcaagcagtgcggactttgaatcacctaacgtggaaaacttttgcggagttctcacatgcagcgtatatccgaagtccttgtaatgctgctatatataaggaagtggatgacccatggcagcttgatatgtcagagttatgtctaagtgaaggcttctcttgtaacatgcaagacaatggcgcagaaaatggcaccgagggaggaggctctagagttaaatatgctctgatggatgttcccatcaccttaccttccatgaaaccagctactgacaagcccaaccccaaacaaggaattggtatgctgtcatggagcaacgacagccactatttctttacccggaacgacaacatgccgactgctctttggatatgggatatatgccgccttgagcttgctgctgtgcttgtgcagaaagatccaatccgtgctgcagcatgggaccctacctgcacacgacttgttttatgcaccgagagccctcacttgtacatgtggacgccatccggtgcctgttgtgtcaacatccccttgctgaacttccgaatcattgatttgaagtggaactcgaatgggagctgcctcctcctgaaggaccgtgaatctttctgctgtgccacaatcatatctgccctgcctgaggaagaacctgatcaatctgatgatacttccgaagatgaatga

SEQ ID NO: 9672 - protein, 470 aa, Sorghum bicolor
  misc_feature: Ceres ANNOT ID no. 6103891
  misc_feature (1)..(465): NCBI GI: 38260632 NCBI Desc: wd-repeat protein [arabidopsis arenosa]
  misc_feature (1)..(465): NCBI GI: 38196020 NCBI Desc: wd-repeat protein [brassica oleracea]
  misc_feature (1)..(465): NCBI GI: 38260686 NCBI Desc: wd-repeat protein [arabidopsis arenosa]
  misc_feature (1)..(465): NCBI GI: 56236046 NCBI Desc: at5g07590 [arabidopsis thaliana]
  misc_feature (1)..(465): NCBI GI: 38260650 NCBI Desc: wd-repeat protein [capsella rubella]
MEFTEAFKQTGPCSFSPDSRFLAIAVDYRLVVRDVVSLKVVQLFSCVDKISSVEWAPDSEYILCGLYKRPMVQAWSLSQPDWTCKIDEGPAGIAYARWSPDSRHILTTSEFQLRLTVWSLVNTACVHVQWPKHGSKGVSFTKDGKFAAICTRRDCKDYINLLSCHSWEIMTVFAVDTVDLAGVEWSPDDSAIVVWDSLLEYKILIYSPDGRCLFKYLAYESGLGVKTVAWSPCGQFLAVGSYDQAVRTLNHLTWKTFAEFSHAAYIRSPCNAAIYKEVDDPWQLDMSELCLSEGFSCNMQDNGAENGTEGGGSRVKYALMDVPITLPSMKPATDKPNPKQGIGMLSWSNDSHYFFTRNDNMPTALWIWDICRLELAAVLVQKDPIRAAAWDPTCTRLVLCTESPHLYMWTPSGACCVNIPLLNFRIIDLKWNSNGSCLLLKDRESFCCATIISALPEEEPDQSDDTSEDE

SEQ ID NO: 9673 - DNA, 2766 bp, Sorghum bicolor
  misc_feature: Ceres ANNOT ID no. 6103904
  misc_feature: Encodes the peptide sequence at SEQ ID NO 9674
atgacgcgccgggtgcggcggcggacgtgcagggaacgggagggtagaggggtgaggggcgcgtcgcgtgttgtttcggcggggccggaaggcgaggaggatgcggcggcggtggaggttgactggagggcgctgccggacgacacggtgctgcagctcttcgcgcggctgaactaccgcgaccgcgccaacatggcgtcagcgtgccgggcttggcgagcgctgggctcgtcaccctgcctgtggagcacgctcgacctccgcgcgcaccgctacgaccgggaggtggcgtcgtcgcttgcctcgcggtgcgggagcctgcgtcggctacgcctgcggggccacgaggcggcagaggccgtcccgggcctccgcgcgcgtggtctccgcgaggtggtggccgatggctgccgcggcctcacagatgctacgctcgctgtcctcgccgcgcggcacgaggacctccagagcctccagatcgggcccgatcctctcgagcacatctccagcgatgccctccgccacgtcgctctttgttgctcgcaactccgccgccttcgcctctcgggtctccgtgaagctgacgcagatgccgtcggagcgctcgcccgctgctgccccctcctcgaggacgtggctttcctcgattgcggcaccgtggatgaggccgcccttgctggtatccactctctccggttcctctctgtagcaggatgccggagcctgaaatgggctactgcatccacctcctggacccagcttccctcccttattgcccttgacgtctcccgcactgatgttccgccaagtgctgtttcacgcctcatttcccatgccaaaaccctcaagcttatatgcacgctgaactgcatttctgttgaggaggaacagcttcacaatcctgctgtatttagtaactctaagggcaaggtcgtgctaacaatcaacagcgacttcaaaacttttgagaccatgtttccagttgtggatgtgaaagcgcacgaggttttcaatcaatgtagctggagtcacaaagacaagatagctggtgatacaatgacatggctcgagtggatcctgtcacagtcacttctccgaattgcagagtccaacccacaaggcatggatagtttctggctacagaagggcactgcactgctgcttagactattgaagagtttgcaggaggatgtgcaggagcgggcagctactgcacttgctacgtttgtagttatggatgacgagagtgcaaatgtggatcctgcaaggtcggaggcggtgatgcagaatgggggcatccgaatgttgctggaccttgcaaggtgctctagggagagcgcacaatctgaagcagcaaaagctattgccaacttgtcagtgaataccaaggttgccaaggcagttgcagaggaaggcggcattacaatactcactaatttagccaagtcgatgaataggcttgttgctgaagaggctgctggtggcctttggaatctctctgtaggcgaggaccataaggcggctattgcagtatctggtggtatcaaggccctggtcgatctaatatttcgttggcctgctggaactgatggagttcttgaacgtgctgctggcgcgcttgcaaacctggctgctgatgacaagtgtagcttggaagttgcaaaggctggtggtgtccatgctttggttacacttgctcgatcatgtaaacttgatggtgtcctagaacaggctgcaagaggtctggctaacttagctgcacatggggacaacaacgacaacaatgctgctgtaggtcaggaagcaggggctctggaggcactagtgcaactaacaggttctcaaaacgagggtgtaagacaagaagctgctggtgctttgtggaacctgtcatttgatgacagaaaccgtgaagccattgctgcagtgggtggtgttgaagctttggttgctctagtgcaacaatgtttgaatgcttcagaaggccttcaggagagagctgctggtgcattatggggattatctgtttcagaagctaatagcattgcaattgggcagggtggtggggttgcacctttgctcacattggcacgctcagaggttgaagatgttcacgagacagctgcaggggcactatggaatcttgctttttattatggtaatgctctccgcatagtcgaagaaggtggggtgcctgttcttgtaaaaatttgctcatcatcagggtccaagatggcacgcttcatgtctgcactagcactagcatatatgtttgacggaagaatggatgaagttgctttggttggagcatcctcggatagcagttccaagagtgttaatgttgagggagctagaagaatagcatttaagcatatagaaacctttgtgcttactttctcagatccacaaatgttctctatggctgctgcctcatcagccccggcagcgctgtctcatgttgctgaagcagtgtttatacacgaagctgggcacctgagatgcagtcgatctgagattggtagatttgttgccatgcttcggaatccttcaccaattctgcgtgcttgtgctgcctttgcccttcttcagttcacaatcccaggaggtcggcatgcggtgcatcacgcaggtctcttgcaggaagcaggagcaggtcgagtgttgcgtgcagcggcggcagcgacaacagcttctattgaagccaaaatttttgccaggattgtcctcaggaacttggagcaccatcagtcagggacgtcaacatga

SEQ ID NO: 9674 - protein, 921 aa, Sorghum bicolor
  misc_feature: Ceres ANNOT ID no. 6103904
  misc_feature (420)..(460): Pfam Id: Arm Pfam Desc: Armadillo/beta-catenin-like repeat
  misc_feature (461)..(501): Pfam Id: Arm Pfam Desc: Armadillo/beta-catenin-like repeat
  misc_feature (502)..(545): Pfam Id: Arm Pfam Desc: Armadillo/beta-catenin-like repeat
  misc_feature (546)..(587): Pfam Id: Arm Pfam Desc: Armadillo/beta-catenin-like repeat
  misc_feature (592)..(632): Pfam Id: Arm Pfam Desc: Armadillo/beta-catenin-like repeat
  misc_feature (633)..(676): Pfam Id: Arm Pfam Desc: Armadillo/beta-catenin-like repeat
  misc_feature (677)..(717): Pfam Id: Arm Pfam Desc: Armadillo/beta-catenin-like repeat
  misc_feature (40)..(87): Pfam Id: F-box Pfam Desc: F-box domain
  misc_feature (1)..(920): NCBI GI: 2344894 NCBI Desc: f-box protein family, atfbx5 [arabidopsis thaliana]
  misc_feature (1)..(917): NCBI GI: 7287983 NCBI Desc: arm repeat containing protein-like [arabidopsis thaliana]
  misc_feature (331)..(921): NCBI GI: 115483458 NCBI Desc: os10g0563200 [oryza sativa (japonica cultivar-group)]
  misc_feature (151)..(230): NCBI GI: 34394718 NCBI Desc: arm repeat protein-like [oryza sativa (japonica cultivar-group)]
  misc_feature (525)..(761): NCBI GI: 30681980 NCBI Desc: armadillo/beta-catenin repeat family protein / u-box domain-containing protein [arabidopsis thaliana]
  misc_feature: The sequence is a functional homolog of SEQ ID NO. 309 in the 11/188,298 US application
MTRRVRRRTCREREGRGVRGASRVVSAGPEGEEDAAAVEVDWRALPDDTVLQLFARLNYRDRANMASACRAWRALGSSPCLWSTLDLRAHRYDREVASSLASRCGSLRRLRLRGHEAAEAVPGLRARGLREVVADGCRGLTDATLAVLAARHEDLQSLQIGPDPLEHISSDALRHVALCCSQLRRLRLSGLREADADAVGALARCCPLLEDVAFLDCGTVDEAALAGIHSLRFLSVAGCRSLKWATASTSWTQLPSLIALDVSRTDVPPSAVSRLISHAKTLKLICTLNCISVEEEQLHNPAVFSNSKGKVVLTINSDFKTFETMFPVVDVKAHEVFNQCSWSHKDKIAGDTMTWLEWILSQSLLRIAESNPQGMDSFWLQKGTALLLRLLKSLQEDVQERAATALATFVVMDDESANVDPARSEAVMQNGGIRMLLDLARCSRESAQSEAAKAIANLSVNTKVAKAVAEEGGITILTNLAKSMNRLVAEEAAGGLWNLSVGEDHKAAIAVSGGIKALVDLIFRWPAGTDGVLERAAGALANLAADDKCSLEVAKAGGVHALVTLARSCKLDGVLEQAARGLANLAAHGDNNDNNAAVGQEAGALEALVQLTGSQNEGVRQEAAGALWNLSFDDRNREAIAAVGGVEALVALVQQCLNASEGLQERAAGALWGLSVSEANSIAIGQGGGVAPLLTLARSEVEDVHETAAGALWNLAFYYGNALRIVEEGGVPVLVKICSSSGSKMARFMSALALAYMFDGRMDEVALVGASSDSSSKSVNVEGARRIAFKHIETFVLTFSDPQMFSMAAASSAPAALSHVAEAVFIHEAGHLRCSRSEIGRFVAMLRNPSPILRACAAFALLQFTIPGGRHAVHHAGLLQEAGAGRVLRAAAAATTASIEAKIFARIVLRNLEHHQSGTST

SEQ ID NO: 9675 - DNA, 2358 bp, Sorghum bicolor
  misc_feature: Ceres ANNOT ID no. 6103911
  misc_feature: Encodes the peptide sequence at SEQ ID NO 9676
  misc_feature: Down-regulated in root tissues in response to salicylic acid treatment
  misc_feature: Down-regulated in shoot tissues in response to salicylic acid treatment
atggggtgcacggcgtccaaggtggagcaggaggacacggtccggcgctgcaaggagcgccgccgccacatgaaggacgcggtggcggcgcgccagctgctggcctccgcgcacgctgactacctccgctccctccgcgtcaccgccgccgcgctctcgcgcttcgcgcagggccacccctcgctcgccgtttcgcaccacactgcccccgttctcctctccgccgccgcgccgccgcctgccccaagcgccgcccacgcgctccccacaccggcgccctccaccgccacgtcgtcatcgctcccgcctccgacgccgctcgctcagcacccgcacccgcacccgccgtcccagccgcagccgcagccggcagcggcgatggcggtgccgcaaccggcgccggcgagggcaccacgcccacggcggctcagggtgccccacatcctgtcggactccagcgtcgccagccccgcgcagtcgtcattccgcaagcagcctccggtgggcacgccgtcctcctcgtccgcgtgggactgggagaacttctacccgccgtcgccgccagactccgagttcttcgaccgccgcaaggccgaggtcgagcaggccagccgcctccgggagcttgacgaggaggagaaggcccgggcctacctccaccaccacacccactacaacctcaaggaagaagacgaggctgccgaagacgacgacggtgaggtggaccatgaaccagaggggatgcattgcggcggatgggaggacgacgagcactacgcgtccacgaccacgtcggagaccagatcggaggacgagggcgagatgggggacagatcggaatgcgggttcgcggccagatcggagtgcgggttcgtggccagatcggagtacggcgggacggcaccgtcagagtacgccgccgtaccattgcccctgaggagggatgagaggtcggaggctggcgactcctcctccacggtcacggcggtgacagagatgcggatggtggtgcgccatcgcactctcgcggaaatcgtggcggccattgaggagtactttgtcaaggcagccgactccggcaacgatgtgtccgagctccttgaggccagccgcgcacagctcgaccgcaacttccggcagctcaaaaagacggtgtaccattccaacagtgtgctatcagcattgtcgtcgacatggtcgtcaaaaccgccattggctgtacgatataagttggacactaatgcactggagatggagtcaacggaggggaagagccatggatccactctagagcggcttttggcttgggagaagaagctctatgaggaggtcaaggcaagagagagtgtgaagattgagcatgagaaaaagctttctactctgcagagcctggagtacagagggagggatagtgcaaagctggacaagaccaaggcctccataaacaagctgcaatcactgattgtagttacctcacaggctgccacaactacatcctctgctattgttagagtccgtgacaatgagcttgcaccacagcttgttcagctttgttttgcgctattgggtatgtggaggtcaatgaaccatttccatgagatacaaaatgagattgttcagcaagtccgcggtctggtggacaactccatggctgagtcaacatctgaccttcacaggcttgcaactcgtgatcttgaggctgctgttgcggcatggcactcgaacttcaaccgccttatcaagtaccagcgtgactacatccgctctctatatggctggctgaagctcacactctgccaagtggataacagtgtgccacaggaagcccatgcctcaatgatctcgcgtgaactcaccagcttctgtgacgagtggaagcaagcactggaccgtcttccagatgctgttgcttcagaggctatcaagagctttgtgaatgttgttcatgtcatttacactaagcaggcagaggagatgaagatcaagaagcggacagagacactttcaaaggagctagaaaagaaaaccaactcactcaggtccattgagaagaagtactaccaatcctactcgatggttggccttggccttcctggcagtggacgcgatggcattgaaagccacgcgtacgatgcccgtgatcctcttgcagagaagaaaactgagattgcccagtgtcgtcggaaggtggaggacgagatgacaaggcatgctaaggccgtcgaggtaacaagatcaatgacgctgaacaacatacagacaggcctgccaggaatattccaagccatagctggtttctcagggacagtggtcgaagctcttgatgtggtgtgccgccgagctgggtcagtgcggtag

SEQ ID NO: 9676 - protein, 785 aa, Sorghum bicolor
  misc_feature: Ceres ANNOT ID no. 6103911
  misc_feature (67)..(785): NCBI GI: 13124871 NCBI Desc: bzip [oryza sativa]
  misc_feature (67)..(785): NCBI GI: 19031022 NCBI Desc: bzip protein [oryza sativa]
  misc_feature (115)..(784): NCBI GI: 62321728 NCBI Desc: bzip-like protein [arabidopsis thaliana]
  misc_feature (297)..(785): NCBI GI: 7576208 NCBI Desc: bzip protein [arabidopsis thaliana]
  misc_feature (356)..(785): NCBI GI: 113367194 NCBI Desc: bzip transcription factor bzip80 [glycine max]
  misc_feature: The sequence is a functional homolog of SEQ ID NO 1519 in the 11/479,226US patent application
  misc_feature: The sequence is a functional homolog of SEQ ID NO 20 in the 10/225,066US patent application
  misc_feature: The sequence is a functional homolog of SEQ ID NO 208 in the 10/225,066US patent application
  misc_feature: The sequence is a functional homolog of SEQ ID NO 2364 in the 10/374,780US patent application
  misc_feature: The sequence is a functional homolog of SEQ ID NO 2844 in the 10/374,780US patent application
  misc_feature: Useful for making plants with modulated growth and phenotype characteristics
  misc_feature: The sequence is a functional homolog of SEQ ID NO 20 in the 20050160493 US patent application
  misc_feature: The sequence is a functional homolog of SEQ ID NO 208 in the 20050160493 US patent application
  misc_feature: The sequence is a functional homolog of SEQ ID NO 1519 in the 20070022495 US patent application
  misc_feature: The sequence is a functional homolog of SEQ ID NO 1519 in the 11/479,226 US patent application
  misc_feature: The sequence is a functional homolog of SEQ ID NO 208 in the 10/225,066 US patent application
  misc_feature: The sequence is a functional homolog of SEQ ID NO 2364 in the 10/374,780 US patent application
  misc_feature: Down-regulated in root tissues in response to salicylic acid treatment
  misc_feature: Down-regulated in shoot tissues in response to salicylic acid treatment
MGCTASKVEQEDTVRRCKERRRHMKDAVAARQLLASAHADYLRSLRVTAAALSRFAQGHPSLAVSHHTAPVLLSAAAPPPAPSAAHALPTPAPSTATSSSLPPPTPLAQHPHPHPPSQPQPQPAAAMAVPQPAPARAPRPRRLRVPHILSDSSVASPAQSSFRKQPPVGTPSSSSAWDWENFYPPSPPDSEFFDRRKAEVEQASRLRELDEEEKARAYLHHHTHYNLKEEDEAAEDDDGEVDHEPEGMHCGGWEDDEHYASTTTSETRSEDEGEMGDRSECGFAARSECGFVARSEYGGTAPSEYAAVPLPLRRDERSEAGDSSSTVTAVTEMRMVVRHRTLAEIVAAIEEYFVKAADSGNDVSELLEASRAQLDRNFRQLKKTVYHSNSVLSALSSTWSSKPPLAVRYKLDTNALEMESTEGKSHGSTLERLLAWEKKLYEEVKARESVKIEHEKKLSTLQSLEYRGRDSAKLDKTKASINKLQSLIVVTSQAATTTSSAIVRVRDNELAPQLVQLCFALLGMWRSMNHFHEIQNEIVQQVRGLVDNSMAESTSDLHRLATRDLEAAVAAWHSNFNRLIKYQRDYIRSLYGWLKLTLCQVDNSVPQEAHASMISRELTSFCDEWKQALDRLPDAVASEAIKSFVNVVHVIYTKQAEEMKIKKRTETLSKELEKKTNSLRSIEKKYYQSYSMVGLGLPGSGRDGIESHAYDARDPLAEKKTEIAQCRRKVEDEMTRHAKAVEVTRSMTLNNIQTGLPGIFQAIAGFSGTVVEALDVVCRRAGSVR

SEQ ID NO: 9677 - DNA, 723 bp, Sorghum bicolor
  misc_feature: Ceres ANNOT ID no. 6103933
  misc_feature: Encodes the peptide sequence at SEQ ID NO 9678
atgacgacgggggaagggacgacagaggcggcggcggtgccgcgggtggtctccatcctgtcggcgctgctgcagcgggtggcggagcgcaacgacgccgccgcggcggagccggaggagggcggcgcggtggtggcggcggcggccgccgctggccgcccggtgtcggcgttccaggggctgaccaagccggccatctccatcggcggctacctggagcgcatcttccgcttcgccagctgcagcccgtcctgctacgtcgtcgcctacatctacctcgaccgattcctgcgccgccgccccgcgctcgccgtcgactccttcaacgtccaccgactcctcatcacctccgtcctcaccgccgtcaagttcgtcgacgacatgtacgtatgctacaacaacgcctacttcgcgcgggtgggcggcatcagcctggtggagatgaactacctggaggtggacttcctcttcggcatcgccttcgacctcaacgtcacgcccgccgccttcgcctcctactgcgccgtgctccagagcgagatggcctacctggacacgccgcccgcgcccgtcgtcgaggcgccccggctgcaccaccactgctacgccgccgccgccgccggcacgtccgatcaccaccacgacgaccccgccgccgccgccgtggtcgcaggagcggcgcccggctgccaccgtcacagtcagacgcagctcaccgtctga

SEQ ID NO: 9678 - protein, 240 aa, Sorghum bicolor
  misc_feature: Ceres ANNOT ID no. 6103933
  misc_feature (14)..(163): Pfam Id: Cyclin Pfam Desc: Cyclin
  misc_feature (13)..(210): NCBI GI: 14140116 NCBI Desc: preg-like protein [oryza sativa]
  misc_feature (13)..(210): NCBI GI: 49387505 NCBI Desc: cyclin-like [oryza sativa (japonica cultivar-group)]
  misc_feature (2)..(190): NCBI GI: 41053064 NCBI Desc: preg-like protein [oryza sativa (japonica cultivar-group)]
  misc_feature (10)..(184): NCBI GI: 38566658 NCBI Desc: at5g61650 [arabidopsis thaliana]
  misc_feature (14)..(181): NCBI GI: 2982283 NCBI Desc: preg-like protein [picea mariana]
MTTGEGTTEAAAVPRVVSILSALLQRVAERNDAAAAEPEEGGAVVAAAAAAGRPVSAFQGLTKPAISIGGYLERIFRFASCSPSCYVVAYIYLDRFLRRRPALAVDSFNVHRLLITSVLTAVKFVDDMYVCYNNAYFARVGGISLVEMNYLEVDFLFGIAFDLNVTPAAFASYCAVLQSEMAYLDTPPAPVVEAPRLHHHCYAAAAAGTSDHHHDDPAAAAVVAGAAPGCHRHSQTQLTV

SEQ ID NO: 9679 - DNA, 1359 bp, Sorghum bicolor
  misc_feature: Ceres ANNOT ID no. 6103936
  misc_feature: Encodes the peptide sequence at SEQ ID NO 9680
atggccgaaccatccgccgccgccgtcaccgcagctgacgtcggggcgctggcttcgttgcccccgctggtcgccgaggaggccgacgccgccgcgatggaggaggccgcggcggccgcgaagaggtggcccgggtggcccggggacagcgtgttccggctggtggtgccagtgctcaaggtcggaagcataatcgggcggaagggcgagctcatcaagcgcctcgtcgaggagaccaaggccagggtccgcatcctcgagggccccgtcggcgccaccgagcgtatcgttttggtttctggaaaagaagatccaggcttggagctacctccagccatggatgctctcatgagagtttttaagcgtgtaattgggataacagatggagctgctgagggcactcaggccgctgctactcctggtgtatgtgctgctcgattgttggttcctggagctcaggcaattaatctaattgggaagcaaggtgccactatcaaagcaatccaggagagcacgggtgctacaatacgggtaatatcagtagatgaacgggagcgaccattctatgtaactgacgatgaaaggataattgagatacagggcgatacagagaaagttctaaaagcactacaagcagtttctaaccatcttcggaagtttttggttgaccatagtgtacttccattatttgaaaaaactaatactacagtgagccaagatcgcaatggtgatggttggagtgatatgtcacatccttcaattggttctgcacaagtgaatcaaccaccttctgtggtagatgaatatattctcccagtgaagagggaatctttgtatcttgaacgagaacctttggtagatcataacattcatcgctcaggagtatcactttatgggcgggatccagccttgtcaacactacgaccctctggaatacatggtgctggcccgctacttacgcagataacccaaaccatgcaaatcccacttacctatgctgaagacattataggagttaaaggagcaaacattgcgtacatacgagctaatagtggggctgttgttacaattcaggagagtttgggtagtcctgatgatattactgttgaaataaaggggacatcctcacaggtacaagctgcacagcagctcatccaggactcgttggctgcacaccgtgaacctgtcaggagcagttatgtgggagcaggattagattcagtgtataggtccagctactcacaatatggcagttccacctatccttcgtcatctctgccatcttattctagtattgatgatgttagtagatacccgtcttcaggtcttggtggctatgggtcgagttaccggtactag

SEQ ID NO: 9680 - protein, 452 aa, Sorghum bicolor
  misc_feature: Ceres ANNOT ID no. 6103936
  misc_feature (51)..(113): Pfam Id: KH_1 Pfam Desc: KH domain
  misc_feature (144)..(213): Pfam Id: KH_1 Pfam Desc: KH domain
  misc_feature (323)..(385): Pfam Id: KH_1 Pfam Desc: KH domain
  misc_feature (29)..(451): NCBI GI: 140067267 NCBI Desc: kh, type 1 [medicago truncatula]
  misc_feature (24)..(451): NCBI GI: 92877479 NCBI Desc: kh, type 1 [medicago truncatula]
  misc_feature (41)..(438): NCBI GI: 61661326 NCBI Desc: flk [arabidopsis thaliana]
  misc_feature (97)..(423): NCBI GI: 115489418 NCBI Desc: os12g0597600 [oryza sativa (japonica cultivar-group)]
  misc_feature (47)..(386): NCBI GI: 56783855 NCBI Desc: hen4 -like [oryza sativa (japonica cultivar-group)]
MAEPSAAAVTAADVGALASLPPLVAEEADAAAMEEAAAAAKRWPGWPGDSVFRLVVPVLKVGSIIGRKGELIKRLVEETKARVRILEGPVGATERIVLVSGKEDPGLELPPAMDALMRVFKRVIGITDGAAEGTQAAATPGVCAARLLVPGAQAINLIGKQGATIKAIQESTGATIRVISVDERERPFYVTDDERIIEIQGDTEKVLKALQAVSNHLRKFLVDHSVLPLFEKTNTTVSQDRNGDGWSDMSHPSIGSAQVNQPPSVVDEYILPVKRESLYLEREPLVDHNIHRSGVSLYGRDPALSTLRPSGIHGAGPLLTQITQTMQIPLTYAEDIIGVKGANIAYIRANSGAVVTIQESLGSPDDITVEIKGTSSQVQAAQQLIQDSLAAHREPVRSSYVGAGLDSVYRSSYSQYGSSTYPSSSLPSYSSIDDVSRYPSSGLGGYGSSYRY

SEQ ID NO: 9681 - DNA, 1500 bp, Sorghum bicolor
  misc_feature: Ceres ANNOT ID no. 6103943
  misc_feature: Encodes the peptide sequence at SEQ ID NO 9682
atggcgcctctcgccaccgcgccgcctcctactccccatgccccgcgctctctcgttccacgggtaaggccgcggcgagggctgacggcagtgcgcgcggcctcacagggaagaacaacggatgggtggacgccgggaagctggcgtgcgcgccctgcgcggcagatcccggagtaccccgacacggcggcgctggaggctacagagcgaactctggcggagtttccaccgctagtgttcacgggtgaggtgcggaagctggaggagcggctcggggaggcggccatgggtcgggcattcctcctgcagggcggcgactgcgccgagagctttagggagttcaatgcacagaaaatccgggacaccttccgactcatactgcagatggccgtcgttctcaccttcggcggacagatgcccaccatcaaggtgggaaggatgggtggtcaatttgcgaagccaagatcgaacccaactgagactgttgatggggtaacccttccctcctatagaggggatatcatcaacgatcaggcttttgatgagaaatctcgtgtaccagatcctgaaaggttgattagagcctatacccagtctgcgagcaccctgaatcttctcagagcatttgcccatggaggttttgcggatcttcagagagtcacccagtggaatctcgactttttgaggcacagcacacaaggagacaggtatctggagctttctcagagggttcatgaagccattgggtttatggttgccgctgggctgacccctcaacaccccatcatgaccacagctgagttatggacatcccatgagtcccttcacttaccatacgagcaagcactgactagggaggattccattagtggccggtactatgactgttccgcacacatgctttgggtcggtgagaggactcggcagctggatggtgctcatgttgaattccttcgtggtatttcaaatcctctgggtataaaggtaagtgataagcttgacccatcagagcttgtgaagttgtgtgagactctgaatcctcacaacaagcctgggcgattgacgattatcacaagaatgggggctgagaacatgcgtgttaagcttccacaaatgatcagagcagtgcgccaagctgggatgattgttacttgggttagtgatcctatgcacggaaacactatcagtgcaccatgcggactgaagacaagatcatttgattcaatcatggctgaactcagggctttcttcgatgttcatgggctagagggaagctaccctggaggagttcacctggagatgacggggcagaatgttacagagtgtatcgggggatctaaggcggtgacatttgatgatctcagtgcccgctaccacacacactgtgaccccagactgaacgcgtcgcagtccctcgagctggctttcgccattgctgacaggttaaggaacaagagagacaagacatggcataatttgacatccagagttgttgcttaa

SEQ ID NO: 9682 - protein, 499 aa, Sorghum bicolor
  misc_feature: Ceres ANNOT ID no. 6103943
  misc_feature (42)..(479): Pfam Id: DAHP_synth_2 Pfam Desc: Class-II DAHP synthetase family
  misc_feature (7)..(489): NCBI GI: 2398681 NCBI Desc: 3-deoxy-d-arabino-heptulosonate 7-phosphate synthase [morinda citrifolia]
  misc_feature (4)..(486): NCBI GI: 21700887 NCBI Desc: at4g33510/f17m5_270 [arabidopsis thaliana]
  misc_feature (20)..(486): NCBI GI: 114193 NCBI Desc: phospho-2-dehydro-3-deoxyheptonate aldolase 1, chloroplast precursor (phospho-2-keto-3-deoxyheptonate aldolase 1) (dahp synthetase 1) (3-deoxy-d-arabino-heptulosonate
  misc_feature (20)..(486): NCBI GI: 114193 (continued) 7-phosphate synthase 1)
  misc_feature (29)..(486): NCBI GI: 584777 NCBI Desc: phospho-2-dehydro-3-deoxyheptonate aldolase 1, chloroplast precursor (phospho-2-keto-3-deoxyheptonate aldolase 1) (dahp synthetase 1) (3-deoxy-d-arabino-heptulosonate
  misc_feature (29)..(486): NCBI GI: 584777 (continued) 7-phosphate synthase 1)
  misc_feature (29)..(486): NCBI GI: 410488 NCBI Desc: phospho-2-dehydro-3-deoxyheptonate aldolase [lycopersicon esculentum]
  misc_feature (4)..(486): SWISSPROT Homolog: EC 2.5.1.54 Phospho-2-dehydro-3-deoxyheptonate aldolase 2, chloroplast precursor
MAPLATAPPPTPHAPRSLVPRVRPRRGLTAVRAASQGRTTDGWTPGSWRARPARQIPEYPDTAALEATERTLAEFPPLVFTGEVRKLEERLGEAAMGRAFLLQGGDCAESFREFNAQKIRDTFRLILQMAVVLTFGGQMPTIKVGRMGGQFAKPRSNPTETVDGVTLPSYRGDIINDQAFDEKSRVPDPERLIRAYTQSASTLNLLRAFAHGGFADLQRVTQWNLDFLRHSTQGDRYLELSQRVHEAIGFMVAAGLTPQHPIMTTAELWTSHESLHLPYEQALTREDSISGRYYDCSAHMLWVGERTRQLDGAHVEFLRGISNPLGIKVSDKLDPSELVKLCETLNPHNKPGRLTIITRMGAENMRVKLPQMIRAVRQAGMIVTWVSDPMHGNTISAPCGLKTRSFDSIMAELRAFFDVHGLEGSYPGGVHLEMTGQNVTECIGGSKAVTFDDLSARYHTHCDPRLNASQSLELAFAIADRLRNKRDKTWHNLTSRVVA

SEQ ID NO: 9683 - DNA, 789 bp, Sorghum bicolor
  misc_feature: Ceres ANNOT ID no. 6103956
  misc_feature: Encodes the peptide sequence at SEQ ID NO 9684
atggaccggaagcgcatcaaggacgccctcgagaagcacctggagaggtcgtcgccgtccacctccaggggcggcgtcgtgcccaaggagagggagcgcctagctgctgccgggaagctgccagcgtcgcttggcaaggcggagaagatgtctgatggtgaggaatttgaaactgacagcgaagattctgatgtcagtggttctgagggggaggacacatcctggatttcatggttctgtacattgcgaggcaatgaattcttttgtgagatcgatgaagactacatacaggatgattttaacctgtgtggtctgagtaatcaggtcccatattatgattatgcacttgatctcatcttagacattgagtcttctaatggtgatgtgttcactgaggagcaaaacgaattaatcgagtcgtctgcagagatgctgtatggattaattcacgcacgatacatcttaaccagcaagggtctagctgcaatgttggagaagttcaagaactatgactttggtagatgccccagagtgtactgctgtggccagccctgtcttccagcagggcaatcagatattcctagatcgagcacagtgaagatatattgtcccaaatgtgaggaacttaattatccaagatccaagtaccaaggcaacattgatggatcatactttgggacgacattcccccatcttttcctgatgacttatccacacttgaagccgcagaagccgttgcagcaatacactccaagagtttttggcttcaaacttcacaagccgtcatga

SEQ ID NO: 9684 - protein, 262 aa, Sorghum bicolor
  misc_feature: Ceres ANNOT ID no. 6103956
  misc_feature (75)..(249): Pfam Id: CK_II_beta Pfam Desc: Casein kinase II regulatory subunit
  misc_feature (1)..(262): NCBI GI: 11527002 NCBI Desc: protein kinase ck2 regulatory subunit ck2b2 [zea mays]
  misc_feature (1)..(262): NCBI GI: 113374086 NCBI Desc: casein kinase ii beta [hordeum vulgare]
  misc_feature (1)..(260): NCBI GI: 21261784 NCBI Desc: protein kinase ck2 regulatory subunit 2 [nicotiana tabacum]
  misc_feature (1)..(261): NCBI GI: 11527004 NCBI Desc: protein kinase ck2 regulatory subunit ck2b3 [zea mays]
  misc_feature (1)..(261): NCBI GI: 140058354 NCBI Desc: casein kinase ii, regulatory subunit [medicago truncatula]
  misc_feature: Useful for making plants with modulated biomass
  misc_feature: Useful for making plants with modulated flowering time
  misc_feature: Useful for making plants with modulated heat sensitivity
  misc_feature: Functional homolog of the protein sequence given in SEQ ID NO 13434
  misc_feature: Functional homolog of the protein sequence given in SEQ ID NO 13452
  misc_feature: Useful for making plants with modulated flowering time
  misc_feature: Functional homolog of the protein sequence given in SEQ ID NO 13452
  misc_feature: The sequence is a functional homolog of SEQ ID NO. 373 in the 11/188,298 US application
  misc_feature: The sequence is a functional homolog of SEQ ID NO. 515 in the 11/188,298 US application
MDRKRIKDALEKHLERSSPSTSRGGVVPKERERLAAAGKLPASLGKAEKMSDGEEFETDSEDSDVSGSEGEDTSWISWFCTLRGNEFFCEIDEDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEELNYPRSKYQGNIDGSYFGTTFPHLFLMTYPHLKPQKPLQQYTPRVFGFKLHKPS

SEQ ID NO: 9685 - DNA, 1368 bp, Sorghum bicolor
  misc_feature: Ceres ANNOT ID no. 6103957
  misc_feature: Encodes the peptide sequence at SEQ ID NO 9686
atgcatcaccaccaccaccaccccgcggccgcgccggagtcggcggccccggcgacagaccctccgccgcccccgccggtgctcgatccgtcctccctccgcatccacatcccgtcaagcccgcaccacgcgctgccgtccaccccgcacaagcgccccgtcgtcatgacctcgtcctcctcctcgtccacccccacccgcccctcgccgtcgcccttcacgccgccgcggaggcgcaaggtccccgcgcccgctgcgcccgcgggggccgccgcggccaggcatctccttcgctgcctgcacctccgcctgcgcatcctcctcctcatctcgctcccctccctctacttcctctccccgacccccgccatcctcccgcgctccctcctcgccgacttcctttccgctgcggccttctcctgcgcgctcctccttctcctctgcctctccctgccgcggcttcccttcgcgctgccgctgccgctccccctccgccgcgcgcgccgatcccccatcctttggtccatcggttcctcgccgtccgcatccgcgaccacccccaccaccggccatttcgtccaggtttatagcaacggcgacgtctacgagggccaattccaccgcggccgctgcactggcagcggcgtctactactactacatgagcgggaggtacgagggggattgggtcgacggcaagtacgatggcttcggcgtcgagacctgggccagaggtagccggtaccggggccagtaccggcagggactcaggcatggctacggcgtgtacaggttctacactggggatgtgtacgccggggagtggtcaaacggccagagccatgggtatggcgtgcacacctgtgaggacggtagccgatatattggcgagttcaagaggggcgtcaagcatggcctcggccactaccatttcaggaatggtgacacctacgctggagagtactttgctgataggatgcacggctttggaatctacagctttgccaatggccatagatatgagggagcatggcatgagggtagaagacagggtttaggcatgtatagtttcaggaatggagagacgcaagctgggcactggcaaaatggagttcttgatactttaagcacccagaattttgtccctggatcacctattgctgtgaaccattccaaggtccttaacgcagtgcaggaagcgagaagagccgcagagaaggcctatgacatcccaagagtagatgataaggtgaacagggctgttgcagcagctaataaagcagccaatgcagccagggtggctgccgtgaaggctgcacaaaagcgcatccccaataatggtgacgatctaccactgtcagtagtgtga

SEQ ID NO: 9686 - protein, 455 aa, Sorghum bicolor
  misc_feature: Ceres ANNOT ID no. 6103957
  misc_feature (202)..(224): Pfam Id: MORN Pfam Desc: MORN repeat
  misc_feature (225)..(247): Pfam Id: MORN Pfam Desc: MORN repeat
  misc_feature (248)..(270): Pfam Id: MORN Pfam Desc: MORN repeat
  misc_feature (271)..(293): Pfam Id: MORN Pfam Desc: MORN repeat
  misc_feature (294)..(316): Pfam Id: MORN Pfam Desc: MORN repeat
  misc_feature (317)..(339): Pfam Id: MORN Pfam Desc: MORN repeat
  misc_feature (340)..(362): Pfam Id: MORN Pfam Desc: MORN repeat
  misc_feature (84)..(452): NCBI GI: 21928129 NCBI Desc: at4g17080/dl4570w [arabidopsis thaliana]
  misc_feature (46)..(443): NCBI GI: 51535948 NCBI Desc: 1-phosphatidylinositol-4-phosphate 5-kinase-like protein [oryza sativa (japonica cultivar-group)]
  misc_feature (193)..(443): NCBI GI: 115476836 NCBI Desc: os08g0469700 [oryza sativa (japonica cultivar-group)]
  misc_feature (196)..(383): NCBI GI: 126725898 NCBI Desc: morn motif precursor [rhodobacterales bacterium htcc2150]
  misc_feature (190)..(369): NCBI GI: 40062709 NCBI Desc: morn repeat protein [uncultured bacterium 314]
MHHHHHHPAAAPESAAPATDPPPPPPVLDPSSLRIHIPSSPHHALPSTPHKRPVVMTSSSSSSTPTRPSPSPFTPPRRRKVPAPAAPAGAAAARHLLRCLHLRLRILLLISLPSLYFLSPTPAILPRSLLADFLSAAAFSCALLLLLCLSLPRLPFALPLPLPLRRARRSPILWSIGSSPSASATTPTTGHFVQVYSNGDVYEGQFHRGRCTGSGVYYYYMSGRYEGDWVDGKYDGFGVETWARGSRYRGQYRQGLRHGYGVYRFYTGDVYAGEWSNGQSHGYGVHTCEDGSRYIGEFKRGVKHGLGHYHFRNGDTYAGEYFADRMHGFGIYSFANGHRYEGAWHEGRRQGLGMYSFRNGETQAGHWQNGVLDTLSTQNFVPGSPIAVNHSKVLNAVQEARRAAEKAYDIPRVDDKVNRAVAAANKAANAARVAAVKAAQKRIPNNGDDLPLSVV

SEQ ID NO: 9687 - DNA, 1476 bp, Sorghum bicolor
  misc_feature: Ceres ANNOT ID no. 6104005
  misc_feature: Encodes the peptide sequence at SEQ ID NO 9688
atggagagctcctcagctaggagcaatgtttctgagaggaatcacctgggttatgcgagaagcacatctatggattccactggtcctccgttagctggtaggtctggctcgatgttaagtaggagaagtagcagacagagctcaaggggatccatcagcctctcaagggagatgggggactccatactgagctcaatgaggcattctcttcagtcggcggatcaattgctaggagacattgatagctcagttctggctcagctcattgaaagtggtcgagttctatcacccgaaggcgatgttgatgaggatacagcaaggatctctgagcataataagattggccctcttccagatgaagcaataaagcaaaacaatgaaaaatttgcatcagcacttgtatcttcagcagagacaaaagatactatttctaacatcctagcagattcatctaccaaggttgaaccatataagctttctctgaggcttgactatgctgcttacatgatccatttagctgtctttggctttctcggggtattcacaaggtatgggctccaaaagctgtttggcccagactgcttggcactcacctcagaccaaagcccactttaccctgaccttccatctaatatgcttggatctttcttgatgggttggtttggtatcatattcaaggctgatatacgatacatatctgaccatcttatcgttggaatcacaactggatacatgggaagccttacaaccttcagtgggtggaaccagaaaatggttggtttgtcgtccaaaggccactgggtaaatgctatagcaggcgtagtactagggatgttcattgtcaacgagtccatcacgattggtgctgagacgggtgagcgcctacggagtttgatcctgaaatacatcagggagaagagtttgataggtcacaaatatggttgggagcactggagggtggataccaggactaagcagtttgtgcttttgtcagtgatgataattttgatgtcttccttttgggttttgagcattgtgttgactgtagtaaagatgcatagtcttgctgatggtgctgtcctatggatgggctgctcggtagcacctccaggagtttggctacgctggtacctggcaaggctcaatggccagggaattggcaagcagagatccttgaaatggctgcccattgggaccctggtagccaatgttcttgctgcaggcataatggcggttcttgctgtaacatccaaagcggtacatacaaagcgatcgacaactattcttagtggaatacagcttggcttccttggttgcttgagtacagtgtctacttttgctgctgaagtgtatacaatgagaagaagcgggcagattgcgagggcctttgtttatgccgcatccactttcctgctttcttttgtgctgggaactctagtgtattccgtgccagtttgggaaaaacattataaatga

SEQ ID NO: 9688 - protein, 491 aa, Sorghum bicolor
  misc_feature: Ceres ANNOT ID no. 6104005
  misc_feature (169)..(281): Pfam Id: CRCB Pfam Desc: CrcB-like protein
  misc_feature (362)..(481): Pfam Id: CRCB Pfam Desc: CrcB-like protein
  misc_feature (346)..(476): NCBI GI: 47605447 NCBI Desc: protein crcb homolog
  misc_feature (371)..(476): NCBI GI: 47605441 NCBI Desc: protein crcb homolog
  misc_feature (168)..(278): NCBI GI: 89096358 NCBI Desc: camphor resistance protein crcb [bacillus sp. nrrl b-14911]
  misc_feature (167)..(316): NCBI GI: 30692518 NCBI Desc: crcb [bacillus thuringiensis serovar aizawai]
  misc_feature (398)..(486): NCBI GI: 46190799 NCBI Desc: cog0239: integral membrane protein possibly involved in chromosome condensation [bifidobacterium longum djo10a]
MESSSARSNVSERNHLGYARSTSMDSTGPPLAGRSGSMLSRRSSRQSSRGSISLSREMGDSILSSMRHSLQSADQLLGDIDSSVLAQLIESGRVLSPEGDVDEDTARISEHNKIGPLPDEAIKQNNEKFASALVSSAETKDTISNILADSSTKVEPYKLSLRLDYAAYMIHLAVFGFLGVFTRYGLQKLFGPDCLALTSDQSPLYPDLPSNMLGSFLMGWFGIIFKADIRYISDHLIVGITTGYMGSLTTFSGWNQKMVGLSSKGHWVNAIAGVVLGMFIVNESITIGAETGERLRSLILKYIREKSLIGHKYGWEHWRVDTRTKQFVLLSVMIILMSSFWVLSIVLTVVKMHSLADGAVLWMGCSVAPPGVWLRWYLARLNGQGIGKQRSLKWLPIGTLVANVLAAGIMAVLAVTSKAVHTKRSTTILSGIQLGFLGCLSTVSTFAAEVYTMRRSGQIARAFVYAASTFLLSFVLGTLVYSVPVWEKHYK

SEQ ID NO: 9689 - DNA, 1308 bp, Sorghum bicolor
  misc_feature: Ceres ANNOT ID no. 6104024
  misc_feature: Encodes the peptide sequence at SEQ ID NO 9690
atggagcatttcaggcgaggggtggagtttgggatggcctccttccagagatgccatccactgtcatgtcaaatggcagagagcgcaccgctcgatgcgcagaagccggatatccgctgtaaagagaagtcacggcattctaagtgctgccacctcgaagagatgccagtcatccctgagcaggccatggagttcctctctcggacatggagcccctcctcctcggatctcttccaaatactctcccccagtggcctgggatcatcgctggaggacccagagcaagatgaagcaagaggagacggaggcgaagacgacaaagaaaagcatcttggcaccgttcgtttcaatgggggaacaacaaaccaattgttcaatcagacatgtagacttgtagccggcggcaggcctaacagcggacagcgccggcacaagctcgtccagcctgcctggctcaaagctggaaacatgaaggcgatgctgcgtggtttcctgctggacagcttgccagtcaccggaagccggcggaggaggcggagggacgagctccggctgcactcggcgcaggcgcacgctgccgtgtcggtggcgcagctcgctgcggcggtggcgggcatcgtgtcggcgtgcgacctgaggccggcggcctcggctagcgctggcgacaggaggctaggcacggtgctcgcgtccgccgcggcgctggtggccaccgtgtgcgctgaggccgcggagaactccggcgccaaccgcggccgcgtcacgtccgccgtgaggaccggcctcgagagccgctcctccgccgacctgctcaccctcaccgctaccgctgccacatgtttgaggggagccgcggcgctgaagcaaagggcagctgacctcaggggaatcagcaccagcaccagcaccagcaccagcagcaacgccgccatggccatgagcgtcagcgctggcatccagaagggcacgactctcagagtctgcctgccttgtggaagtgtgcgtgtgaggacggtgtccgtcttcccgcggcgcggcgacggcgcagcggtggttctgcggctggggaagaagcgcctgcacggcgcgttcgccaccttcaaggactatgtggtctcggcggtcggagacggcggcggcgaggcggtggtggaagggcggccggcgttcccggtggcgctgatcacgtcagagcagggggtgacggtgcagctgctgttcgagcaccagacgcactgcaaggtctggaaggccgccatcgagggcatgctggccgaaagaagaagctcaagcgcgacaaccaactga

SEQ ID NO: 9690 - protein, 435 aa, Sorghum bicolor
  misc_feature: Ceres ANNOT ID no. 6104024
  misc_feature (323)..(431): Pfam Id: PH_2 Pfam Desc: Plant pleckstrin homology-like region
  misc_feature (1)..(428): NCBI GI: 115483542 NCBI Desc: os10g0568300 [oryza sativa (japonica cultivar-group)]
  misc_feature (165)..(432): NCBI GI: 115483538 NCBI Desc: os10g0568100 [oryza sativa (japonica cultivar-group)]
  misc_feature (225)..(432): NCBI GI: 78709031 NCBI Desc: new cdna-based gene [oryza sativa (japonica cultivar-group)]
  misc_feature (175)..(425): NCBI GI: 38345392 NCBI Desc: osjnba0067k08.21 [oryza sativa (japonica cultivar-group)]
  misc_feature (175)..(425): NCBI GI: 116310721 NCBI Desc: osigba0092e01.13 [oryza sativa (indica cultivar-group)]
  misc_feature: The sequence is a functional homolog of SEQ ID NO 430 in the 10/666,642US patent application
  misc_feature: Useful for making plants with modulated growth and phenotype characteristics
  misc_feature: The sequence is a functional homolog of SEQ ID NO 430 in the 20070033671 US patent application
MEHFRRGVEFGMASFQRCHPLSCQMAESAPLDAQKPDIRCKEKSRHSKCCHLEEMPVIPEQAMEFLSRTWSPSSSDLFQILSPSGLGSSLEDPEQDEARGDGGEDDKEKHLGTVRFNGGTTNQLFNQTCRLVAGGRPNSGQRRHKLVQPAWLKAGNMKAMLRGFLLDSLPVTGSRRRRRRDELRLHSAQAHAAVSVAQLAAAVAGIVSACDLRPAASASAGDRRLGTVLASAAALVATVCAEAAENSGANRGRVTSAVRTGLESRSSADLLTLTATAATCLRGAAALKQRAADLRGISTSTSTSTSSNAAMAMSVSAGIQKGTTLRVCLPCGSVRVRTVSVFPRRGDGAAVVLRLGKKRLHGAFATFKDYVVSAVGDGGGEAVVEGRPAFPVALITSEQGVTVQLLFEHQTHCKVWKAAIEGMLAERRSSSATTN

SEQ ID NO: 9691 - DNA, 2163 bp, Sorghum bicolor
  misc_feature: Ceres ANNOT ID no. 6104028
  misc_feature: Encodes the peptide sequence at SEQ ID NO 9692
atggcgctggcaatctccatggagggcatcgatgcgcgggcgcgggagctcggggtggacctctccgctgtcgatctggactccatcaccctcccggccggcgaggacttcggcatcctcagtgatgatgaggaggtacttcgtagtgaggatcctccagaacttgaaatgggtttatccaacattattgtcgtggacaacctgccagttgttcctccagaaaagtttgagaagcttgagaatgtcatacgcaagatctacagccaaattggtgtgataaaagaaaatggtctatggatgcctgtaaactcagagacaaagaagacatatggctactgtttcattgagtataatacccctcaggaagctgagctggctagggaaaaaaccaatgggtacaaactcgacaagtctcacatcttcgcagttaatttgcttgatgatttcgagaagtacatgaaagttcctgacacatggacccccgctgaaattaagccatacactgccggagaaaatcttctgaagtggctaactgatgaaaaggcccgagaccaatttgtcattcgtgctggcacactaactgaagtttattggaatgatgcaagaaagctagcacctgagcttgtgtttcaaaagcagtactggacagacagtttcatccagtggtcccctctgggaacgtacttggcaacggttcataggcagggatcacaggtgtggggtggtgaaaatggcttcgagcgtttgatgcgttttgctcatcccatggtgaaactgattgacttctctcctggcgagagatatttggtcacatacagcagccatgagcccagcaaccctagagacacacatagggttgtcctgaatatctttgatgtaaggactgggaaggttatgcgagactttaagggaagcgccgatgattatactactggtgggaatattggggtttctggtgtttcatggcctattttcaggtggggtggtggaaaggacgacaaatattttgcaaggcttgggaagaatataatatctgtctatgaaaccaatacattctcccttcttgataaaaagtctttgaaggtagaaaatgtagtggacttcagctggtctcccactgatcctatcatctctctgttcgtgcctgaaatgggtggtggaaatcagcctgcgagggtgagtctagtgcaaatccctggcaaagaggagctgcgacagaaaaatcttttcagtgtcagtgattgcaaaatgtattggcagaacagtggagaatatcttgctgttcaagttgatagatacacaaaaacaaaaaagagcacctacactgggtttgagctgtttagaattaaggagagggatatcccaattgaggtccttgaacttgagaacaagaatgacaagatcattgcatttgcatgggaacctaaaggacatcgctttgctatcattcatggtgatggccctaggcctgacgttagcttctacaccatgcgaacagcaaataacactaaccgtgtgtccaagctcacaacactcaaggccaagcaagctaatgctttgtactggtctcctgctgggcgcttcattgttcttgctggactgaagggtttcaacggacagctggaattctacaatgttgatgaactagagacaatggcaacaggagagcattttatggcaacggatattatgtgggatccaactgggagatatctcgcgactgcagttacctcagttcatgaaatggagaatggctttcaaatatggtcctttaatggcaagcatctttacaaggtgtcaaaggatcatttctatcagttcatatggcgcccgagaccaccctcactgctaagccctgagaaggaagaagagatctcaaggaacctgaagaagtacagcaaaaagtacgaacaagaggaccaggacgcgttcaaccagttgagcgagcaggaccggaagaggcggacacagcttcaggaagaatgggactcatgggttgccaagtggaagcagatgcatgaggaggagcgtgctttcaggatggagctcagggatggggaagccagtgacgaggaggaagagtacgaggccaaggaagttgaggtagaggaagttgttgatgtccgtcaggaagttcttgcattcgacctagatcaggagtga

SEQ ID NO: 9692 - protein, 720 aa, Sorghum bicolor
  misc_feature: Ceres ANNOT ID no. 6104028
  misc_feature (407)..(607): Pfam Id: eIF2A Pfam Desc: Eukaryotic translation initiation factor eIF2A
  misc_feature (63)..(142): Pfam Id: RRM_1 Pfam Desc: RNA recognition motif. (a.k.a. RRM, RBD, or RNP domain)
  misc_feature (1)..(713): NCBI GI: 92873280 NCBI Desc: translation initiation factor eif-3b [medicago truncatula]
  misc_feature (1)..(720): NCBI GI: 5911685 NCBI Desc: prt1 protein [nicotiana tabacum]
  misc_feature (10)..(713): NCBI GI: 20857380 NCBI Desc: at5g27640/f15a18_100 [arabidopsis thaliana]
  misc_feature (121)..(713): NCBI GI: 79328836 NCBI Desc: tif3b1 (eukaryotic translation initiation factor 3b); nucleic acid binding / translation initiation factor [arabidopsis thaliana]
  misc_feature (10)..(713): NCBI GI: 7689383 NCBI Desc: eif3b [arabidopsis thaliana]
MALAISMEGIDARARELGVDLSAVDLDSITLPAGEDFGILSDDEEVLRSEDPPELEMGLSNIIVVDNLPVVPPEKFEKLENVIRKIYSQIGVIKENGLWMPVNSETKKTYGYCFIEYNTPQEAELAREKTNGYKLDKSHIFAVNLLDDFEKYMKVPDTWTPAEIKPYTAGENLLKWLTDEKARDQFVIRAGTLTEVYWNDARKLAPELVFQKQYWTDSFIQWSPLGTYLATVHRQGSQVWGGENGFERLMRFAHPMVKLIDFSPGERYLVTYSSHEPSNPRDTHRVVLNIFDVRTGKVMRDFKGSADDYTTGGNIGVSGVSWPIFRWGGGKDDKYFARLGKNIISVYETNTFSLLDKKSLKVENVVDFSWSPTDPIISLFVPEMGGGNQPARVSLVQIPGKEELRQKNLFSVSDCKMYWQNSGEYLAVQVDRYTKTKKSTYTGFELFRIKERDIPIEVLELENKNDKIIAFAWEPKGHRFAIIHGDGPRPDVSFYTMRTANNTNRVSKLTTLKAKQANALYWSPAGRFIVLAGLKGFNGQLEFYNVDELETMATGEHFMATDIMWDPTGRYLATAVTSVHEMENGFQIWSFNGKHLYKVSKDHFYQFIWRPRPPSLLSPEKEEEISRNLKKYSKKYEQEDQDAFNQLSEQDRKRRTQLQEEWDSWVAKWKQMHEEERAFRMELRDGEASDEEEEYEAKEVEVEEVVDVRQEVLAFDLDQE

SEQ ID NO: 9693 - DNA, 840 bp, Sorghum bicolor
  misc_feature: Ceres ANNOT ID no. 6104037
  misc_feature: Encodes the peptide sequence at SEQ ID NO 9694
atggcggcgtgccggggcttcttcgagtgcctgctcaggctgctcaacttcatcctcaccgtcgccggcctcgccatggtcggctacgggatctacctgctcgtcgagtggacgaagatatccgaggacggcagcggcgggggattgacggcggaggtgctcgtctccgcccggccgttgttgggggctgtcgctctcggtgacagcttcctcgacgacctacccaaagcatggtttatttatttgttcattggtgttggtgctatcgtcttcctcgtgtctctgtttggctgcattggagcagggacaagaaacacatgctgtttgtgtttctatgctttcttggtcatattgttgatccttgctgaagctggagctgctgcattcattttctttgaccaaagctggaaagatgtaattccagtggacaagacacataactttgatgttatgtatgactttctgaaggaaaactgggagattgcaagatgggttgctcttggtgttgttgtttttgaggcagtgctctttctgttagctctggttgtcagggcaatgaacaaacctgctgagtatgacagtgacgatgaaattattgcaattggccgaagccctaccatgcggcagccactgatccatgcccaaaatgtgcctgccactggtgttcctgtcccaacactcgatcagcgtgcaagtagaaatgatgcctggagccaaaggatgcgagagaagtatggtctggacacgagccagttcacatacaacccttcagacccaagcaggtaccagcagaatggcacgccacaggctgaagaaaggagtcgatgcactataatgtga

SEQ ID NO: 9694 - protein, 279 aa, Sorghum bicolor
  misc_feature: Ceres ANNOT ID no. 6104037
  misc_feature (7)..(173): Pfam Id: Tetraspannin Pfam Desc: Tetraspanin family
  misc_feature (3)..(279): NCBI GI: 37806408 NCBI Desc: senescence-associated protein-like [oryza sativa (japonica cultivar-group)]
  misc_feature (1)..(279): NCBI GI: 140055385 NCBI Desc: cd9/cd37/cd63 antigen [medicago truncatula]
  misc_feature (112)..(279): NCBI GI: 8920615 NCBI Desc: contains similarity to gmfp4 from glycine max gbu64915. ests gbav442477, gbav441037, gbav534954, gbav560678 and gbav518757 come from this gene. [arabidopsis thaliana]
  misc_feature (3)..(279): NCBI GI: 37806153 NCBI Desc: senescence-associated protein-like [oryza sativa (japonica cultivar-group)]
  misc_feature (72)..(260): NCBI GI: 54291569 NCBI Desc: senescence-associated protein-like [oryza sativa (japonica cultivar-group)]
MAACRGFFECLLRLLNFILTVAGLAMVGYGIYLLVEWTKISEDGSGGGLTAEVLVSARPLLGAVALGDSFLDDLPKAWFIYLFIGVGAIVFLVSLFGCIGAGTRNTCCLCFYAFLVILLILAEAGAAAFIFFDQSWKDVIPVDKTHNFDVMYDFLKENWEIARWVALGVVVFEAVLFLLALVVRAMNKPAEYDSDDEIIAIGRSPTMRQPLIHAQNVPATGVPVPTLDQRASRNDAWSQRMREKYGLDTSQFTYNPSDPSRYQQNGTPQAEERSRCTIM

SEQ ID NO: 9695 - DNA, 1707 bp, Sorghum bicolor
  misc_feature: Ceres ANNOT ID no. 6104042
  misc_feature: Encodes the peptide sequence at SEQ ID NO 9696
atggcggccgcggcagagatcggtggtttcacagcggcgagagtggcggcggcggcggcgctcaggccggctgcgcacccagccccggcggcggcggcgccaccgcagcccaggagggctgtggcggcgcagtcgctgcggacgaccaccgccgaggtgctgacggcggatctcgccggcacgaccaacggcgcggtgcacgctcagatgaatagtgaggctactagtgaaatcacttcacaggcagttatttctaggaggaagacaaagatagtctgcaccataggtccctcaaccaacactcgtgagatgatttggaagcttgcagagactggaatgaatgtagcacgccttaatatgtcccatggtgaccaccagtcacaccagaaggttattgatttggtcaaggagtacaacacacagaacactgatggcaatgttattgccatcatgctggacactaagggtcctgaagttagaagtggggatgttccagagccaatcatgctcaaggaaggtcaagagttcaacttcacgattaaaagaggggtgagcactgaagacactgtcagtgtgaactatgatgacttcataaatgatgttgaagctggtgacatactgttagtggatggaggaatgatgtcgcttgctgtgaagtctaaaacagccgatacagtcaagtgtgaagtagttgacggtggggaattgaaatcaaggcgccacctaaatgtccgtggaaagagtgctactttgccatctatcactgagaaggattgggaagacataaaatttggtgtcgaaaacggtgttgatttctatgcagtttcctttgtgaaggatgccaaagttattcatgaattaaaggactaccttaaaggtgctaatgcggatatacatgtcattccaaaaattgaaagtgcagattcaataccaaatctgcagtccattattgctgcttcagatggggcaatggtagcacgtggagaccttggtgctgaacttcccattgaggacgttcctttgctacaggcagagattgttcaaacatgtcgaagcatggagaaaccagtcattgtcgctacaaatatgttggaaagcatgattgaccatcctactccaactagggcagaggtttctgacatagctattgcagtccgggaaggtgctgatgccatcatgttatctggcgaaactgctcatggaaagtacccactaaaggcagtcaaggtgatgcacactgtggcactcagaacagaatccagcctttataacccaactacttcccctagtcttgttgcatctgcacagggtctacagaatgaggagttttccccaagccagctaagtaaaatgtttggatctcatgcaacgatgatggcaaacacccttcgcacaccaatcattgtatttacacagaccggctccatggctgtcctcctgagccactatcggccctcgtctacactatttgcatttacaaacgaggaacgagtgaagcaacggctggcactctaccagggggtcatccctattcacatgcagttctctgacgacgcagaagaaactttctccagagcaattagcagcttgctgaaagcacaatatgtgaagaagggagactacgtcactcttgttcagagcggagtgacttccatctggagagaggaatctactcaccacatccaagtgaggaaagttcaggtctga

SEQ ID NO: 9696 - protein, 568 aa, Sorghum bicolor
  misc_feature: Ceres ANNOT ID no. 6104042
  misc_feature (86)..(428): Pfam Id: PK Pfam Desc: Pyruvate kinase, barrel domain
  misc_feature (453)..(557): Pfam Id: PK_C Pfam Desc: Pyruvate kinase, alpha/beta domain
  misc_feature (85)..(567): NCBI GI: 482938 NCBI Desc: pyruvate kinase; plastid isozyme [nicotiana tabacum]
  misc_feature (86)..(566): NCBI GI: 62320826 NCBI Desc: pyruvate kinase [arabidopsis thaliana]
  misc_feature (86)..(566): NCBI GI: 20147129 NCBI Desc: at5g52920/mxc20_15 [arabidopsis thaliana]
  misc_feature (85)..(568): NCBI GI: 8920620 NCBI Desc: strong similarity to a pyruvate kinase isozyme g, chloroplast precursor from nicotiana tabacum gbz28374. it contains a pyruvate kinase domain pf00224. est gbai996399 comes
  misc_feature (85)..(568): NCBI GI: 8920620 (continued) from this gene. [arabidopsis thaliana]
  misc_feature (69)..(566): NCBI GI: 92883864 NCBI Desc: pyruvate kinase [medicago truncatula]
  misc_feature (85)..(567): SWISSPROT Homolog: EC 2.7.1.40 Pyruvate kinase isozyme G, chloroplast precursor
MAAAAEIGGFTAARVAAAAALRPAAHPAPAAAAPPQPRRAVAAQSLRTTTAEVLTADLAGTTNGAVHAQMNSEATSEITSQAVISRRKTKIVCTIGPSTNTREMIWKLAETGMNVARLNMSHGDHQSHQKVIDLVKEYNTQNTDGNVIAIMLDTKGPEVRSGDVPEPIMLKEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVSFVKDAKVIHELKDYLKGANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEEFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 9697 - DNA, 1125 bp, Sorghum bicolor
  misc_feature: Ceres ANNOT ID no. 6104048
  misc_feature: Encodes the peptide sequence at SEQ ID NO 9698
atgacggcagcggcagcggaggtcgtgtcgcgccgcctgggcgcggctgtgcgtgacctctccggcacgtggtacgggcgccacatggccgcagccgagcgcgccatccgcgcgcgcctgcccctcgtcgacctcgtcctcgaggtccgcgacgcacgcgtgcccgcctcctcgtcgttcgagcctctccgccgccgccgcgggcctctggagccagaccgccgccgggtggtccttcttaacaaggcggacctggcagacccgtccgagactgaggagtgggtggcgtacatcaagaagcagacgagctgcccttgcgtcgcggtaaattctcacagcagggaaagcatcaaggagctattgaatgctgtgcaaacaagaatcaaggagatcaagaatggcgagaacaattgcacggcaactgccctcctggtcgggattccaaacgttgggaaatcggccattgttaatgcgatgcatcaaattgggaggattgcggcagcagagaagggaaaactgaagcatgcgattgtgagcagccatcctggagaaactagagacataagtggatacaaggttgctagtcatccgaatatatatgtgttggacactcctggtgtgctgtcaccaagatttgcaaatgatggttctggccccagactagctttgactggagctatcaaggactccttgttagaggagtatgatatcgtacagtttcttcttgcaattgtgaactcagggaaggaatataggaagtgggagaagttgaataaagcaggagatacattttcttgtggcaaaacaattacgtccaggggccacaacaatgaagggcaatatgcttcagatcacacacaggatttcgtcgtgaaagtagtccgccaagtgctttttgagactgtatcttgttttaatggcgatctaggacaggtggatgagttaagaagattgataggccaccaacttgtaaacttgcaggaggttttcaaggtctcgactgaatcaagtgaggatatgtgtaaacctatagctatgaaactactcaatctgtatcggacaggaaggcttggccattataccttagaacatgtcccagatgttaggcaggaagttgttgcataa

SEQ ID NO: 9698 - protein, 374 aa, Sorghum bicolor
  misc_feature: Ceres ANNOT ID no. 6104048
  misc_feature (140)..(261): Pfam Id: MMR_HSR1 Pfam Desc: GTPase of unknown function
  misc_feature (1)..(365): NCBI GI: 3600035 NCBI Desc: contains similarity to gtp-binding proteins [arabidopsis thaliana]
  misc_feature (5)..(367): NCBI GI: 62701701 NCBI Desc: short integuments 2 [oryza sativa (japonica cultivar-group)]
  misc_feature (24)..(295): NCBI GI: 4514314 NCBI Desc: ylqf [bacillus halodurans]
  misc_feature (24)..(240): NCBI GI: 94547935 NCBI Desc: gtp-binding protein [streptococcus pyogenes mgas10750]
  misc_feature (24)..(240): NCBI GI: 94990505 NCBI Desc: gtp-binding protein [streptococcus pyogenes mgas10270]
MTAAAAEVVSRRLGAAVRDLSGTWYGRHMAAAERAIRARLPLVDLVLEVRDARVPASSSFEPLRRRRGPLEPDRRRVVLLNKADLADPSETEEWVAYIKKQTSCPCVAVNSHSRESIKELLNAVQTRIKEIKNGENNCTATALLVGIPNVGKSAIVNAMHQIGRIAAAEKGKLKHAIVSSHPGETRDISGYKVASHPNIYVLDTPGVLSPRFANDGSGPRLALTGAIKDSLLEEYDIVQFLLAIVNSGKEYRKWEKLNKAGDTFSCGKTITSRGHNNEGQYASDHTQDFVVKVVRQVLFETVSCFNGDLGQVDELRRLIGHQLVNLQEVFKVSTESSEDMCKPIAMKLLNLYRTGRLGHYTLEHVPDVRQEVVA

SEQ ID NO: 9699 - DNA, 1401 bp, Sorghum bicolor
  misc_feature: Ceres ANNOT ID no. 6104061
  misc_feature: Encodes the peptide sequence at SEQ ID NO 9700
atggcgctcacctccgccaccaccgccgccgccacggtctcctctccctcccgaatcatccgccgcttcgcttcttctccagactctcgcgccccttcctcgctcctccgtctcgccccgcgccgaggagccgagaattccccgcgcgcctgtagctggcaccggctcgtggtggtgcgccggatggacggcagggcgcgagcgctcctcggcggactctcggacgccggaggcagtgagagcgacgaggaagaggaggaggaggagcacgccctgcgagggggccagcgggagggcgaggtcgacgacgccgtggcgctctccgcggcggccgtcgggccagagagatgggacgtgctgggcctcggccaggcgatggttgacttctcagggatggtggatgacgagttccttcagagattgagcatagagaagggcacgagaaaggtcataaaccatgaggagaggggacgggtcttgcgtgccatggatgggtgcagctacaaggctgcagctggaggctccctgtccaactcgctcgtggcgctggcaaggcttggtagtagccagtctgctggctaccctgagcttaaaattgctatggccggtagtgtgggcagtgacccactaggtagtttctacagggcgaagttgcgccgtgctaatgtgcacttcttgtctaagccggtcaaagatggaacaactggaactgtaattgttctaacaacgccggacgcacagcgaactatgcttgcgtatcagggtacttcgtcaactctgagttacgattcagacttggccagtttagtgtctaaatcaaatgtactaattgtggaaggttatctgtttgagctacctcatacaattgaagctatcaggcaagcgtgtgaagatgctcacaagaatggtgcactcattgctgttactgcatcagatgtatcttgcatcaagcgttgctacaatgacttccgggatattgtaggaaactatgcagatatactgttcgccaacgccaatgaagcaagggccttctgcgagctaccctcaacagagagccccatgtcagccacaagatacttaagccactcagttcccctagtatccgtgactgacggcatgcatggctcctacattggggtgaaaggtgaagcaatatacatccctccaccatcctgcatacccgtggacacttgtggcgctggcgacgcatatgcttctgggattctgtacggcatcctccggggtgcttctgacctgaaaggcataggactactggcctcgcgggtagctgctgttgtcgtcgggcagcaaggcacgcgcctgcgggttcaggatgccgacagactggctgaatcgtttgcgcatcacctggatagcttggagttctgctcagatgtttga

SEQ ID NO: 9700 - protein, 466 aa, Sorghum bicolor
  misc_feature: Ceres ANNOT ID no. 6104061
  misc_feature (150)..(446): Pfam Id: PfkB Pfam Desc: pfkB family carbohydrate kinase
  misc_feature (67)..(466): NCBI GI: 16974333 NCBI Desc: at4g27600/t29a15_90 [arabidopsis thaliana]
  misc_feature (67)..(466): NCBI GI: 7269614 NCBI Desc: carbohydrate kinase-like protein [arabidopsis thaliana]
  misc_feature (77)..(466): NCBI GI: 21595460 NCBI Desc: carbohydrate kinase-like protein [arabidopsis thaliana]
  misc_feature (115)..(444): NCBI GI: 116121586 NCBI Desc: sugar kinase [leptospira borgpetersenii serovar hardjo-bovis l550]
  misc_feature (115)..(444): NCBI GI: 116125440 NCBI Desc: sugar kinase [leptospira borgpetersenii serovar hardjo-bovis jb197]
  misc_feature: The sequence is a functional homolog of SEQ ID NO. 349 in the 11/188,298 US application
  misc_feature: The sequence is a functional homolog of SEQ ID NO. 302 in the 11/188,298 US application
MALTSATTAAATVSSPSRIIRRFASSPDSRAPSSLLRLAPRRGAENSPRACSWHRLVVVRRMDGRARALLGGLSDAGGSESDEEEEEEEHALRGGQREGEVDDAVALSAAAVGPERWDVLGLGQAMVDFSGMVDDEFLQRLSIEKGTRKVINHEERGRVLRAMDGCSYKAAAGGSLSNSLVALARLGSSQSAGYPELKIAMAGSVGSDPLGSFYRAKLRRANVHFLSKPVKDGTTGTVIVLTTPDAQRTMLAYQGTSSTLSYDSDLASLVSKSNVLIVEGYLFELPHTIEAIRQACEDAHKNGALIAVTASDVSCIKRCYNDFRDIVGNYADILFANANEARAFCELPSTESPMSATRYLSHSVPLVSVTDGMHGSYIGVKGEAIYIPPPSCIPVDTCGAGDAYASGILYGILRGASDLKGIGLLASRVAAVVVGQQGTRLRVQDADRLAESFAHHLDSLEFCSDV

SEQ ID NO: 9701 - DNA, 654 bp, Sorghum bicolor
  misc_feature: Ceres ANNOT ID no. 6104062
  misc_feature: Encodes the peptide sequence at SEQ ID NO 9702
atggtggtggccacggaggaaatggcggtctactgctttgacaccctcgtcgcccactacaccggcgagcagccgccgcctcccgccttcgaggatggaaaccacccattgtttgtgacctggaagaaggttgccaatggttcagaaccacgcctcaggggatgcataggaaccctggagccccgtcagattgtcagtggctttaaggactactccctaactagtgccctgagggaccgacgctttcccccaatacaatcaaaggaactcccaaccttggaatgcacagtatctatactcactgattatgaaattgcagagggctaccttgattgggaggttggaaagcatggtttaattatcgaatttacagatccagaatacaacataagacgcagtgcaacctatttgcctgaagttgcaggccatgaaggatggacacatgcagaaaccattgattcgctcatgaggaaggcaggttaccaaggtaccatcactgagtccttgaggaagaaaatcaaagtcacccgctaccagagcaccctgtgcaccatgcactatggtgaatatgttgcatacctcaagaagaatagaggtgcagccccgtcaattagtggggtgcctgcagttaatggcttcaagccaggtcattga

SEQ ID NO: 9702 - protein, 217 aa, Sorghum bicolor
  misc_feature: Ceres ANNOT ID no. 6104062
  misc_feature (4)..(187): Pfam Id: AMMECR1 Pfam Desc: AMMECR1
  misc_feature (2)..(193): NCBI GI: 45767818 NCBI Desc: zgc:66100 protein [danio rerio]
  misc_feature (2)..(193): NCBI GI: 41053750 NCBI Desc: similar to ammecr1 protein [danio rerio]
  misc_feature (2)..(192): NCBI GI: 23943793 NCBI Desc: riken cdna e230022h04 gene [mus musculus]
  misc_feature (2)..(193): NCBI GI: 57209219 NCBI Desc: alport syndrome, mental retardation, midface hypoplasia and elliptocytosis chromosomal region, gene 1 [homo sapiens]
  misc_feature (2)..(193): NCBI GI: 119623068 NCBI Desc: alport syndrome, mental retardation, midface hypoplasia and elliptocytosis chromosomal region, gene 1 [homo sapiens]
MVVATEEMAVYCFDTLVAHYTGEQPPPPAFEDGNHPLFVTWKKVANGSEPRLRGCIGTLEPRQIVSGFKDYSLTSALRDRRFPPIQSKELPTLECTVSILTDYEIAEGYLDWEVGKHGLIIEFTDPEYNIRRSATYLPEVAGHEGWTHAETIDSLMRKAGYQGTITESLRKKIKVTRYQSTLCTMHYGEYVAYLKKNRGAAPSISGVPAVNGFKPGH

SEQ ID NO: 9703 - DNA, 531 bp, Sorghum bicolor
  misc_feature: Ceres ANNOT ID no. 6104071
  misc_feature: Encodes the peptide sequence at SEQ ID NO 9704
atgttcacgaatgcgcagcgccaggtcgagcgcaccggccgttccggcactccgcgagatcagtaccttcaggatcttgtgacccagttccagagcgccacagatgaagaatctaaggagaagatagttgctaacttggcaaattttgcttatgacccttttaattatgccttcatgcgccagctgaatgttcttgagttattcttggactgcattacagagccaaatgaaaggcttgttgagtttggcattggtggaatatgcaactcctgtgttgatcctgcaaatgcttcaatcattactcagtgtggtggaatcccgttggttatacaatgcttatcaagcccagtgcggaatactgtgacttacgcacttggggctttgtattatctttgcaactctttgacaaagaaggagatcttgaaaccagatgtagttagaactataagagagtatgcctcagctggagctgtcaacaccagcttcagcaatctggcaaatgctttcctggagaaacatgttgatccatga

SEQ ID NO: 9704 - protein, 176 aa, Sorghum bicolor
  misc_feature: Ceres ANNOT ID no. 6104071
  misc_feature (93)..(133): Pfam Id: Arm Pfam Desc: Armadillo/beta-catenin-like repeat
  misc_feature (1)..(175): NCBI GI: 115485841 NCBI Desc: os11g0546200 [oryza sativa (japonica cultivar-group)]
  misc_feature (1)..(174): NCBI GI: 92875138 NCBI Desc: armadillo [medicago truncatula]
  misc_feature (19)..(173): NCBI GI: 49119318 NCBI Desc: mgc80851 protein [xenopus laevis]
  misc_feature (22)..(176): NCBI GI: 119609643 NCBI Desc: armadillo repeat containing 7, isoform cra_b [homo sapiens]
  misc_feature (3)..(76): NCBI GI: 76155848 NCBI Desc: sjchgc07140 protein [schistosoma japonicum]
MFTNAQRQVERTGRSGTPRDQYLQDLVTQFQSATDEESKEKIVANLANFAYDPFNYAFMRQLNVLELFLDCITEPNERLVEFGIGGICNSCVDPANASIITQCGGIPLVIQCLSSPVRNTVTYALGALYYLCNSLTKKEILKPDVVRTIREYASAGAVNTSFSNLANAFLEKHVDP

SEQ ID NO: 9705 - DNA, 1224 bp, Sorghum bicolor
  misc_feature: Ceres ANNOT ID no. 6104096
  misc_feature: Encodes the peptide sequence at SEQ ID NO 9706
atggcggcgacggaggccttggcagataagaacgccgtcttccgcaagctccgcgccaaatcggacaacaagatgtgcttcgattgcaacgccaagaacccgacgtgggcgtccgtcacctacggcgtcttcctctgcatcgactgctcagcggtgcaccgcagcctcggcgtccacgtctcctttgtcaggtcaacaaatttggattcgtggactccagaacagttgagaatgatggtctatggaggaaacaaccgtgcacaggctttctttaagcagcatggttggaccgatggtggaaagattgaagcaaagtatacttcaagagcagctgacttgtaccggcagttgcttgctaaagaggttgctaaaagctccacagaagatggcaacaatagttggccgtcttccccagttgcagtttcccagggtccaaatcaagctcctgcatttccagatctcaagctgacagaggtgtcaaaagaaaatgtaagtgaaaagaaagagcctgagattgttcgttcgcctagagctccaacccattctttcaagaagccgattggtgctaaaaagcctggaaataagactggtggacttggtgcgcggaagcttacatcaaagccaaatgaaagcctctatgagcagaagcccgaagaaccagctcccatcctgccatcggtgactgagagtactgcaactaggagcaaaccccatacttctcgatttgaatatgtagaaaatgcacctgccgctcctaagactggtagcagctcagaagacaaccacatgagtggacatgttgcacccccaaagtcgtcgaacttctttgctgaatttgggatggacagtggatatcacaaaaaatctacatccagctcatccaaagtgcagattgaggaaagcagtgaagcaagacagaaattctcgaatgcaaaatcaatttcatcctctcagttttttggtgatcaagccagttttgaaaaggacgctcaagtctctctccaaaagttttcaggttcttctgccatatcaagtgctgatctatttggccatccagcaaacaatcctagagtggatctcagtgcttcagatttgatcaacagaatttcattccaggccactcaggatctgtcttctctcaagaacatggcaggggaaacggggaaaaagttgacatcgatggcatccaacatcatcactgatcttcaggaccgcatcctctga

SEQ ID NO: 9706 - protein, 407 aa, Sorghum bicolor
  misc_feature: Ceres ANNOT ID no. 6104096
  misc_feature (11)..(127): Pfam Id: ArfGap Pfam Desc: Putative GTPase activating protein for Arf
  misc_feature (3)..(407): NCBI GI: 22136388 NCBI Desc: zinc finger protein glo3-like [arabidopsis thaliana]
  misc_feature (1)..(372): NCBI GI: 79325147 NCBI Desc: ubp20 (ubiquitin-specific protease 20); dna binding [arabidopsis thaliana]
  misc_feature (3)..(340): NCBI GI: 42571059 NCBI Desc: human rev interacting-like family protein / hrip family protein [arabidopsis thaliana]
  misc_feature (1)..(138): NCBI GI: 99028876 NCBI Desc: zinc finger protein 289, id1 regulated [gallus gallus]
  misc_feature (3)..(148): NCBI GI: 71535005 NCBI Desc: zinc finger glo3-like protein [medicago sativa]
  misc_feature: The sequence is a functional homolog of SEQ ID NO. 425 in the 11/188,298 US application
MAATEALADKNAVFRKLRAKSDNKMCFDCNAKNPTWASVTYGVFLCIDCSAVHRSLGVHVSFVRSTNLDSWTPEQLRMMVYGGNNRAQAFFKQHGWTDGGKIEAKYTSRAADLYRQLLAKEVAKSSTEDGNNSWPSSPVAVSQGPNQAPAFPDLKLTEVSKENVSEKKEPEIVRSPRAPTHSFKKPIGAKKPGNKTGGLGARKLTSKPNESLYEQKPEEPAPILPSVTESTATRSKPHTSRFEYVENAPAAPKTGSSSEDNHMSGHVAPPKSSNFFAEFGMDSGYHKKSTSSSSKVQIEESSEARQKFSNAKSISSSQFFGDQASFEKDAQVSLQKFSGSSAISSADLFGHPANNPRVDLSASDLINRISFQATQDLSSLKNMAGETGKKLTSMASNIITDLQDRIL

SEQ ID NO: 9707 - DNA, 1485 bp, Sorghum bicolor
  misc_feature: Ceres ANNOT ID no. 6104115
  misc_feature: Encodes the peptide sequence at SEQ ID NO 9708
atggatcgaatatcaagttccttactgtgtcaattgtggtgtctttccagcttggacgaaggcatcatcgaggctttattcggcactgcagcagcaaaccgcaagccgaaatctgcagacaccaaggaatccgctggatcgtcggcccttgggcgctcaaacacgccagagcaaatcttcctgctcgagccgcgcaagtcgcacaatatttccatcatcctcaagtccctcacggtggggcgggatgaaataatcgacgtcctccgggatgggcacacagaactcagcactgaggtcttggagaagctttcgcggctcaacatctctaaagaggaagagtccaccaacttgaagttctctgggaaccccgacaggcttgccccaacggaggccttcctcctccgcctcctccttgatgtgcccaatccaattgcgcgcgtcaatgcactgcttttcaaggttaactatggtgctgaggttgcccagctcaagcactcgcttcggacgttggaattggcaagccaggagctgaggacaaagggcctgttcttcaagctgctcgaggccgtgctcaaggcaggaaacaggatgaatgccggaacagcacgtggcaacgctcaggccttcaaccttacagcgctccgcaagctctctgacatgaagagcactgatgggagcaccacattgctgcacttcgtcgttgaggaggttgttcgctccgagggaaagcggcttgccatcaatcgtaaccacagcatccgccgctcaggcagtctcgcaaggtctggccacgagggaggcagttcagcagcaggctttgcaagccaggggccatcacgggaggaaagaatgaacgaatacatgaacttggggctaccaattgttggtggtctcagcacagagtttgccaacgtgaagagagccgcactggtcgactacgatgcagttgtcagcgagtgtgccattctagacagccgacttaatgagatcaagaagctcttggagacctgcattgacgatggatttgcgagggggttgcgaggatttgtgaaggctgcagaacaggagctgaaggcactaagaagggagcaggaaagaacaacagagtactaccatgctggtgccgccaaggaacggaacgcacatcccctccagctgttcatcgtagtgagggacttcttgggtatggttgatcaggcatgtgttgacatcaagaggaaagcgcaacagaagaaaccagcaccatcgtcatcgcagccaaacgcagcagctgctgcccccaaggtggcggctgcggctgcggccacaacagcggtgacagcgtcagtgacaaaggaagcgacccatggtcaagcagcaccaactcagaaaccacccgaagaggcagatagtaaaaggaagagggtcatgccaagatttccaaacctaccagcggacttcatgaaggatagtgcagattctgattcaagtagtgacgaggaatag

SEQ ID NO: 9708 - protein, 494 aa, Sorghum bicolor
  misc_feature: Ceres ANNOT ID no. 6104115
  misc_feature (2)..(398): Pfam Id: FH2 Pfam Desc: Formin Homology 2 Domain
  misc_feature (17)..(494): NCBI GI: 115448573 NCBI Desc: os02g0739100 [oryza sativa (japonica cultivar-group)]
  misc_feature (17)..(422): NCBI GI: 2194126 NCBI Desc: est gbt43335 comes from this gene. [arabidopsis thaliana]
  misc_feature (18)..(242): NCBI GI: 37694426 NCBI Desc: formin-like protein atfh6 [arabidopsis thaliana]
  misc_feature (19)..(421): NCBI GI: 115472635 NCBI Desc: os07g0545500 [oryza sativa (japonica cultivar-group)]
  misc_feature (18)..(406): NCBI GI: 92866950 NCBI Desc: actin-binding fh2 [medicago truncatula]
MDRISSSLLCQLWCLSSLDEGIIEALFGTAAANRKPKSADTKESAGSSALGRSNTPEQIFLLEPRKSHNISIILKSLTVGRDEIIDVLRDGHTELSTEVLEKLSRLNISKEEESTNLKFSGNPDRLAPTEAFLLRLLLDVPNPIARVNALLFKVNYGAEVAQLKHSLRTLELASQELRTKGLFFKLLEAVLKAGNRMNAGTARGNAQAFNLTALRKLSDMKSTDGSTTLLHFVVEEVVRSEGKRLAINRNHSIRRSGSLARSGHEGGSSAAGFASQGPSREERMNEYMNLGLPIVGGLSTEFANVKRAALVDYDAVVSECAILDSRLNEIKKLLETCIDDGFARGLRGFVKAAEQELKALRREQERTTEYYHAGAAKERNAHPLQLFIVVRDFLGMVDQACVDIKRKAQQKKPAPSSSQPNAAAAAPKVAAAAAATTAVTASVTKEATHGQAAPTQKPPEEADSKRKRVMPRFPNLPADFMKDSADSDSSSDEE

SEQ ID NO: 9709 - DNA, 1101 bp, Sorghum bicolor
  misc_feature: Ceres ANNOT ID no. 6104135
  misc_feature: Encodes the peptide sequence at SEQ ID NO 9710
atggctcccatcttcgccgcggcgtcccacgcgtccctcctccccctctcccacgtcgaccgccccgccgccggccgcctagtccgtggcactctcaggccccacacctcgggcctccgcttgcgccgccccccgggggcaaccgggcgcggccgcgggcgtggccgaggaggcatccccgacgagtggggcgagcgttcgccgccaggcgcccccgaggcccccgcgcagcccgatccgctcatcgacgacgaggacgactccgccgacggcaactcacgccctatcgtcgtcgacgagtggggcgagcccggggcgcccgagcccgagccgccctccgccgcggacccgcctagccccgccgcagacgacgagtgggaggaggagccagaggcgtcggtgccggacccgaccccggctccggcggcggcggaggaggacgagcaggcggtgaagagggaggagctcaagcgctgcttggtggacacggtgtacggctccgacctcggcttccgggcgtccacggaggtcagaggggaggtcgtcgagctagtcacccagctcgaggcggctaaccctactacggcatatacagcatattccgagcttctgcctattctagctgctggggcaacacctttggtcaaagtaaagcagatatcccaagaaattgactccaaaagcatgacgatagtcaatgcttcaacccttacgactccattcgcatcattttcattcagcgcaactgcctcttttgaggttcaaagtccgtcaagaatagaggtccaatttaaggaggggagctttcagcctccggtaatatcatcatctgtggatctacctcaacaaattgatatatttgggcagaagatcagcctggggccagtccagcaggcactgaatccattgcagcaagcatttgctagcattgcagggtccatttctgggcagccacccctcaaggtaccgattcccggcaacaacagagctcgatcctggctcttgactacctacctggacaaagacttaaggatctcgagaggtgatggaggcttgtttattcttgcgaaagaggggagccctttgctagatctattgtaa

SEQ ID NO: 9710 - protein, 366 aa, Sorghum bicolor
  misc_feature: Ceres ANNOT ID no. 6104135
  misc_feature (154)..(356): Pfam Id: PAP_fibrillin Pfam Desc: PAP_fibrillin
  misc_feature (3)..(366): NCBI GI: 62900689 NCBI Desc: probable plastid-lipid associated protein 3, chloroplast precursor
  misc_feature (57)..(365): NCBI GI: 62900702 NCBI Desc: plastid-lipid associated protein 3, chloroplast precursor
  misc_feature (57)..(365): NCBI GI: 14248558 NCBI Desc: plastid-lipid associated protein pap3 [brassica rapa]
  misc_feature (57)..(365): NCBI GI: 14248552 NCBI Desc: plastid-lipid associated protein pap3 [brassica rapa]
  misc_feature (3)..(293): NCBI GI: 115483624 NCBI Desc: os10g0575700 [oryza sativa (japonica cultivar-group)]
  misc_feature: Abnormal phyllotaxy, leaf number higher than wild-type
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: Useful for making plants with modulated nitrogen use efficiency
  misc_feature: GREAT-hit functional homolog of the protein sequence given in SEQ ID NO 13148
  misc_feature: GREAT-hit functional homolog of the protein sequence given in SEQ ID NO 13149
  misc_feature: Useful for making plants with modulated nitrogen use efficiency
  misc_feature: Functional homolog of the protein sequence given in SEQ ID NO 13149
MAPIFAAASHASLLPLSHVDRPAAGRLVRGTLRPHTSGLRLRRPPGATGRGRGRGRGGIPDEWGERSPPGAPEAPAQPDPLIDDEDDSADGNSRPIVVDEWGEPGAPEPEPPSAADPPSPAADDEWEEEPEASVPDPTPAPAAAEEDEQAVKREELKRCLVDTVYGSDLGFRASTEVRGEVVELVTQLEAANPTTAYTAYSELLPILAAGATPLVKVKQISQEIDSKSMTIVNASTLTTPFASFSFSATASFEVQSPSRIEVQFKEGSFQPPVISSSVDLPQQIDIFGQKISLGPVQQALNPLQQAFASIAGSISGQPPLKVPIPGNNRARSWLLTTYLDKDLRISRGDGGLFILAKEGSPLLDLL

SEQ ID NO: 9711 - DNA, 987 bp, Sorghum bicolor
  misc_feature: Ceres ANNOT ID no. 6104185
  misc_feature: Encodes the peptide sequence at SEQ ID NO 9712
atgtgggtggagatcctgtgcggcctcttggcctacaagatcatccaacgcgtcttcttcgccggcggcgacgacgcttcctacctcgccgacctcgactcctcccactccgacctatgcttcgccgtcgcctccaggctcgagaagctctacgccggccgatgcttcgttggtctccgcatccccgaccccgacgccggcgagcgccagcatattgacgttgtcctcgttaccaagagggaggtgatggtggtagcgatcaagaacttctctggttttgttgaggctgacaaggatggaaattggtcttgcccaactgacaagaagcgtaagcaagagatatttccgaaccctgtattagaagttaacagactagttgctagtcttcaatcatacttggagcaaaggggagcaaaattgcctgatgggcatatcgtcgggagagttgttctgccaaaccccaattgcaggccttcgtatactataagcatccaaccagaggtcatgttgtatgagcaatggaaggatctcaagacagactcaaagagtggactctcagcatggattaaaggtgcatttactggaagcaaaagtgacatgcaagattcagtactccagaatctacattttattctcagctcatcgcctatgtgggacaggttggaactcagaggagacaaaaatgttcttggtgaattcattgagttcaaaggaaggcatgaggacattcaacttctcaaaaatctcaagaggtcaaaagtcagtcgattcgtcatccagaagtcaactctttttggtggtttcggcaggtcacgagttcaaatattgtattctcctcgtgattatcgagctgaggggacttcatcttcagagtggaaagagatttctgtgaagcaatatacagagattgttttccagccactgcattccaaaaaggctcggaagttcaagctgtccagtgttgtttctgtcacactgagtgcctag

SEQ ID NO: 9712 - protein, 328 aa, Sorghum bicolor
  misc_feature: Ceres ANNOT ID no. 6104185
  misc_feature (30)..(158): Pfam Id: NERD Pfam Desc: Nuclease-related domain
  misc_feature (1)..(328): NCBI GI: 92899417 NCBI Desc: nerd [medicago truncatula]
  misc_feature (1)..(266): NCBI GI: 6227000 NCBI Desc: est gbai998705 comes from this gene. [arabidopsis thaliana]
MWVEILCGLLAYKIIQRVFFAGGDDASYLADLDSSHSDLCFAVASRLEKLYAGRCFVGLRIPDPDAGERQHIDVVLVTKREVMVVAIKNFSGFVEADKDGNWSCPTDKKRKQEIFPNPVLEVNRLVASLQSYLEQRGAKLPDGHIVGRVVLPNPNCRPSYTISIQPEVMLYEQWKDLKTDSKSGLSAWIKGAFTGSKSDMQDSVLQNLHFILSSSPMWDRLELRGDKNVLGEFIEFKGRHEDIQLLKNLKRSKVSRFVIQKSTLFGGFGRSRVQILYSPRDYRAEGTSSSEWKEISVKQYTEIVFQPLHSKKARKFKLSSVVSVTLSA

SEQ ID NO: 9713 - DNA, 1200 bp, Sorghum bicolor
  misc_feature: Ceres ANNOT ID no. 6104224
  misc_feature: Encodes the peptide sequence at SEQ ID NO 9714
atgggcgacaatctgatggataaagtcaacgcccttggtgagcggctcaagataggcagtgcagaagttagccgcaagatgtcagttggcgtcagcaacatgagtttcaagatgaaggagttcttccagggccagaacatggcggacaagattgttgatgaagccacgttggagaccatggacacccctgattgggctaccaaccttgagatatgcgacatggtgaacactgacagggtcaacagcattgaagtcatccgggccgtcaagagaagaattatgttgaagaatccacgcgtgcagtatctatctctcgtcctgcttgagaccattgttaagaactgcgacaaggctttctctgagattgctgctgagcgggtgctggatgagatggtcaagctgattgatgatccacagactatagttaacaacagaaacaaggctcttatgcttattgaagcatggggagaatctggagatgacctccgctaccttccagtgtatgaagaaacgtacaagagcttaagatctagaggaattcgctttcctgggcgtgatgatgagagcctagcaccaatatttactcctccccgttcagtacctgcggctgaaccatattctgaggtagcacaagaaggatatcaggaaattccagatgagaattttgctcctgctccaactcgcacttcccctgctgtgcaagtaaatgaggcttttgaggtggctcgtaatagtgtcgagcttctttgcacagtgttatcttcctctcctcaaaaagaggttttacaggatgaattggcaaccactctcgttcaacaatgccaacaatgtcagtacacgatccagaggatcatcgagacggctggtgataatgaggctcaactttttgaggcattgagcattcacgaggaactgcagaaggtcctgtccaagtatgaaaagctcaaggagcctgtctgtgttgagctagagcccgagccagcgatgattccagttaccgtggagcccgaggaatccccccgcactgtgagcaaagaagacgcccatgtaaggaaaccaggaggttctggagatcagtccagtcgggatgacctgctgcaggatctagatgacatgatatttggtaagaaaggtgctacatcctctcatcaggacacaactcccagaaaggataacaaggacgatttcatcagcttctaa

SEQ ID NO: 9714 - protein, 399 aa, Sorghum bicolor
  misc_feature: Ceres ANNOT ID no. 6104224
  misc_feature (46)..(179): Pfam Id: VHS Pfam Desc: VHS domain
  misc_feature (227)..(328): Pfam Id: GAT Pfam Desc: GAT domain
  misc_feature (1)..(399): NCBI GI: 21537352 NCBI Desc: tom (target of myb1)-like protein [arabidopsis thaliana]
  misc_feature (1)..(290): NCBI GI: 30686081 NCBI Desc: vhs domain-containing protein / gat domain-containing protein [arabidopsis thaliana]
  misc_feature (1)..(192): NCBI GI: 115483652 NCBI Desc: os10g0578000 [oryza sativa (japonica cultivar-group)]
  misc_feature (6)..(364): NCBI GI: 23308355 NCBI Desc: at1g06210/f9p14_4 [arabidopsis thaliana]
  misc_feature (6)..(270): NCBI GI: 42571359 NCBI Desc: vhs domain-containing protein / gat domain-containing protein [arabidopsis thaliana]
MGDNLMDKVNALGERLKIGSAEVSRKMSVGVSNMSFKMKEFFQGQNMADKIVDEATLETMDTPDWATNLEICDMVNTDRVNSIEVIRAVKRRIMLKNPRVQYLSLVLLETIVKNCDKAFSEIAAERVLDEMVKLIDDPQTIVNNRNKALMLIEAWGESGDDLRYLPVYEETYKSLRSRGIRFPGRDDESLAPIFTPPRSVPAAEPYSEVAQEGYQEIPDENFAPAPTRTSPAVQVNEAFEVARNSVELLCTVLSSSPQKEVLQDELATTLVQQCQQCQYTIQRIIETAGDNEAQLFEALSIHEELQKVLSKYEKLKEPVCVELEPEPAMIPVTVEPEESPRTVSKEDAHVRKPGGSGDQSSRDDLLQDLDDMIFGKKGATSSHQDTTPRKDNKDDFISF

SEQ ID NO: 9715 - DNA, 1158 bp, Sorghum bicolor
  misc_feature: Ceres ANNOT ID no. 6104227
  misc_feature: Encodes the peptide sequence at SEQ ID NO 9716
atggcgctgcagtacgtggaggcgcagcggcaggcgcgcccggacctcgccgactggtacgcctccctcgccgacctctaccagcggaagctatggcaccagctcaccctcaagctcgaccaattcctacagctccaggccgcacagaccggagacactatcattcagctctacaacaatttcatcaccgactttgagaccaagattaatctgctcaagcttgcccattttgcggtgatagcttctcgccagtaccctgataaggatgctgcaattactttcttagagggggtgatcacaaagctgcgtgagactagagagtcgcggattaatgaaccaattctctatgtgaagatgcaaattgcagctattaatcttgagaaaggaaaccaaaaggagtgcaaaaatttgttggacgatgggaaaaccactctggatagtatgactgatgtcgatcccacagttcatgctagcttttactggatatcatctcaataccacaaggcccgccaagaatttgcagagttctataagaacgctcttctctatctggcctacacaactgtggagtctctatctgagtcattcaagctagacttggcttttgatctttctctagcagcgttgttgggtgataacatttacaactttggggagttgttagctcacccaattatcaatagtcttattggaaccaaggtggagtgggtttatcatatgttacaagcattcaacaccggcaaccttgctctctaccaagaactttgcagggttcacaatgctgctcttactgcacaaccagctttggtgcagaatgagcggaagctgcttgagaaaatcaatattctttgtctgatggagataatctttagccggccatctgaagatagaactattccattaagtgttattgccgagcggactaagctttcaatcagtgacgtggagtatcttcttatgaagagcctctcggttcatcttattgagggaataattgatgaagtggacagtacagttcatgtctcgtgggtccagcccagagtgcttggaattccacaggttaaggctttgcgcgaccgcctggatgcctgggttggaaaggtgcataccacattgctttcagttgaggcggaaacccctgatcttgttgctgcgtaa

SEQ ID NO: 9716 - protein, 385 aa, Sorghum bicolor
  misc_feature: Ceres ANNOT ID no. 6104227
  misc_feature (235)..(343): Pfam Id: PCI Pfam Desc: PCI domain
  misc_feature (27)..(385): NCBI GI: 78059502 NCBI Desc: rpn9 [nicotiana benthamiana]
  misc_feature (105)..(385): NCBI GI: 17298163 NCBI Desc: 26s proteasome regulatory particle non-atpase subunit9b [oryza sativa (japonica cultivar-group)]
  misc_feature (2)..(324): NCBI GI: 9758666 NCBI Desc: 26s proteasome subunit-like protein [arabidopsis thaliana]
  misc_feature (7)..(383): NCBI GI: 37681915 NCBI Desc: proteasome 26s subunit, non-atpase, 13 [danio rerio]
  misc_feature (7)..(383): NCBI GI: 41055644 NCBI Desc: similar to proteasome (prosome, macropain) 26s subunit, non-atpase, 13 [danio rerio]
MALQYVEAQRQARPDLADWYASLADLYQRKLWHQLTLKLDQFLQLQAAQTGDTIIQLYNNFITDFETKINLLKLAHFAVIASRQYPDKDAAITFLEGVITKLRETRESRINEPILYVKMQIAAINLEKGNQKECKNLLDDGKTTLDSMTDVDPTVHASFYWISSQYHKARQEFAEFYKNALLYLAYTTVESLSESFKLDLAFDLSLAALLGDNIYNFGELLAHPIINSLIGTKVEWVYHMLQAFNTGNLALYQELCRVHNAALTAQPALVQNERKLLEKINILCLMEIIFSRPSEDRTIPLSVIAERTKLSISDVEYLLMKSLSVHLIEGIIDEVDSTVHVSWVQPRVLGIPQVKALRDRLDAWVGKVHTTLLSVEAETPDLVAA

SEQ ID NO: 9717 - DNA, 891 bp, Sorghum bicolor
  misc_feature: Ceres ANNOT ID no. 6104237
  misc_feature: Encodes the peptide sequence at SEQ ID NO 9718
atggcgcgcgtctccaatgccaagaagcggcacggcgccaagcccgccgccgcctccgcgggcctcagcggcaccaacaacagctccgccaccgccaccaccaagaggaaggccgaggacgaccgccccgtgcgcgtctacgccgacggcatcttcgatctcttccacttcggccacgcccgcgccctcgagcaggccaagttgctgttccccaacacctatctcctcgtcggatgctgcaacgacgagctaaccaaccgctacaagggcaagaccgtcatgacacaggaagagcgatacgagtccctgcgacactgcaagtgggttgatgaggtcattcctgatgcaccgtgggttctcacacaggagtttattgataagcatcagattgactatgttgctcatgatgcgctgccttatgctgatactagcggagcagcaaatgatgtctatgaatttgttaaaaagattggaaaattcaaggaaacaaaaaggacagacggggtttctacttcagatctcataatgaggatcttgaaggactataatcagtatgtcatgaggaatttagcacggggctactcgaggaaggatcttggtgtgagctacgtcaaggagaaacaattgcaagttaatatgaagatcaataaactgcgggagactgtgaaggcgcatcaggagaagttgcaaacagtggcaaagactgctggtttgaatcatgaagaatggcttgctaatgcggaccgctgggttgctggtttcctggagaagtttgagcaacactgccacaacatggagactgccatcaaggatcagatacaagtgaggctggggagacagttgagcaaaggaataatcgctggtcttgtgcaggaatcggtgacagcctaa

SEQ ID NO: 9718 - protein, 296 aa, Sorghum bicolor
  misc_feature: Ceres ANNOT ID no. 6104237
  misc_feature (47)..(177): Pfam Id: CTP_transf_2 Pfam Desc: Cytidylyltransferase
  misc_feature (38)..(283): NCBI GI: 21668500 NCBI Desc: ctp:phosphorylcholine cytidylyltransferase [arabidopsis thaliana]
  misc_feature (22)..(286): NCBI GI: 1416514 NCBI Desc: ctp:phosphocholine cytidylyltransferase [brassica napus]
  misc_feature (13)..(283): NCBI GI: 1418127 NCBI Desc: ctp:phosphocholine cytidylyltransferase [brassica napus]
  misc_feature (39)..(286): NCBI GI: 1657382 NCBI Desc: cholinephosphate cytidylyltransferase [pisum sativum]
  misc_feature (39)..(286): NCBI GI: 140043931 NCBI Desc: cytidylyltransferase [medicago truncatula]
  misc_feature (41)..(281): SWISSPROT Homolog: EC 2.7.7.15 Choline-phosphate cytidylyltransferase B
MARVSNAKKRHGAKPAAASAGLSGTNNSSATATTKRKAEDDRPVRVYADGIFDLFHFGHARALEQAKLLFPNTYLLVGCCNDELTNRYKGKTVMTQEERYESLRHCKWVDEVIPDAPWVLTQEFIDKHQIDYVAHDALPYADTSGAANDVYEFVKKIGKFKETKRTDGVSTSDLIMRILKDYNQYVMRNLARGYSRKDLGVSYVKEKQLQVNMKINKLRETVKAHQEKLQTVAKTAGLNHEEWLANADRWVAGFLEKFEQHCHNMETAIKDQIQVRLGRQLSKGIIAGLVQESVTA

SEQ ID NO: 9719 - DNA, 456 bp, Sorghum bicolor
  misc_feature: Ceres ANNOT ID no. 6104244
  misc_feature: Encodes the peptide sequence at SEQ ID NO 9720
atggcggcggtggtgcgcggcgtcttgaggggcatcaaggagaagggactcaccaacttcatccgcgatgcccgcgacgaaggatacttcaaatgccttctggatgggaaccttttgcaaacgaaaattcacaatattggcgcaacacttgtaggagttgacaagtttggaaacaaatactatgagaaactacatgacactcagtatggaaggcataggtgggtagaatatgcagagaaaggtcgttacaatgcatcccaagtgcctcctgaatggcatggatggctgcaccacctgctgaaccagaagactgctaggtaccttgtagagcacaagcagaactactccggtgagggtgaagagctgatctaccactccaaggggcatgctttgaatccggggcaaagggactggacgaggtatcagccctgggagccaaagaaagagcaagcctag

SEQ ID NO: 9720 - protein, 151 aa, Sorghum bicolor
  misc_feature: Ceres ANNOT ID no. 6104244
  misc_feature (48)..(146): Pfam Id: NDUFA12 Pfam Desc: NADH ubiquinone oxidoreductase subunit NDUFA12
  misc_feature (4)..(150): NCBI GI: 79312708 NCBI Desc: nadh dehydrogenase (ubiquinone)/ electron transporter/ oxidoreductase [arabidopsis thaliana]
  misc_feature (31)..(151): NCBI GI: 34334022 NCBI Desc: nadh:ubiquinone oxidoreductase b17.2-like subunit [chlamydomonas reinhardtii]
  misc_feature (17)..(150): NCBI GI: 24581165 NCBI Desc: cg3214-pa [drosophila melanogaster]
  misc_feature (46)..(150): NCBI GI: 21429922 NCBI Desc: gh12382p [drosophila melanogaster]
  misc_feature (46)..(150): NCBI GI: 38048633 NCBI Desc: similar to drosophila melanogaster cg3214 [drosophila yakuba]
MAAVVRGVLRGIKEKGLTNFIRDARDEGYFKCLLDGNLLQTKIHNIGATLVGVDKFGNKYYEKLHDTQYGRHRWVEYAEKGRYNASQVPPEWHGWLHHLLNQKTARYLVEHKQNYSGEGEELIYHSKGHALNPGQRDWTRYQPWEPKKEQA

SEQ ID NO: 9721 - DNA, 495 bp, Sorghum bicolor
  misc_feature: Ceres ANNOT ID no. 6104262
  misc_feature: Encodes the peptide sequence at SEQ ID NO 9722
atgcggcggtggtggtgcgccgccggcggcctcggccgccgcgtcctctcgtcctccacccccgccgtcgcctcccatgcccgtccgctgccgctacccctgatacccaaatctccctcctttaccgtccctttctccttgtcctgtcgcaggcaccactctctccaggggttctttcacccggccatcgcttcttctcccttccgccctccgtcggcgcatcatcagcaagtgcggcactacgccaagaaggagagatcgcgcgcgccgctcacgcccaccaaatccaaagtcaagaaatacaagatcaaggccccctcgtccatgaagtttagattcagaaccatgaaagacggacaggtccgcaggtggagggccggcaagcgccacaatgcacacctcaagtctaaggaggccaaacgaagacttcggaaacctgctttggtgcatttggcctatgcaaaagttataaagaagctcaacttctgtgggtag

SEQ ID NO: 9722 - protein, 164 aa, Sorghum bicolor
  misc_feature: Ceres ANNOT ID no. 6104262
  misc_feature (103)..(161): Pfam Id: Ribosomal_L35p Pfam Desc: Ribosomal protein L35
  misc_feature (6)..(163): NCBI GI: 115483676 NCBI Desc: os10g0579500 [oryza sativa (japonica cultivar-group)]
  misc_feature (100)..(160): NCBI GI: 22096085 NCBI Desc: 50s ribosomal protein l35
  misc_feature (100)..(160): NCBI GI: 20808118 NCBI Desc: ribosomal protein l35 [thermoanaerobacter tengcongensis]
  misc_feature (102)..(160): NCBI GI: 125973739 NCBI Desc: ribosomal protein l35 [clostridium thermocellum atcc 27405]
  misc_feature (102)..(160): NCBI GI: 31541407 NCBI Desc: rpmi [mycoplasma gallisepticum r]
MRRWWCAAGGLGRRVLSSSTPAVASHARPLPLPLIPKSPSFTVPFSLSCRRHHSLQGFFHPAIASSPFRPPSAHHQQVRHYAKKERSRAPLTPTKSKVKKYKIKAPSSMKFRFRTMKDGQVRRWRAGKRHNAHLKSKEAKRRLRKPALVHLAYAKVIKKLNFCG

SEQ ID NO: 9723 - DNA, 870 bp, Sorghum bicolor
  misc_feature: Ceres ANNOT ID no. 6104290
  misc_feature: Encodes the peptide sequence at SEQ ID NO 9724
atggcggccgggagtgccagtgccacggcgtctctctccgtggcggcggcagcggctgctgctctgcgcgtcaggcggccatgcgctcgcgctcgcgcttgggccccctcgcagcggccgcagcaaggggcactcctcagcctcaagccttgcgcctcactggcaccacacgcgcctctgtggcgggcggagtcggatgccgcgggcggtggtgccggcgccggcgacgtcatgggcctccttctccgggagcgcatagtcttcctcggcaacgagatcgaggacttcctcgcggacgccgtcgtcagccagctcctcctcctcgacgccatcgatccggactctgacatccgcctcttcgtcaactcaccaggggggtccctcagtgcaacaatggccatctatgatgtaatgcagcttgtgagggcggatgtctccactattggaatgggcatagctggatcaacagcttctataatccttggtggtggcacgaagggcaagcgatttgccatgcccaacaccaggattatgatccatcagcctgtcggaggtgcaagtgggcaggccctagatgtagaggtccaagcgaaggagatattgacgaacaagaggaatgtcattcggatcgtgtcaggcttcacgggccgcactctggagcaggtagagaaagatattgacagagatcgttacatgggccctcttgaggctgttgattatggacttattgatggtgtgatcgatggagacagtatcatcccacttgagcctgtcccagagagggtgaagcctaagtataactatgaagagctgtacaaggacccacagaagtttcttacaccagatgtcccagatgatgagatatactag

SEQ ID NO: 9724 - protein, 289 aa, Sorghum bicolor
  misc_feature: Ceres ANNOT ID no. 6104290
  misc_feature (69)..(250): Pfam Id: CLP_protease Pfam Desc: Clp protease
  misc_feature (6)..(289): NCBI GI: 5360593 NCBI Desc: nclpp4 [arabidopsis thaliana]
  misc_feature (73)..(289): NCBI GI: 30023792 NCBI Desc: at5g45390 [arabidopsis thaliana]
  misc_feature (73)..(289): NCBI GI: 4454056 NCBI Desc: clpp [arabidopsis thaliana]
  misc_feature (73)..(289): NCBI GI: 21593305 NCBI Desc: atp-dependent clp protease proteolytic subunit (clpp4) [arabidopsis thaliana]
  misc_feature (73)..(289): NCBI GI: 9758729 NCBI Desc: atp-dependent clp protease-like protein [arabidopsis thaliana]
  misc_feature (66)..(256): SWISSPROT Homolog: EC 3.4.21.92 ATP-dependent Clp protease proteolytic subunit 1
MAAGSASATASLSVAAAAAAALRVRRPCARARAWAPSQRPQQGALLSLKPCASLAPHAPLWRAESDAAGGGAGAGDVMGLLLRERIVFLGNEIEDFLADAVVSQLLLLDAIDPDSDIRLFVNSPGGSLSATMAIYDVMQLVRADVSTIGMGIAGSTASIILGGGTKGKRFAMPNTRIMIHQPVGGASGQALDVEVQAKEILTNKRNVIRIVSGFTGRTLEQVEKDIDRDRYMGPLEAVDYGLIDGVIDGDSIIPLEPVPERVKPKYNYEELYKDPQKFLTPDVPDDEIY

SEQ ID NO: 9725 - DNA, 1074 bp, Sorghum bicolor
  misc_feature: Ceres ANNOT ID no. 6104438
  misc_feature: Encodes the peptide sequence at SEQ ID NO 9726
atgagggtgcacggggaggtgtcggacgatgaggctggggccgcggcggcggctgtgactgtggtcggggagacggtggtgccttcgtccccgccgcccgcctccgctgcggggcagcagcagcagcagccgcagcagctggtggtggggtacgctctcaccaagaagaaggtcaagagctttctgcagcccaaactgctcgcgctcgccaggaagaaaggcattcatttcgtatcaattgatgaaacgtgccctctctctgaacaaggtccatttgacatcattttgcacaagcttactagtaaggagtggcagcaagttttggaggattatcgtgaagagcacccagaagtgactgtccttgacccaccaaatgctatccaacatttgcacaatcgccaatcaatgctacaagaagttgctgatttgaacttgtccgatggttatggtgaggtttgcgctccacgacaactagtcatcatgaaagatccatcttctatacctgatgcagttgctaaggctggactaagcttgcctttggttgccaaaccattggtcgctgatggaacatcaaaatctcatgagctatcccttgcgtatgtggaagcatcgttgcctttgcttgatcctcctttggttctccaggaatttgtcaatcatggtgggatcctatttaaggtatatattgttggtgaaacaatacaggttgtccgcaggttttcacttcctgatgtcaacacatatgacttgggaaacaatgatggcatctttagattcccaagagtttcatgtgctacaaataatgcagaagatgcagatgttgacccttgtattgcagaacttcctccaaagccacttctagagaaacttggcaaggagcttcgacgccgactgggtcttagactgtttaacatagatattattagagaacatggaagaaaggatcggtactatgtcattgacatcaactattttcctgggtatggcaagatgccaggatatgagcacatatttactgacttcctgctaagcctcgtgcaaagcaaatacaagaggcatctaagtgggagctga

SEQ ID NO: 9726 - protein, 357 aa, Sorghum bicolor
  misc_feature: Ceres ANNOT ID no. 6104438
  misc_feature (40)..(344): Pfam Id: Ins134_P3_kin Pfam Desc: Inositol 1, 3, 4-trisphosphate 5/6-kinase
  misc_feature (1)..(357): NCBI GI: 78707605 NCBI Desc: inositol 1, 3, 4-trisphosphate 5/6-kinase [oryza sativa (japonica cultivar-group)]
  misc_feature (1)..(356): NCBI GI: 33303695 NCBI Desc: inositol 1,3,4-trisphosphate 5/6-kinase [oryza sativa]
  misc_feature (24)..(352): NCBI GI: 16323320 NCBI Desc: at4g08170/t12g13_10 [arabidopsis thaliana]
  misc_feature (42)..(352): NCBI GI: 42567363 NCBI Desc: inositol 1,3,4-trisphosphate 5/6-kinase family protein [arabidopsis thaliana]
  misc_feature (24)..(327): NCBI GI: 7267457 NCBI Desc: inositol 1, 3, 4-trisphosphate 5/6-kinase-like protein [arabidopsis thaliana]
MRVHGEVSDDEAGAAAAAVTVVGETVVPSSPPPASAAGQQQQQPQQLVVGYALTKKKVKSFLQPKLLALARKKGIHFVSIDETCPLSEQGPFDIILHKLTSKEWQQVLEDYREEHPEVTVLDPPNAIQHLHNRQSMLQEVADLNLSDGYGEVCAPRQLVIMKDPSSIPDAVAKAGLSLPLVAKPLVADGTSKSHELSLAYVEASLPLLDPPLVLQEFVNHGGILFKVYIVGETIQVVRRFSLPDVNTYDLGNNDGIFRFPRVSCATNNAEDADVDPCIAELPPKPLLEKLGKELRRRLGLRLFNIDIIREHGRKDRYYVIDINYFPGYGKMPGYEHIFTDFLLSLVQSKYKRHLSGS

SEQ ID NO: 9727 - DNA, 1851 bp, Sorghum bicolor
  misc_feature: Ceres ANNOT ID no. 6104464
  misc_feature: Encodes the peptide sequence at SEQ ID NO 9728
atgagggggagaaatgactcggggcacagcaagaggccggttgtgctgtgctgtgtgatgattgtgtgcctatgcctcctcttcttgtatttctcgggctccaaaggacaggctgggaccactgcatttgagtacgggaccaaattctcaaggtcacttggatggggcagtgatgatggagacgatggctctgaagagtccatttttggaactggggatgcagatgatgtcaagcccaagagctttcctgtgtgtgatgaccggcactctgagctgatcccctgcttggataggaacttgatatatcaaatgaggctgaagctggatttaaacctgatggagcactatgagaggcattgccctccaccggaaaggcgttttaattgcttgattcctccaccacatggctataaggttcctataaaatggccaaaaagtcgtgatgtagtgtggaaagcaaacattccacacactcaccttgcaaaagagaagtcagaccagaattggatggttgaagccggtgaaaagatcaagtttccaggtggtgggacccattttcaccatggagctgacaaatatatatcaaatattgcaaatatgctaaatttcaaagataacaatataaacaatgaggggatgcttcgtacagttcttgatgttggttgtggagttgctagttttggaggatacctactttcttctaatgtgatagcaatgtctttggcaccaaacgatgtgcatcagaatcagattcagtttgcacttgaaagagggatccctgcatatcttggtgttttgggaacaaaaaggcttccgtacccaagtagatcatttgaactagcccattgttcacgttgtaggatcgactggcttcaaagagatggaattcttctgcttgaactagacagattgctacgacctggaggttattttgcttactcctctcctgaagcatatgcacaggatgaggaggatctccgaatctggaaagaaatgagtgcccttgtggaaaggatgtgctggaaaattgcagagaaaagaaaccaaactgttatttgggtgaaacctctgaacaatgattgttacaagagacgagcacatggtacaaagccacctctatgcaaaagtggtgatgatccagattcagtatggggagtgccaatggaagcttgcattactccatatcctgaacaaatgcacagagatgggggaactgggctagctccctggcctgctcgattaacaaccccgccaccccgtcttgctgatttgtatgttactgcagacacatttgaaaaggacacggaaatgtggcagcaaagagttgaaaattattggagtttgttgggcccaaaggtaaaatcagatgctattagaaacatcatggacatgaaagcaaactttgggtcatttgctgctgcactcaaggaaaaagacgtatgggtgatgaatgttgtgccacatgatggaccaagcaccctcaagataatctatgatagagggctgataggcagcaatcacgactggtgtgaagccttttcaacctatcctcgaacatatgatcttctccacgcatgggcagtcttctctgaccttgataaaagaggttgcagtgccgaagacctgctccttgaaatggatcgtatcctcaggccgactgggtttgccatcgtgagggacaagagcactatcattgaattcatcaagaaatacctccacgcacttcactgggaagcaataactgttgtagatgctgagcccaacccagaatcagaggagaacgaaatgatcttgatcatccggaagaagttgtggctaccagaagcaggctcgcatgtttccagcacgtaa

SEQ ID NO: 9728 - protein, 616 aa, Sorghum bicolor
  misc_feature: Ceres ANNOT ID no. 6104464
  misc_feature (218)..(313): Pfam Id: Methyltransf_11 Pfam Desc: Methyltransferase domain
  misc_feature (1)..(606): NCBI GI: 21536697 NCBI Desc: ankyrin-like protein [arabidopsis thaliana]
  misc_feature (1)..(606): NCBI GI: 11994314 NCBI Desc: ankyrin-like protein [arabidopsis thaliana]
  misc_feature (22)..(606): NCBI GI: 7268141 NCBI Desc: ankyrin like protein [arabidopsis thaliana]
  misc_feature (84)..(399): NCBI GI: 2341032 NCBI Desc: est gbatts0956 comes from this gene. [arabidopsis thaliana]
  misc_feature (27)..(607): NCBI GI: 42573369 NCBI Desc: dehydration-responsive protein-related [arabidopsis thaliana]
  misc_feature: Useful for making plants with altered cell wall content and/or composition
  misc_feature: GREAT-hit functional homolog of the protein sequence encoded by LOCUS at1g04430
  misc_feature: Useful for making plants with altered cell wall content and/or composition
  misc_feature: Functional homolog of the protein sequence given in SEQ ID NO 13845
  misc_feature: The sequence is a functional homolog of SEQ ID NO 1236 in the 11/479,226 US patent application
MRGRNDSGHSKRPVVLCCVMIVCLCLLFLYFSGSKGQAGTTAFEYGTKFSRSLGWGSDDGDDGSEESIFGTGDADDVKPKSFPVCDDRHSELIPCLDRNLIYQMRLKLDLNLMEHYERHCPPPERRFNCLIPPPHGYKVPIKWPKSRDVVWKANIPHTHLAKEKSDQNWMVEAGEKIKFPGGGTHFHHGADKYISNIANMLNFKDNNINNEGMLRTVLDVGCGVASFGGYLLSSNVIAMSLAPNDVHQNQIQFALERGIPAYLGVLGTKRLPYPSRSFELAHCSRCRIDWLQRDGILLLELDRLLRPGGYFAYSSPEAYAQDEEDLRIWKEMSALVERMCWKIAEKRNQTVIWVKPLNNDCYKRRAHGTKPPLCKSGDDPDSVWGVPMEACITPYPEQMHRDGGTGLAPWPARLTTPPPRLADLYVTADTFEKDTEMWQQRVENYWSLLGPKVKSDAIRNIMDMKANFGSFAAALKEKDVWVMNVVPHDGPSTLKIIYDRGLIGSNHDWCEAFSTYPRTYDLLHAWAVFSDLDKRGCSAEDLLLEMDRILRPTGFAIVRDKSTIIEFIKKYLHALHWEAITVVDAEPNPESEENEMILIIRKKLWLPEAGSHVSST

SEQ ID NO: 9729 - DNA, 1626 bp, Sorghum bicolor
  misc_feature: Ceres ANNOT ID no. 6104471
  misc_feature: Encodes the peptide sequence at SEQ ID NO 9730
atggaggtggagccggcgaggagggacgcggcagcgctggacccggagctgctgcagctggcggagctcgcgccgggcgcgcttcgtgagaactccataatagctgatgcgctctactcgcagtggctcgtgctacccgagacggccaaactggtaaagtctttgattgaggatgcaaagactggtgccgtgcttaatgttgttggaagctctgctagcacaaatgctgcttcaagcagttccctaccgtcgatgtttcctgctggtagtgctccaccactttctcctaggagcacttctgggtccccccgtgttatgagacgaggatctggagctggaccatcgtccttgggttctccattaaaattagttagtgaaccagtgagagaagttatacctcagttttacttcaagaatgggcgtcctcctacaaaagatttgaaggagcagtgcttatcaagaacagatcatctattttttggtggggagggacttcagattcaagaattcagatcggtcacaaaggacatatgtaaacttccttcattcttctctagtgttcttttcaagaaaattgatgttgcatgcactggaactgtctcaagggatgcatttgttgagtactggatcaatgacaataagattacaatggatatggctagtcaaatatttgaaatattaagaaagccgggttacacatatctcactcaggatgacttcaagcctgtcctgaaagaactactggcaactcaccctggcttagagtttttacaagggacccccgaatttcaggagagatatgcggagactgtgatatacagaatcttttactccataaatagatctgggaatggccatctgactctgagagagctcaaacgtggaaatttaattgctgcacttcagcagttagatgaggaagaagatatcaacaaagtgttgagatacttctcatatgagcacttctatgttatctactgtaaattctgggagctggatacagatcacgattttttgattgataaggaaaatctcatcagatatggaaatcattcgttgacctatagaatagttgatagaattttcacacagatcccaaggaaattcacaagcatgtcagaaggaaagatgggttatgaagactttgtttacttcatattatcagaggaagacaaatcatctgagcctagccttgaatactggtttaagtgcatcgatcttgatggtaatggtattttaacttccaatgaaatgcaatttttctacgaggagcaattacaccgaatggagtgcatggcacaggagcctgtgctttttgaggacatactatgccagatgattgatatgattggaccagagaatgagagctatttcactctacgggacttaaaacggtgtaaactctcagggaatatattcaatattcttttcaatctcaacaagttcatggcgtttgaaactcgtgatccattcctcattcgccaggaacgtgaaaatccaactctaactgagtgggatcggtttgcgcatagagaatatattagattgtccatggaagaagatggtgaggatgcttcaaatggaagtggtgatgtgtgggatgaatcacttgaggctccattctga

SEQ ID NO: 9730 - protein, 541 aa, Sorghum bicolor
  misc_feature: Ceres ANNOT ID no. 6104471
  misc_feature (9)..(541): NCBI GI: 4585988 NCBI Desc: similar to phosphoprotein phosphatase 2a regulatory subunit [arabidopsis thaliana]
  misc_feature (9)..(541): NCBI GI: 42740922 NCBI Desc: protein phosphatase 2a beta [arabidopsis thaliana]
  misc_feature (1)..(541): NCBI GI: 4204293 NCBI Desc: highly similar to protein phosphatase 2a regulatory subunit [arabidopsis thaliana]
  misc_feature (268)..(541): NCBI GI: 115444759 NCBI Desc: os02g0191700 [oryza sativa (japonica cultivar-group)]
  misc_feature (163)..(541): NCBI GI: 42571333 NCBI Desc: calcium-binding ef hand family protein [arabidopsis thaliana]
MEVEPARRDAAALDPELLQLAELAPGALRENSIIADALYSQWLVLPETAKLVKSLIEDAKTGAVLNVVGSSASTNAASSSSLPSMFPAGSAPPLSPRSTSGSPRVMRRGSGAGPSSLGSPLKLVSEPVREVIPQFYFKNGRPPTKDLKEQCLSRTDHLFFGGEGLQIQEFRSVTKDICKLPSFFSSVLFKKIDVACTGTVSRDAFVEYWINDNKITMDMASQIFEILRKPGYTYLTQDDFKPVLKELLATHPGLEFLQGTPEFQERYAETVIYRIFYSINRSGNGHLTLRELKRGNLIAALQQLDEEEDINKVLRYFSYEHFYVIYCKFWELDTDHDFLIDKENLIRYGNHSLTYRIVDRIFTQIPRKFTSMSEGKMGYEDFVYFILSEEDKSSEPSLEYWFKCIDLDGNGILTSNEMQFFYEEQLHRMECMAQEPVLFEDILCQMIDMIGPENESYFTLRDLKRCKLSGNIFNILFNLNKFMAFETRDPFLIRQERENPTLTEWDRFAHREYIRLSMEEDGEDASNGSGDVWDESLEAPF

SEQ ID NO: 9731 - DNA, 1440 bp, Sorghum bicolor
  misc_feature: Ceres ANNOT ID no. 6104474
  misc_feature: Encodes the peptide sequence at SEQ ID NO 9732
atggagcatgtgattggagggaagtataagcttgggaggaagattgggagcggatccttcggggagctatatctcggtgttaatatacagaatggagaggaagtaggaataaagttggagcctgtgaaaacaaaacatccacagctgcactatgaatctaaagtttatatgctactgcagggtggaaacggtatcccacacctcaagtggtatggtgtcgaaggggagtacaatgttatggtgattgatcttcttggcccaagtttggaagatttgtttaattgctgcaacaggaaattttctatgaaaacagtgcttatgcttgctgatcaactgataaaccgagtggaatacatgcattccaagggatttattcaccgtgacatcaagccagacaacttccttatgggcttaggtcggaaagctaatcaggtctatatcattgattatggccttgctaagaaatacaaggaccttcagactcataaacacatcccatacagagagaacaaaaatctgactggaacagcacgctatgctagtgtgaatactcatcttggaatagaacaaagcaggagagatgatctggagtctgttggctatcttctgctatattttttaagaggaagcctcccatggcagggtcttaaagctggcactaagaaacaaaagtatgacaaaattagtgaaaagaaaatgcttacctcagcagaggtcctgtgcaaatcttacccatcggaattcatctcatatttccactattgtcgctccctgcgatttgaagacaggccagattactcttttctgaagaaactctttcgtgatgtatttatccgggaaggataccaatttgattatgtatttgactggactgcactcaagtaccctcaaatgggttccaacaacaagcttgttcaacaaccaagtgcaagaatggctggagttggaccatcagttgagagaacagacaaagcttctgtgggacaagagatccgggaaagattcactggtgctgttgaggcattcgccagaagaaatccaggctctggccgccatggagatcattccaggcacaaaagccttgcagattcctttggaacatccaacgaagcagtcgctgccgactcagagaaaacgcgcatcttgtcccggggagggagctcgtcgaaaatgcccgcggctaattcgtccggccggccgacctcttcgggggactgcagtgaccagaaccgccggtgggtctctggcagcagtggcggcagcgggcgcccgtccaccgcgcagaggctccaccactcgggaggcgccgagaacagcaggtcgtccccgcgctctcccgtggcccggaacgcggctgggagaggaggctccggctcgcgggacaacacgacgttccggagcctcgagcgcctctccatcaccaccagcaggaggaagtga

SEQ ID NO: 9732 - protein, 479 aa, Sorghum bicolor
  misc_feature: Ceres ANNOT ID no. 6104474
  misc_feature (9)..(278): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(473): NCBI GI: 21536851 NCBI Desc: protein kinase adk1-like protein [arabidopsis thaliana]
  misc_feature (1)..(433): NCBI GI: 1103318 NCBI Desc: casein kinase i [arabidopsis thaliana]
  misc_feature (1)..(450): NCBI GI: 18087640 NCBI Desc: at5g44100/mln1_2 [arabidopsis thaliana]
  misc_feature (1)..(306): NCBI GI: 41223158 NCBI Desc: casein kinase i [oryza sativa]
  misc_feature (26)..(442): NCBI GI: 1197461 NCBI Desc: casein kinase i [arabidopsis thaliana]
  misc_feature (1)..(442): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 332 in the 11/188,298 US application
  misc_feature: The sequence is a functional homolog of SEQ ID NO. 340 in the 11/188,298 US application
  misc_feature: The sequence is a functional homolog of SEQ ID NO. 312 in the 11/188,298 US application
  misc_feature: The sequence is a functional homolog of SEQ ID NO. 399 in the 11/188,298 US application
  misc_feature: The sequence is a functional homolog of SEQ ID NO. 310 in the 11/188,298 US application
  misc_feature: The sequence is a functional homolog of SEQ ID NO. 323 in the 11/188,298 US application
  misc_feature: The sequence is a functional homolog of SEQ ID NO. 464 in the 11/188,298 US application
  misc_feature: The sequence is a functional homolog of SEQ ID NO. 498 in the 11/188,298 US application
  misc_feature: The sequence is a functional homolog of SEQ ID NO. 311 in the 11/188,298 US application
  misc_feature: The sequence is a functional homolog of SEQ ID NO. 520 in the 11/188,298 US application
  misc_feature: The sequence is a functional homolog of SEQ ID NO. 446 in the 11/188,298 US application
  misc_feature: The sequence is a functional homolog of SEQ ID NO. 358 in the 11/188,298 US application
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNCCNRKFSMKTVLMLADQLINRVEYMHSKGFIHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSAEVLCKSYPSEFISYFHYCRSLRFEDRPDYSFLKKLFRDVFIREGYQFDYVFDWTALKYPQMGSNNKLVQQPSARMAGVGPSVERTDKASVGQEIRERFTGAVEAFARRNPGSGRHGDHSRHKSLADSFGTSNEAVAADSEKTRILSRGGSSSKMPAANSSGRPTSSGDCSDQNRRWVSGSSGGSGRPSTAQRLHHSGGAENSRSSPRSPVARNAAGRGGSGSRDNTTFRSLERLSITTSRRK

SEQ ID NO: 9733 - DNA, 909 bp, Sorghum bicolor
  misc_feature: Ceres ANNOT ID no. 6104479
  misc_feature: Encodes the peptide sequence at SEQ ID NO 9734
atggactctcgctatggccagccgccccactacaagatctatgttaagatgatgaaaactgtgccacttgatgtgaagtccactgataccatagatcagatcaagtctcagatcagtgctttagaggggattgacagtagccagcaagcgctcttttttgctggaaatcagttggagaaggacaacagacttgctgattacaatatcatggcaaactcttgtgtcgacctttatgtaactgatgggatgcagatctctgtcagtatcccctctgttgggaagaccatcaagctcaatttgaagaaatcccagagtgttgctgatgtcaaggcggtgatcgaacagaaggggggaattcctctggatgaacaaatcctgatgtatggatgccaaaagcttgaggacaacaagttgttgagtcagtgtggtttgagcaatggccacaccctgcatgttttggtctgccccactgacaagctgcgtatctctgtggatgttgatggtgaaagaactatcaatgtcgatgtcaaaagctggtatactgttgctgatgtcaagttgatgatcgaaaccttagagggtttacctgcaagcacacagatactcatgcgcactcaacctggtggtaatcaacacatcaagaacaatgacattgtcactctatatcttaaagtcaacttcttcatcaagacatatgaaggtaggacactagtgatgtcaatgtggacttgtgacacggcagaggaagtcatgaaggtgattgaagaaaagctggaggtcaacacaggtgtctactacctgcactacagggggcgtgttctgtctcgtggggatactcttcggaagcacaagattggcaacaattccacgatcgatgtccgccttcggaattcacatgtaccgcagtga

SEQ ID NO: 9734 - protein, 302 aa, Sorghum bicolor
  misc_feature: Ceres ANNOT ID no. 6104479
  misc_feature (16)..(82): Pfam Id: ubiquitin Pfam Desc: Ubiquitin family
  misc_feature (90)..(157): Pfam Id: ubiquitin Pfam Desc: Ubiquitin family
  misc_feature (12)..(296): NCBI GI: 114159830 NCBI Desc: polyubiquitin [porphyra yezoensis]
  misc_feature (12)..(299): NCBI GI: 146421245 NCBI Desc: ubiquitin [pichia guilliermondii atcc 6260]
  misc_feature (12)..(296): NCBI GI: 902584 NCBI Desc: polyubiquitin containing 7 ubiquitin monomers
  misc_feature (12)..(296): NCBI GI: 3047318 NCBI Desc: poly-ubiquitin [magnaporthe grisea]
  misc_feature (12)..(296): NCBI GI: 312160 NCBI Desc: ubiquitin [lycopersicon esculentum]
MDSRYGQPPHYKIYVKMMKTVPLDVKSTDTIDQIKSQISALEGIDSSQQALFFAGNQLEKDNRLADYNIMANSCVDLYVTDGMQISVSIPSVGKTIKLNLKKSQSVADVKAVIEQKGGIPLDEQILMYGCQKLEDNKLLSQCGLSNGHTLHVLVCPTDKLRISVDVDGERTINVDVKSWYTVADVKLMIETLEGLPASTQILMRTQPGGNQHIKNNDIVTLYLKVNFFIKTYEGRTLVMSMWTCDTAEEVMKVIEEKLEVNTGVYYLHYRGRVLSRGDTLRKHKIGNNSTIDVRLRNSHVPQ

SEQ ID NO: 9735 - DNA, 1824 bp, Sorghum bicolor
  misc_feature: Ceres ANNOT ID no. 6104499
  misc_feature: Encodes the peptide sequence at SEQ ID NO 9736
atgggccgtacccccggcacgaggtggagctccgcccttaagcctactctcacagagggggatgtaaacgagaactcggacaacccgtcctggaaagcaataggctacagcgtgccggagccggacgtggacaggccaccggaagaagcgccgtcggcttggccactggacgccggcatcgtggagaccagatccctgaatgacgccacgctgctcaggtcactcacggagagaggactggcggtgaaagcggacgtgtcgggcgcgcaccacactgtgcaatgcgacgtcgtcatcgtcggctcaggctgcggaggcggcgtggccgccgccgtgctggcggcggcggggcacaaggtcatcgtcgtcgagaagggggactacttcacagccgagagctacacctccgtggagggcccgtccatggagcgcctctacgagaagggaggcatcttctgcacgtccaacgtgacgaccatcatgttcacgggcgccacggtcggcggcggctctgcgatcaactggtcggccagcatccgcacgccggagtgggtcaccaaggagtgggcgcgcgaccatgggctccccgtgttcgggacgcccgagtacgcgcgtgccatggacgcggtctgcgcccggctcgcggtgaccggcgggtgccgtcaggaggggttccagaacaaggctttgcgccgtggctgcgaggcgctcgggctacgtggcgacgccgtgccgcgcaactcgtcggagggccacttctgcggtagctgccacctcggctgccccaccggcgagaagcgtggcaccgacacgacgtggctcgtcgacgccgtcgaccgcggcgcggttatactgacgggatgcaaggccgagcgtttcatactcgagagcaaccccggcggcggcggcgacaacggccggagcaagaagtgcgtgggcctggtggcggcgtgcatgagcgacggcatcagcaagaagctgcgcatcgaggccaaggtttccatctcggcgtgtggcgcgctcatgacaccgcctctgctccgcaacagcgggctcaagaacaggcacatcggtcgcaaccttcacctccacccggtgtctatggcgtggggctatttcccggacggcacgccggagaacgcagagctcagtggcaagtgctacgagggcggcatcatcacgaccatgcaccgcgtcaccgcccgcaccatcatccagacgccggcgctggggccagggtgctgggcttcgctgatcccctgggagtcggggcgcgacatgaaggagcgcatgctccggtacgcgcgcaccgcgcacgccttcgccctggtccgcgaccgcggcgccgggcacgtggacggcgagggccgcgtgcgctacgccccgagccgggaagacgtggaggagctccgcaacgggctgcgccaggcgctgcgcatcctggtggccgccggagcggccgaggtcggcacccaccgcagcgacgggctccggctgcggtgcgacggcggcctccgcgacgaggacctggaggcgttcctcaaggaggtgaccgtgggggaaggccccatgctcccggggcctgacaagtgggcgctccattgctcggcgcaccagatgggcagctgccggatggggtgcagcccgaaggacggcgccgtggacggccgcggcgagagctgggaggcggaggggctgtacgtgtgcgacggcagcgtgctgcccacggcggtgggcgtcaaccccatgatcaccatacagtccaccgcgtactgcgtctccaaaggcatcgcggagtctctggcgcgtgacaagaaacagtag

SEQ ID NO: 9736 - protein, 607 aa, Sorghum bicolor
  misc_feature: Ceres ANNOT ID no. 6104499
  misc_feature (142)..(379): Pfam Id: GMC_oxred_N Pfam Desc: GMC oxidoreductase
  misc_feature (96)..(493): Pfam Id: DAO Pfam Desc: FAD dependent oxidoreductase
  misc_feature (22)..(601): NCBI GI: 22798796 NCBI Desc: alcohol oxidase [arabidopsis thaliana]
  misc_feature (23)..(606): NCBI GI: 42561674 NCBI Desc: alcohol oxidase-related [arabidopsis thaliana]
  misc_feature (42)..(605): NCBI GI: 144925050 NCBI Desc: glucose-methanol-choline oxidoreductase [medicago truncatula]
  misc_feature (22)..(605): NCBI GI: 42566953 NCBI Desc: alcohol oxidase-related [arabidopsis thaliana]
  misc_feature (77)..(590): NCBI GI: 15807796 NCBI Desc: gmc oxidoreductase [deinococcus radiodurans r1]
MGRTPGTRWSSALKPTLTEGDVNENSDNPSWKAIGYSVPEPDVDRPPEEAPSAWPLDAGIVETRSLNDATLLRSLTERGLAVKADVSGAHHTVQCDVVIVGSGCGGGVAAAVLAAAGHKVIVVEKGDYFTAESYTSVEGPSMERLYEKGGIFCTSNVTTIMFTGATVGGGSAINWSASIRTPEWVTKEWARDHGLPVFGTPEYARAMDAVCARLAVTGGCRQEGFQNKALRRGCEALGLRGDAVPRNSSEGHFCGSCHLGCPTGEKRGTDTTWLVDAVDRGAVILTGCKAERFILESNPGGGGDNGRSKKCVGLVAACMSDGISKKLRIEAKVSISACGALMTPPLLRNSGLKNRHIGRNLHLHPVSMAWGYFPDGTPENAELSGKCYEGGIITTMHRVTARTIIQTPALGPGCWASLIPWESGRDMKERMLRYARTAHAFALVRDRGAGHVDGEGRVRYAPSREDVEELRNGLRQALRILVAAGAAEVGTHRSDGLRLRCDGGLRDEDLEAFLKEVTVGEGPMLPGPDKWALHCSAHQMGSCRMGCSPKDGAVDGRGESWEAEGLYVCDGSVLPTAVGVNPMITIQSTAYCVSKGIAESLARDKKQ

SEQ ID NO: 9737 - DNA, 2148 bp, Sorghum bicolor
  misc_feature: Ceres ANNOT ID no. 6104501
  misc_feature: Encodes the peptide sequence at SEQ ID NO 9738
atggaagcaaagttggcattctcccaggaaagcccaccaatttccatcatttgtgcggctaaggttgcagatgtacccctgaccattgatcctagtcttcctacgggctctgcacccatcctaaagtttagttctggagaatcactccatggcgtcaaaccaattctccattacattgcccgtagcgcatctttttctagcttttctgggaaaaacaacatggagtttggacatgttgttgaatggcttgattatgcccccactttcttttcaggctctgaatttgaaaatgcctgctcattcgttgatggattcctggcatcccggacctttctggtcggtcatggtctgacagttgctgatattgcagtgtggtcaaatcttgctgggattggtcaacggtgggagagtctaaggagatcaaagaaataccaaaatcttgtccgctggttcaatagcattgatgctgaatacagagatacactaaatgaaattgtggctgcatatgttgggaaacgaggaatcggaaaatctcctgcaccaagccttaaggaaaaggtacatgattcaaaggacccatcagctccagaagttgacctccctggtgcaaaagttgggcaagtttgtgttcgttttgctccagagcctagtgggtacctccatattggtcatgcaaaggctgcactgttgaacaaatactttgctgaaagatatcaagggcgcctaatagttcgatttgatgatacaaacccttcaaaagaaagcaatgagtttgttgagaaccttctgaaagatattgagacattggggatcaaatatgatgctgtcacatacacatccgattatttcccaatgctaatggaaatggctgaaagtttaatcaagcaggggaaagcatatattgatgacacaccaaaggaacaaatgaggaaagagaggatggatggtattgaatcaaggtgcagaaataatactgttgaagagaatctgtcattatggaaagaaatggttaatggaactgaaaggggtatgcagtgctgtgtgcgtggcaaactcgacatgcaggatcctaacaagtcgctcagggatcctgtttactaccgctgtaatactgaccctcaccatcgtgtgggttcattgtataatgtctatccaacatatgactttgcttgcccatttgtcgatgcattggagggagtgacacatgcccttcgttccagtgaataccatgacaggaatgcacaatattatcgaattcttcaagatatggggctgaggagagtggaaatttatgaattcagccggttgaatatggtttacactcttctcagcaagaggaagcttctctggtttgtacaaaacaagaaagtcgaagattggactgacccacgttttcccactgttcaaggcatagtacgtcgtggcttgaaagttgaggcattgatacaatttatactccaacagggcgcttcaaaaaatctgaatcttatggagtgggataaactctggacaatcaacaagaagataattgacccagtgtgcgcaaggcatactgccgtgctaacagatcagcgtgtgatctttactctcactaatggtccagagaagccatttgttcgaattttaccgaggcacaagaaatgtgagggtgctggaaagaaggctacaaccttcaccaacagaatctggctagattatgctgatgcgtctgccattagcaagggtgaggaagtaaccctaatggactgggggaatgctatcattaacgagatcaagatggagggtggagtcattactgaactagttggagaactacatcttgagggctctgtgaagacaacaagaatgaagatcacatggttagcagatatggaggagctagtgcccctctcattggtggaattcgattatctcatctgcaagaaaaagctggaggaggatgaagacttccttgagaatcttaacccttgcactcgacgagagaccttggcccttggagatgcaaacatgaggaatgtcaagcgcggagagatcatacagatcgagaggaaaggctactacaggtgtgatgccccattcatgaggtcgtcaaaacctgtagttctgtttgcaatcccagatggtcgacagcaggcctcgctgaactag

SEQ ID NO: 9738 - protein, 715 aa, Sorghum bicolor
  misc_feature: Ceres ANNOT ID no. 6104501
  misc_feature (207)..(512): Pfam Id: tRNA-synt_1c Pfam Desc: tRNA synthetases class I (E and Q), catalytic domain
  misc_feature (514)..(690): Pfam Id: tRNA-synt_1c_C Pfam Desc: tRNA synthetases class I (E and Q), anti-codon binding domain
  misc_feature (5)..(714): NCBI GI: 92873328 NCBI Desc: glutamyl-trna synthetase archae/euk cytosolic; glutathione s-transferase, c-terminal-like [medicago truncatula]
  misc_feature (4)..(709): NCBI GI: 3047084 NCBI Desc: similar to aminoacyl-trna synthetases [arabidopsis thaliana]
  misc_feature (29)..(709): NCBI GI: 126136887 NCBI Desc: glutamine-trna ligase [pichia stipitis cbs 6054]
  misc_feature (72)..(709): NCBI GI: 37362649 NCBI Desc: glutamyl-trna synthetase (glurs), forms a complex with methionyl-trna synthetase (mes1p) and arc1p; complex formation increases the catalytic efficiency of both trna synthetases and
  misc_feature (72)..(709): NCBI GI: 37362649 (continued) ensures their correct localization to the cytoplasm [saccharomyces cerevisiae]
  misc_feature (21)..(709): NCBI GI: 146453059 NCBI Desc: glutamyl-trna synthetase [lodderomyces elongisporus nrrl yb-4239]
MEAKLAFSQESPPISIICAAKVADVPLTIDPSLPTGSAPILKFSSGESLHGVKPILHYIARSASFSSFSGKNNMEFGHVVEWLDYAPTFFSGSEFENACSFVDGFLASRTFLVGHGLTVADIAVWSNLAGIGQRWESLRRSKKYQNLVRWFNSIDAEYRDTLNEIVAAYVGKRGIGKSPAPSLKEKVHDSKDPSAPEVDLPGAKVGQVCVRFAPEPSGYLHIGHAKAALLNKYFAERYQGRLIVRFDDTNPSKESNEFVENLLKDIETLGIKYDAVTYTSDYFPMLMEMAESLIKQGKAYIDDTPKEQMRKERMDGIESRCRNNTVEENLSLWKEMVNGTERGMQCCVRGKLDMQDPNKSLRDPVYYRCNTDPHHRVGSLYNVYPTYDFACPFVDALEGVTHALRSSEYHDRNAQYYRILQDMGLRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLTDQRVIFTLTNGPEKPFVRILPRHKKCEGAGKKATTFTNRIWLDYADASAISKGEEVTLMDWGNAIINEIKMEGGVITELVGELHLEGSVKTTRMKITWLADMEELVPLSLVEFDYLICKKKLEEDEDFLENLNPCTRRETLALGDANMRNVKRGEIIQIERKGYYRCDAPFMRSSKPVVLFAIPDGRQQASLN

SEQ ID NO: 9739 - DNA, 735 bp, Sorghum bicolor
  misc_feature: Ceres ANNOT ID no. 6104809
  misc_feature: Encodes the peptide sequence at SEQ ID NO 9740
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
atggccgcagccgcaggaccctccgccggctctgtggcggagacgctcccgccggccctcggctccacctcccagccacctcctgtcttcgatggcaccaccaggctgtacatttgctacttctgcccgttcgctcagcgcgcctgggttaccaggaacttcaagggtttgcaggacaagatggagctggtggccattgatctgcaggacaaaccagcttggtacaaggagaaggtttacccacagggcacggtgccttccctggagcacgacaacgaggtcaggggcgagagcctggacctgatcaagtacatcgacagcaacttcgacggccctaccctgctcccagaggatgctgcaaagaggcagttcgctgatgagctgatcgcgcatgccaatgcgttcaccaaggccctctactcgcccttgatggcccacgcagccgtgtcagatgaagttgttgctgctctggataaactcgaagctgagctgtcgaagttcaacgacggcccgttcttcctaggccagtttagcttggcggatatagcctatgttacaattttggaaagggttcagatatactattctcatcttaggaactatgacatcaccaaaggcaggccaaaccttgagaaattcattgaggagatgaacaagatcgaagcatatacgcagactaaaaaggatcctctgtttttgcttgatcttgccaagaatcatcttaagattgcctga

SEQ ID NO: 9740 - protein, 244 aa, Sorghum bicolor
  misc_feature: Ceres ANNOT ID no. 6104809
  misc_feature (1)..(244): NCBI GI: 22347 NCBI Desc: in2-1 [zea mays]
  misc_feature (1)..(244): NCBI GI: 7939638 NCBI Desc: xig [oryza sativa]
  misc_feature (1)..(244): NCBI GI: 85700990 NCBI Desc: glutathione s-transferase [oryza sativa (indica cultivar-group)]
  misc_feature (17)..(238): NCBI GI: 37051105 NCBI Desc: glutathione s-transferase [pisum sativum]
  misc_feature (12)..(238): NCBI GI: 11385579 NCBI Desc: in2-1 protein [glycine max]
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MAAAAGPSAGSVAETLPPALGSTSQPPPVFDGTTRLYICYFCPFAQRAWVTRNFKGLQDKMELVAIDLQDKPAWYKEKVYPQGTVPSLEHDNEVRGESLDLIKYIDSNFDGPTLLPEDAAKRQFADELIAHANAFTKALYSPLMAHAAVSDEVVAALDKLEAELSKFNDGPFFLGQFSLADIAYVTILERVQIYYSHLRNYDITKGRPNLEKFIEEMNKIEAYTQTKKDPLFLLDLAKNHLKIA

SEQ ID NO: 9741 - DNA, 2382 bp, Sorghum bicolor
  misc_feature: Ceres ANNOT ID no. 6104953
  misc_feature: Encodes the peptide sequence at SEQ ID NO 9742
atgtcggccgccgacccctccgcggctccggtcgcggccgcggtcgccgacccggatggccctgacgccgtgcggcttacctggaacacctggccacggtcaaaggtcgaggccagccgctgcgtcgtgccgctcgccgccaccatctcgcccgctcgcgtcccggacccctccgcggcgtccccgccgccgctcccttaccctccgctccgctgcaagcctccctgctccgcgctcctcaaccccttcgcgcgcgtcgacttcgccgccaagatctggatctgcccgctctgcttctcccggaaccacttccccccgcactacgctgccatatctgagtccaacgtccccgccgagctcttcccgcagtgctccaccgtcgagtacatcgttggcggagccggcgtccccggggtaggcagcgcgccggcgcccccaccacccgtatttctcttcgtcatcgacacctgcgtcatcgaggaggagctggagtacgtcaagatggccatgcggaaggccgtcgcgcttctgccagagcacgcactcgtgggcctcgtcaccttcggcacgcaggtgcatctgcacgagctcggattctccgatctcagcaagatctacgtcttccgggggaccaaggagatctccaaggaccagattttggatcagcttgggctggcgggggctgggcgcccggggttccccaagatgccacagcaaccaggcgggccgcaggtgaatgggatgcattcgctgtccacggccggggtcaacaggttcctgctcccggtgtcagagtgcgagtgtgcactaagcacgttgctggacgagttgcagcctgaccaatggccagtggaggccgggaaccgggcaatccggtgcaccggtgttgcgctcagtgtggctgctggtttgcttggtgcttgcatgcctgggacaggtgcaaggatcattgcattgctaggtggtccatgtaccgagggccctggaatgattgtttcaaaagaattgtcagaaccagttagatcacataaggatcttgacaaggacgcagctcctcacttccagaaagccattaaattttatgatggtcttgctaagcagttagtcagtcaaggccacgtgttagatgtttttgcatccgctctcgatcaggttgggctagctgagatgaaggttgctattgagagaacaggtggccttgttgtcttgtctgaaagttttgggcattctgtattcaaggattctttcaaacgcatttttgagggaggtgaacagtctctaggcctttcattcaatggtacaattgaaataaactgttcaaaagatattaaagtccaaggtattattggaccatgcacatctttggagaagaaaggagctgtgtgcgctgacactgttgttggtcaaggaaatacagcagcatggaaaatgtgtggtctcgatagaaatacttctctgacagtattttttgatgtctcaccgagtgaacgatcgagccagccaggacaccaaaatccccatttgtatatacaatttgtaacaagttaccaacacccggaaggtcaaatgaggataagagttactacaatatgcaggaaatgggtagacggatccactaataccgaggaattagttgaaggttttgaccaggaaactgcagctgttgtgttggctagatacatctctttgaaaatggagatggaggaagagttcgatgcaacacggtggcttgatagatctctcatacgtctttgttcaagatttggggattatcggaaggatgatccctcttcatttagcctgcattcaaatttctcattgttccctcagtttatgtttaatctgcggcgttcacaatttgttcaggttttcaataacagtccagatgagacagcttatttcaggatgctactcaatcgcgagagtatcactaactcggttgccatgatccagccttccttgatatcattttcttttgattcacctccatccccagtatttctagatgtggcatcaatagcagcagatcgtatactgctacttgatgcgtactttagtgttgttattttccatggtatgacaattgctcagtggagaaacatgggttatcagaaccaacctgagcatgagcaatttgcacaactattacaagcaccacatgaggatgcacagatgataataaaaggtcgatttccagttccaagactagttgtctgcgatcaacatggctcgcaggcaaggtttttgttggctaagctgaatccatcagccacatataattcagctcatgatgttgctccaggttctgacatcattttcacggatgatgttagcttccaggtcttctgtgagcacctacaaaggctggctgttcagtcttaa

SEQ ID NO: 9742 - protein, 793 aa, Sorghum bicolor
  misc_feature: Ceres ANNOT ID no. 6104953
  misc_feature (145)..(420): Pfam Id: Sec23_trunk Pfam Desc: Sec23/Sec24 trunk domain
  misc_feature (430)..(535): Pfam Id: Sec23_BS Pfam Desc: Sec23/Sec24 beta-sandwich domain
  misc_feature (550)..(650): Pfam Id: Sec23_helical Pfam Desc: Sec23/Sec24 helical domain
  misc_feature (659)..(749): Pfam Id: Gelsolin Pfam Desc: Gelsolin repeat
  misc_feature (68)..(108): Pfam Id: zf-Sec23_Sec24 Pfam Desc: Sec23/Sec24 zinc finger
  misc_feature (14)..(793): NCBI GI: 140063092 NCBI Desc: zinc finger, sec23/sec24-type; sec23/sec24 trunk region; sec23/sec24 helical region; gelsolin region; sec23/sec24 beta-sandwich [medicago truncatula]
  misc_feature (14)..(793): NCBI GI: 15912297 NCBI Desc: at1g05520/t25n20_16 [arabidopsis thaliana]
  misc_feature (14)..(710): NCBI GI: 8778725 NCBI Desc: t25n20.17 [arabidopsis thaliana]
  misc_feature (65)..(793): NCBI GI: 7268121 NCBI Desc: transport protein [arabidopsis thaliana]
  misc_feature (65)..(793): NCBI GI: 20147367 NCBI Desc: at4g14160/dl3120w [arabidopsis thaliana]
MSAADPSAAPVAAAVADPDGPDAVRLTWNTWPRSKVEASRCVVPLAATISPARVPDPSAASPPPLPYPPLRCKPPCSALLNPFARVDFAAKIWICPLCFSRNHFPPHYAAISESNVPAELFPQCSTVEYIVGGAGVPGVGSAPAPPPPVFLFVIDTCVIEEELEYVKMAMRKAVALLPEHALVGLVTFGTQVHLHELGFSDLSKIYVFRGTKEISKDQILDQLGLAGAGRPGFPKMPQQPGGPQVNGMHSLSTAGVNRFLLPVSECECALSTLLDELQPDQWPVEAGNRAIRCTGVALSVAAGLLGACMPGTGARIIALLGGPCTEGPGMIVSKELSEPVRSHKDLDKDAAPHFQKAIKFYDGLAKQLVSQGHVLDVFASALDQVGLAEMKVAIERTGGLVVLSESFGHSVFKDSFKRIFEGGEQSLGLSFNGTIEINCSKDIKVQGIIGPCTSLEKKGAVCADTVVGQGNTAAWKMCGLDRNTSLTVFFDVSPSERSSQPGHQNPHLYIQFVTSYQHPEGQMRIRVTTICRKWVDGSTNTEELVEGFDQETAAVVLARYISLKMEMEEEFDATRWLDRSLIRLCSRFGDYRKDDPSSFSLHSNFSLFPQFMFNLRRSQFVQVFNNSPDETAYFRMLLNRESITNSVAMIQPSLISFSFDSPPSPVFLDVASIAADRILLLDAYFSVVIFHGMTIAQWRNMGYQNQPEHEQFAQLLQAPHEDAQMIIKGRFPVPRLVVCDQHGSQARFLLAKLNPSATYNSAHDVAPGSDIIFTDDVSFQVFCEHLQRLAVQS

SEQ ID NO: 9743 - DNA, 534 bp, Sorghum bicolor
  misc_feature: Ceres ANNOT ID no. 6105129
  misc_feature: Encodes the peptide sequence at SEQ ID NO 9744
atgttcaatatgtctagggacccattggtcgtcgggcatgtcgtgggggatattgtggatccattcatcacaactgcatcactgagggtgttctacaacaataaggagatgacaaatggttctgaccttaagccatctcaagtgatgaatgagccaagggtccacatcagtgggcgtgacatgaggactctctacacacttgtcatggtggacccagatgcaccaagccccagtaaccccactaaaagagagaaccttcactggttggtgacagacattccagagacaactgatgccagtttcgggaatgaaatagttccatatgagagcccacgtccaactgccggaatccatcgctttgcattcgtcttgttcaggcagtcagtcaggcagaccacctatgcgccggggtggagatcaaactttaacacaagggacttcgcagccatctacaaccttggctcccctgtcgctgcagtgtacttcaactgccagagagagaacggctgtggtggaagaaggtacataaggtga

SEQ ID NO: 9744 - protein, 177 aa, Sorghum bicolor
  misc_feature: Ceres ANNOT ID no. 6105129
  misc_feature (20)..(165): Pfam Id: PBP Pfam Desc: Phosphatidylethanolamine-binding protein
  misc_feature (4)..(177): NCBI GI: 38344240 NCBI Desc: oj991113_30.17 [oryza sativa (japonica cultivar-group)]
  misc_feature (6)..(174): NCBI GI: 38256990 NCBI Desc: flowering locus t [populus nigra]
  misc_feature (6)..(174): NCBI GI: 115503902 NCBI Desc: ft-like protein [vitis vinifera]
  misc_feature (6)..(174): NCBI GI: 38347694 NCBI Desc: flowering locus t [populus nigra]
  misc_feature (6)..(174): NCBI GI: 41323980 NCBI Desc: floweing locus t-like protein ft1 [populus deltoides]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7196246
  misc_feature: The sequence is a functional homolog of SEQ ID NO 2 in US patent 7208653
MFNMSRDPLVVGHVVGDIVDPFITTASLRVFYNNKEMTNGSDLKPSQVMNEPRVHISGRDMRTLYTLVMVDPDAPSPSNPTKRENLHWLVTDIPETTDASFGNEIVPYESPRPTAGIHRFAFVLFRQSVRQTTYAPGWRSNFNTRDFAAIYNLGSPVAAVYFNCQRENGCGGRRYIR

SEQ ID NO: 9745 - DNA, 2379 bp, Sorghum bicolor
  misc_feature: Ceres ANNOT ID no. 6105496
  misc_feature: Encodes the peptide sequence at SEQ ID NO 9746
  misc_feature: Up-regulated in shoot tissues in response to methyl jasmonate treatment
atggcgcgctggttgcagtctgcaggcctgcagcaccttgcggcgtcctcggccgccggcggggtcggggccggcgacatccgcggcggtggtctcagcggcgttggcggcagcggccttctccccagtcttctcatgcaggggtatgggccacaatcaattgaggaaaaacagaagctttatacattattgaggagcctaaattttaatggcgaattagcatctgcatctatatccgagccctatactccaacaggacagagctttgctggtggtgctcctgtagatggattttattcacctgaacttagaggtgaatttggggctggccttttggatcttcatgcaatggatgacagcgagcttctttctgagagtgctgcatcagaaccatttgagccttcgccttttgtgccaaaagaaatggacgacgacgacgacgatgtaataacagaaaaccagcaaggtctagtggacaaccggagtagtgccttcaccaacgaaaaagagaacactgtggtcggtgctagagaaagtaatgtagcaaagattaaagtcgtggtaaggaaaagacctctgaacaaaaaggaggtatctcgaaaagaggaagacatcatagatgtacacaattctcaattcttgactgtccatgaacctaaactaaaggtggatttgacagcttatgtggaaaagcatgatttctgttttgacactgtcttggacgagaatgtaactaatgatgaggtgtaccgtgagactgtggagcctattataccaataattttccaaaggacaaaagcgacatgctttgcctatggccagacaggcagtgggaagacctatacaatgcaacccctacctcttagagctgcacatgatatggttcgtcttttacatcaacctatgtatcggaatcaacatttcaagttgtggctcagctactttgaaatttatggtggcaaactcttcgatcttctcagcgaaaggagacaactcttaatgagagaagatggaaagaaacaggtctgtattgttggtttacaggagtttgaggtttctgatgtccagattgtcaaagaatacattgagaaaggaaatgctgcaagaagcacaggcacaactggagccaatgaagagtcatcacgatctcatgctattctgcaattggctgtgaaaaagcatatcccagttactgaaacccggagacagagagaccgagatgctattgaagcaaagaatacaaagctcgtggggaaaatgtcatttattgatcttgctggaagtgagcgtggtgctgatacaacagataatgacaaacaaacaagaattgagggtgcagagatcaacaagagccttttggctctcaaggaatgtatccgggcactggataatgatcaaatacacattcctttcagaggaagcaaactaacagaggtgcttcgggactcctttgttggaaactctcgaacagtgatgatttcttgtgtttcaccaagttcaggttcatgtgaacacacactgaataccttaagatacgccgacagggttaaaagtctttcaaaaggtggtaacacaaaaaaggagcagtttgctgtgcaatctgtatcatctggcaaggagtctacctacacaccataccctttatcatgtgaagctgaagagactatggagcagacccaagaattcaggcctgttgattcttctagaaaaggtgttgacagtttcacttcaaattcttccatggaacctgagagaaactcctatagtatgattccaagctatccacagagaggaagagaagaaactagtactagggagagaggggacttgaaatctaaccaggctggttttaatagtaaaacacagtcacttcaggaatcaattagttctcaagaagaggtgaaagtgacaaaagtctcaccaccccggagaaaaggtaacagggatgagaaatcagaaaggcaggtcaacttcatgaaaaaagaaagtggacctgaaattagtcggactgttgttaagcagcaacagcaacttaaacagcagcagctgcaaagaccatcatcaacctcagcatctcaggtttcatccaagcaatctgaaaaggaagatatggaaataaatgcaatacttgaggaagaggcgctgatagcagctcacagaaaggaaattgaaagtacaatggagatagtacgggaagagatgaacctattagcagaggtcgatcagccaggtagtcttattgacaactacgtggcacagctaagctttctgttgtcacggaaggcttctggtttggtaagcctccaggcacgcttggcacggtttcagcagcgccttaaggaacaggagattcttagccgtcaaaaaacactgagatag

SEQ ID NO: 9746 - protein, 792 aa, Sorghum bicolor
  misc_feature: Ceres ANNOT ID no. 6105496
  misc_feature (189)..(520): Pfam Id: Kinesin Pfam Desc: Kinesin motor domain
  misc_feature (1)..(664): NCBI GI: 33439496 NCBI Desc: central motor kinesin 1 [gossypium hirsutum]
  misc_feature (5)..(675): NCBI GI: 73656868 NCBI Desc: internal-motor kinesin [nicotiana tabacum]
  misc_feature (338)..(792): NCBI GI: 115462169 NCBI Desc: os05g0154700 [oryza sativa (japonica cultivar-group)]
  misc_feature (47)..(634): NCBI GI: 13536983 NCBI Desc: by-2 kinesin-like protein 10 [nicotiana tabacum]
  misc_feature (160)..(637): NCBI GI: 16974325 NCBI Desc: at3g16060/msl1_10 [arabidopsis thaliana]
  misc_feature: Up-regulated in shoot tissues in response to methyl jasmonate treatment
MARWLQSAGLQHLAASSAAGGVGAGDIRGGGLSGVGGSGLLPSLLMQGYGPQSIEEKQKLYTLLRSLNFNGELASASISEPYTPTGQSFAGGAPVDGFYSPELRGEFGAGLLDLHAMDDSELLSESAASEPFEPSPFVPKEMDDDDDDVITENQQGLVDNRSSAFTNEKENTVVGARESNVAKIKVVVRKRPLNKKEVSRKEEDIIDVHNSQFLTVHEPKLKVDLTAYVEKHDFCFDTVLDENVTNDEVYRETVEPIIPIIFQRTKATCFAYGQTGSGKTYTMQPLPLRAAHDMVRLLHQPMYRNQHFKLWLSYFEIYGGKLFDLLSERRQLLMREDGKKQVCIVGLQEFEVSDVQIVKEYIEKGNAARSTGTTGANEESSRSHAILQLAVKKHIPVTETRRQRDRDAIEAKNTKLVGKMSFIDLAGSERGADTTDNDKQTRIEGAEINKSLLALKECIRALDNDQIHIPFRGSKLTEVLRDSFVGNSRTVMISCVSPSSGSCEHTLNTLRYADRVKSLSKGGNTKKEQFAVQSVSSGKESTYTPYPLSCEAEETMEQTQEFRPVDSSRKGVDSFTSNSSMEPERNSYSMIPSYPQRGREETSTRERGDLKSNQAGFNSKTQSLQESISSQEEVKVTKVSPPRRKGNRDEKSERQVNFMKKESGPEISRTVVKQQQQLKQQQLQRPSSTSASQVSSKQSEKEDMEINAILEEEALIAAHRKEIESTMEIVREEMNLLAEVDQPGSLIDNYVAQLSFLLSRKASGLVSLQARLARFQQRLKEQEILSRQKTLR

SEQ ID NO: 9747 - DNA, 1497 bp, Sorghum bicolor
  misc_feature: Ceres ANNOT ID no. 6105499
  misc_feature: Encodes the peptide sequence at SEQ ID NO 9748
atgggcgcccttaccgacagccggaagcgcctctcggcggaccactgcctctcggccgaccaccgcctcccctacccctcctttcccccgccgtcccttacccctccctccaagcgggccaagctcgccccattccctgagctcgatccctccacctccaccgtcccgcctatccgtccctctccccaaatcatccactccaccgccacggcatccgcctcctccacgccgggcccttcctcctcttgtatcaccaccgcttccaccccgcttccgcaaaggcgccgactccctccgccgccgccaatccagcgcccgatccacgccccccagcggaacctccgcgtcttccggcttgggggcgccgcacggacccacgccgccggctactcgtggttctccccgtcatcacccccgcctcgttctctcggactccagcagttcgttgagctcgtcaaaagtgtctcacacccggcaccgcccactcccgctgccacaaccgatgctacgaggcaggcggaggcggaggcggacgcggtgcccctcgaggtgatcaccatcgaggaggataaggaggtgaggaagcagcaggacgaggaggtgagggggggcgtggtagtgagaagggggccaatatacaaggagctgtacaaggcgtcgcaacagaagcgggatgccaagctcaagacgctcgagtttgaggtgcggctcgctgaggagggccgtcttggccttgagcggcttgccgaggccctcccgcgaattacgccaaagaaggaggaggtgcctgaaccttttgttcctcttactgatgaggacgaagaaatggtccgtcaggctcttaatggcaagaacagccgtgagaggttagcattacatgaaccttcaaatattgtgataacgagggagatcctgcagtgcctgaataacaaggaatggctaaatgatgaggttatcaatttgtatcttgatctgcttaaagagagggaactaagagaacctcgcaagttcttaaaatgtcatttcttcaacacctttttctacaagaagctgatttcaagtgggtatgattataaagctgttagaagatggacaacaaaaaggaagttagggtacagtctaattgactgtgacaagatatttgttcccatacacaaggaagtccattggtgtttagcagtcattaacataagggacaaaaagtttcagtatctcgactcacttggtggcatggacaagaaggtcttgagtaccttggccaagtatattgtggatgaggtcaaagacaaaagtgggcaacagatggatgtgctctcatggaagcatgaaggtgtcaaaaaccttcctttgcaggacaatggatgggactgcggcatgttcatgctgaaatacattgacttctacagcagagatatggacctcattttcggacagaagcaaatgcattacttccgcaggaggacagcaaaggaaatactgagtttgagggctgaataa

SEQ ID NO: 9748 - protein, 498 aa, Sorghum bicolor
  misc_feature: Ceres ANNOT ID no. 6105499
  misc_feature (312)..(497): Pfam Id: Peptidase_C48 Pfam Desc: Ulp1 protease family, C-terminal catalytic domain
  misc_feature (242)..(498): NCBI GI: 115436482 NCBI Desc: os01g0355900 [oryza sativa (japonica cultivar-group)]
  misc_feature (213)..(498): NCBI GI: 34787206 NCBI Desc: sumo protease [arabidopsis thaliana]
  misc_feature (213)..(498): NCBI GI: 30680058 NCBI Desc: ulp1 protease family protein [arabidopsis thaliana]
  misc_feature (272)..(498): NCBI GI: 42566204 NCBI Desc: ulp1 protease family protein [arabidopsis thaliana]
  misc_feature (354)..(498): NCBI GI: 115452965 NCBI Desc: os03g0344300 [oryza sativa (japonica cultivar-group)]
  misc_feature: Useful for making plants with modulated flowering time
  misc_feature: GREAT-hit functional homolog of the protein sequence given in SEQ ID NO 13393
  misc_feature: Useful for making plants with modulated flowering time
  misc_feature: Functional homolog of the protein sequence given in SEQ ID NO 13393
MGALTDSRKRLSADHCLSADHRLPYPSFPPPSLTPPSKRAKLAPFPELDPSTSTVPPIRPSPQIIHSTATASASSTPGPSSSCITTASTPLPQRRRLPPPPPIQRPIHAPQRNLRVFRLGGAARTHAAGYSWFSPSSPPPRSLGLQQFVELVKSVSHPAPPTPAATTDATRQAEAEADAVPLEVITIEEDKEVRKQQDEEVRGGVVVRRGPIYKELYKASQQKRDAKLKTLEFEVRLAEEGRLGLERLAEALPRITPKKEEVPEPFVPLTDEDEEMVRQALNGKNSRERLALHEPSNIVITREILQCLNNKEWLNDEVINLYLDLLKERELREPRKFLKCHFFNTFFYKKLISSGYDYKAVRRWTTKRKLGYSLIDCDKIFVPIHKEVHWCLAVINIRDKKFQYLDSLGGMDKKVLSTLAKYIVDEVKDKSGQQMDVLSWKHEGVKNLPLQDNGWDCGMFMLKYIDFYSRDMDLIFGQKQMHYFRRRTAKEILSLRAE

SEQ ID NO: 9749 - DNA, 804 bp, Sorghum bicolor
  misc_feature: Ceres ANNOT ID no. 6105613
  misc_feature: Encodes the peptide sequence at SEQ ID NO 9750
atgttgtggcgcacagtacgcagtatggatgtaataatgcattcttcgagtttccttcttccgaaactgcatcaacctgtcaacaaaccagtcaagaactatgctttagttgttctaaaccagcaacttccacgattcatgcctcgactctgggatcatgcaaacttgaggatctgtgctgatggaggagctaatcatatttttgatgagatgtatcagatgaccaatgatgaagacaaaaaaagcaccagaaataagtatattccagaaataattgagggggacatggattctatcagacctgaagtaaaactgttctactccagtcagggatccaaaatttctgataagtcacataaccaggagacaacagatctacacaaatgtatttcccgtatccatcatcgtacgcctgatcatgaaaaacccaatctctgtgttcttgttactggagcactaggtggtaggtttgatcatgaggcggcaaatatcaatgttctgtatctgttttcggacatgaggattgtcctcctatcagatgattgcttgattcgacttcttccgagaacacatcgccatgagctctatattgagtcgtctgttgaaggacctcattgtgggctttttcctgttggagcaccatcaacaagcaccacaactactggcctgaaatggaatctaagtgaatcaaagatgagatttgggagcatgataagcacatccaacattgtgcagtcggagaaggtaactgtagaatctgatgcagatcttttgtggacaatttctctgcgaaatctgacataa

SEQ ID NO: 9750 - protein, 267 aa, Sorghum bicolor
  misc_feature: Ceres ANNOT ID no. 6105613
  misc_feature (40)..(180): Pfam Id: TPK_catalytic Pfam Desc: Thiamin pyrophosphokinase, catalytic domain
  misc_feature (191)..(259): Pfam Id: TPK_B1_binding Pfam Desc: Thiamin pyrophosphokinase, vitamin B1 binding domain
  misc_feature (1)..(267): NCBI GI: 115436492 NCBI Desc: os01g0356500 [oryza sativa (japonica cultivar-group)]
  misc_feature (14)..(265): NCBI GI: 14278355 NCBI Desc: chain b, mouse thiamin pyrophosphokinase complexed with thiamin
  misc_feature (34)..(265): NCBI GI: 46250253 NCBI Desc: thiamin pyrophosphokinase 1 [homo sapiens]
  misc_feature (34)..(265): NCBI GI: 119600497 NCBI Desc: thiamin pyrophosphokinase 1, isoform cra_a [homo sapiens]
  misc_feature (34)..(265): NCBI GI: 39644700 NCBI Desc: tpk1 protein [homo sapiens]
MLWRTVRSMDVIMHSSSFLLPKLHQPVNKPVKNYALVVLNQQLPRFMPRLWDHANLRICADGGANHIFDEMYQMTNDEDKKSTRNKYIPEIIEGDMDSIRPEVKLFYSSQGSKISDKSHNQETTDLHKCISRIHHRTPDHEKPNLCVLVTGALGGRFDHEAANINVLYLFSDMRIVLLSDDCLIRLLPRTHRHELYIESSVEGPHCGLFPVGAPSTSTTTTGLKWNLSESKMRFGSMISTSNIVQSEKVTVESDADLLWTISLRNLT

SEQ ID NO: 9751 - DNA, 1374 bp, Sorghum bicolor
  misc_feature: Ceres ANNOT ID no. 6105616
  misc_feature: Encodes the peptide sequence at SEQ ID NO 9752
atggcggccgtagcggcggctccacggccgcagctctccccgctatctggcggcggtggcgccacaatctccagtctcaccctccaaacactggccttcatctcccccctccccacacgccgccgtcgccgctgtgtgctccgctccaacgcctcgtcgtccccgtctccgccgccgtcgcaggagaaggaggcagcggctgaggtggtgccaacagctgagtcctgcgtcaacctcggactccagctcttctccaagggcagggtgaaggatgctcttgaacaatttgagaatgccttagagctgaatccaacacctgttgaggcccaagcagcactgtataacaaggcatgctgccatgcatatagagaagaaagcaaaaaagctgcagaatgtttaagggaagctttgcgagactacaatctcaaatttggtaccatacttaacgatccagacttggcgccattcagagcatcaccggaattcaaggaacttcaagaagaggctttgcgtggtggagaagatattggttctggtttccgaagagacctgaaactcattagtgaagtacaagcaccatttcgtggtgtccgaagattcttctatgtagctttgacagccgcagctggaatttcaacattctttaccattccccgacttgtactagcagttcgagggggtgatggcgcccctgatcttctggaaactgctggaaatgctgccatcaatattggaggtatcgttgtgctagtagctttgtatttctgggaaaacaagaaagaagagaagcagatcacacaaatttctcgtaatgaaaccctttcaagattacctgtgcgcctgtcaaccaatcgcattattgaacttgttcaactccgggacatcactaggcctgttagtataactttcttcatttttagtgtccactgttcaaaagcatctgttactcgggcattgcaaagagccgagaggtaccggactgaactgcttaaacgaggcgttcttctaattcctgtgatctttggtgcttctcagaaagaccaaaccaaaccaaggggttttggtacaagaagagcagctgcatcagttccttccgttgggggtgacttcgaaaagcgtactgaatctattgcagcaaagtcacggttgaagtctgaggttcgatttaaggctgatattgtctcccctgaacaatgggaaagttggatacgggaccagcaagagtccgaaggtgtcactcctggtgaggatgtctacataatccttcgtctagatggccgtgtcagaagatctggaataggtatgccaaactggaatgacatattacaggaactgccacgacttgaagatctgatgagcaaacttgaacggtga

SEQ ID NO: 9752 - protein, 457 aa, Sorghum bicolor
  misc_feature: Ceres ANNOT ID no. 6105616
  misc_feature (73)..(106): Pfam Id: TPR_2 Pfam Desc: Tetratricopeptide repeat
  misc_feature (73)..(106): Pfam Id: TPR_1 Pfam Desc: Tetratricopeptide repeat
  misc_feature (51)..(455): NCBI GI: 119387903 NCBI Desc: photosystem-ii repair protein [chlamydomonas reinhardtii]
  misc_feature (185)..(338): NCBI GI: 116310319 NCBI Desc: osigba0157a06.4 [oryza sativa (indica cultivar-group)]
  misc_feature (175)..(337): NCBI GI: 20147175 NCBI Desc: at4g28740/f16a16_150 [arabidopsis thaliana]
  misc_feature (185)..(338): NCBI GI: 115459324 NCBI Desc: os04g0507100 [oryza sativa (japonica cultivar-group)]
  misc_feature (80)..(165): NCBI GI: 13650078 NCBI Desc: shoot1 protein [glycine max]
MAAVAAAPRPQLSPLSGGGGATISSLTLQTLAFISPLPTRRRRRCVLRSNASSSPSPPPSQEKEAAAEVVPTAESCVNLGLQLFSKGRVKDALEQFENALELNPTPVEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDGAPDLLETAGNAAINIGGIVVLVALYFWENKKEEKQITQISRNETLSRLPVRLSTNRIIELVQLRDITRPVSITFFIFSVHCSKASVTRALQRAERYRTELLKRGVLLIPVIFGASQKDQTKPRGFGTRRAAASVPSVGGDFEKRTESIAAKSRLKSEVRFKADIVSPEQWESWIRDQQESEGVTPGEDVYIILRLDGRVRRSGIGMPNWNDILQELPRLEDLMSKLER

SEQ ID NO: 9753 - DNA, 699 bp, Sorghum bicolor
  misc_feature: Ceres ANNOT ID no. 6105659
  misc_feature: Encodes the peptide sequence at SEQ ID NO 9754
atgaggctggtcggcctgacgggcgggatcgcgtccgggaagagcactgtctccaatctcttcaaggacgccggcgtgcccgtcgtcgacgccgacatcgttgctcgggatgtagtgcagaaaggcactggaggttggaagaagattgtaaaagccttcgggaatgatattttgttggaaagtggagaaattaacagggctcacttagggcaaattgtattttctgacccatcaaaacgtcaacttctaaaccgtcttctggcgccacatatttcttggggaataatgtgggagataacaaaactatggatgaaaggatgcaacgttatcatcctggacatcccactgctgtttgagaccaagatggatcgatggacaaatccagtaactgtggtgtgggttaacccagaaacccagattcagaggctgatgtcaagagataggtgctctgaagaacaagctcagaacaggatcaacgcacaactcacgctggaatggaagaagtcggaaggcaacatagtgatcgacaactctggatcactggatgacaccaggcaacacttccgcgaagtcttgaggaaggtctctgagaccttaacatggaaggaacgcttgagatctcgagatggcctgatctctgttgtcgtgtgcacggcagtgagcgttttacttgcccggaagaatctgctatggtcctga

SEQ ID NO: 9754 - protein, 232 aa, Sorghum bicolor
  misc_feature: Ceres ANNOT ID no. 6105659
  misc_feature (2)..(183): Pfam Id: CoaE Pfam Desc: Dephospho-CoA kinase
  misc_feature (1)..(227): NCBI GI: 92886951 NCBI Desc: uridine kinase; dephospho-coa kinase [medicago truncatula]
  misc_feature (2)..(186): NCBI GI: 16414085 NCBI Desc: lin1598 [listeria innocua]
  misc_feature (3)..(192): NCBI GI: 52081407 NCBI Desc: dephospho-coa kinase [bacillus licheniformis atcc 14580]
  misc_feature (1)..(204): NCBI GI: 116128489 NCBI Desc: ensangp00000017632 [anopheles gambiae str. pest]
  misc_feature (1)..(216): NCBI GI: 25325227 NCBI Desc: protein t05g5.5 [imported] - caenorhabditis elegans
MRLVGLTGGIASGKSTVSNLFKDAGVPVVDADIVARDVVQKGTGGWKKIVKAFGNDILLESGEINRAHLGQIVFSDPSKRQLLNRLLAPHISWGIMWEITKLWMKGCNVIILDIPLLFETKMDRWTNPVTVVWVNPETQIQRLMSRDRCSEEQAQNRINAQLTLEWKKSEGNIVIDNSGSLDDTRQHFREVLRKVSETLTWKERLRSRDGLISVVVCTAVSVLLARKNLLWS

SEQ ID NO: 9755 - DNA, 3606 bp, Sorghum bicolor
  misc_feature: Ceres ANNOT ID no. 6105669
  misc_feature: Encodes the peptide sequence at SEQ ID NO 9756
atggcggccgaacccgccgctgcggccgctgcgtcggcggcggccgcgatctccgccgtgatggactggcgctcatcccccgacgcccgcgccgccgccttcgcgtacctcgaatcggttaagagtggagacgtccgagccttggcaagcacatcgtttctcttggttcggaaggaccagacgtcagagatccgcctgcacgggttcaagatgttgcagcacctggtaagattgaggtgggaggagctcagtgctgcagagcggaatgaatttgctaatttgacaattaatttgatatcggatgttgttggccctcatgaggtgtgggccttgaagagtcaaacagctgctttagtagcagaggtagttcgaagggagggagttgatttgtggaatactttacttccatctattgtttctctctctaacagtggccctattgaggctgagttagttgccatgattctaaggtggcttccagaggatatcactgttcataatgaagatttggagggtgataggcggagatctctgttacgcggccttactgagtcactgtcacaaattctgcctctattatattctctacttgagaaacattttgttgctgctttaagtgagcatgcaaagcagcaaatggatttggctaaacaacatgcagggacagtgacggcagttctaaatgctgtcaatgcatatgctgaatgggctcctgtgacagatctagccaaatatggtttaattcatggatgtggttccttgctttcttacagcgattttcgcctccatgcttgtgagttttttaaagtgatatgccagagaaaaagacctgtggatgtggcagttgctgagtatgatgctgcaatgtgcaacattttccaggtgttgatgaacatttcacaacaatttttgaccagatctggcatgcagcccagctctattgatgagagcgaatatgagtttgcatcgtgtgtttgtgagacaatggttgctctagggtcttcaaacatgcaatgcatactagccgatggacccaggactttccagttcttacaacaaatgctggagtattaccaacattacaaaatcgcgcttcatttccagtctttattattttggctggtggtattgagagaaccatcgaaagctaagtctgttgcacgtgtttctggtgataattctgctgctggtaattctgcatctactggtgacttatcaacagaaaaggagaagaaaggtgtatcagtatttgtcactgatgaaatgtacagtacaattttggatgtttctttcaagagaatgctcaagaacagtggaagtgcaacttctgggttgttagaactatggagcgaagagcttgaggggaaaagtgacttctgcaactaccgcaccaaattgttggatctcattaaagtcattgcttctcaaagatctgtgattgctgcagcaagtgttgtccagagaataaatgttgtctttggagatgctaatcaagcaactaaatccccccaggatcttgacgcaatggaaggggctcaactggggcttgaagcagttgtcagtgctatttttgatggctcatttgattgtggaaaaactgatttggagacgaaatcccaactgcacaagatttttgaaggcttacttcaacagcttctttctttgaagtggacagaacctaaccttgcagttattcatggtcattatttggatgctttgggccctttcttgaaacattatccagatgcagttgccagtgttgttaataagctttttgaactgttgacatctctcccaatcacatttcaggatccatcaaacaattctcgcctagcaaggttgcagatctgctcatcattcattcgtatatcgagagctgctgataaagctcttctgcctcatatgaagaacattgctgataccatggcttaccttcaaggagagggccgcttactacgtggtgaacataatcatttatgtgaagcatttcttgtgatggcgtcctctgctgggattcaacagcaacaagaagttcttgcctggttacttgaacctcttaataaaatgtggactcaagtggaatggcaaactgcatacttgtctgacccttctggtttgacaaacatgtttgccgatagccaattcatgtggtcaatttatcacacggttacattctttgaaaaggcgctcaagagaagtggaaccaaaaagtcttcagcagctctacaagcacccaccacaacagtacctggttatctgcatccgatgtcttcacatcttgcatggattgtgccccctctcttaaggctgctgcgatgcatacatgctttttggtctgagccatttgcccagtctcagacaggggaaatcaaagcagcaaaaagcatgactgttgcggagcaggccagccttctaggagagacagggaaacttaccaaaggtcaggttgctcctgctgatggattgctggatgttcagagagatggagaatcaaaagaaaacaatataaaaaactggttgcgtgggatccgagacagcgggtacaatgttttaggattagcagctactcttggggaaccattctttcgatgcatagagggttcttctgtcacccttgctcttatggagaatatgcaagttatggagtttcggcatctgcgccaacttatccaccttgtcattattccatttgttaaatattgccctgccgatctatggcatgtatggctagtgaaccttttgcagccattatttgtccactgtcagcaagctcttaattattcatggtccagtcttcttcatgagggtcgggctaaggttcctgacagcattggtaatcttcctgggtcagaactgaaggtagaggtaatggaagaaaagttgctacgtgacttgactcgtgaagtatgttctgtgctttgggctttatcatcaccaggcttaaataatggacttccatccttggaacaacttggaccttctaaccggatggattctgttctgaagaatctggagtcctttgcttcaagttctctaactggatttcttatgcttcatattggcacagctcttcctgcattgaggatatcagttgaagtgttcacttggacagatagtgaagctgtgactaaagttatccccttttgtggtgctttgatccacctagccattgcttcaaaccaggctgagttgaggcagtttgttgcaaaggatttattttcctctataatacatggtttatctgttgaatcaaattcagtcatgagtgctgaacttgttggactttgtcgggagatatatgtctatctgtccgatagagatcctgcacctaggcaggttcttctttccctcccgcacataaagcaggaagatttactagcatttgatgactctttgagtaaaactgctagtccaaaagagcaaaagcaacatatgcgaagcttacttctgctggctacagggaacaaactaagagcccttgttgctcagaagacaactaatgtgattaccaatgttacaacacgaaataggagctctactggtcaccatggatcaagtgccgaagaagatggccatattgggttggccgcactatcatcgacatga

SEQ ID NO: 9756 - protein, 1201 aa, Sorghum bicolor
  misc_feature: Ceres ANNOT ID no. 6105669
  misc_feature (108)..(268): Pfam Id: Xpo1 Pfam Desc: Exportin 1-like protein
  misc_feature (4)..(1177): NCBI GI: 28629393 NCBI Desc: hasty [arabidopsis thaliana]
  misc_feature (167)..(1198): NCBI GI: 92875785 NCBI Desc: hasty [medicago truncatula]
  misc_feature (1)..(1157): NCBI GI: 57209079 NCBI Desc: xpo5 [homo sapiens]
  misc_feature (1)..(1157): NCBI GI: 12407633 NCBI Desc: ranbp21 [homo sapiens]
  misc_feature (1)..(1157): NCBI GI: 22748937 NCBI Desc: exportin 5 [homo sapiens]
MAAEPAAAAAASAAAAISAVMDWRSSPDARAAAFAYLESVKSGDVRALASTSFLLVRKDQTSEIRLHGFKMLQHLVRLRWEELSAAERNEFANLTINLISDVVGPHEVWALKSQTAALVAEVVRREGVDLWNTLLPSIVSLSNSGPIEAELVAMILRWLPEDITVHNEDLEGDRRRSLLRGLTESLSQILPLLYSLLEKHFVAALSEHAKQQMDLAKQHAGTVTAVLNAVNAYAEWAPVTDLAKYGLIHGCGSLLSYSDFRLHACEFFKVICQRKRPVDVAVAEYDAAMCNIFQVLMNISQQFLTRSGMQPSSIDESEYEFASCVCETMVALGSSNMQCILADGPRTFQFLQQMLEYYQHYKIALHFQSLLFWLVVLREPSKAKSVARVSGDNSAAGNSASTGDLSTEKEKKGVSVFVTDEMYSTILDVSFKRMLKNSGSATSGLLELWSEELEGKSDFCNYRTKLLDLIKVIASQRSVIAAASVVQRINVVFGDANQATKSPQDLDAMEGAQLGLEAVVSAIFDGSFDCGKTDLETKSQLHKIFEGLLQQLLSLKWTEPNLAVIHGHYLDALGPFLKHYPDAVASVVNKLFELLTSLPITFQDPSNNSRLARLQICSSFIRISRAADKALLPHMKNIADTMAYLQGEGRLLRGEHNHLCEAFLVMASSAGIQQQQEVLAWLLEPLNKMWTQVEWQTAYLSDPSGLTNMFADSQFMWSIYHTVTFFEKALKRSGTKKSSAALQAPTTTVPGYLHPMSSHLAWIVPPLLRLLRCIHAFWSEPFAQSQTGEIKAAKSMTVAEQASLLGETGKLTKGQVAPADGLLDVQRDGESKENNIKNWLRGIRDSGYNVLGLAATLGEPFFRCIEGSSVTLALMENMQVMEFRHLRQLIHLVIIPFVKYCPADLWHVWLVNLLQPLFVHCQQALNYSWSSLLHEGRAKVPDSIGNLPGSELKVEVMEEKLLRDLTREVCSVLWALSSPGLNNGLPSLEQLGPSNRMDSVLKNLESFASSSLTGFLMLHIGTALPALRISVEVFTWTDSEAVTKVIPFCGALIHLAIASNQAELRQFVAKDLFSSIIHGLSVESNSVMSAELVGLCREIYVYLSDRDPAPRQVLLSLPHIKQEDLLAFDDSLSKTASPKEQKQHMRSLLLLATGNKLRALVAQKTTNVITNVTTRNRSSTGHHGSSAEEDGHIGLAALSST

SEQ ID NO: 9757 - DNA, 312 bp, Sorghum bicolor
  misc_feature: Ceres ANNOT ID no. 6105860
  misc_feature: Encodes the peptide sequence at SEQ ID NO 9758
atggaccaggtgacaaggctggcatcgcagcgtgcagtggtgatcttcagcacgagcacctgctgcatgtgccacactgtgacgcagctcttccgcgagctcggggtgaacacgatggtggtggagctggacaaggagccgcggggaaaggagatggaaaaggggctggcgaggctactgggccgcagtgcaggtgtcccagcggtgttcatcggtggcaggctcgtcggctccacggacaaggtcatgtcgctccacctcagcggcaacctcgtccctctgctgcgcaatgcgggggcactctgggtctag

SEQ ID NO: 9758 - protein, 103 aa, Sorghum bicolor
  misc_feature: Ceres ANNOT ID no. 6105860
  misc_feature (13)..(76): Pfam Id: Glutaredoxin Pfam Desc: Glutaredoxin
  misc_feature (1)..(103): NCBI GI: 75326792 NCBI Desc: glutaredoxin-c1 precursor
  misc_feature (1)..(103): NCBI GI: 102139809 NCBI Desc: glutaredoxin family protein [musa acuminata]
  misc_feature (1)..(103): NCBI GI: 102139810 NCBI Desc: glutaredoxin family protein [musa acuminata]
  misc_feature (2)..(103): NCBI GI: 115442091 NCBI Desc: os01g0936000 [oryza sativa (japonica cultivar-group)]
  misc_feature (1)..(103): NCBI GI: 122064227 NCBI Desc: monothiol glutaredoxin-s8
  misc_feature: Useful for making plants with altered protein content
  misc_feature: Functional homolog of the protein sequence given in SEQ ID NO 13359
  misc_feature: Useful for making plants with altered protein content
  misc_feature: Functional homolog of the protein sequence given in SEQ ID NO 13359
  misc_feature: The sequence is a functional homolog of SEQ ID NO. 382 in the 11/188,298 US application
MDQVTRLASQRAVVIFSTSTCCMCHTVTQLFRELGVNTMVVELDKEPRGKEMEKGLARLLGRSAGVPAVFIGGRLVGSTDKVMSLHLSGNLVPLLRNAGALWV

SEQ ID NO: 9759 - DNA, 2187 bp, Sorghum bicolor
  misc_feature: Ceres ANNOT ID no. 6105902
  misc_feature: Encodes the peptide sequence at SEQ ID NO 9760
atggcacacagccgcgagccaatcctcctcgatgaggggtgggcacatatgagggccggcttcgaaaagctcaagctcatcctcgccggtgaacccggcgtcgccttcgtctccgtcgagtacatgcacctctacactacaatatacaatatgtgcacgcagaagcctccaaatgactactcggggctgctctaccaaaggtaccaggaggttttgaacgactacatcactgccacggtgctgccgtccttgcaggacaagcacggcgagttcctgctgaaggaactggtgttcaggtggaaaaaccataagctaatggtcaggtggctcagcaggtttttctactatcttgaccgctactttatttcacggaggtcactcgtgccccttaaaaatgttggctgggattcattcaaaactctggtttttgacaaccataaagcaacagtgacatcgattctgattgccatggttgacgaggatagggagggacagattatagatcgtactcttgtcaagaatgttcttgatatctatattgaaattgattctgattctgggtcaaaactttacaacgaggacttcgaagatgcctttctgaaggctacagttgattactattctaagaaggcccaagcctggattgtggaggacacgtgccctgaatacatggttaaggcagaggagtgtttacaaaaagagaagcaacgagttgcacagtatttgcatgctaatactgaaccgaggttgatggaggatgtgcaagaagaattgctaacttcgcatatggagcaaattctgaggaaacagaactctggatgcaaagtgttgctttgtgatgaaaaggttgaagatctttcaaggatgtttagtctcttctctaggattaatggtggcctgactccagtatctaaaatattccaggagcatgtcaatgaagtaggcatgtctttgttgaaacaagcaatagatgctgctaccagcaaaaagaatgagaagaaagatgtagtgagtacattggaactggactatgtgcggaaaatcttagatctccatgacaaatacaaggcatatgtcatcaactgtttccaaaaccatacactatttcacaaggcacttaaggaggcctttgaagttgtttgcaataaaactgttgctggttgctctagtgctgaattgttcgcagcatactgtgacagcattcttaaaaaaggtggatgtgaaaaacttagtgacgaagcaattgaagagaaccttgataaggcatggaaaaaactaggaaggagattgatctttgataggagtggcaatagtgatcaagagcgaagcctgctgtccaagctaaagcagtattttggagcgcagtttacttcaaaaatggagggcatgatcaatgatgtcacagttgcaaaagataagcacacagacttagaaaattacataagagagaacccagaattaaatcctagggtagacctgagtgttcaggttttgacaacaggatactggccaacttacaaaagcactgatataaatcttccttcagagatggttaaatgtgtggaggttttcagtaaattttatcattccaacacggatcgaaaaagaaagcttaattggatttattccttgggtaattgcaccgttgttgggaatttcaaagcccaaaaaattgatctgattgttacaacttatcaggctgcactcctgttgctattcaacgagtctgaaagactaagtttctctgagatcgtgacacaattaaacctttctgaagatgatactgtgcgtctgcttcattcactgtcatgtgcaaagtacaagattctcaacaaagagccaaatagcagaacaatttccccaaaggacgtctttgagttcaaccacagatttaccgataaaatgcgcaggataaaggtaccacttcctccatccgatgagaagaaaaaggtaatcgaagatgttaacaaggacaggaggtttgcaattgatgcagcgctagtgcgtattatgaagagccgcaagatcatgacccaccagaatctcgttgcggaatgtgtgcaacagctcagccgcatgttcaagcctgatatcaaaatgatcaagagaaggattgaggaccttatcaccagagactacctggaacgcgatagagacgcgccgaactcatatcgatacgtagcttga

SEQ ID NO: 9760 - protein, 728 aa, Sorghum bicolor
  misc_feature: Ceres ANNOT ID no. 6105902
  misc_feature (14)..(632): Pfam Id: Cullin Pfam Desc: Cullin family
  misc_feature (3)..(728): NCBI GI: 33243052 NCBI Desc: cul1 [oryza sativa (japonica cultivar-group)]
  misc_feature (5)..(728): NCBI GI: 92877087 NCBI Desc: cullin [medicago truncatula]
  misc_feature (3)..(728): NCBI GI: 82470783 NCBI Desc: cullin 1-like protein c [petunia inflata]
  misc_feature (47)..(728): NCBI GI: 115462119 NCBI Desc: os05g0149600 [oryza sativa (japonica cultivar-group)]
  misc_feature (1)..(728): NCBI GI: 34481801 NCBI Desc: cullin 1b [nicotiana tabacum]
MAHSREPILLDEGWAHMRAGFEKLKLILAGEPGVAFVSVEYMHLYTTIYNMCTQKPPNDYSGLLYQRYQEVLNDYITATVLPSLQDKHGEFLLKELVFRWKNHKLMVRWLSRFFYYLDRYFISRRSLVPLKNVGWDSFKTLVFDNHKATVTSILIAMVDEDREGQIIDRTLVKNVLDIYIEIDSDSGSKLYNEDFEDAFLKATVDYYSKKAQAWIVEDTCPEYMVKAEECLQKEKQRVAQYLHANTEPRLMEDVQEELLTSHMEQILRKQNSGCKVLLCDEKVEDLSRMFSLFSRINGGLTPVSKIFQEHVNEVGMSLLKQAIDAATSKKNEKKDVVSTLELDYVRKILDLHDKYKAYVINCFQNHTLFHKALKEAFEVVCNKTVAGCSSAELFAAYCDSILKKGGCEKLSDEAIEENLDKAWKKLGRRLIFDRSGNSDQERSLLSKLKQYFGAQFTSKMEGMINDVTVAKDKHTDLENYIRENPELNPRVDLSVQVLTTGYWPTYKSTDINLPSEMVKCVEVFSKFYHSNTDRKRKLNWIYSLGNCTVVGNFKAQKIDLIVTTYQAALLLLFNESERLSFSEIVTQLNLSEDDTVRLLHSLSCAKYKILNKEPNSRTISPKDVFEFNHRFTDKMRRIKVPLPPSDEKKKVIEDVNKDRRFAIDAALVRIMKSRKIMTHQNLVAECVQQLSRMFKPDIKMIKRRIEDLITRDYLERDRDAPNSYRYVA

SEQ ID NO: 9761 - DNA, 669 bp, Sorghum bicolor
  misc_feature: Ceres ANNOT ID no. 6105961
  misc_feature: Encodes the peptide sequence at SEQ ID NO 9762
atggcgccaatgaaggtgtatgggtgggccgtgtcgccgtggatggcgcgcgccctggtgtgcctggaggaggccggcgtggagtacgaggttgtcccgatgagcaggtgcggcggcgaccaccgccgcccagagcacctcgccagaaacccgttcggtgaaatccctgttctagaggacggtgatctgacgctctaccaatcacgcgccattgcacggtacgttcttcgcaagtacaagccagagcttgtcaaggaaggcgacctggagggatcagcaatggtggacgtatggatggaggtggaagccaacaacatcgagccgaccctgtggcccatcgtccggcactgcatcatcggccagtacgtcgggcgcgaccgcgaccaggccgtcattgacgagaacctcgagaagctgaggatgctgctgccggtgtatgaggctaggttgtcagtctgcaagtacctagcgggggacgacatcactgccgccgacctctgccacttcggtttcatgcgctacttcatggccacggagtacgccggcgtggtggacgcgttcccgcacgtcaaggcgtggtgggatgcgctgctggcgaggccgtcggtgcagaaggtgatggccggcatgccgccggattttgggtatgccagcggcaacattccgtag

SEQ ID NO: 9762 - protein, 222 aa, Sorghum bicolor
  misc_feature: Ceres ANNOT ID no. 6105961
  misc_feature (2)..(77): Pfam Id: GST_N Pfam Desc: Glutathione S-transferase, N-terminal domain
  misc_feature (110)..(201): Pfam Id: GST_C Pfam Desc: Glutathione S-transferase, C-terminal domain
  misc_feature (3)..(222): NCBI GI: 11385467 NCBI Desc: glutathione s-transferase gst 8 [zea mays]
  misc_feature (1)..(222): NCBI GI: 23504743 NCBI Desc: glutathione transferase f4 [triticum aestivum]
  misc_feature (1)..(215): NCBI GI: 23504741 NCBI Desc: glutathione transferase f3 [triticum aestivum]
  misc_feature (2)..(216): NCBI GI: 23504739 NCBI Desc: glutathione transferase f2 [triticum aestivum]
  misc_feature (4)..(215): NCBI GI: 695789 NCBI Desc: glutathione transferase [zea mays]
  misc_feature (4)..(215): SWISSPROT Homolog: EC 2.5.1.18 Glutathione S-transferase IV
MAPMKVYGWAVSPWMARALVCLEEAGVEYEVVPMSRCGGDHRRPEHLARNPFGEIPVLEDGDLTLYQSRAIARYVLRKYKPELVKEGDLEGSAMVDVWMEVEANNIEPTLWPIVRHCIIGQYVGRDRDQAVIDENLEKLRMLLPVYEARLSVCKYLAGDDITAADLCHFGFMRYFMATEYAGVVDAFPHVKAWWDALLARPSVQKVMAGMPPDFGYASGNIP

SEQ ID NO: 9763 - DNA, 552 bp, Sorghum bicolor
  misc_feature: Ceres ANNOT ID no. 6106107
  misc_feature: Encodes the peptide sequence at SEQ ID NO 9764
atgtcgtccccgagcaagcgccgtgagatggacctcatgaagctgatgatgagcgactacaaggtggagatggtgaacgacgggatgcaggaattcttcgtagaatttaaggggccgaccgaaagtatctaccaaggtggtgtctggaaggttagggtagaactgcctgatgcatatccttacaaatccccctccattggcttcatcaacaagatttatcacccgaatgtcgatgagatgtctggctctgtctgtttggatgtcatcaaccagacatggagcccaatgtttgatctagtaaatgtttttgaagtattccttccacagcttttactgtatccgaatccttctgatccattaaatggggaggctgcagcactgatgatgcgtgatcgtcctgcttatgaacagaaagtgaaagagtattgtgaaaagtatgccaaaccagaggacgctggcatcactccggaagacaaatccagcgacgaagagcttagtgaggaggaagatgactccggggatgaagctatacttggcaatcctgatccttag

SEQ ID NO: 9764 - protein, 183 aa, Sorghum bicolor
  misc_feature: Ceres ANNOT ID no. 6106107
  misc_feature (7)..(143): Pfam Id: UQ_con Pfam Desc: Ubiquitin-conjugating enzyme
  misc_feature (1)..(183): NCBI GI: 6066285 NCBI Desc: ubiquitin carrier protein 4 [glycine max]
  misc_feature (1)..(183): NCBI GI: 431266 NCBI Desc: ubiquitin conjugating enzyme
  misc_feature (1)..(183): NCBI GI: 136644 NCBI Desc: ubiquitin-conjugating enzyme e2-23 kda (ubiquitin-protein ligase) (ubiquitin carrier protein)
  misc_feature (1)..(183): NCBI GI: 2815252 NCBI Desc: ubiquitin carrier protein [arabidopsis thaliana]
  misc_feature (1)..(182): NCBI GI: 19113409 NCBI Desc: ubiquitin conjugating enzyme [schizosaccharomyces pombe]
  misc_feature (1)..(183): SWISSPROT Homolog: EC 6.3.2.19 Ubiquitin-conjugating enzyme E2-21 kDa 1
MSSPSKRREMDLMKLMMSDYKVEMVNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEYCEKYAKPEDAGITPEDKSSDEELSEEEDDSGDEAILGNPDP

SEQ ID NO: 9765 - DNA, 1083 bp, Sorghum bicolor
  misc_feature: Ceres ANNOT ID no. 6106160
  misc_feature: Encodes the peptide sequence at SEQ ID NO 9766
atggacgcggtggtcgtcgacgcgggctccaaactgctcaaggccggcatcgcggcgcccgaccaggcgcccccgctggtgatgccgtcgaagatgaaggtggatgtggaggaccaggagctggccgacggcgccgtggttgaggaggtggtgcagccggtggtgcgcggcttcgtcaaggactgggacgccatggaggacctactcaactacgtcctctacaggaacattgggtgggagattggggatgagggccagattctcttcaccgaaccgctcttcacacccaagactcttcgggagcaattggtgcagcttatgtttgaaaagttcaatgtttcaggcttttatgcctctgaacaggctgtattgtcactctatgctgttggacgcatttcaggatgtacagttgacattgggcacgggaaaatagatattgctccagtttgtgaaggagctgttcaacacatagcttctaagagattagagattgggggggttgacttgacaaacctgtttgcacaagaactgaaaaaatccaatccatcagtaaaccttgatgtttctgatgttgagaggctgaaagagcagtatgcatgttgcgcagaagatcagttggcttttgaagctataggaagctcttgccaaccagaaaagcacactcttcctgatgggcaggttataacaattgaaaaagagggatacattgttggtgaagctttatttcaaccatgtatattgggcttggaagattatggtatcgttcaccagctagttactagtgtctcaaatgtttcatcagagtaccatcgtcagctgcttgaaaataccatgttatgtggtggcaccgcatcaatgactggctttgaggacaggttccagagagaagcaaatctgtctgcttcagcaatctgtccatcacttgtgaagccccctgaatacatgcctgagaacctagcaaggtactcggcctggttgggtggtgcgatcttggccaaggtcgttttccctcaaaaccagcatgtcaccaagggcgagtatgatgagacggggccgtccattgtgcacaagaagtgcttttag

SEQ ID NO: 9766 - protein, 360 aa, Sorghum bicolor
  misc_feature: Ceres ANNOT ID no. 6106160
  misc_feature (3)..(360): Pfam Id: Actin Pfam Desc: Actin
  misc_feature (1)..(360): NCBI GI: 92897486 NCBI Desc: actin/actin-like [medicago truncatula]
  misc_feature (1)..(360): NCBI GI: 21593327 NCBI Desc: actin-like protein [arabidopsis thaliana]
  misc_feature (1)..(144): NCBI GI: 7329693 NCBI Desc: actin-like protein [arabidopsis thaliana]
  misc_feature (163)..(360): NCBI GI: 115455733 NCBI Desc: os03g0783000 [oryza sativa (japonica cultivar-group)]
  misc_feature (214)..(360): NCBI GI: 110741084 NCBI Desc: actin - like protein [arabidopsis thaliana]
MDAVVVDAGSKLLKAGIAAPDQAPPLVMPSKMKVDVEDQELADGAVVEEVVQPVVRGFVKDWDAMEDLLNYVLYRNIGWEIGDEGQILFTEPLFTPKTLREQLVQLMFEKFNVSGFYASEQAVLSLYAVGRISGCTVDIGHGKIDIAPVCEGAVQHIASKRLEIGGVDLTNLFAQELKKSNPSVNLDVSDVERLKEQYACCAEDQLAFEAIGSSCQPEKHTLPDGQVITIEKEGYIVGEALFQPCILGLEDYGIVHQLVTSVSNVSSEYHRQLLENTMLCGGTASMTGFEDRFQREANLSASAICPSLVKPPEYMPENLARYSAWLGGAILAKVVFPQNQHVTKGEYDETGPSIVHKKCF

SEQ ID NO: 9767 - DNA, 708 bp, Sorghum bicolor
  misc_feature: Ceres ANNOT ID no. 6106161
  misc_feature: Encodes the peptide sequence at SEQ ID NO 9768
atgcgcaagtttcaggactccgtcaaggccctccaggccgacatcgatcacgccaatgagctggcgtcggaattcctgagggactacgacggctcggtcatccagatgcggatggcctacagcgccgtcgcgcatttcctcgtgcagtggaccgactgcaagctggccggcgcgctcggcctcctcaaggttatgctatacaaggtgtacgcggacgactcgtcggcgcttcctgactgggagagggaggccagcatcagggagttctacggcatcattttcccgtcgctgctgctgctgccgagcggcatcaccgagctggacgacaggaaacagaggaaactctgcctgaagaaattcaggagcagggatgagcagctctcggaggtggacacggagagggagctcgagtgcgggatctgcctcgaggttagccgcaagatcgtgctgcccgactgtgcccacacgctctgcatgcgctgctttgaggactggaacgagaaatcaaagtcctgccccttctgtcgcgcctgccttgaggaggtgaagccaggcagcctgtggatgtacactgacgacagcgacgttgtggatatggatactttgactagggagaacattaggcggctgtttatgtacataaataagttgccacttgtagtcctacatgtagttgaccttgacatttacgagtaccgcatcaagtaa

SEQ ID NO: 9768 - protein, 235 aa, Sorghum bicolor
  misc_feature: Ceres ANNOT ID no. 6106161
  misc_feature (2)..(235): NCBI GI: 38175742 NCBI Desc: zinc finger protein family-like [oryza sativa (japonica cultivar-group)]
  misc_feature (2)..(235): NCBI GI: 124360609 NCBI Desc: zinc finger, ring-type [medicago truncatula]
  misc_feature (4)..(221): NCBI GI: 21618121 NCBI Desc: rna-binding protein-like protein [arabidopsis thaliana]
  misc_feature (1)..(220): NCBI GI: 140051168 NCBI Desc: zinc finger, ring-type [medicago truncatula]
  misc_feature (4)..(221): NCBI GI: 9294812 NCBI Desc: mtd2 [medicago truncatula]
  misc_feature: Useful for making plants with altered Lignin content
  misc_feature: Functional homolog of the protein sequence given in SEQ ID NO 13283
  misc_feature: Useful for making plants with altered lignin content
  misc_feature: Functional homolog of the protein sequence given in SEQ ID NO 13283
MRKFQDSVKALQADIDHANELASEFLRDYDGSVIQMRMAYSAVAHFLVQWTDCKLAGALGLLKVMLYKVYADDSSALPDWEREASIREFYGIIFPSLLLLPSGITELDDRKQRKLCLKKFRSRDEQLSEVDTERELECGICLEVSRKIVLPDCAHTLCMRCFEDWNEKSKSCPFCRACLEEVKPGSLWMYTDDSDVVDMDTLTRENIRRLFMYINKLPLVVLHVVDLDIYEYRIK

SEQ ID NO: 9769 - DNA, 360 bp, Sorghum bicolor
  misc_feature: Ceres ANNOT ID no. 6106182
  misc_feature: Encodes the peptide sequence at SEQ ID NO 9770
atggaggacggcaacggcaaggacaccggtggcggtggcaccaagccgtgttgctctaagcgtccgtggggcaagtttgctgccgagatccgtgacccggagcgtggcggcgcccgggtttggcttggcacactcgacacggccgaggaggccgcgcgccgcggcgccgccgctgtgctcaacttcccggccggcatcggtgaggccgccggcagggtcgccgccggtaattcttctcctggcccctctgcctcgttgaggaggatgggccgctggaacggtgaaaggatcgagctcgagtgcctcgacgataaggtcctcgacgaccttctcgataaagacaagtatggcggtaaatga

SEQ ID NO: 9770 - protein, 119 aa, Sorghum bicolor
  misc_feature: Ceres ANNOT ID no. 6106182
  misc_feature (19)..(65): Pfam Id: AP2 Pfam Desc: AP2 domain
  misc_feature (20)..(114): NCBI GI: 38567644 NCBI Desc: b1234d02.6 [oryza sativa (japonica cultivar-group)]
  misc_feature (1)..(114): NCBI GI: 33440020 NCBI Desc: ap23 [oryza sativa (japonica cultivar-group)]
  misc_feature (20)..(82): NCBI GI: 56567585 NCBI Desc: bth-induced erf transcriptional factor 3 [oryza sativa (indica cultivar-group)]
  misc_feature (20)..(82): NCBI GI: 113537145 NCBI Desc: os02g0654700 [oryza sativa (japonica cultivar-group)]
  misc_feature (20)..(82): NCBI GI: 116310255 NCBI Desc: osigba0101c23.15 [oryza sativa (indica cultivar-group)]
  misc_feature: The plant flowers significantly late compared to wild-type.
  misc_feature: The plant is abnormally small.
  misc_feature: The sequence is a functional homolog of SEQ ID NO 14 in the 10/903,236US patent application
  misc_feature: The sequence is a functional homolog of SEQ ID NO 16 in the 10/903,236US patent application
  misc_feature: The sequence is a functional homolog of SEQ ID NO 1737 in the 10/374,780US patent application
  misc_feature: The sequence is a functional homolog of SEQ ID NO 18 in the 10/903,236US patent application
  misc_feature: The sequence is a functional homolog of SEQ ID NO 2129 in the 10/666,642US patent application
  misc_feature: The sequence is a functional homolog of SEQ ID NO 2209 in the 10/666,642US patent application
  misc_feature: The sequence is a functional homolog of SEQ ID NO 2211 in the 10/666,642US patent application
  misc_feature: The sequence is a functional homolog of SEQ ID NO 74 in the 10/714,887US patent application
  misc_feature: The sequence is a functional homolog of SEQ ID NO 74 in the 11/435,388US patent application
  misc_feature: The sequence is a functional homolog of SEQ ID NO 76 in the 10/714,887US patent application
  misc_feature: The sequence is a functional homolog of SEQ ID NO 76 in the 11/435,388US patent application
  misc_feature: The sequence is a functional homolog of SEQ ID NO 78 in the 10/714,887US patent application
  misc_feature: The sequence is a functional homolog of SEQ ID NO 78 in the 11/435,388US patent application
  misc_feature: Useful for making plants with altered lutein content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 13470
  misc_feature: The sequence is a functional homolog of SEQ ID NO 14 in the 20050155117 US patent application
  misc_feature: The sequence is a functional homolog of SEQ ID NO 16 in the 20050155117 US patent application
  misc_feature: The sequence is a functional homolog of SEQ ID NO 18 in the 20050155117 US patent application
MEDGNGKDTGGGGTKPCCSKRPWGKFAAEIRDPERGGARVWLGTLDTAEEAARRGAAAVLNFPAGIGEAAGRVAAGNSSPGPSASLRRMGRWNGERIELECLDDKVLDDLLDKDKYGGK

SEQ ID NO: 9771 - DNA, 1626 bp, Sorghum bicolor
  misc_feature: Ceres ANNOT ID no. 6106188
  misc_feature: Encodes the peptide sequence at SEQ ID NO 9772
atggcgcgcgggggagacggcctgcaggtgctcagcgcgctggacgcggccaagacgcagtggtaccacttcacggccatcatcgtggccggcatgggcttcttcaccgacgcctacgacctcttctgcatctccctcgtcaccaagctgctgggccgcatctactacacggacaccagcaaggacaaccccggctcgctccctcccaacgtcgccgccgcggtcaacggcgtcgccttctgcggcacgctcgccggccagctcttcttcggctggctcggcgacaagctcggccgcaagagcgtctacgggatgacgctcatgctcatggtcatctgctccatcgcgtcgggcctctccttcggccacacccccacgggtgtcatggccacgctctgcttcttccgcttctggctcgggttcggcatcggcggcgactacccgctgtccgccaccatcatgtccgagtacgccaacaagaagacccgcggcgccttcatcgccgccgtcttcgccatgcagggcttcggcatcctcgccggtggcattgtcacgctcatcatctccgccgcgttccgcgccgggtaccctgccccggcgtacaaggacgaccacttcaactccaccgtgccgcagtccgacttcgtgtggcgcatcatcctcatgctcggcgccttgccggcgctgctcacctactactggcggatgaagatgcccgagacggcgcgctacaccgcgctggtggccaagaacgccaagcaggccgcggccgacatgtccaaggtgctccacacggagatcgtcgacgagcaggagaagctggaccagatggtcaccgccgagagcaacaccttcggcctcttctccagggagttcgcgcgccgccacggcctccacctcgtcggcaccgccaccacctggttcctgctcgacatcgccttctacagccagaacctgttccagaaggacatcttcacggccatcaactggatccccaaggccaacaccatgagcgcgctcgaggaggtgttccgcatctcccgcgcgcagacgctcatcgcgctctgcggcaccgtcccggggtactggttcaccgtcgcgctcatcgacgtcgtcggacgattcgccatccagctgctcggattcttcatgatgaccgtcttcatgctcggcctcgccatcccctaccaccactggaccaccgccggcaaccacatcggattcgtcgtcatgtacggcttcaccttcttcttcgcaaacttcgggcccaacagcaccaccttcatcgtgccggctgagatcttcccggcgcggctgcgctccacctgccacggcatctccgccgcctcggggaaggccggagccatcatcggcgccttcgggttcctgtacgcggcgcagaaccaggacaagagcaaggcggacgccgggtaccccgcgggcatcggcgtgcgcaactcgctcttcgtcctcgcgggctgcaacatgctcggattcgtcctcactttcctcgtgccggagtccaagggcaagtcgctggaggagatgtcaggtgaggctgacgacgccgaggaggaggccgtcggcgcccgcgcggtgcggccgtcggagacccagatggtatag

SEQ ID NO: 9772 - protein, 541 aa, Sorghum bicolor
  misc_feature: Ceres ANNOT ID no. 6106188
  misc_feature (26)..(520): Pfam Id: Sugar_tr Pfam Desc: Sugar (and other) transporter
  misc_feature (30)..(459): Pfam Id: MFS_1 Pfam Desc: Major Facilitator Superfamily
  misc_feature (1)..(541): NCBI GI: 65335848 NCBI Desc: inorganic phosphate transporter 1 [zea mays]
  misc_feature (1)..(541): NCBI GI: 65335863 NCBI Desc: inorganic phosphate transporter 2 [zea mays]
  misc_feature (1)..(541): NCBI GI: 49066604 NCBI Desc: phosphate transport protein [zea mays]
  misc_feature (1)..(541): NCBI GI: 65335894 NCBI Desc: inorganic phosphate transporter 4 [zea mays]
  misc_feature (1)..(536): NCBI GI: 29367133 NCBI Desc: phosphate transporter hvpt4 [hordeum vulgare subsp. vulgare]
  misc_feature: Useful for making plants with modulated carbohydrate content
  misc_feature: Useful for making plants with modulated phosphate use efficiency
  misc_feature: Functional homolog of the protein sequence given in SEQ ID NO 13399
  misc_feature: GREAT-hit functional homolog of the protein sequence given in SEQ ID NO 13401
  misc_feature: GREAT-hit functional homolog of the protein sequence given in SEQ ID NO 13402
  misc_feature: Functional homolog of the protein sequence given in SEQ ID NO 13403
  misc_feature: GREAT-hit functional homolog of the protein sequence given in SEQ ID NO 13404
  misc_feature: Functional homolog of the protein sequence given in SEQ ID NO 13406
  misc_feature: Functional homolog of the protein sequence given in SEQ ID NO 13407
  misc_feature: Functional homolog of the protein sequence given in SEQ ID NO 13408
  misc_feature: Useful for making plants with modulated phosphate use efficiency
  misc_feature: Functional homolog of the protein sequence given in SEQ ID NO 13401
  misc_feature: Useful for making plants with modulated carbohydrate content
  misc_feature: Functional homolog of the protein sequence given in SEQ ID NO 13408
  misc_feature: The sequence is a functional homolog of SEQ ID NO. 296 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSIASGLSFGHTPTGVMATLCFFRFWLGFGIGGDYPLSATIMSEYANKKTRGAFIAAVFAMQGFGILAGGIVTLIISAAFRAGYPAPAYKDDHFNSTVPQSDFVWRIILMLGALPALLTYYWRMKMPETARYTALVAKNAKQAAADMSKVLHTEIVDEQEKLDQMVTAESNTFGLFSREFARRHGLHLVGTATTWFLLDIAFYSQNLFQKDIFTAINWIPKANTMSALEEVFRISRAQTLIALCGTVPGYWFTVALIDVVGRFAIQLLGFFMMTVFMLGLAIPYHHWTTAGNHIGFVVMYGFTFFFANFGPNSTTFIVPAEIFPARLRSTCHGISAASGKAGAIIGAFGFLYAAQNQDKSKADAGYPAGIGVRNSLFVLAGCNMLGFVLTFLVPESKGKSLEEMSGEADDAEEEAVGARAVRPSETQMV

SEQ ID NO: 9773 - DNA, 1569 bp, Sorghum bicolor
  misc_feature: Ceres ANNOT ID no. 6106189
  misc_feature: Encodes the peptide sequence at SEQ ID NO 9774
atggctggcgagcagctcaaagttctgacggcgctggaccaggcgaagacgcagtggtaccatttcatggccatcgtgatcgccggcatgggcttcttcacggacgcctacgacctcttctgcatctccctcgtctccaagctgctgggccgcatctactacacggagcccaacacccccagccccggcaccctgccgcccaacgtgtccgcggccgtgaacggcgtcgcgctctgcggcacgctcgccggccagctcttcttcggctggctcggcgacaagctcggccggaaaagcgtctacggcttcacgctcatcctcatggtgctctgctccgtcgcgtcgggcctctcgttcggccaaacccccaagggcgtcatcgccacgctctgcttcttccgcttctggctcgggttcggcatcggcggcgactacccgctgtcggccaccatcatgtccgagtacgccaacaagaagacccgcggcgccttcatcgccgccgtgttcgccatgcagggcttcggcatcctcttcggcgccatcgtcgcgctcgtcgtgtccagcggcttccggaactcgtacccggcgccgtcgtaccaggacaaccccgcggcgtcgctcgtccccgaggccgactacgtgtggcggatcatcctcatgttcggcaccatcccggcggcgctcacctactactggcgcatgaagatgccggagacggcgcggtacacggcgctcatcgcgcgcaacgccaagcaggccgcggcggacatgtccaaggtgctcaactcggagatcgaggaggacctggaccgcgccggcgagcgcaaggccagcaacgagtgggggctcttctcggcgcagttcgtgcgccggcacgggctccacctgctgggcaccaccaccacgtggttcctcctggacattgccttctacagccagaacctgttccagaaggacatcttctccaaggtcgggtggatcccgccggccaagaccatgaacgccgtcgaggaggtgttccgcatcgcgcgcgcgcaggcgctcatcgcgctctgcggcaccatcccgggctactggttcaccgtcttcttcatagacatcatcggccgcttcgccatccagctcatggggttcttcatgatgaccgtcttcatgatcggcctcgccgcgccgtaccaccactggaccaccgccggccaccacaccggcttcgtcgtcatgtacggcttcaccttcttcttcgcaaacttcgggcccaacagcaccaccttcatcgtgccggctgagatcttcccggcgcggctgcggtccacctgccacggcatatcggccgcggctggcaaggccggtgccatcatcggcgcgttcgggttcctgtacgctgcgcaggacccgcacacgccggaggccggctactcgcccggcatcggcatccgcaacgcgctcttcgtgctagccggcaccaacttccttgggatgatcatgacgctgctggtgccggagtccaagggattgtcacttgaagagatatccaaggagaacgttgacgacgacgaggcggccgcttga

SEQ ID NO: 9774 - protein, 522 aa, Sorghum bicolor
  misc_feature: Ceres ANNOT ID no. 6106189
  misc_feature (28)..(455): Pfam Id: MFS_1 Pfam Desc: Major Facilitator Superfamily
  misc_feature (23)..(514): Pfam Id: Sugar_tr Pfam Desc: Sugar (and other) transporter
  misc_feature (1)..(522): NCBI GI: 52550761 NCBI Desc: phosphate transporter 1 [oryza sativa (japonica cultivar-group)]
  misc_feature (1)..(520): NCBI GI: 33242907 NCBI Desc: phosphate transporter [oryza sativa (japonica cultivar-group)]
  misc_feature (1)..(520): NCBI GI: 52550763 NCBI Desc: phosphate transporter 2 [oryza sativa (japonica cultivar-group)]
  misc_feature (1)..(522): NCBI GI: 15594018 NCBI Desc: inorganic phosphate transporter [triticum aestivum/thinopyrum intermedium alien addition line]
  misc_feature (1)..(522): NCBI GI: 31580632 NCBI Desc: phosphate transporter 8 [triticum aestivum]
  misc_feature: Useful for making plants with modulated phosphate use efficiency
  misc_feature: GREAT-hit functional homolog of the protein sequence given in SEQ ID NO 13396
  misc_feature: GREAT-hit functional homolog of the protein sequence given in SEQ ID NO 13397
  misc_feature: GREAT-hit functional homolog of the protein sequence given in SEQ ID NO 13398
  misc_feature: Functional homolog of the protein sequence given in SEQ ID NO 13399
  misc_feature: Functional homolog of the protein sequence given in SEQ ID NO 13401
  misc_feature: Functional homolog of the protein sequence given in SEQ ID NO 13404
  misc_feature: Useful for making plants with modulated phosphate use efficiency
  misc_feature: Functional homolog of the protein sequence given in SEQ ID NO 13398
  misc_feature: Useful for making plants with modulated carbohydrate content
  misc_feature: Functional homolog of the protein sequence given in SEQ ID NO 13408
  misc_feature: The sequence is a functional homolog of SEQ ID NO. 296 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
MAGEQLKVLTALDQAKTQWYHFMAIVIAGMGFFTDAYDLFCISLVSKLLGRIYYTEPNTPSPGTLPPNVSAAVNGVALCGTLAGQLFFGWLGDKLGRKSVYGFTLILMVLCSVASGLSFGQTPKGVIATLCFFRFWLGFGIGGDYPLSATIMSEYANKKTRGAFIAAVFAMQGFGILFGAIVALVVSSGFRNSYPAPSYQDNPAASLVPEADYVWRIILMFGTIPAALTYYWRMKMPETARYTALIARNAKQAAADMSKVLNSEIEEDLDRAGERKASNEWGLFSAQFVRRHGLHLLGTTTTWFLLDIAFYSQNLFQKDIFSKVGWIPPAKTMNAVEEVFRIARAQALIALCGTIPGYWFTVFFIDIIGRFAIQLMGFFMMTVFMIGLAAPYHHWTTAGHHTGFVVMYGFTFFFANFGPNSTTFIVPAEIFPARLRSTCHGISAAAGKAGAIIGAFGFLYAAQDPHTPEAGYSPGIGIRNALFVLAGTNFLGMIMTLLVPESKGLSLEEISKENVDDDEAAA

SEQ ID NO: 9775 - DNA, 882 bp, Sorghum bicolor
  misc_feature: Ceres ANNOT ID no. 6106274
  misc_feature: Encodes the peptide sequence at SEQ ID NO 9776
atgagacccgcagccgcaacagccaccgctaccgccgccgcgctccgtctccgcgccgccgctgcctccctctcgcctcctctcgccgccctccttcctcaccgtagatcctccctcgtacttcctccgctgcgccgcttctgctcacctgcgcctccccacgcctccgccgcccccgattcccagcccccgccgcggttgccttctcccatcatggacgcgcagttcgagctcttccgcgcgcagctcgacgactcttccaccctccgcgaccgcatccgcgccgtcgtcgccgagatcgagtccgcctcccgcgtcgccaccgccgctctcctcctcgtccaccagcccgtccccctcgcagacgtgctcgtgaaggccaaggcgcaggtggaggtgatcaaggggctgtatgcccggctggcggaggtcctcaaggagtgccctggtcagtactacaggtaccatggtgattggaggaccgagacacagatggcggtgtcgatgcttgcgttcacgcactggctggagactgggggcctactcatgcatgctgaagcccaggagaagctaggattgtcctctggggagtttggccttgatgttgaggactacctgacaggactctgcttcatgtccaatgaatttcctagatttgtagtaaatcgcgttactgctggtgactatgactgtcctaaaagggttttgggcttcttgactgatcttcatgcttcatttaggatgctgaacctgcgcaatgacttcttgcgtaagaaatttgatgggatgaagtatgatttgaggagggtggaagaggtctactatgatgtgaagatccgaggacttgtacctgtggagttgaaacaagagactcaatcgtag

SEQ ID NO: 9776 - protein, 293 aa, Sorghum bicolor
  misc_feature: Ceres ANNOT ID no. 6106274
  misc_feature (87)..(282): Pfam Id: Translin Pfam Desc: Translin family
  misc_feature (8)..(290): NCBI GI: 115482220 NCBI Desc: os10g0443200 [oryza sativa (japonica cultivar-group)]
  misc_feature (72)..(283): NCBI GI: 20197945 NCBI Desc: translin-like protein [arabidopsis thaliana]
  misc_feature (76)..(282): NCBI GI: 108880126 NCBI Desc: translin [aedes aegypti]
  misc_feature (76)..(284): NCBI GI: 87248625 NCBI Desc: translin [bombyx mori]
  misc_feature (76)..(282): NCBI GI: 108875474 NCBI Desc: translin [aedes aegypti]
MRPAAATATATAAALRLRAAAASLSPPLAALLPHRRSSLVLPPLRRFCSPAPPHASAAPDSQPPPRLPSPIMDAQFELFRAQLDDSSTLRDRIRAVVAEIESASRVATAALLLVHQPVPLADVLVKAKAQVEVIKGLYARLAEVLKECPGQYYRYHGDWRTETQMAVSMLAFTHWLETGGLLMHAEAQEKLGLSSGEFGLDVEDYLTGLCFMSNEFPRFVVNRVTAGDYDCPKRVLGFLTDLHASFRMLNLRNDFLRKKFDGMKYDLRRVEEVYYDVKIRGLVPVELKQETQS

SEQ ID NO: 9777 - DNA, 882 bp, Sorghum bicolor; identical to SEQ ID NO: 9775
  misc_feature: Ceres ANNOT ID no. 6106277
  misc_feature: Encodes the peptide sequence at SEQ ID NO 9778

SEQ ID NO: 9778 - protein, 293 aa, Sorghum bicolor; identical to SEQ ID NO: 9776
  misc_feature: Ceres ANNOT ID no. 6106277
  misc_feature (87)..(282): Pfam Id: Translin Pfam Desc: Translin family
  misc_feature (8)..(290): NCBI GI: 115482220 NCBI Desc: os10g0443200 [oryza sativa (japonica cultivar-group)]
  misc_feature (72)..(283): NCBI GI: 20197945 NCBI Desc: translin-like protein [arabidopsis thaliana]
  misc_feature (76)..(282): NCBI GI: 108880126 NCBI Desc: translin [aedes aegypti]
  misc_feature (76)..(284): NCBI GI: 87248625 NCBI Desc: translin [bombyx mori]
  misc_feature (76)..(282): NCBI GI: 108875474 NCBI Desc: translin [aedes aegypti]

SEQ ID NO: 9779 - DNA, 1107 bp, Sorghum bicolor
  misc_feature: Ceres ANNOT ID no. 6106319
  misc_feature: Encodes the peptide sequence at SEQ ID NO 9780
atgggtgaggagaagaaggcaggcaaggacgccggcggcgacaagaagaaggacgccggcgcggcggccgcgccgcagcccatcgtgctgaaggtcgacttgcattgcgccggctgcgccagcaaggttcgcaaggccatcaagcgcgccccaggtgtggagtcggtgacggcggacatggcggcgggcaaggtcgtcgtgaccggtccggcggacgcggtggagctcaaggagcgcatcgaggccagggcaaagaagcccgtccagatcgtctccgccggcgccggcccgcccaagaaggacaaggaaaaggaaaaggacaaggagaagaaagcggacggcggcgagaagaaggcagacaaggagaagggcggcgacggcggagacaagaaggccgacaaggagaagggcggcggcggcggcggcgagaagaaggccgacaaggaaaagggcggcggcggcggcgagaagaaggccgacaaggagaagggcgccgacaagcccaaggaggagaagaagcccaaggaggagacggtgacgctcaagatccggctgcactgcgacggctgcatcgaccgcatcaagcgccgcatctccaagatcaaaggcgtgaaggatgtggcgttcgacgccgccaaggacctggtgaaggtgaccggcaccatggacgccgccgctctgccggcttacctcagggacaagctcagccgggacgtcgaggtcgtcgccccaggcaagaaggacggcggcggcgacaagaaggacaagggcgcaggagacgggggagacaagaagaaggacggtgggggcgaggagaagaaggacaaggccgcggccgcggccgcgtcggtggcgccgttacccctggccgacgccgccatgtaccagatgcccccgcactacgggtacggcgcgtatccgccggctcccggcggctactacggcgccgccccgccgccgccacccaaccacgccggtggcttctaccaccccaacgccggtgtccattacccgcccgcgccggcctacgggtacggcggcccctcccacctccacgcgccccagatgttcagcgacgagaaccccaacgcctgctccgtcatgtga

SEQ ID NO: 9780 - protein, 368 aa, Sorghum bicolor
  misc_feature: Ceres ANNOT ID no. 6106319
  misc_feature (28)..(90): Pfam Id: HMA Pfam Desc: Heavy-metal-associated domain
  misc_feature (179)..(241): Pfam Id: HMA Pfam Desc: Heavy-metal-associated domain
  misc_feature (9)..(295): NCBI GI: 48716353 NCBI Desc: heavy-metal-associated domain-containing protein-like [oryza sativa (japonica cultivar-group)]
  misc_feature (169)..(368): NCBI GI: 4097571 NCBI Desc: gmfp5 [glycine max]
  misc_feature (3)..(113): NCBI GI: 145359095 NCBI Desc: metal ion binding [arabidopsis thaliana]
  misc_feature (3)..(186): NCBI GI: 38344582 NCBI Desc: osjnba0053b21.14 [oryza sativa (japonica cultivar-group)]
  misc_feature (3)..(186): NCBI GI: 116309351 NCBI Desc: osigba0096p03.8 [oryza sativa (indica cultivar-group)]
MGEEKKAGKDAGGDKKKDAGAAAAPQPIVLKVDLHCAGCASKVRKAIKRAPGVESVTADMAAGKVVVTGPADAVELKERIEARAKKPVQIVSAGAGPPKKDKEKEKDKEKKADGGEKKADKEKGGDGGDKKADKEKGGGGGGEKKADKEKGGGGGEKKADKEKGADKPKEEKKPKEETVTLKIRLHCDGCIDRIKRRISKIKGVKDVAFDAAKDLVKVTGTMDAAALPAYLRDKLSRDVEVVAPGKKDGGGDKKDKGAGDGGDKKKDGGGEEKKDKAAAAAASVAPLPLADAAMYQMPPHYGYGAYPPAPGGYYGAAPPPPPNHAGGFYHPNAGVHYPPAPAYGYGGPSHLHAPQMFSDENPNACSVM

SEQ ID NO: 9781 - DNA, 1503 bp, Sorghum bicolor
  misc_feature: Ceres ANNOT ID no. 6106350
  misc_feature: Encodes the peptide sequence at SEQ ID NO 9782
atggaggaggggcaatcagcttcatatactgtggatgatgcgctcttgtcatcaggttttgggaggttccagatactgattctttcatatgctgggattggcttaattgccgaagcgatggaaatgatgctgctgtcatttgttggtccatcagtacagctagaatggaagcttacttctcatcaggaaagcatgattacaagtgttgtttttgttggaatgctgattggagcttactcgtggggtgtggtttcagacaactatggaaggaggcaggtccaatcttttacttatgtcatgagaggctttctatttactgccatcgtgacaagtggagctggattcttgagtgcttttgctccgaactatctgtcattaatttccctgagattcttagttggtattggtttgggaggagggcctgttctgggatcttggttcttggaatttgttcctgctccaactagaggaacatggatggtggtattttctgcattttggactgttgggacaatattggaggcatctcttgcatggacagttatgcccaagtttggctggaggtggttgttagcattatcagctattccatcttttctcctgctgctattttatgccattacgccagagtcaccaaggttcctttgcatgaaaggccgaactaccgaggctgtggatgtattggagaaaatggcaagactaaacaatgtacaactaccttctggtaggcttgtttctgacaaaaatattgagctagatgaagtctcaggatcttcagagtccacgacacttttgtctggtgccgaagaaagtgacaacctaagtgaagatcgtggttctgatttcggaggtattaagtctgttggcaagctacttgcaccaaaactgatcagagcaaccctgcttctgtggatggccttctttggaaatgcgtttgcctattatggcattgttcttctgacatcagagctcagtaatggaaataggatatgtgccaaacaggatgttgaatcagttaattcaactaatgcaagcctatataagaatgttttcatatctagttttgcagagatcccagggtcatttctatcggccatgatcgtggatagatttggtcgcaagctttcaatggcgtcgatgctcttcactagctgtgttttcttagtcccactggtgttctcccggacagatatactaaccagaatctccctgtttggtgcccggctctgtatatccgccagcttcaccattgtatacatatatgctccagagatttacccgaccgcggtgagaacgacgggcattggcatcgcgagctcagtgggcaggatcggcggcatcctttgcccgctcgtcgcggtcgccctggtgcacagctgccagcagacgacggcgatcctcctcttcgaacttgtaatcttcctctccggcctggccgtctcgttcttccccttcgagacgaaggggtgtagactcaacgacaccgaggtggacatgaactga

SEQ ID NO: 9782 - protein, 500 aa, Sorghum bicolor
  misc_feature: Ceres ANNOT ID no. 6106350
  misc_feature (31)..(450): Pfam Id: MFS_1 Pfam Desc: Major Facilitator Superfamily
  misc_feature (24)..(499): Pfam Id: Sugar_tr Pfam Desc: Sugar (and other) transporter
  misc_feature (101)..(500): NCBI GI: 38567900 NCBI Desc: osjnba0060n03.20 [oryza sativa (japonica cultivar-group)]
  misc_feature (1)..(500): NCBI GI: 90265074 NCBI Desc: h0702g05.6 [oryza sativa (indica cultivar-group)]
  misc_feature (101)..(500): NCBI GI: 115460440 NCBI Desc: os04g0609200 [oryza sativa (japonica cultivar-group)]
  misc_feature (3)..(495): NCBI GI: 92892063 NCBI Desc: major facilitator superfamily [medicago truncatula]
  misc_feature (1)..(495): NCBI GI: 28416475 NCBI Desc: at3g13050/mgh6_16 [arabidopsis thaliana]
  misc_feature: The sequence is a functional homolog of SEQ ID NO. 296 in the 11/188,298 US application
  misc_feature: The sequence is a functional homolog of SEQ ID NO. 488 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
MEEGQSASYTVDDALLSSGFGRFQILILSYAGIGLIAEAMEMMLLSFVGPSVQLEWKLTSHQESMITSVVFVGMLIGAYSWGVVSDNYGRRQVQSFTYVMRGFLFTAIVTSGAGFLSAFAPNYLSLISLRFLVGIGLGGGPVLGSWFLEFVPAPTRGTWMVVFSAFWTVGTILEASLAWTVMPKFGWRWLLALSAIPSFLLLLFYAITPESPRFLCMKGRTTEAVDVLEKMARLNNVQLPSGRLVSDKNIELDEVSGSSESTTLLSGAEESDNLSEDRGSDFGGIKSVGKLLAPKLIRATLLLWMAFFGNAFAYYGIVLLTSELSNGNRICAKQDVESVNSTNASLYKNVFISSFAEIPGSFLSAMIVDRFGRKLSMASMLFTSCVFLVPLVFSRTDILTRISLFGARLCISASFTIVYIYAPEIYPTAVRTTGIGIASSVGRIGGILCPLVAVALVHSCQQTTAILLFELVIFLSGLAVSFFPFETKGCRLNDTEVDMN

SEQ ID NO: 9783 - DNA, 1023 bp, Sorghum bicolor
  misc_feature: Ceres ANNOT ID no. 6106351
  misc_feature: Encodes the peptide sequence at SEQ ID NO 9784
atggtctccggtgccggaccctccggcggggcagcccactccgcgtccaccggtggtgggggcggctccccctccgacaggggcggcgccgcgccctcggcctcggcgtcggtctccacgccagccagcgagagcaccgtcgcccgccgcctcaacggacttgacctccaaggcgacgacgcgccatcgtctcagccagccgcgagcaagaagaaaaagaaagggtcacgtgcagttggtcctgacaaaaatggccgtggattgcgccaatttagcatgagagtctgtgagaaagttgaaagcaaagggagaacaacctacaatgaggtggcagatgaattggttgctgagttttcagatcccaatattaatattgactctccagatcctgataatccctccgcgcaacaatatgatgagaaaaatattcgaagaagagtttatgatgcgctgaatgtcctaatggctatggaaattatatccaaagataaaaaagaaatacaatggagaggcttgcccaagacaagtatgaatgatattgaagaattgaagacagaggtcattagactgaaaggccggattgacaagaaagctgcatatctgcaggatttacaagatcaatatgtatgtctccaaaacttggttcgacggaatgagcagctatatgggtcaggagatgcaccctccggtggagtggccttgccatttatactagttaagacacgtcctcatgcaactgtagaagtggagatatcagaagatatgcagcttgtgcattttgacttcaatagcactcctttcgagttgcaggatgatacctttgtactgaaagcaatgggattatctggcaaagaagaaaatgattgtacacaagctcctgttgtgaatggaggtgagtgctcaagtacaccgaacaattattggcatcagtcaccgcagcctccaggaccaagaggagttagggtaccgaactcgcctcctattccagggatactaaaagggcgcgtcaagcatgaacactag

SEQ ID NO: 9784 - protein, 340 aa, Sorghum bicolor
  misc_feature: Ceres ANNOT ID no. 6106351
  misc_feature (178)..(339): Pfam Id: DP Pfam Desc: Transcription factor DP
  misc_feature (83)..(171): Pfam Id: E2F_TDP Pfam Desc: E2F/DP family winged-helix DNA-binding domain
  misc_feature (4)..(340): NCBI GI: 32187097 NCBI Desc: dp1 [populus tremula x populus tremuloides]
  misc_feature (93)..(317): NCBI GI: 7378623 NCBI Desc: transcription factor-like protein [arabidopsis thaliana]
  misc_feature (75)..(287): NCBI GI: 7413636 NCBI Desc: dp-2 transcription factor-like [arabidopsis thaliana]
  misc_feature (28)..(336): NCBI GI: 89741408 NCBI Desc: dp1 [chlamydomonas reinhardtii]
  misc_feature (59)..(290): NCBI GI: 51512989 NCBI Desc: mgc81762 protein [xenopus laevis]
  misc_feature: The sequence is a functional homolog of SEQ ID NO 1550 in the 10/666,642US patent application
  misc_feature: The sequence is a functional homolog of SEQ ID NO 610 in the 10/666,642US patent application
  misc_feature: Useful for making plants with modulated growth and phenotype characteristics
  misc_feature: The sequence is a functional homolog of SEQ ID NO 1550 in the 20070033671 US patent application
  misc_feature: The sequence is a functional homolog of SEQ ID NO 1550 in the 10/666,642 US patent application
  misc_feature: The sequence is a functional homolog of SEQ ID NO 610 in the 10/666,642 US patent application
  misc_feature: The sequence is a functional homolog of SEQ ID NO. 416 in the 11/188,298 US application
MVSGAGPSGGAAHSASTGGGGGSPSDRGGAAPSASASVSTPASESTVARRLNGLDLQGDDAPSSQPAASKKKKKGSRAVGPDKNGRGLRQFSMRVCEKVESKGRTTYNEVADELVAEFSDPNINIDSPDPDNPSAQQYDEKNIRRRVYDALNVLMAMEIISKDKKEIQWRGLPKTSMNDIEELKTEVIRLKGRIDKKAAYLQDLQDQYVCLQNLVRRNEQLYGSGDAPSGGVALPFILVKTRPHATVEVEISEDMQLVHFDFNSTPFELQDDTFVLKAMGLSGKEENDCTQAPVVNGGECSSTPNNYWHQSPQPPGPRGVRVPNSPPIPGILKGRVKHEH

SEQ ID NO: 9785 - DNA, 1674 bp, Sorghum bicolor
  misc_feature: Ceres ANNOT ID no. 6106418
  misc_feature: Encodes the peptide sequence at SEQ ID NO 9786
atgccaccgccacgccactgccagggccacattgcgcaatgcctcggacggatcctctcctgccgcggcgacgccaccgtcgccgctgctgccggccgacggctctccggcgcggaattcgtcgacggcgtgcggagcctcgccgccggcctcgtccaccgcgggctgcgcccgggccacgtcgtcgccgccgtcgccctcaacagcgtcgagtacgtccagctgttcctcgccgtcacctacgccggagcgatcatcgcccctctcaactaccgctggagcttcgaggaggcggcgcaggcggtggagctcgtgcagccatcggcgttcgtctttgacggcggcgtcttcagctcttgggctcttcgactgatggagagcgacaggtttccatccattggcctgtacctcctcctggacgatccttgcaggattggccatgctgctgcagattttgaatccactgaccacatcatgaggagagctacggcgacgatggaacccgtgtcagctccagcggatgttgctctaatatgcttcacatctggaaccactgggcggccaaagggtgtagcgataagccatacgtctttgatcattcagtcccttgcgaaaattgccattgttggctacggtgaggatgatgtttacctgcatacagcgcctctgtgccatatcggagggatctcctcatgcatggctatcctgatggccggaggttgccatgtcctgataccgaaattcgacgccaaatcagcctttgacgccatccaggaacaaggagtgacttctttcatcactgtccccgcgatcatggctgacctgctgtcctatgctcgaaaagagatgatatcagattgtgggaagacagtgaccaagattctgaatgggggtggtgggctgtcccttgacctcctaaatggagcttcacaattgtttcctcgtgctgccattttctcagcttatgggatgactgaggcctgttcatctctgacattcatggctctcaacgtaccaaagcttcaagaacccaataaccaaccaggcagccattatggaggcgtttgtgttggcaaaccggcaccacatgttgagatacgaatcggcatggatgataataacaccagttcttcaccaactgggaacatcttaactagaggcttccacaccatggctgggtactgggcaaacaacaaggtggattcatcagattgtgtcaggaacggatggcttgacactggagacactggatggattgacaaagccggtaatctatggctcatggggcggcaaaagggccgcataaaaaccggaggtgaaaatgtttacccggaagaggttgaactggtactatctcagcacccaggagtagcaagagttgtggtagtcggtataccagatagtcgtctcggggagaaagttattgcttgtgttagcatcagggatggctggaagtgggttcatgcaagaactgagcaccaaggcaaaggcaaggaagtgtctcctcagatccttcatgaccactgcaggatgaaaaaactgagcagatttaaggtgccaaggtcttattatcagtggaggcagccatttccagtgactacgacagggaaaatcaaaagagaggagctgaagagggaaattttagcagcaattcaactacccagcaacttgtag

SEQ ID NO: 9786 - protein, 557 aa, Sorghum bicolor
  misc_feature: Ceres ANNOT ID no. 6106418
  misc_feature (36)..(462): Pfam Id: AMP-binding Pfam Desc: AMP-binding enzyme
  misc_feature (6)..(553): NCBI GI: 34365547 NCBI Desc: at1g30520/f26g16_3 [arabidopsis thaliana]
  misc_feature (216)..(553): NCBI GI: 6634775 NCBI Desc: contains similarity to gi34845 luciferase ye protein from pyrophorus plagiophthalamus, and contains an amp-binding pf00501 domain. [arabidopsis thaliana]
  misc_feature (290)..(557): NCBI GI: 115474651 NCBI Desc: os08g0130400 [oryza sativa (japonica cultivar-group)]
  misc_feature (10)..(544): NCBI GI: 73538583 NCBI Desc: amp-dependent synthetase and ligase [ralstonia eutropha jmp134]
  misc_feature (10)..(545): NCBI GI: 94311461 NCBI Desc: amp-dependent synthetase and ligase [ralstonia metallidurans ch34]
MPPPRHCQGHIAQCLGRILSCRGDATVAAAAGRRLSGAEFVDGVRSLAAGLVHRGLRPGHVVAAVALNSVEYVQLFLAVTYAGAIIAPLNYRWSFEEAAQAVELVQPSAFVFDGGVFSSWALRLMESDRFPSIGLYLLLDDPCRIGHAAADFESTDHIMRRATATMEPVSAPADVALICFTSGTTGRPKGVAISHTSLIIQSLAKIAIVGYGEDDVYLHTAPLCHIGGISSCMAILMAGGCHVLIPKFDAKSAFDAIQEQGVTSFITVPAIMADLLSYARKEMISDCGKTVTKILNGGGGLSLDLLNGASQLFPRAAIFSAYGMTEACSSLTFMALNVPKLQEPNNQPGSHYGGVCVGKPAPHVEIRIGMDDNNTSSSPTGNILTRGFHTMAGYWANNKVDSSDCVRNGWLDTGDTGWIDKAGNLWLMGRQKGRIKTGGENVYPEEVELVLSQHPGVARVVVVGIPDSRLGEKVIACVSIRDGWKWVHARTEHQGKGKEVSPQILHDHCRMKKLSRFKVPRSYYQWRQPFPVTTTGKIKREELKREILAAIQLPSNL

SEQ ID NO: 9787 - DNA, 1236 bp, Sorghum bicolor
  misc_feature: Ceres ANNOT ID no. 6106433
  misc_feature: Encodes the peptide sequence at SEQ ID NO 9788
atggaagagccggattgtccagaaggttccgtttccgaccgcggaggagagcggcagacggcttccctgccgctgccggacgccttcctcgagttcctcagcgagaatggcctggacccagcggtgtactcaatggcagccaccatcccgcgctacataagggagcttgatttagtttttttcctaatcccaagactaaaaccaggcatggagtcccagatcacagagatcgaatccgagttgaagtgtgtcctcgagaaggtttcatggctgccagggttctatgcgattccgccagaaattcagattgctggctccaaggcttatcagcaagggaagatctatggaattgatgctgcttctggagctgctatattagcacttgatgttcgaccaggcgaccatgttcttgacctctgtgctgctccagatacgcttggaaccactggttctctgactggtgttgatgttgcaaagcaccgtcttgcagcctgtcgtacaatgttgcagaagtattgtcttggtgaccgtactcggctctttgttgctgatggaactttgttttccattttacctgtgaactccaggatgcaaagaatggaaggttcaattggcgttgaagaaaatggaagcacattcccagaatggacttcaagaagatcatggaaggatcggcagaagactaagaaagcaaatgcaaatggtccacagcacctactggccactttggaacctgaactgatatactatggtaaacattcaggattagttggactgtgtaaatctgatgtcttttgtccatcagttgataatgaagcttgtacatctggctatgataaggtcctagtggatgcggagtgtactcatgatggatccataaaacacattcagaaatttgaattctggggatggaaaactctggatcgccgcatacttgatgctggaagaaccgagaaccttcttcagcttcagttacatcttctcacaaatggttttaaactgttgaaaaccggtggatcacttgtatatagtacttgcagcttgacagtctcacaaaatgagagtgtggttcagcaattcctttcaactcacccttctgcagatttgcagaagatcgatttggctgataattggccgtgcagaagtggcggcatccccaaaacactgcgatttgatcctgcagtttcacaaaccagtggtctttttgttgccaagttcagtaaactaccaacttaa

SEQ ID NO: 9788 - protein, 411 aa, Sorghum bicolor
  misc_feature: Ceres ANNOT ID no. 6106433
  misc_feature (153)..(407): Pfam Id: Nol1_Nop2_Fmu Pfam Desc: NOL1/NOP2/sun family
  misc_feature (17)..(346): NCBI GI: 50252730 NCBI Desc: phosphate/phosphoenolpyruvate translocator-like [oryza sativa (japonica cultivar-group)]
  misc_feature (17)..(409): NCBI GI: 140063595 NCBI Desc: bacterial fmu (sun)/eukaryotic nucleolar nol1/nop2p [medicago truncatula]
  misc_feature (279)..(408): NCBI GI: 126014110 NCBI Desc: fmu (sun) domain protein [staphylothermus marinus f1]
  misc_feature (240)..(408): NCBI GI: 20093483 NCBI Desc: trna/rrna cytosine-c5-methylase [methanopyrus kandleri av19]
  misc_feature (278)..(408): NCBI GI: 42519411 NCBI Desc: sun protein [lactobacillus johnsonii ncc 533]
MEEPDCPEGSVSDRGGERQTASLPLPDAFLEFLSENGLDPAVYSMAATIPRYIRELDLVFFLIPRLKPGMESQITEIESELKCVLEKVSWLPGFYAIPPEIQIAGSKAYQQGKIYGIDAASGAAILALDVRPGDHVLDLCAAPDTLGTTGSLTGVDVAKHRLAACRTMLQKYCLGDRTRLFVADGTLFSILPVNSRMQRMEGSIGVEENGSTFPEWTSRRSWKDRQKTKKANANGPQHLLATLEPELIYYGKHSGLVGLCKSDVFCPSVDNEACTSGYDKVLVDAECTHDGSIKHIQKFEFWGWKTLDRRILDAGRTENLLQLQLHLLTNGFKLLKTGGSLVYSTCSLTVSQNESVVQQFLSTHPSADLQKIDLADNWPCRSGGIPKTLRFDPAVSQTSGLFVAKFSKLPT

SEQ ID NO: 9789 - DNA, 1092 bp, Sorghum bicolor
  misc_feature: Ceres ANNOT ID no. 6106434
  misc_feature: Encodes the peptide sequence at SEQ ID NO 9790
atggagagaggcaataatggcgggagcgggaggccgccttctccgccgccgactccggtcgagaggaaggcggcgtgggcgtggagggacggcgccgtcacctacttccacctcctcttctacatcgccatctccggcggccagatcttcttcaacaagtgggtcttatcctcaaaagagatcaacttcccctatcctgtggcactaactctgctgcacatggtcttctcctctgtagtatgctttgcgattacaaaggttttcaagatcataaagattgaggagggaatgactacagatatatatatcagttcagtcattccaattggggcaatgtttgcaatgacactttggctagggaacagtgcgtacctctacatatctgtcgcgtttgcacaaatgttgaaggcaataatgcctgtagctgtgtttcttctcggagcagcatttggcctggaagaaatgagctataaaatgctttctatcatgtctgttatcagtgtcggagttattgtggcttctgttggtgaaattacaatcagttgggttggagtggtttaccagatgggtggagttgttgcggaagccctaagacttatcttcattgagatatttctgaagaaaaagggcgtcaagctgaacttgatatccatgatgtactatgttagcccttgcagtgctgtatgcctctttattccctggttgttcttagagaagccaaagatggatgatagtatttcatggaacttcccgccattcacattgttcttaaattgcctgtgcactttcatactcaacatgtcggttttccttgtcatatctcggactagtgcgctgacagctcgtgttactggagttgtgagggattggtctgtagttttgctgtcagctgccatcttcgctgatacacaacttaccttcataaacataattggttatgccatagccatagctggtgttgttgcatataacaaccacaagctcaaggtaaaaccccaagcgaacccacagcaaggtgacgagaacaaggtcatctcaggaagcactcgagatgtggtattatcaatgaattcatcaaaagaagcttcgtaa

SEQ ID NO: 9790 - protein, 363 aa, Sorghum bicolor
  misc_feature: Ceres ANNOT ID no. 6106434
  misc_feature (184)..(325): Pfam Id: TPT Pfam Desc: Triose-phosphate Transporter family
  misc_feature (40)..(331): Pfam Id: UAA Pfam Desc: UAA transporter family
  misc_feature (27)..(363): NCBI GI: 46390796 NCBI Desc: phosphate/phosphoenolpyruvate translocator protein-like [oryza sativa (japonica cultivar-group)]
  misc_feature (33)..(329): NCBI GI: 20147279 NCBI Desc: at3g14410/mln21_19 [arabidopsis thaliana]
  misc_feature (33)..(329): NCBI GI: 9279588 NCBI Desc: phosphate/phosphoenolpyruvate translocator protein-like [arabidopsis thaliana]
  misc_feature (33)..(329): NCBI GI: 15221115 NCBI Desc: phosphate translocator-related [arabidopsis thaliana]
  misc_feature (33)..(329): NCBI GI: 8778534 NCBI Desc: f21d18.5 [arabidopsis thaliana]
  misc_feature: The sequence is a functional homolog of SEQ ID NO. 360 in the 11/188,298 US application
  misc_feature: The sequence is a functional homolog of SEQ ID NO. 484 in the 11/188,298 US application
MERGNNGGSGRPPSPPPTPVERKAAWAWRDGAVTYFHLLFYIAISGGQIFFNKWVLSSKEINFPYPVALTLLHMVFSSVVCFAITKVFKIIKIEEGMTTDIYISSVIPIGAMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFILNMSVFLVISRTSALTARVTGVVRDWSVVLLSAAIFADTQLTFINIIGYAIAIAGVVAYNNHKLKVKPQANPQQGDENKVISGSTRDVVLSMNSSKEAS

SEQ ID NO: 9791 - DNA, 1110 bp, Sorghum bicolor; identical to SEQ ID NO: 23
  misc_feature: Ceres ANNOT ID no. 6106441
  misc_feature: Encodes the peptide sequence at SEQ ID NO 9792

SEQ ID NO: 9792 - protein, 369 aa, Sorghum bicolor; identical to SEQ ID NO: 24
  misc_feature: Ceres ANNOT ID no. 6106441
  misc_feature (49)..(355): Pfam Id: Exo_endo_phos Pfam Desc: Endonuclease/Exonuclease/phosphatase family
  misc_feature (1)..(366): NCBI GI: 55733769 NCBI Desc: at3g48425 [arabidopsis thaliana]
  misc_feature (11)..(288): NCBI GI: 14578320 NCBI Desc: pv1h14200_p [plasmodium vivax]
  misc_feature (107)..(357): NCBI GI: 83314890 NCBI Desc: ap endonuclease-related [plasmodium yoelii yoelii str. 17xnl]
  misc_feature (128)..(334): NCBI GI: 42733748 NCBI Desc: similar to dictyostelium discoideum (slime mold). dna-(apurinic or apyrimidinic site) lyase (ec 4.2.99.18) (class ii apurinic/apyrimidinic(ap)-endonuclease)
  misc_feature (107)..(341): NCBI GI: 178743 NCBI Desc: apurinic endonuclease

SEQ ID NO: 9793 - DNA, 510 bp, Sorghum bicolor
  misc_feature: Ceres ANNOT ID no. 6106464
  misc_feature: Encodes the peptide sequence at SEQ ID NO 9794
atggtgatgatgatgagagccctgactgctgtggccatggcggtggcggtggtggtggccgccgtgttgatggaggcagcggcggcggcgacatacacagtcggcgcgccggacggtctgtgggatctgcagaccgactacgcagagtgggtgaagaccaagaccttccaccccggcgacaggatcacgttcacgtactcgccggagctgcacgacgtggtggaggtgacggaggccggctacgacgcctgctccagcgccaacaacatctccgccttccgcaccggcaacgacgtcgtgccgctcgccgccgtcggcacgcgctacttcctctgcggcttcacgggccactgcggcaacggcatgaagatccgcgtcgacgtcgtcgatgggggtgccgcgtcaggccccgcggcgtcgtcttcctccaccaccgcggcctcgcccgccgccgccgctgggcttggctccggcctccttgtagccgtcttggcggcgaccttctggtag

SEQ ID NO: 9794 - protein, 169 aa, Sorghum bicolor
  misc_feature: Ceres ANNOT ID no. 6106464
  misc_feature (41)..(122): Pfam Id: Cu_bind_like Pfam Desc: Plastocyanin-like domain
  misc_feature (7)..(166): NCBI GI: 115474719 NCBI Desc: os08g0137400 [oryza sativa (japonica cultivar-group)]
  misc_feature (5)..(166): NCBI GI: 115480813 NCBI Desc: os09g0572700 [oryza sativa (japonica cultivar-group)]
  misc_feature (2)..(153): NCBI GI: 115474721 NCBI Desc: os08g0137800 [oryza sativa (japonica cultivar-group)]
  misc_feature (5)..(139): NCBI GI: 52550771 NCBI Desc: blue copper-binding protein [oryza sativa (japonica cultivar-group)]
  misc_feature (5)..(166): NCBI GI: 4104058 NCBI Desc: blue copper-binding protein homolog [triticum aestivum]
MVMMMRALTAVAMAVAVVVAAVLMEAAAAATYTVGAPDGLWDLQTDYAEWVKTKTFHPGDRITFTYSPELHDVVEVTEAGYDACSSANNISAFRTGNDVVPLAAVGTRYFLCGFTGHCGNGMKIRVDVVDGGAASGPAASSSSTTAASPAAAAGLGSGLLVAVLAATFW

SEQ ID NO: 9795 - DNA, 753 bp, Sorghum bicolor
  misc_feature: Ceres ANNOT ID no. 6106469
  misc_feature: Encodes the peptide sequence at SEQ ID NO 9796
atgtctctccccccggacggcggcggtggcaccggcgacgactggttcctcgactgcggcatcctcgacgacctcccggccgcggcctgcggggccttcccgtgggacgcgtccccgtcgtcttccaaccccagtgtggaagtgggcagctatgtgaacacaaatgatgtcttcaaggagcccaatgatgtcttcaaggagcctggcagcaataaacgtttaaggtcaggatccaatgatgtgccaacatctaaagcttctagggaaaaaatgaggaggaacaaactgaatgataggtttcttgaattggggtctacattagaaccagggaagccagtaaaagctgacaaagctgctatcctaagtgatgctactcgcatggttattcagcttcgttcagaagcacagcagctcaaggaaactaatggtagccttgaagaaaagattaaagaactaaaggctgagaaggatgagcttcgtgatgagaagcagaagttgaaattagagaaggagagtttagagcaccagatgaagcttatgacctcaactccagcctacatgcctcatccgaccctgatgccagcgcctttccctcaggcgcccttagcaccattccatgcccaggggcaagctgcagggcagaagctgatgatgccctttgtcagctatccggggtacccaatgtggcagttcatgccgccatcagaagttgacacctcgaaggacagcgaagcgtgccctcctgttgcgtaa

SEQ ID NO: 9796 - protein, 250 aa, Sorghum bicolor
  misc_feature: Ceres ANNOT ID no. 6106469
  misc_feature (81)..(132): Pfam Id: HLH Pfam Desc: Helix-loop-helix DNA-binding domain
  misc_feature (7)..(250): NCBI GI: 38636768 NCBI Desc: helix-loop-helix-like protein [oryza sativa (japonica cultivar-group)]
  misc_feature (30)..(250): NCBI GI: 29367409 NCBI Desc: helix-loop-helix-like protein [oryza sativa (japonica cultivar-group)]
  misc_feature (62)..(250): NCBI GI: 92896368 NCBI Desc: prefoldin; helix-loop-helix dna-binding [medicago truncatula]
  misc_feature (64)..(250): NCBI GI: 92918531 NCBI Desc: helix-loop-helix dna-binding [medicago truncatula]
  misc_feature (109)..(250): NCBI GI: 115464245 NCBI Desc: os05g0455400 [oryza sativa (japonica cultivar-group)]
  misc_feature: The sequence is a functional homolog of SEQ ID NO 10 in the 10/666,642US patent application
  misc_feature: The sequence is a functional homolog of SEQ ID NO 1203 in the 11/479,226US patent application
  misc_feature: The sequence is a functional homolog of SEQ ID NO 2422 in the 10/374,780US patent application
  misc_feature: The sequence is a functional homolog of SEQ ID NO 54 in the 10/412,699US patent application
  misc_feature: The sequence is a functional homolog of SEQ ID NO 542 in the 10/412,699US patent application
  misc_feature: The sequence is a functional homolog of SEQ ID NO 814 in the 10/225,066US patent application
  misc_feature: Useful for making plants with altered Lignin content
  misc_feature: Useful for making plants with modulated growth and phenotype characteristics
  misc_feature: Functional homolog of the protein sequence given in SEQ ID NO 12959
  misc_feature: The sequence is a functional homolog of SEQ ID NO 54 in the 20040045049 US patent application
  misc_feature: The sequence is a functional homolog of SEQ ID NO 542 in the 20040045049 US patent application
MSLPPDGGGGTGDDWFLDCGILDDLPAAACGAFPWDASPSSSNPSVEVGSYVNTNDVFKEPNDVFKEPGSNKRLRSGSNDVPTSKASREKMRRNKLNDRFLELGSTLEPGKPVKADKAAILSDATRMVIQLRSEAQQLKETNGSLEEKIKELKAEKDELRDEKQKLKLEKESLEHQMKLMTSTPAYMPHPTLMPAPFPQAPLAPFHAQGQAAGQKLMMPFVSYPGYPMWQFMPPSEVDTSKDSEACPPVA

SEQ ID NO: 9797 - DNA, 423 bp, Sorghum bicolor
  misc_feature: Ceres ANNOT ID no. 6106480
  misc_feature: Encodes the peptide sequence at SEQ ID NO 9798
atggcggcggctgtggcgaggtcagggttccggcgcatgttctctgtctccgccttcgcaccgccgaaggcgcccgccccgcgcccccaggccgacccctcccccaacctcttcgtctccggattaagcaagcgtaccacaactgaaggacttagagacgcctttgcgaagttcggtgaagttgtgcatgctcgagttgtgaccgaccgtgtcagtgggttttcgaagggatttggctttgtaaggtatgctacaactgaagaggcaactaaaggaatagaaggaatggatggaaagttccttgatggatgggttattttcgcggaatatgctagacccagagcaccgccggagcaagcagagatgaattcgccgccacagcaatcatggggtgcttcaccaggatcttggggttcacagtag

SEQ ID NO: 9798 - protein, 140 aa, Sorghum bicolor
  misc_feature: Ceres ANNOT ID no. 6106480
  misc_feature (37)..(108): Pfam Id: RRM_1 Pfam Desc: RNA recognition motif. (a.k.a. RRM, RBD, or RNP domain)
  misc_feature (34)..(127): NCBI GI: 92897903 NCBI Desc: rna-binding region rnp-1 (rna recognition motif) [medicago truncatula]
  misc_feature (15)..(116): NCBI GI: 1009363 NCBI Desc: rgp-3 [nicotiana sylvestris]
  misc_feature (34)..(116): NCBI GI: 1778374 NCBI Desc: glycine-rich rna-binding protein psgrbp [pisum sativum]
  misc_feature (34)..(116): NCBI GI: 2366750 NCBI Desc: rna binding protein [nicotiana sylvestris]
  misc_feature (1)..(127): NCBI GI: 38346331 NCBI Desc: oj000126_13.13 [oryza sativa (japonica cultivar-group)]
  misc_feature: The sequence is a functional homolog of SEQ ID NO. 339 in the 11/188,298 US application
MAAAVARSGFRRMFSVSAFAPPKAPAPRPQADPSPNLFVSGLSKRTTTEGLRDAFAKFGEVVHARVVTDRVSGFSKGFGFVRYATTEEATKGIEGMDGKFLDGWVIFAEYARPRAPPEQAEMNSPPQQSWGASPGSWGSQ

SEQ ID NO: 9799 - DNA, 1617 bp, Sorghum bicolor
  misc_feature: Ceres ANNOT ID no. 6106483
  misc_feature: Encodes the peptide sequence at SEQ ID NO 9800
atggccaccagcagccccgtcgctctgatctcgcaggtgcagcagcgcaagccccggccatacaccccaagcctatggggtgacttcttcctccaccacatcccatgcactccatcacagctcttctcaatgaagaagaaggcacagatcaagaaggaagaagtgaggcagattatattagaaacccttgcctcctccaacctggttgagaagatggagctcgtcgacacgcttcaacggattggggtggactaccactacaagaaggagatcaatgatttgctttgctacgtctacaacgacaaagatggaggctctagcaatctctacatcacctcactgaggttctatttgctcaggaatgtgtttgagaaatttagggatgagcaagggaacattacaagtgatgatatcagttgcttgctgatgttgtacgacgctgcgcatctgagaactcatggggaggacatacttgacaacattatcactttcaacaagagccgcctccagtctctactgctgggaaatttggagccacagctacaggaggaagtccagtgcagtttggagacacctcggttcaggcgggtcaagagagtggaggcaaggcgctacatctcagtatatgagaaaaaggctacacgggatgggaccatactggaatttgcaaaactagactacaacatcttgcaagctatctattgtgatgagttgaaagaacttacagtatggtggaaagatttccaatcacaaacatatctgagctttgcacgggacagaatggtggagctacatttttggatgctcggagtggtttacgagccctattattcatattcaaggataatgatgacaaagttcatcgtatttgcatccttgctcgatgacctttatgacaactatagcaccacaatggagagcaataccttcaccatggccatgcaaaggtgggatgaacaaaccacagaacagcttccagcatacttgaaagcactcttcatcaacatattaaacactacaaataagattgaggaggagttaaaacttatgaaaaacaagcatgctgatttgatcaaaagactggtgattgacactgccaaattctaccatgctgaggttgaatggcgtgatgaacactacataccaactagtgtcgaagaacacctccaaatttccacccatagtagtgtttgcatgcagataacaaaccttgcgctcatttcgcttggagacgtgactactagggaggatgttaattgggctctcaccttccccaaaatcatcagaggtgcttgtattgtggggcgtgttggcaatgacatcgtgtcacatgagcgtgaacaaacttcagagcatgtcacatccacggtgcaaacttgcatgaaggaatatggggtgacagtagaagaagccaatgaaaagcttagaattataatcgaagaagcatggatggacatcgtcgaagactgccttgagcaaaaacgtcccatggtacttttagagacagccatcaacgttgcaagaacaatggatttcatgtacaagcgtgaagacgcatataccctctcattcagcctcaaggatgttataacttcaatgtacgtcaactctgtgtga

SEQ ID NO: 9800 - protein, 538 aa, Sorghum bicolor
  misc_feature: Ceres ANNOT ID no. 6106483
  misc_feature (218)..(487): Pfam Id: Terpene_synth_C Pfam Desc: Terpene synthase family, metal binding domain
  misc_feature (26)..(213): Pfam Id: Terpene_synth Pfam Desc: Terpene synthase, N-terminal domain
  misc_feature (35)..(538): NCBI GI: 115474741 NCBI Desc: os08g0139700 [oryza sativa (japonica cultivar-group)]
  misc_feature (21)..(538): NCBI GI: 62754276 NCBI Desc: terpene synthase 10 [zea mays]
  misc_feature (21)..(538): NCBI GI: 62754278 NCBI Desc: terpene synthase 10 [zea mays]
  misc_feature (10)..(538): NCBI GI: 46358533 NCBI Desc: terpene synthase 6 [zea mays]
  misc_feature (21)..(538): NCBI GI: 46358537 NCBI Desc: terpene synthase 9 [zea mays]
MATSSPVALISQVQQRKPRPYTPSLWGDFFLHHIPCTPSQLFSMKKKAQIKKEEVRQIILETLASSNLVEKMELVDTLQRIGVDYHYKKEINDLLCYVYNDKDGGSSNLYITSLRFYLLRNVFEKFRDEQGNITSDDISCLLMLYDAAHLRTHGEDILDNIITFNKSRLQSLLLGNLEPQLQEEVQCSLETPRFRRVKRVEARRYISVYEKKATRDGTILEFAKLDYNILQAIYCDELKELTVWWKDFQSQTYLSFARDRMVELHFWMLGVVYEPYYSYSRIMMTKFIVFASLLDDLYDNYSTTMESNTFTMAMQRWDEQTTEQLPAYLKALFINILNTTNKIEEELKLMKNKHADLIKRLVIDTAKFYHAEVEWRDEHYIPTSVEEHLQISTHSSVCMQITNLALISLGDVTTREDVNWALTFPKIIRGACIVGRVGNDIVSHEREQTSEHVTSTVQTCMKEYGVTVEEANEKLRIIIEEAWMDIVEDCLEQKRPMVLLETAINVARTMDFMYKREDAYTLSFSLKDVITSMYVNSV

SEQ ID NO: 9801 - DNA, 1746 bp, Sorghum bicolor
  misc_feature: Ceres ANNOT ID no. 6106515
  misc_feature: Encodes the peptide sequence at SEQ ID NO 9802
atgaggtgggcggcgttcctgtgggaaggcgcgtcccgggcgtccggcggccgccgcccgggggtctccaacctcctcctcgtcgtcgcagctgccagtagcggtggcctcgttgcctatgccgactccggatcagatgctgctgttgagaagccgcaacttcctccaaggaaaaaagttgtggtgcttgggactggttggggcggcaccacattcctgaggaatctcgatagcaggttgtacgatgtgcaggttatatctcctcggaactactttgcgtttacgccactgctcccgagtgtcacttctggaacagttgagcctaggagcattgttgagccaatccgtaggatcttggagaagaaaggtggagaaatcaaattttgggaagcagagtgcttcaagattgatccacaaagcaagaaaatccattgtcgctcgaatgttgggacaaatcttgaggggaatggcgagttctcggttgactatgactatctcgtggtagcagttggagctaggacaaatacattcaatactcctggcgtggtagagaattgccacttcttgaaggaagtagaggatgctcaaaagatcagacggagtgtgatggactgctttgagagagcaagcctccccttcctgaatgaagaagagaggaagaagaatcttcatttcgtggttgtgggtggtggacctactggagtggaatttgcagcatctctgcatgattttgttaccgaagatttatccaagctttatccctcggttcagcaccttgtcaagatatcactgatcgaagctgcagatcacatactgaccatgtttgacaagaggataactaactttgctgaggataagtttggaagggacggtattgatgtgaaaacaggatacaaagttgtgaaggtttctaaggatgatattaccatgcaaaatcctgccactggggatatttcagttccttatggcatggctgtctggtcaactggtattggaactcgtccattcgttgtggaatttatgaaacaaattggccaggccaatcggcgtgtcttagctactgatgaatggctaagggtccgtgaatgtgatggcgtctatgcaataggtgactgtgctacaataaaccagaggaaagtaatggaggacatttcagaaatattcagagttgcagataaggataagtctggaaccttgactgtgaaagaaattcaagatatcctggatgatatttacgtgagatacccacaagtacagctctaccttaagagcaagcagatgaacggcatcgctgatctagtaaggagtgccaaaggagacgctgaaaaggaatccatggaactgaacatcgaggaattcaagaaggctcttgcactcgtggattcgcaagtcaaattcttacctgcaactgctcaggtcgcatcccagcagggccaatatcttgctaggtgctttaacaagatgaaggatgctgaagaaaaccctgaaggtccaatccgcatcaggggagaaggccgccatcgcttccgccctttcaggtaccggcatctgggccaattcgccccactaggaggggagcaaactgctgcacagcttcccggggactggatctccattggccacagcacccagtggctctggtactccgtgtatgcaaccaaacaaatcagttggcgcacgaggatgctggtggtatctgactggacgcgcagattcatcttcggaagagactcgagttgcatatag

SEQ ID NO: 9802 - protein, 581 aa, Sorghum bicolor
  misc_feature: Ceres ANNOT ID no. 6106515
  misc_feature (59)..(377): Pfam Id: Pyr_redox_2 Pfam Desc: Pyridine nucleotide-disulphide oxidoreductase
  misc_feature (224)..(330): Pfam Id: Pyr_redox Pfam Desc: Pyridine nucleotide-disulphide oxidoreductase
  misc_feature (383)..(411): Pfam Id: efhand Pfam Desc: EF hand
  misc_feature (25)..(581): NCBI GI: 87240748 NCBI Desc: fad-dependent pyridine nucleotide-disulphide oxidoreductase; calcium-binding ef-hand [medicago truncatula]
  misc_feature (26)..(581): NCBI GI: 7267261 NCBI Desc: at4g05020 [arabidopsis thaliana]
  misc_feature (26)..(581): NCBI GI: 14532464 NCBI Desc: at4g05020/t32n4_4 [arabidopsis thaliana]
  misc_feature (33)..(581): NCBI GI: 42567013 NCBI Desc: pyridine nucleotide-disulphide oxidoreductase family protein [arabidopsis thaliana]
  misc_feature (26)..(581): NCBI GI: 5734587 NCBI Desc: external rotenone-insensitive nadph dehydrogenase [solanum tuberosum]
MRWAAFLWEGASRASGGRRPGVSNLLLVVAAASSGGLVAYADSGSDAAVEKPQLPPRKKVVVLGTGWGGTTFLRNLDSRLYDVQVISPRNYFAFTPLLPSVTSGTVEPRSIVEPIRRILEKKGGEIKFWEAECFKIDPQSKKIHCRSNVGTNLEGNGEFSVDYDYLVVAVGARTNTFNTPGVVENCHFLKEVEDAQKIRRSVMDCFERASLPFLNEEERKKNLHFVVVGGGPTGVEFAASLHDFVTEDLSKLYPSVQHLVKISLIEAADHILTMFDKRITNFAEDKFGRDGIDVKTGYKVVKVSKDDITMQNPATGDISVPYGMAVWSTGIGTRPFVVEFMKQIGQANRRVLATDEWLRVRECDGVYAIGDCATINQRKVMEDISEIFRVADKDKSGTLTVKEIQDILDDIYVRYPQVQLYLKSKQMNGIADLVRSAKGDAEKESMELNIEEFKKALALVDSQVKFLPATAQVASQQGQYLARCFNKMKDAEENPEGPIRIRGEGRHRFRPFRYRHLGQFAPLGGEQTAAQLPGDWISIGHSTQWLWYSVYATKQISWRTRMLVVSDWTRRFIFGRDSSCI

SEQ ID NO: 9803 - DNA, 1152 bp, Sorghum bicolor
  misc_feature: Ceres ANNOT ID no. 6106550
  misc_feature: Encodes the peptide sequence at SEQ ID NO 9804
atgacgcgggacggcgtgcctccggcggcgcccccgccggtggccggctccggctctggcggcgcggtggcggcggcgggcgacgggcccaggcggtgctcgcagtgcgggcaccacgggcacaacgcgcgcacctgcaccgcgcggcccgtcaagctcttcggcgtgcgcatcggggacaagcccatccggaagagcgccagtatggggaacatcgcgcacctcgctgcggagggcagcggaggaggaggaggcggcggcggtagcagggaggaagggtacggctccgatggggagcgtccgcacaagaagcgaggtgaggcatggactgaagaggagcacaagaagtttctacttggcttgaataagctagggaaaggtgattggcgtggtatatcccgcaattatgttatttcaaggacacctactcaagtggctagccatgcacaaaagtatttcaatcgccaaacaaatgtgcatagaagaaagagaagatcaagcctattcgatatggtgattgatgactcgcctgatcagcttccgctctcacgttcatcgtcacaagaagtggagcagcaacatttagatgatccacagcctgttgcagccctgcctgcccctgtggtctctccagctactgtggtacctccttctgttcctgtggaagtgcctgcttcagttccagcgcccgttcaagtcccagttccagttccagctcaagtggtgacatctcagcctatggagcaggactcggttgcctcaagttcaagtgctggagaggcaggggctgtgatgccaggagccatgcccccctatctttatccaatgatgattcctcctccctactaccatcctgcatttgttccagtgccctgctacggttatgttccgttttactatgggccaccaggtgttgcacaagctccacatgaggttgtcaagccagtggctgtgcactcaacacccccattaaacgtcaaagacctttacaatatgtctgaattgagcctgaagggtgactcagatgcaaatggtggagtgcctgcttctcccttgcctccaaagccaattggtggaccagagaggcaatctgctttccatggaaaaggtaccagtggctcgtcaggcggactaattcctgcagtcaagtga

SEQ ID NO: 9804 - protein, 383 aa, Sorghum bicolor
  misc_feature: Ceres ANNOT ID no. 6106550
  misc_feature (106)..(153): Pfam Id: Myb_DNA-binding Pfam Desc: Myb-like DNA-binding domain
  misc_feature (95)..(208): NCBI GI: 110931694 NCBI Desc: myb transcription factor myb180 [glycine max]
  misc_feature (31)..(346): NCBI GI: 89257523 NCBI Desc: myb family transcription factor [brassica oleracea]
  misc_feature (31)..(367): NCBI GI: 114432231 NCBI Desc: myb [brassica rapa subsp. pekinensis]
  misc_feature (96)..(181): NCBI GI: 71041110 NCBI Desc: mybr2 [malus x domestica]
  misc_feature (95)..(207): NCBI GI: 110931692 NCBI Desc: myb transcription factor myb93 [glycine max]
  misc_feature: The sequence is a functional homolog of SEQ ID NO 1045 in the 11/479,226US patent application
  misc_feature: The sequence is a functional homolog of SEQ ID NO 452 in the 10/412,699US patent application
  misc_feature: Useful for making plants with modulated growth and phenotype characteristics
  misc_feature: The sequence is a functional homolog of SEQ ID NO 452 in the 20040045049 US patent application
  misc_feature: The sequence is a functional homolog of SEQ ID NO. 514 in the 11/188,298 US application
MTRDGVPPAAPPPVAGSGSGGAVAAAGDGPRRCSQCGHHGHNARTCTARPVKLFGVRIGDKPIRKSASMGNIAHLAAEGSGGGGGGGGSREEGYGSDGERPHKKRGEAWTEEEHKKFLLGLNKLGKGDWRGISRNYVISRTPTQVASHAQKYFNRQTNVHRRKRRSSLFDMVIDDSPDQLPLSRSSSQEVEQQHLDDPQPVAALPAPVVSPATVVPPSVPVEVPASVPAPVQVPVPVPAQVVTSQPMEQDSVASSSSAGEAGAVMPGAMPPYLYPMMIPPPYYHPAFVPVPCYGYVPFYYGPPGVAQAPHEVVKPVAVHSTPPLNVKDLYNMSELSLKGDSDANGGVPASPLPPKPIGGPERQSAFHGKGTSGSSGGLIPAVK

SEQ ID NO: 9805 - DNA, 1482 bp, Sorghum bicolor
  misc_feature: Ceres ANNOT ID no. 6106591
  misc_feature: Encodes the peptide sequence at SEQ ID NO 9806
atggcttccgcggcggctcagtgcttcagctactcctcgtcaccggccacgtgggctatgcggcagcgcggcggcggcggtgccggtgccggtgccggcgtgcttcggctctcgtcccggcggaccttctcggtctccgcggcggccgggttcgacaaccagaaccgcgagtatgtgatcgtcggcggagggaacgccgcggggtacgccgccaggacgttcgtcgagcacggcatggctgatggccgcctctgcatcgtctccaaggagccagttccaccatacgaacggccagccttgaccaaaggctatctttttcctccggacaagaaaccggcccgcctacctggtttccatacatgtgttggatctggtggacagcgacagactgctgaatggtacaaggagaatggtatagaggtgctgtatgaggatccagttgtagcatttgatggcaaaacacaaaccttaaaaacttcatcagggaaaattctgaaatatggctcacttattatttctactggatgtgaagcttcaagattacctgagaaaattggaggcacattacctggagttcactacatacgggatgttgctgatgctgattctctagtatcctcattgggaagtgcaaagaaggtggtggttattggtgggggctatattggcatggaggtagctgcagcagcttgtggctggaatcttgacacaactattatattcccagaggaccacattatgccaagattatttacaccctcccttgctaagaagtatgaggaactgtatcagcaaaatggtgtcaaattcataaagggggctcttatcgacaaacttgaagctggctctgatggaagggtgtcttctgcagtacttaaggatggatctgtagttgaagctgatacagtaattgttggtataggagcaaaaccagttgtcagcccctttgaagctgttggagtcagcgctgaagttggtggaatagaggttgattccctgttcagaactagtgtacctggcatctttgcaattggagatgtagcagcctttcccctgaagatgtacgatagagttgctcgagtggaacatgtggatcatgctcggaaatctgcacaccactgtgtagaaactctcctaacatcccagacaaaagcgtatgactaccttccatatttctattcaagagtttttgagtatgaaggaagtgcgaggaaaatttggtggcagttttatggtgataacgttggcgaagcagttgaagtagggagctttgatccaaagattgcaactttctggattgactctgatagtcgactgaagggtgttttccttgagagtggaacctcagaggaattctcgcttcttccgcagctcgctaaatctcagcctgttgtcgacaagtctaagctccaggccgcaacttctgttgaaaatgcattagagattgcaagaagctcactccagtccagcgcttcggtttag

SEQ ID NO: 9806 - protein, 493 aa, Sorghum bicolor
  misc_feature: Ceres ANNOT ID no. 6106591
  misc_feature (57)..(352): Pfam Id: Pyr_redox_2 Pfam Desc: Pyridine nucleotide-disulphide oxidoreductase
  misc_feature (213)..(308): Pfam Id: Pyr_redox Pfam Desc: Pyridine nucleotide-disulphide oxidoreductase
  misc_feature (40)..(489): NCBI GI: 24638429 NCBI Desc: monodehydroascorbate reductase [zantedeschia aethiopica]
  misc_feature (39)..(487): NCBI GI: 15320419 NCBI Desc: monodehydroascorbate reductase [spinacia oleracea]
  misc_feature (35)..(489): NCBI GI: 4704613 NCBI Desc: monodehydroascorbate reductase [brassica juncea]
  misc_feature (49)..(489): NCBI GI: 46093473 NCBI Desc: monodehydroascorbate reductase [brassica oleracea]
  misc_feature (37)..(489): NCBI GI: 9081770 NCBI Desc: monodehydroascorbate reductase [arabidopsis thaliana]
  misc_feature (37)..(489): SWISSPROT Homolog: EC 1.6.5.4 Monodehydroascorbate reductase, chloroplast precursor
MASAAAQCFSYSSSPATWAMRQRGGGGAGAGAGVLRLSSRRTFSVSAAAGFDNQNREYVIVGGGNAAGYAARTFVEHGMADGRLCIVSKEPVPPYERPALTKGYLFPPDKKPARLPGFHTCVGSGGQRQTAEWYKENGIEVLYEDPVVAFDGKTQTLKTSSGKILKYGSLIISTGCEASRLPEKIGGTLPGVHYIRDVADADSLVSSLGSAKKVVVIGGGYIGMEVAAAACGWNLDTTIIFPEDHIMPRLFTPSLAKKYEELYQQNGVKFIKGALIDKLEAGSDGRVSSAVLKDGSVVEADTVIVGIGAKPVVSPFEAVGVSAEVGGIEVDSLFRTSVPGIFAIGDVAAFPLKMYDRVARVEHVDHARKSAHHCVETLLTSQTKAYDYLPYFYSRVFEYEGSARKIWWQFYGDNVGEAVEVGSFDPKIATFWIDSDSRLKGVFLESGTSEEFSLLPQLAKSQPVVDKSKLQAATSVENALEIARSSLQSSASV

SEQ ID NO: 9807 - DNA, 1041 bp, Sorghum bicolor
  misc_feature: Ceres ANNOT ID no. 6106780
  misc_feature: Encodes the peptide sequence at SEQ ID NO 9808
atggcggcgtcttgtgtttcgaaggaaaggacaggcgtgcccgtggtagctctgagtctgggcaagccgatgccgcgcgtcggcttcggcacggcgtcggcgactctgggccaggccgagggccgcgccggcgtgacggaggccgtcctcagcgctctcagcgctgggtaccgccacttcgacacggcgtcggcgtacaactcggaggccgcggtcggggacgccgtcatccacgccgccgccgtccgcgacgacctctacatcacgacgaagctcgccatcaccgacgcgcaccccggccgtgttctgccggcgctacacaagtcactccggaatctgcagatggagtacgtggatctttatctcattcactttccggtgagcatgcggccgccggtggtggaaggaggcctggcggtggtgaaggaggacctggtagagatggacatgaagggggtgtgggaggagatggaggagtgccacaggcgagggcttgcgagggccattggcgtcagcaacttcagctgcaagaagctagaatacttgctatcctttgctaacattcccccggctgccaaccaggtggaggtgcacccacactgccgtcagaacaagctaagggcattttgcagggagaaaggaatccagctttgtgcattctcaccgctaggtgccaagggcacggcatgggctaacaactccgtcatggagtgccctgtcctcaagcagatagcccatgaaaagggcaagaccgtcgcccaggtgtgcattaggtgggtgtttgagcagggagattgcgtcatcgtaaaaagcttcaacgagaagaggatgcgagagaacctcgacatattcggctgggagctcacggaagacgaccgtcgcaaaatcagcggcctcccagaatcgagaggaaccttcgatttcttcgtccatgagtccgggcctttcaaaaccgccgaagagttttgggatggtgagatcgttgctggccaatccactaaccaagttgctgtccgtttggatccgaccagcttacagtaa

SEQ ID NO: 9808 - protein, 346 aa, Sorghum bicolor
  misc_feature: Ceres ANNOT ID no. 6106780
  misc_feature (18)..(301): Pfam Id: Aldo_ket_red Pfam Desc: Aldo/keto reductase family
  misc_feature (13)..(333): NCBI GI: 78707646 NCBI Desc: oxidoreductase, aldo/keto reductase family [oryza sativa (japonica cultivar-group)]
  misc_feature (24)..(327): NCBI GI: 112807100 NCBI Desc: deoxymugineic acid synthase1 [hordeum vulgare]
  misc_feature (17)..(327): NCBI GI: 112807098 NCBI Desc: deoxymugineic acid synthase1 [oryza sativa (japonica cultivar-group)]
  misc_feature (24)..(327): NCBI GI: 112807102 NCBI Desc: deoxymugineic acid synthase1 [triticum aestivum]
  misc_feature (24)..(327): NCBI GI: 112807104 NCBI Desc: deoxymugineic acid synthase1 [zea mays]
  misc_feature: Useful for making plants with modulated drought sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13495
MAASCVSKERTGVPVVALSLGKPMPRVGFGTASATLGQAEGRAGVTEAVLSALSAGYRHFDTASAYNSEAAVGDAVIHAAAVRDDLYITTKLAITDAHPGRVLPALHKSLRNLQMEYVDLYLIHFPVSMRPPVVEGGLAVVKEDLVEMDMKGVWEEMEECHRRGLARAIGVSNFSCKKLEYLLSFANIPPAANQVEVHPHCRQNKLRAFCREKGIQLCAFSPLGAKGTAWANNSVMECPVLKQIAHEKGKTVAQVCIRWVFEQGDCVIVKSFNEKRMRENLDIFGWELTEDDRRKISGLPESRGTFDFFVHESGPFKTAEEFWDGEIVAGQSTNQVAVRLDPTSLQ

SEQ ID NO: 9809 - DNA, 1062 bp, Sorghum bicolor
  misc_feature: Ceres ANNOT ID no. 6106812
  misc_feature: Encodes the peptide sequence at SEQ ID NO 9810
atggctgccatcgaggatgatcaagcagcagggtccgcggtgccggcagtggcactgagctccggcaagccgatgccgcggataggcctcggcacggcatccttcccgctcgggaacgccggggatcgcccagtcgtacgggaggccgtcctccgcgccctggacgccggctaccgccacttcgacacatccgcggtgtacggcacggagcgcgcgatcggcgacgccgtggcggaggccgtgagtgctgggacgctcgcctcccgggacgatgtctacatcacctccaagctctggatcgcggacgcgcaccctggacacgttctgccggcgctcaggaagaccctccagaatctgcagatggagtatgtggacctgtacctgatccacttcccggtgagcatgcggctgccggaggcggaaggaggggcgggagcgggaccggtgctggcaaaggaaaacctggtggagatggacatgaagggtgtgtgggaggagatggaggagtgccacaggcgagggctggccaaggccatcggcgtcagcaacttcagctgcaagaagctggactacttgctctcctttgccaacatccctccggccgtcaaccaggtggaggtaaacccatgctgccggcagaacaaactgagggtgttttgcagggagaaaggaatccagctctgcgcctactctccattgggtggcaagggagcaccatgggccaacaattctgtcatgaacagccctctcctcaggcagattgcccttacaaagggtaaaaccgtcgcccaggtgtgcattaggtgggtgtacgagcagggcgattgcgtgatagctaaaagcttcaacgagaagaggatgcgagagaacctcgacatctttgagtggcaactcacggaagacgagtgtcgcaggattagcgccctcccagaatcgaggggaacctacgatttcttcgtccatgaatctggcccgtacaaaactgcccaagagttttgggatggtgagattgtggctggccaggctaacaatgatgctttgagtttggatcctaccaattga

SEQ ID NO: 9810 - protein, 353 aa, Sorghum bicolor
  misc_feature: Ceres ANNOT ID no. 6106812
  misc_feature (19)..(311): Pfam Id: Aldo_ket_red Pfam Desc: Aldo/keto reductase family
  misc_feature (14)..(337): NCBI GI: 78707646 NCBI Desc: oxidoreductase, aldo/keto reductase family [oryza sativa (japonica cultivar-group)]
  misc_feature (16)..(337): NCBI GI: 112807098 NCBI Desc: deoxymugineic acid synthase1 [oryza sativa (japonica cultivar-group)]
  misc_feature (25)..(337): NCBI GI: 112807100 NCBI Desc: deoxymugineic acid synthase1 [hordeum vulgare]
  misc_feature (25)..(337): NCBI GI: 112807102 NCBI Desc: deoxymugineic acid synthase1 [triticum aestivum]
  misc_feature (25)..(337): NCBI GI: 112807104 NCBI Desc: deoxymugineic acid synthase1 [zea mays]
  misc_feature: Useful for making plants with modulated drought sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13495
MAAIEDDQAAGSAVPAVALSSGKPMPRIGLGTASFPLGNAGDRPVVREAVLRALDAGYRHFDTSAVYGTERAIGDAVAEAVSAGTLASRDDVYITSKLWIADAHPGHVLPALRKTLQNLQMEYVDLYLIHFPVSMRLPEAEGGAGAGPVLAKENLVEMDMKGVWEEMEECHRRGLAKAIGVSNFSCKKLDYLLSFANIPPAVNQVEVNPCCRQNKLRVFCREKGIQLCAYSPLGGKGAPWANNSVMNSPLLRQIALTKGKTVAQVCIRWVYEQGDCVIAKSFNEKRMRENLDIFEWQLTEDECRRISALPESRGTYDFFVHESGPYKTAQEFWDGEIVAGQANNDALSLDPTN

SEQ ID NO: 9811 - DNA, 1158 bp, Sorghum bicolor
  misc_feature: Ceres ANNOT ID no. 6106925
  misc_feature: Encodes the peptide sequence at SEQ ID NO 9812
atggccgccgccgccaagtcctggcccctcaacaaggtcaccgacgccgcccactgggacgccgaggacctcttcggccgcctgtgcattgtgggcgatgccgctttcctgtcctctggcttcctgccatgcgacgcgtcggagacgacaccctgctttgtatcccgccgctactcggtgccgcagctggcccaccgagagggcgcggacgccgccgtgctgtgcatctcacggcgggggcgccgtcgtggaggctgcggccacggcaagatcacggtggacgcctacgtcgacagcaacggacgccatctgaacgcccgaagggagctgctgccgctggcggctttcgcgcctgtcctctcgtgcggtatggacgacgcggctcgcgcgctgacgatgtcgtcgtcgtcgtcgccagatgacgacgccaatggcggcgcgacgtggctctggaagcttttcgcagatcagctgtgccgccgcctctttctctccatctgccaccacagcgacgtgccggtgttgccctgcttcgtgtgccttcccatcgacctacaggtggcgatcctgtgtaggctccacgtcgccgaggacgtcgcgacggttgagtgcgctagcaaggatctgaggtgcctcgtcgccgaccacgacgccgtgctctggaaggccaggtatgagtccatgagatctcagtactcctgtcttcagcaacctgaatacagaccaccactgatcttcgccaacaagggaccaccgtacttcaccgacgaggacatgccattgatgagctggaaagagaggtacgcgatggctagatggcagacaatggtgatgtcaagatggcggttcaggacaactcccatgccgacatggaagccatgggtgccgtctgcaaagagagcaaagctacagaccattatagatatggtgcgccgacgttgtgggcaacatagttcaccgcaacaccatgatcgaccagaacaaccgaggacagttgcgcggacaagtagtgatcatggatggagaggcaccaccattgatgacagaagcagaagaatgatggcgacggtggtgctgtgcagcaaaccctataggaaggggaacggtgctggtgcggttcactcgccgtcttcccggcaccgatggaatcactggtga

SEQ ID NO: 9812 - protein, 385 aa, Sorghum bicolor
  misc_feature: Ceres ANNOT ID no. 6106925
  misc_feature (3)..(293): NCBI GI: 115481004 NCBI Desc: os10g0130200 [oryza sativa (japonica cultivar-group)]
  misc_feature (27)..(226): NCBI GI: 115451729 NCBI Desc: os03g0232000 [oryza sativa (japonica cultivar-group)]
MAAAAKSWPLNKVTDAAHWDAEDLFGRLCIVGDAAFLSSGFLPCDASETTPCFVSRRYSVPQLAHREGADAAVLCISRRGRRRGGCGHGKITVDAYVDSNGRHLNARRELLPLAAFAPVLSCGMDDAARALTMSSSSSPDDDANGGATWLWKLFADQLCRRLFLSICHHSDVPVLPCFVCLPIDLQVAILCRLHVAEDVATVECASKDLRCLVADHDAVLWKARYESMRSQYSCLQQPEYRPPLIFANKGPPYFTDEDMPLMSWKERYAMARWQTMVMSRWRFRTTPMPTWKPWVPSAKRAKLQTIIDMVRRRCGQHSSPQHHDRPEQPRTVARTSSDHGWRGTTIDDRSRRMMATVVLCSKPYRKGNGAGAVHSPSSRHRWNHW

SEQ ID NO: 9813 - DNA, 1482 bp, Sorghum bicolor
  misc_feature: Ceres ANNOT ID no. 6106963
  misc_feature: Encodes the peptide sequence at SEQ ID NO 9814
atggaatctgccatagctgcggttgcaggtgaactcgtcagccgattcatctccttcgcctttagcagatattgctccagctacagctatgaaggattggaggagaagcgggagaggctgcgacaactcctgatgagggttcacaccgtcgtcgaggaggcagatgcgcgatacatcaccaactctgggatgctgatgcagctcaagctgctgtcggaggccatgtaccagggctaccatgcgctggataccttgacattccagctccacgacgacgaggaggactccacaaactgcatggttagcgactcatcaatctccttgtgttccgccactcgcttcaaacgtcaacgcacagttcttgcttcggcgaaaaaggacaaggtagccgcattggataatctggaaacagctgtggcgaacatatcagagttcgttgcgcttctgtgtgggtgtgatgagcgcttgtcccgtagaccctacgatgcatatctttacatcggcaatttcatgtttggtcgacatgccgaaaagcaaaagctcctcaacttcttactgcagcaaaacccatcagatgaccttgcaccacctcctgtcctgccaatcatcggtgctcttggagttgggaagaagactttggtcgcccatgtgtgtgctgacgagagggtacgctgcaaattcgcttcgattctgcatctgaacggtgaaaacttactgaatatcgtcgaccacgaaaaggccatgctgggaatgccgtcacttgtggttgttgagtttgtttcagatgttgatgacatgaaatggaatgagttttattcatttgtgacaagaacagctagtacaagaagcaaggtgatcatcatcagcaagcttggaacattagcaaggtttgggtcagtaagaccaatctttcttgatgctctgtcatacgaggagttgtggtacctcttcaagaacctagcatttggaagtgcggacccggcagagcatccaaggctagtacatatagcagaaggatttgccaaggaatttcatcagggtggatcacttgttacagcaaatgcattcgctgacgtgttgagaagcaacctgaatgctcaattctggctttcgatactgaacaagtgcagaaaagtgatggagaagaacctcttcgcttacgggcagctcccaaatttactcttcgatcaaggccgcgaggtagacatcacggatttcgtttcgagtcctgctattaatcccattcgcatcttaccttgtactactagtagggctctagccaaaacagaattaccaaaggtggcgtttggagaactactcctagatccttctgttagacccaaaggagaatttcgtctattgacatgggagtccaggttaccaccttatacttcatttattcacttggttccaaattccactcaagatctgcctcaaggacatagtttatcagggaggaagcgccacatagtgcctttctga

SEQ ID NO: 9814 - protein, 493 aa, Sorghum bicolor
  misc_feature: Ceres ANNOT ID no. 6106963
  misc_feature (1)..(467): NCBI GI: 115439635 NCBI Desc: os01g0721800 [oryza sativa (japonica cultivar-group)]
  misc_feature (1)..(467): NCBI GI: 18461229 NCBI Desc: p0690b02.14 [oryza sativa (japonica cultivar-group)]
  misc_feature (1)..(490): NCBI GI: 57899231 NCBI Desc: fusarium resistance protein i2c-5-like [oryza sativa (japonica cultivar-group)]
  misc_feature (1)..(488): NCBI GI: 18461224 NCBI Desc: p0690b02.9 [oryza sativa (japonica cultivar-group)]
  misc_feature (1)..(466): NCBI GI: 115447413 NCBI Desc: os02g0627900 [oryza sativa (japonica cultivar-group)]
MESAIAAVAGELVSRFISFAFSRYCSSYSYEGLEEKRERLRQLLMRVHTVVEEADARYITNSGMLMQLKLLSEAMYQGYHALDTLTFQLHDDEEDSTNCMVSDSSISLCSATRFKRQRTVLASAKKDKVAALDNLETAVANISEFVALLCGCDERLSRRPYDAYLYIGNFMFGRHAEKQKLLNFLLQQNPSDDLAPPPVLPIIGALGVGKKTLVAHVCADERVRCKFASILHLNGENLLNIVDHEKAMLGMPSLVVVEFVSDVDDMKWNEFYSFVTRTASTRSKVIIISKLGTLARFGSVRPIFLDALSYEELWYLFKNLAFGSADPAEHPRLVHIAEGFAKEFHQGGSLVTANAFADVLRSNLNAQFWLSILNKCRKVMEKNLFAYGQLPNLLFDQGREVDITDFVSSPAINPIRILPCTTSRALAKTELPKVAFGELLLDPSVRPKGEFRLLTWESRLPPYTSFIHLVPNSTQDLPQGHSLSGRKRHIVPF

SEQ ID NO: 9815 - DNA, 1485 bp, Sorghum bicolor
  misc_feature: Ceres ANNOT ID no. 6106969
  misc_feature: Encodes the peptide sequence at SEQ ID NO 9816
atggaagtagctctatctgccatttctagtgaaatactcagccgactcatgtccttcataatcaagaaacataccgacaggtcatgtgtggaagagaagctagaaaggcttgagcatctcctgctgagagtccataccgtggtcgaggaggccgagggacgatacatcaccaattccaagatgctggtgcagctcaggatgcttgttgatggcatgtaccaaggctatcatgtgctcaacaccttcaggttcaagcctgctgaggaagccccactccaaaaccaggtgacacaatcatctgccttgccaactcctgttaagcgcacccgtgcagcagcttctaccgttgggactatcaaggtttccaaccatgagctacaagcttcactggaaaaattggaaaccgttgttgcaaatatgacagagtttgtcattctactgggtgggtgcaagcagatgcataaaagaccctatgacacctatatctacattgacaatttcatgttcagtcgcatcgtcgaaaagcaggagctgatcaacgccctgttgcaagacaactctcctctagatgttccagctgttgtgccagtaattggtgcatacagagccgggaagaaaagcttagttgggtttgcttgcaacgatgatatgattcgctctcacttctcctcggtattgcactttaaaagcaacaactttctgaaagaaagccgtgaaacaatcatgcctgtaagaactttagttgttgtggagtttatttcagatgtggataacagtgaatgggtaaagttttattcagatgcatcgtcacagatgggcacaggaagcaaagtgatcatcatgagtaggttccaagagattgcgaggtttggaacagtaaagccaattgtcctcagaagcttgtcagatgcagagttctgttacctcttcaaggtactcgcgttcggagggacagacccagagaatcacccacaactagcatcaatagctatggagctagccacgaatgtgaatgggttgctccttgtagggaatatggtcgctgacttgttaaggacgaaccaaaatgtccaattctggttccatatattgaagaggttcaggaagtcattagagcgtaatttttccaggtttggtgagcatccgaagcaacttcttgagagggaccgtccgactgacataacaatgctggttccgccttcttctgctacacttcgtctcatgccatcccacgacaacactggttgtttatgcatgaaagtactgcccaaggtgaagcttgcagacctggtgcaaggttcaactactattctacccaatgaggagtttcagataattatatgggaatcaagattacccccttttactaagtttgtcgcaaactgtatcgctgaggagcatccttgtacttcctcagacaataaaaggcataagtcagcatgtaacagtactagtgtaacacccaaaaatttgcttttgaattaa

SEQ ID NO: 9816 - protein, 494 aa, Sorghum bicolor
  misc_feature: Ceres ANNOT ID no. 6106969
  misc_feature (151)..(412): Pfam Id: NB-ARC Pfam Desc: NB-ARC domain
  misc_feature (107)..(335): NCBI GI: 53793433 NCBI Desc: nbs-lrr-like protein [oryza sativa (japonica cultivar-group)]
  misc_feature (1)..(479): NCBI GI: 115447413 NCBI Desc: os02g0627900 [oryza sativa (japonica cultivar-group)]
  misc_feature (1)..(465): NCBI GI: 18461224 NCBI Desc: p0690b02.9 [oryza sativa (japonica cultivar-group)]
  misc_feature (1)..(466): NCBI GI: 22831028 NCBI Desc: fusarium resistance protein i2c-5-like [oryza sativa (japonica cultivar-group)]
  misc_feature (1)..(465): NCBI GI: 57899231 NCBI Desc: fusarium resistance protein i2c-5-like [oryza sativa (japonica cultivar-group)]
MEVALSAISSEILSRLMSFIIKKHTDRSCVEEKLERLEHLLLRVHTVVEEAEGRYITNSKMLVQLRMLVDGMYQGYHVLNTFRFKPAEEAPLQNQVTQSSALPTPVKRTRAAASTVGTIKVSNHELQASLEKLETVVANMTEFVILLGGCKQMHKRPYDTYIYIDNFMFSRIVEKQELINALLQDNSPLDVPAVVPVIGAYRAGKKSLVGFACNDDMIRSHFSSVLHFKSNNFLKESRETIMPVRTLVVVEFISDVDNSEWVKFYSDASSQMGTGSKVIIMSRFQEIARFGTVKPIVLRSLSDAEFCYLFKVLAFGGTDPENHPQLASIAMELATNVNGLLLVGNMVADLLRTNQNVQFWFHILKRFRKSLERNFSRFGEHPKQLLERDRPTDITMLVPPSSATLRLMPSHDNTGCLCMKVLPKVKLADLVQGSTTILPNEEFQIIIWESRLPPFTKFVANCIAEEHPCTSSDNKRHKSACNSTSVTPKNLLLN

SEQ ID NO: 9817 - DNA, 1452 bp, Sorghum bicolor
  misc_feature: Ceres ANNOT ID no. 6106986
  misc_feature: Encodes the peptide sequence at SEQ ID NO 9818
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atggagctggttgtatccgcagttgtaggtgaacttgttaaccggttcatgtccttcttattcaacaagtacaaaagtgaagagcagttggagaagaaggtgagaatgctgcaagatctagttgttagagctcatatgattgtggaggaggccgaggcgcgatacatcaccaactcaaagatgctgcttcagctcaagaagcttgtggaggtcatgtaccaaggctaccttgtcctggacaccaacaggtacacgactgtaaacgaggtcagcagcagcttcagtgagttgtccgtcaccacttatattaaacgactttttacttgtgtggatcatgagcttcagcctgcactggataatttggaatctcttctttcaaacatgaaagagtttgtatttcttctccatggatgcgaacgcatgttccgcggcccctatgactcgtatctgtacatagacaacttcatgtttggtcgtcacgtagagaagcagcagattatcaatatcttactgcaagataatcctcctccctttttcactccaacagtgctcccggtgattggcggtgtcagagtcggtaagaaaactctgattgcacatgtgtgcaacaatgagaaaatcaggtcacagttctcttcagtcctgcacctgaatggagaaaacatttggacaatggagcatgatgctgctcctgttataccagcaccagcagggaagtctttgctggtggttcactttgcatcggatgtggatgatgaggtgtggctcaagttttactcatcagcagcaaaacaaatggggagaggaagcaagatcgtaattgtcagtagggttaggatgctatcaaggctcggaactgtacagccaatctgtcttaacaacttgtcgcaccaggagtacagctacctcttcaaggttcttgcgtttggaagcacaaacccagaagagcaccaccctcagttagcatcagtagcacaatatctagcagaggccttgagaggatcactcgtcacggcgaacctgtatgctcatttgctacggaagaatcagaatgttggcgcctggctctgcatattacagaagtacaggaaagtagtggagaacaacatgtcaattttcggtgtgcatcccaagaatctaatggacaaagagcacccaatatatataaccagccttgtaccgttgtcatcatcgcctatacttcgcctgatgccccctcaaagagaaattgatgcctccaaagggcgattaccaaaggtgttgttgggagatctgattgtgggctcagctgttctgcccaagaaggaatttcaggtggttgtgtgggaatcacggatacccccttacaaaaggtttgttcatcttgctacatattgtgatgatgagccggtggtctcttctcagcatcatactgcatcacctagcatgaagcgcagacggttagataaataa

SEQ ID NO: 9818 - protein, 483 aa, Sorghum bicolor
  misc_feature: Ceres ANNOT ID no. 6106986
  misc_feature (1)..(453): NCBI GI: 18461229 NCBI Desc: p0690b02.14 [oryza sativa (japonica cultivar-group)]
  misc_feature (1)..(397): NCBI GI: 22831028 NCBI Desc: fusarium resistance protein i2c-5-like [oryza sativa (japonica cultivar-group)]
  misc_feature (24)..(458): NCBI GI: 115439635 NCBI Desc: os01g0721800 [oryza sativa (japonica cultivar-group)]
  misc_feature (1)..(452): NCBI GI: 115447413 NCBI Desc: os02g0627900 [oryza sativa (japonica cultivar-group)]
  misc_feature (1)..(453): NCBI GI: 18461224 NCBI Desc: p0690b02.9 [oryza sativa (japonica cultivar-group)]
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MELVVSAVVGELVNRFMSFLFNKYKSEEQLEKKVRMLQDLVVRAHMIVEEAEARYITNSKMLLQLKKLVEVMYQGYLVLDTNRYTTVNEVSSSFSELSVTTYIKRLFTCVDHELQPALDNLESLLSNMKEFVFLLHGCERMFRGPYDSYLYIDNFMFGRHVEKQQIINILLQDNPPPFFTPTVLPVIGGVRVGKKTLIAHVCNNEKIRSQFSSVLHLNGENIWTMEHDAAPVIPAPAGKSLLVVHFASDVDDEVWLKFYSSAAKQMGRGSKIVIVSRVRMLSRLGTVQPICLNNLSHQEYSYLFKVLAFGSTNPEEHHPQLASVAQYLAEALRGSLVTANLYAHLLRKNQNVGAWLCILQKYRKVVENNMSIFGVHPKNLMDKEHPIYITSLVPLSSSPILRLMPPQREIDASKGRLPKVLLGDLIVGSAVLPKKEFQVVVWESRIPPYKRFVHLATYCDDEPVVSSQHHTASPSMKRRRLDK

SEQ ID NO: 9819 - DNA, 1020 bp, Sorghum bicolor
  misc_feature: Ceres ANNOT ID no. 6106987
  misc_feature: Encodes the peptide sequence at SEQ ID NO 9820
atgatgttctggaaggacggcggcgggactgggggcggcaacggacgggacctcagcggtgggccgccctgcggccaggtgcgtgtgctcgtcgttggcgactcaggtgttggtaaatcttcattggtgcatctcttattgaaaggttctgcagtggctcgaccagcccaaacaattgggtgtgcagttggtgttaaacatattacttacagtagtccagggagttcatctaatagcatcaagggcgatgctgaaaggaacttttttgttgagctttgggatgtttctggacatgagcgctacaaagactgtcgttcacttttttattcacaaattaatggtgtcatatttgtttatgacctttcccagaggaaaacaaagacaaatttgaacaagtgggcagtggaagttgctgaatctgggaccttttcagctcctcttgggtctggtggtcctggtggccttccagttccttacctagttattgccaacaaagtggatattgctccaagagatggtagaagagtgagcagtgggaatcttgttgatgttgctcgccaatgggttgaaaagcaaggcctgcttccatccagtgaagaacttccacttgcagatagctttcctggcaattctggtctgctcacggctgccaaagagggaagatatgataaagaagctctaatcaagttcttccgcatgttgataaggaggaggtatttttcgaatgagcttcctgcccctagcccatggtcactcactcccagagaagataccattcttcctgtagaatctgtgaatgatgatgacatgttccaaagaaaaagctacggtggccagagctacaaatacaatggggtggccccactgcctgcacagcggaacctaactccacccccgacactctatccacagcagccaatgtcctcttcatcagaaaactacagataccacagattttcctcctcgtcaatacctgattcaagtggtggtagaacaagccgagcaaacctcaatatatga

SEQ ID NO: 9820 - protein, 339 aa, Sorghum bicolor
  misc_feature: Ceres ANNOT ID no. 6106987
  misc_feature (28)..(167): Pfam Id: Miro Pfam Desc: Miro-like protein
  misc_feature (28)..(240): Pfam Id: Ras Pfam Desc: Ras family
  misc_feature (27)..(167): Pfam Id: MMR_HSR1 Pfam Desc: GTPase of unknown function
  misc_feature (2)..(339): NCBI GI: 92885180 NCBI Desc: sigma-54 factor, interaction region; ras small gtpase, rab type [medicago truncatula]
  misc_feature (1)..(339): NCBI GI: 145357836 NCBI Desc: atp binding / gtp binding / transcription factor binding [arabidopsis thaliana]
  misc_feature (26)..(137): NCBI GI: 116127026 NCBI Desc: ensangp00000013042 [anopheles gambiae str. pest]
  misc_feature (26)..(245): NCBI GI: 18088572 NCBI Desc: rab, member of ras oncogene family-like 3 [homo sapiens]
  misc_feature (26)..(239): NCBI GI: 49257301 NCBI Desc: mgc82648 protein [xenopus laevis]
  misc_feature: The sequence is a functional homolog of SEQ ID NO. 400 in the 11/188,298 US application
MMFWKDGGGTGGGNGRDLSGGPPCGQVRVLVVGDSGVGKSSLVHLLLKGSAVARPAQTIGCAVGVKHITYSSPGSSSNSIKGDAERNFFVELWDVSGHERYKDCRSLFYSQINGVIFVYDLSQRKTKTNLNKWAVEVAESGTFSAPLGSGGPGGLPVPYLVIANKVDIAPRDGRRVSSGNLVDVARQWVEKQGLLPSSEELPLADSFPGNSGLLTAAKEGRYDKEALIKFFRMLIRRRYFSNELPAPSPWSLTPREDTILPVESVNDDDMFQRKSYGGQSYKYNGVAPLPAQRNLTPPPTLYPQQPMSSSSENYRYHRFSSSSIPDSSGGRTSRANLNI

SEQ ID NO: 9821 - DNA, 531 bp, Sorghum bicolor
  misc_feature: Ceres ANNOT ID no. 6107147
  misc_feature: Encodes the peptide sequence at SEQ ID NO 9822
atgggtggctgttgttgctgttcgtcgagaacatctgaagcagttagagcaccagttgatatctatcgtcaacaaaatcttgaggagcatgagccgttgtcttcagcttttgatggatcatctccagcctctgcaattgttgcagtagacacaaatttggatacttccacacctgacacatatcgagcaccacctgcacccttgccttatgatgttgttttggcagtcccagataaccctggtttggagaagccagacactaagagcaaaactgatgaccatcaagagtccataaatgatgagcagtccttaaaggtggatgagtcatgtaagaaaggtgttactgaagataaggctgatgaggaggatgtttgtcctatctgccttgaagaatatgatgaagaaaatcctcgctctgtaactaaatgcgagcatcatttccatctttgctgcattcttgaatggatggagcgaaaagatacttgcccagtttgtgaccagataactttggtggatgagatgtttgaatag

SEQ ID NO: 9822 - protein, 176 aa, Sorghum bicolor
  misc_feature: Ceres ANNOT ID no. 6107147
  misc_feature (125)..(165): Pfam Id: zf-C3HC4 Pfam Desc: Zinc finger, C3HC4 type (RING finger)
  misc_feature (1)..(170): NCBI GI: 79324959 NCBI Desc: rhb1a; protein binding / ubiquitin-protein ligase/ zinc ion binding [arabidopsis thaliana]
  misc_feature (1)..(173): NCBI GI: 42572783 NCBI Desc: zinc finger (c3hc4-type ring finger) family protein [arabidopsis thaliana]
  misc_feature (1)..(173): NCBI GI: 21593116 NCBI Desc: ring-h2 finger protein rhb1a [arabidopsis thaliana]
  misc_feature (9)..(176): NCBI GI: 23505815 NCBI Desc: at5g41350/myc6_6 [arabidopsis thaliana]
  misc_feature (119)..(165): NCBI GI: 57900128 NCBI Desc: zinc finger (c3hc4-type ring finger) protein-like [oryza sativa (japonica cultivar-group)]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
  misc_feature: The sequence is a functional homolog of SEQ ID NO. 350 in the 11/188,298 US application
MGGCCCCSSRTSEAVRAPVDIYRQQNLEEHEPLSSAFDGSSPASAIVAVDTNLDTSTPDTYRAPPAPLPYDVVLAVPDNPGLEKPDTKSKTDDHQESINDEQSLKVDESCKKGVTEDKADEEDVCPICLEEYDEENPRSVTKCEHHFHLCCILEWMERKDTCPVCDQITLVDEMFE

SEQ ID NO: 9823 - DNA, 708 bp, Sorghum bicolor
  misc_feature: Ceres ANNOT ID no. 6107555
  misc_feature: Encodes the peptide sequence at SEQ ID NO 9824
atggcatcaggcagcgaagagaaagcggcggcggtgcgtgtgatcggcgggtgggcgtgcccctacgccatccgcgtgttcgcggcgctcaagctcaagggtgtcgagtacgagttcctgcaggagccggcaggcaggaagagcgagctgctgctcaagtccaacccggtctacaagaagattccggtcctgctccaccatggcaaccccatctgtgagtccatgatcatcatccagtatatcgatgaggtgtgggcctcttaccagccggccatccttccgactgacccgtacgcgcgtgccaacgaacggttctgggctcagtacgttgatgacaagattgccccagcattccttgtcctgagagggctcaccaacggagacaaggacgaagcagcagcgcaagtgtccactgccctagagcatctggaggaggctttcgtcaagtgcagtcaagggaagcactacttcggcggcgaccgcatcggcttcctcgacctcgttctcggctcacaccttggctggttcaaggcagtggagaagatctctggtaccaagctcctcaaagaagccaagtaccctgaaatcacagcatgggcagaccgcttctgcgctcaccacgctgtgaaagacgtcatgcctgaaaccgacaggctcgtagagttcagcaccaattctgccttgaaggctaaacctagtagcaattaa

SEQ ID NO: 9824 - protein, 235 aa, Sorghum bicolor
  misc_feature: Ceres ANNOT ID no. 6107555
  misc_feature (10)..(83): Pfam Id: GST_N Pfam Desc: Glutathione S-transferase, N-terminal domain
  misc_feature (105)..(207): Pfam Id: GST_C Pfam Desc: Glutathione S-transferase, C-terminal domain
  misc_feature (2)..(217): NCBI GI: 46276331 NCBI Desc: glutathione s-transferase gstu31 [oryza sativa (japonica cultivar-group)]
  misc_feature (10)..(223): NCBI GI: 11385519 NCBI Desc: glutathione s-transferase gst 34 [zea mays]
  misc_feature (10)..(232): NCBI GI: 11385513 NCBI Desc: glutathione s-transferase gst 31 [zea mays]
  misc_feature (3)..(235): NCBI GI: 6652872 NCBI Desc: glutathione s-transferase 2 [papaver somniferum]
  misc_feature (3)..(235): NCBI GI: 6652874 NCBI Desc: glutathione s-transferase 3 [papaver somniferum]
MASGSEEKAAAVRVIGGWACPYAIRVFAALKLKGVEYEFLQEPAGRKSELLLKSNPVYKKIPVLLHHGNPICESMIIIQYIDEVWASYQPAILPTDPYARANERFWAQYVDDKIAPAFLVLRGLTNGDKDEAAAQVSTALEHLEEAFVKCSQGKHYFGGDRIGFLDLVLGSHLGWFKAVEKISGTKLLKEAKYPEITAWADRFCAHHAVKDVMPETDRLVEFSTNSALKAKPSSN

SEQ ID NO: 9825 - DNA, 720 bp, Sorghum bicolor
  misc_feature: Ceres ANNOT ID no. 6107593
  misc_feature: Encodes the peptide sequence at SEQ ID NO 9826
atgtcaagtgcaggcaacgagctgaagcttctgagcacatggttcagcccgttcgggtccagggtgaagctcgcgctccacctcaagggcttgagctacgagtacgtcgaggaggatctcatgaacaagagccagctcctcctccagagcaatcccgtgcacaagaaggttcccgtcctcttccacaggggcaaggctctctgtgagtccatggtcatcgtggattatatcgaggaggccttccctgacgccggaccgcggcttctcccctccgacccctacgaacgcgccgtcgctcggttctgggttgcttttatcgagaacaagtttgtggcgccgtggtgtcagatgttcgatgtcaccaagacgcgcgaagagaaggccgaggggttgaagcagattcttgcggcgagggcgaccatggagggcgctctggaggagtactccaagcaggggaagcccttcttcggcggcgacagcgtcgggtgcgttgacattgcgctgggcggactgctcgtgtgggtgcgcgcgtccgaggtgctgtccggcgtcaagttactcgacgccgccacggccccgctgctgtcagcatgggcggagcgcttcgccgcgcttgacgcggcgaaggccgccctgccagacttcggcagggtgctcgagtacgccacgaagatgcgaggccccgcggccgccaaagctgtgcgctattctacaccctag

SEQ ID NO: 9826 - protein, 239 aa, Sorghum bicolor
  misc_feature: Ceres ANNOT ID no. 6107593
  misc_feature (6)..(79): Pfam Id: GST_N Pfam Desc: Glutathione S-transferase, N-terminal domain
  misc_feature (102)..(206): Pfam Id: GST_C Pfam Desc: Glutathione S-transferase, C-terminal domain
  misc_feature (3)..(231): NCBI GI: 22038178 NCBI Desc: glutathione-s-transferase 2 [aegilops tauschii]
  misc_feature (3)..(231): NCBI GI: 22038179 NCBI Desc: glutathione s-transferase 1 [aegilops tauschii]
  misc_feature (3)..(232): NCBI GI: 21956482 NCBI Desc: glutathione-s-transferase 28e45 [triticum aestivum]
  misc_feature (3)..(231): NCBI GI: 11385535 NCBI Desc: glutathione s-transferase gst 42 [zea mays]
  misc_feature (7)..(226): NCBI GI: 115483076 NCBI Desc: os10g0529800 [oryza sativa (japonica cultivar-group)]
  misc_feature: The plant is abnormally small.
  misc_feature: Useful for making plants with modulated biomass
  misc_feature: Functional homolog of the protein sequence given in SEQ ID NO 12911
MSSAGNELKLLSTWFSPFGSRVKLALHLKGLSYEYVEEDLMNKSQLLLQSNPVHKKVPVLFHRGKALCESMVIVDYIEEAFPDAGPRLLPSDPYERAVARFWVAFIENKFVAPWCQMFDVTKTREEKAEGLKQILAARATMEGALEEYSKQGKPFFGGDSVGCVDIALGGLLVWVRASEVLSGVKLLDAATAPLLSAWAERFAALDAAKAALPDFGRVLEYATKMRGPAAAKAVRYSTP

SEQ ID NO: 9827 - DNA, 711 bp, Sorghum bicolor
  misc_feature: Ceres ANNOT ID no. 6107605
  misc_feature: Encodes the peptide sequence at SEQ ID NO 9828
atggcaggtggaggagacgagatgaagcttctgagcacttggttcagtcctttcggatctagagtgaagcttgcactccacctcaagggcctgagctacgagtacgtcgaggaggacctcaccaacaagagccagctcctcctcgacagcaaccccgtccacaagaaggtccccgtgctattccacaagggcaaggctctgtgcgagtccatggtcatcgtcgactacattgacgaggcattcgccgccgctgggccgccgctcctcccctctgaaccctacgaacgtgccatcgctcggttctgggtcgccttcatcgagaccaagctggtggagccctggttcaagatgcttgacggcaccaggacacgagcggagatgggcgacggggtgaagcagatgctcgcggcggtggcgaccttggagggcgcgctggcgcagtgctccaaggggagacccttcttcggcggcgacagcgtcgggaacgtggacgtcgcgctgggcgggctcctggtgtgggtgcgcgcgtccgaggtgctgctcggcgtcaagttcctcgacgccgccaggaccccgctcctggcggcctgggccgaccgcttcgcgtcgcttgacgcggccaaggcggccctgccggacttcggcagggtgatcaagcacgccatgatgaggcggggcgcggcggcagccgctttggcaacgaataactga

SEQ ID NO: 9828 - protein, 236 aa, Sorghum bicolor
  misc_feature: Ceres ANNOT ID no. 6107605
  misc_feature (6)..(79): Pfam Id: GST_N Pfam Desc: Glutathione S-transferase, N-terminal domain
  misc_feature (102)..(205): Pfam Id: GST_C Pfam Desc: Glutathione S-transferase, C-terminal domain
  misc_feature (4)..(231): NCBI GI: 22038179 NCBI Desc: glutathione s-transferase 1 [aegilops tauschii]
  misc_feature (4)..(231): NCBI GI: 22038178 NCBI Desc: glutathione-s-transferase 2 [aegilops tauschii]
  misc_feature (4)..(229): NCBI GI: 21956482 NCBI Desc: glutathione-s-transferase 28e45 [triticum aestivum]
  misc_feature (1)..(228): NCBI GI: 22038181 NCBI Desc: glutathione s-transferase [aegilops tauschii]
  misc_feature (4)..(228): NCBI GI: 11385535 NCBI Desc: glutathione s-transferase gst 42 [zea mays]
MAGGGDEMKLLSTWFSPFGSRVKLALHLKGLSYEYVEEDLTNKSQLLLDSNPVHKKVPVLFHKGKALCESMVIVDYIDEAFAAAGPPLLPSEPYERAIARFWVAFIETKLVEPWFKMLDGTRTRAEMGDGVKQMLAAVATLEGALAQCSKGRPFFGGDSVGNVDVALGGLLVWVRASEVLLGVKFLDAARTPLLAAWADRFASLDAAKAALPDFGRVIKHAMMRRGAAAAALATNN

SEQ ID NO: 9829 - DNA, 1392 bp, Sorghum bicolor
  misc_feature: Ceres ANNOT ID no. 6107619
  misc_feature: Encodes the peptide sequence at SEQ ID NO 9830
atgggcgccgcggcggcgcggtcggcattggcgtccgccggccgtgcggcgaacgaggccgtaagcttcgtggtgttcctgctgctggacgcgctggaggtgctgctgtgcgtcgtgtacaaggtggcggactacgtggtggaaggcgcgtggcgtccctgctactgctcgtcgtcggcggccacgggcaagatcgtcgtgtcggagcggggaggctccaaggtcgtcagcatgctgtccgccaccaggctccacctcgaggacatctccgacacgctctacacgcggccctccgtgctggcctccgccgccgcggcgtcgtcggcgtcctcccagtcccagcggcgcgcgccggcgccgggggtcaccgtgcactccgccatcgtgcagatgctccgcggcaaggtcggcgccggcgccggagacggcaagcacaggccgtacccgtcgccgcgctggtccgactgccactgcgccaactgcaacccggcggacacggaccgcctcctcttcgtccacgtcgaggcgccgccgcaaggtacgccgacggaggaggacgtgctgttcatccacgggttcatctcgtcgtcggggttctggacggagacggtgctgccgcacgtgagccccgcggcgcgttcccgccgccggctgttcgccgtggacctgctgggtttcgggcggagcccgaagccggcggactcgctgtacacgctgcgggagcacgtggagatgatcgagcggtccgtgatcgagcgccacggggtgaggtccttccacctggtggcgcactcgctgggctccatcctcgcgctggcgctcgccgtccggcaccccgccgccgtcaggtccctcaccctcgtcgcgccgccctacttcccggtgccgcgcggggaggtgggcacgcggtacgtgctgcgggcggtggcgccgcgccgggtgtggccgcccatcgcgttcggcgcctccgtggcgtgctggtacgagcacctcagccgcaccgtcagcatcgtgctctgcaagcaccaccgcctctgggagctcgccttccgcgtcttcaccctctacagggtgcggacctacctcatggacggcttcttctgccacacccacatcgcgtcgtggcacaccctgcacaacatcatctgcggcagcgccggcaagatcgacaggtgcctcgaggtggtcagggaccagctcacctgcgacgtcaccgtctaccacggcagcgacgacgagctcctccccgtgcagtgcagctacgccgtcaaggccaagatcccgcgcgcccaggtgaaggtcgtcgacggcaaggaccacgtcaccatcgtcgtcggacgccagaaggacctggccagggagctggaggagatctgggacaggaaacggtga

SEQ ID NO: 9830 - protein, 463 aa, Sorghum bicolor
  misc_feature: Ceres ANNOT ID no. 6107619
  misc_feature (216)..(457): Pfam Id: Abhydrolase_1 Pfam Desc: alpha/beta hydrolase fold
  misc_feature (3)..(301): NCBI GI: 115466206 NCBI Desc: os06g0132500 [oryza sativa (japonica cultivar-group)]
  misc_feature (4)..(461): NCBI GI: 6633825 NCBI Desc: f1n19.24 [arabidopsis thaliana]
  misc_feature (187)..(301): NCBI GI: 88856479 NCBI Desc: esterase, tropinesterase related protein [marine actinobacterium phsc20c1]
  misc_feature (187)..(288): NCBI GI: 38638532 NCBI Desc: hydroxymuconic semialdehyde hydrolase [pseudomonas sp. nd6]
  misc_feature (187)..(288): NCBI GI: 22000712 NCBI Desc: 2-hydroxymuconic semialdehyde hydrolase [pseudomonas fluorescens]
MGAAAARSALASAGRAANEAVSFVVFLLLDALEVLLCVVYKVADYVVEGAWRPCYCSSSAATGKIVVSERGGSKVVSMLSATRLHLEDISDTLYTRPSVLASAAAASSASSQSQRRAPAPGVTVHSAIVQMLRGKVGAGAGDGKHRPYPSPRWSDCHCANCNPADTDRLLFVHVEAPPQGTPTEEDVLFIHGFISSSGFWTETVLPHVSPAARSRRRLFAVDLLGFGRSPKPADSLYTLREHVEMIERSVIERHGVRSFHLVAHSLGSILALALAVRHPAAVRSLTLVAPPYFPVPRGEVGTRYVLRAVAPRRVWPPIAFGASVACWYEHLSRTVSIVLCKHHRLWELAFRVFTLYRVRTYLMDGFFCHTHIASWHTLHNIICGSAGKIDRCLEVVRDQLTCDVTVYHGSDDELLPVQCSYAVKAKIPRAQVKVVDGKDHVTIVVGRQKDLARELEEIWDRKR

SEQ ID NO: 9831 - DNA, 1914 bp, Sorghum bicolor
  misc_feature: Ceres ANNOT ID no. 6107632
  misc_feature: Encodes the peptide sequence at SEQ ID NO 9832
atgctgcacggcccggcccactccgcttcgccggcgacggccgccgccggcggcggcgtgcagccgctggtggtggcgctcaactgcctcgaggacccgtcgctggagcaggaggcgctgtcgggcgcggcggccgtggagcacgcgccgctctcgtccctatccgcggggcgcgtcgaggccgccgccgccgtgctgctgccctcgctcgccttcctcccgcgcgccgcgcagcggaggctccgcccgtggcagctgctgctctgcctcggctcgcccgagcgcgccgccgacgccgcggcggccgccgagctcggcctccgcctcgtccacgtcgacgccaaccgcgccgaggaggtggccgacaccgtcatggcgctcttcctgggcctcctccgccgcacccacctgctgtcccgccacgcctcctcgtcgtccccgaccgccgggtggctcggctccgtccagccgctgtgccggggcatgcgacgctgcagggggctcgtgctgggcatcatcggcgtcaacgccgccgcgcggtgcctcgccacccgcagccttgccttccgcatgagcgtcctctacttcgatccgatatacgaggttactgggaaagtaaagcgtccttctattgtatttccttctgctgcaagaagaatggatactctcaatgatttgttagcagcaagtgatcttgtttcgcttcattgtgcattgacaaatgatacaacacatatacttaatgctgagcgccttcagcacataaaacctggagcgttcatagtcaacactggtagctgtcagctcatagatgattgtgcactcaaacaactcttgattgatggcactatagctggatgtgcattagatggtgctgaaggcccccagtggatggaagcatgggtgcatgagatgccaaatgttttaattcttcctcgaagtgccgactacagtgaggaagtgtggatggagatcagagagaaagcaattgcaatattgcagtcctttctctatgatggtgttgttccaaacaatgttatttctgatgaagatgaagagataagtgaagtgggatgtgacgatgatcaacttgctaaacaagaaaaagaacatgctttgcagatttgtgatggtgaacaacaaacagaagaaagccaattaactgcagaatatgacaaaagaagagccatttcacaacctgaagagcctcaagcttctgcacaatctcatactattggctccagatctgaaggaaggcgcagccgatctggaaagaaagggaaaaagagacctgctcgccgcagatcacaacagaaaatggatgaattgtcaactgtagaaggtggaagtaactattcttcacgcagagatgatgataatcaagtgttaagttctagttcacgatttgcatcgcctgaggactccaaaaataaacataagtcttctgttgaatctccaatggagataatttctgaaaataagttgcctgcagggcttggtagaaagcctcctgagaagttaaaagaaggttttgttattgctctaaagacaagagataattcaggtttttatgtttcaagagagagggtcgctggcggtggatggtatctggatgtgataccaaatgctacaaagagggatcctgctgctcagtttctagtcactttcagaaacaaggacactatgggactgcgatcttttgttgctggaggcaaactattacaggctaataataagatggagtttgtcttcacaagtcattcttttgatgtttgtgagagctggatgctcgaagggtccctttcagaatgctgcaaactggttaatcgcaaaaattctttggccgtacttgaagtctatattgaggtccttggagctccgagtgaagatggtgtcgttcggtggcttgattaa

SEQ ID NO: 9832 - protein, 637 aa, Sorghum bicolor
  misc_feature: Ceres ANNOT ID no. 6107632
  misc_feature (125)..(315): Pfam Id: 2-Hacid_dh_C Pfam Desc: D-isomer specific 2-hydroxyacid dehydrogenase, NAD bindingdomain
  misc_feature (22)..(637): NCBI GI: 28804254 NCBI Desc: angustifolia [ipomoea nil]
  misc_feature (22)..(637): NCBI GI: 2505877 NCBI Desc: dehydrogenase [arabidopsis thaliana]
  misc_feature (22)..(637): NCBI GI: 15408535 NCBI Desc: c-terminal binding protein [arabidopsis thaliana]
  misc_feature (22)..(630): NCBI GI: 8920588 NCBI Desc: contains similarity to a dehydrogenase from arabidopsis thaliana gby12776 and contains a d-isomer specific 2-hydroxyacid dehydrogenases pf00389 and myb-like dna binding
  misc_feature (22)..(630): NCBI GI: 8920588 (continued) pf00249 domains. ests gbz48385, gbz48386 come from this gene
  misc_feature (205)..(637): NCBI GI: 115450445 NCBI Desc: os03g0126100 [oryza sativa (japonica cultivar-group)]
MLHGPAHSASPATAAAGGGVQPLVVALNCLEDPSLEQEALSGAAAVEHAPLSSLSAGRVEAAAAVLLPSLAFLPRAAQRRLRPWQLLLCLGSPERAADAAAAAELGLRLVHVDANRAEEVADTVMALFLGLLRRTHLLSRHASSSSPTAGWLGSVQPLCRGMRRCRGLVLGIIGVNAAARCLATRSLAFRMSVLYFDPIYEVTGKVKRPSIVFPSAARRMDTLNDLLAASDLVSLHCALTNDTTHILNAERLQHIKPGAFIVNTGSCQLIDDCALKQLLIDGTIAGCALDGAEGPQWMEAWVHEMPNVLILPRSADYSEEVWMEIREKAIAILQSFLYDGVVPNNVISDEDEEISEVGCDDDQLAKQEKEHALQICDGEQQTEESQLTAEYDKRRAISQPEEPQASAQSHTIGSRSEGRRSRSGKKGKKRPARRRSQQKMDELSTVEGGSNYSSRRDDDNQVLSSSSRFASPEDSKNKHKSSVESPMEIISENKLPAGLGRKPPEKLKEGFVIALKTRDNSGFYVSRERVAGGGWYLDVIPNATKRDPAAQFLVTFRNKDTMGLRSFVAGGKLLQANNKMEFVFTSHSFDVCESWMLEGSLSECCKLVNRKNSLAVLEVYIEVLGAPSEDGVVRWLD

SEQ ID NO: 9833 - DNA, 1905 bp, Sorghum bicolor
  misc_feature: Ceres ANNOT ID no. 6107650
  misc_feature: Encodes the peptide sequence at SEQ ID NO 9834
  misc_feature: Up-regulated in root tissues in response to salicylic acid treatment
atggcgcatgacgagcaagcaggcctagcgtacgcggactacttcgcggcggcggcggccgccggcgccgtggcgacgctcgtgccggaggtggacgacgacgccgtcgccggggccggggaggaggaggaggatcttcacctctacggcgtgcaccaccagcatggggtcgagttgttcgggcccagcaggggccacatgctgcctgccgcgacgatgatggccggcggccacgctgccgctgcggcgcacggcaaggccgccgcgctcggtctcgtcgacgtcgacgtcgcttctcccgtcgtcggcgggcacgactttggcgaccaccaccaccggcagcagggtctccaggcgccgctgtcgctggcgctgcaccaccaccaccaccagcagcagctcggcggcggcggcgtgccacggcataaccagctgtcggcggcgtggccaggcccacagcagcagcaggggcagggcgcggcgtggcacctccgtggctccagattcctgcgcccgacgcagcagctcctgcaagaattctgcacccttcccgtcgacaccaccaccacagctgctgcttccaagcagccagccagcgaggacggcgtcggcgtcggctcctcgacctcggccccgtcggcgcagatccatgccatgagtgcgtccgagctgcagaggctcaaggccaagctctacgccatgctccaagaggtggagaggagataccggaggtaccgggagcagatgagggcggtggcggggtccttcgaggcggtggccggagagcaggcggcggtggcgtacacgaggctggcgtcgcggaccatatccaagcacttccggagcctgagggatggcgtggcggcgcagatgcaggtggtgcgccgggcgctcggcgagaaggacgcggacggcggtgttccggcggccggcgggatggtcaagggggagacgacgcccaggctgcgggtcatcgaccagtgtctgaggcagcacagggcgtaccaggccggcgtgctcgagagccagccgtggaggccgcagcgcgggctgccggagcgcgccgtctccatcctccgggcctggctgttcgagcacttcttgcacccgtatccaagcgacgtggataagcacatcctggcgcgccagacgggcctatcacgcagccaagtctccaactggttcatcaacgcgagggtcaggctgtggaagccgatggtggaggagatgtactcggaggagatgaaggacccgcaggagggcggcggcggcgccgcctgcagcaacgcgaacaacaacagcgtgaacactagcagctacacgtccgagctagggcagcagcagctggggcacgggggtggcgccagtggcgtggacggccgcggcggcgagcggaagccgacgcgggcgcagctgctggtccacgacgccgggtcgctagcgtcggtcgtcagtattggaagcagcagcagggaccagcagcagcagatgagcagcatcaattttggcatgatggaccacctcgacttcgacgcgtacaatgacgaccccaccgcggccggccccggcgggccagccggtgggttcggtgccggtggttccggcggcgtgtcgctcacgctcgggctgcagcatcagcacgccgacgacccgcacggcggcgtgaacatcgcgttcgccggcgccgctccgtcggcggcgcacgagttcctgttcatggcaggcggcggcgagcagcagatggtcgcgggtggcgccgtgcacccgtcccacggacacggacacggtcaccacggtcagttctcggccgccggcatgcaaggcgacggcgtgccctcctcgcactaccaccggggcctcagcgccgccaccgggttccagctcctccacgacctggctggctga

SEQ ID NO: 9834 - protein, 634 aa, Sorghum bicolor
  misc_feature: Ceres ANNOT ID no. 6107650
  misc_feature (162)..(289): Pfam Id: POX Pfam Desc: Associated with HOX
  misc_feature (96)..(433): NCBI GI: 115465946 NCBI Desc: os06g0108900 [oryza sativa (japonica cultivar-group)]
  misc_feature (155)..(425): NCBI GI: 31323443 NCBI Desc: bell-like homeodomain protein 3 [lycopersicon esculentum]
  misc_feature (155)..(422): NCBI GI: 22652121 NCBI Desc: bel1-related homeotic protein 14 [solanum tuberosum]
  misc_feature (126)..(417): NCBI GI: 15215857 NCBI Desc: at4g36870/c7a10_490 [arabidopsis thaliana]
  misc_feature (15)..(430): NCBI GI: 7239157 NCBI Desc: homeodomain protein [malus x domestica]
  misc_feature: The plant is abnormally small.
  misc_feature: The sequence is a functional homolog of SEQ ID NO 2330 in the 10/374,780US patent application
  misc_feature: The sequence is a functional homolog of SEQ ID NO 236 in the 10/225,068US patent application
  misc_feature: The sequence is a functional homolog of SEQ ID NO 268 in the 10/412,699US patent application
  misc_feature: The sequence is a functional homolog of SEQ ID NO 588 in the 11/479,226US patent application
  misc_feature: Useful for making plants with modulated biomass
  misc_feature: Useful for making plants with modulated growth and phenotype characteristics
  misc_feature: The sequence is a functional homolog of SEQ ID NO 268 in the 20040045049 US patent application
  misc_feature: Functional homolog of the protein sequence given in SEQ ID NO 13567
  misc_feature: Up-regulated in root tissues in response to salicylic acid treatment
  misc_feature: The sequence is a functional homolog of SEQ ID NO. 320 in the 11/188,298 US application
  misc_feature: The sequence is a functional homolog of SEQ ID NO. 499 in the 11/188,298 US application
MAHDEQAGLAYADYFAAAAAAGAVATLVPEVDDDAVAGAGEEEEDLHLYGVHHQHGVELFGPSRGHMLPAATMMAGGHAAAAAHGKAAALGLVDVDVASPVVGGHDFGDHHHRQQGLQAPLSLALHHHHHQQQLGGGGVPRHNQLSAAWPGPQQQQGQGAAWHLRGSRFLRPTQQLLQEFCTLPVDTTTTAAASKQPASEDGVGVGSSTSAPSAQIHAMSASELQRLKAKLYAMLQEVERRYRRYREQMRAVAGSFEAVAGEQAAVAYTRLASRTISKHFRSLRDGVAAQMQVVRRALGEKDADGGVPAAGGMVKGETTPRLRVIDQCLRQHRAYQAGVLESQPWRPQRGLPERAVSILRAWLFEHFLHPYPSDVDKHILARQTGLSRSQVSNWFINARVRLWKPMVEEMYSEEMKDPQEGGGGAACSNANNNSVNTSSYTSELGQQQLGHGGGASGVDGRGGERKPTRAQLLVHDAGSLASVVSIGSSSRDQQQQMSSINFGMMDHLDFDAYNDDPTAAGPGGPAGGFGAGGSGGVSLTLGLQHQHADDPHGGVNIAFAGAAPSAAHEFLFMAGGGEQQMVAGGAVHPSHGHGHGHHGQFSAAGMQGDGVPSSHYHRGLSAATGFQLLHDLAG

SEQ ID NO: 9835 - DNA, 978 bp, Sorghum bicolor
  misc_feature: Ceres ANNOT ID no. 6107678
  misc_feature: Encodes the peptide sequence at SEQ ID NO 9836
atggcggtgcagaggatggaggtactgtacttgcaggtggcggcggtggcggcgctgctgatggcgacggagctgcgcgcgcagctgcgggtgggcttctacgacaactcgtgccctgcggcggagatcatcgtgcagcaggaggtgagcacggcggtggcggccaacccgggcatcgccgccggcctgctccggctccacttccacgactgcttcgttggggggtgcgacgcgtcggtgctcatcgactcgaccaagggcaacaccgcggagaaggacgccgggccaaacaccagcctgcggggcttcgaggtcatcgaccgcatcaaggcgcgcgtcgagcaggcctgcttcggcgtcgtctcctgcgcggacatactcgccttcgccgccagggacagcgtcgcactggccggtggtaacgcgtaccaggtgccggcgggtcgccgcgacgggtccacgtcgcgcgcgtcggacacgaacggcaacctgccgccgccgacggcgaacgtggcccagctcacgaagatcttcggcaacaagggcctgacgcagaaggagatggtgatcctctccggcgcgcacaccatcgggtcctcgcactgcagctccttcagcgggcggctgtcgagttcgtccacgacggcggggcaggacccgaccatggacccggcgtacgtggcgcagctggcgcggcagtgcccgcaggccggcggggacccgctggtggccatggactacgtgtccccgaacgccttcgacgagggcttctacaagggcgtcatggccaaccgcggcctgctgtcctcggaccaggcgctgctcagcgacaagaacaccgccgtgcaggtcgtcacctacgccaacgacccggccacgttccagagcgacttcgccgcggccatggtcaagatgggcaccgtcggcgtgctcaccggagccagcggcaagatcagggcaaactgcagagtcgcctga

SEQ ID NO: 9836 - protein, 325 aa, Sorghum bicolor
  misc_feature: Ceres ANNOT ID no. 6107678
  misc_feature (45)..(290): Pfam Id: peroxidase Pfam Desc: Peroxidase
  misc_feature (27)..(324): NCBI GI: 92878644 NCBI Desc: haem peroxidase, plant/fungal/bacterial [medicago truncatula]
  misc_feature (27)..(324): NCBI GI: 4760700 NCBI Desc: peroxidase 1 [scutellaria baicalensis]
  misc_feature (8)..(324): NCBI GI: 7453849 NCBI Desc: peroxidase prx12 precursor [spinacia oleracea]
  misc_feature (8)..(322): NCBI GI: 55701007 NCBI Desc: tpa: class iii peroxidase 70 precursor [oryza sativa (japonica cultivar-group)]
  misc_feature (11)..(324): NCBI GI: 51038121 NCBI Desc: peroxidase [oryza sativa (japonica cultivar-group)]
  misc_feature (27)..(323): SWISSPROT Homolog: EC 1.11.1.7 Cationic peroxidase 1 precursor
  misc_feature: Useful for making plants with altered cell wall content and/or composition
  misc_feature: Functional homolog of the protein sequence encoded by LOCUS at1g05260
  misc_feature: Functional homolog of the protein sequence encoded by LOCUS at5g17820
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 14062
MAVQRMEVLYLQVAAVAALLMATELRAQLRVGFYDNSCPAAEIIVQQEVSTAVAANPGIAAGLLRLHFHDCFVGGCDASVLIDSTKGNTAEKDAGPNTSLRGFEVIDRIKARVEQACFGVVSCADILAFAARDSVALAGGNAYQVPAGRRDGSTSRASDTNGNLPPPTANVAQLTKIFGNKGLTQKEMVILSGAHTIGSSHCSSFSGRLSSSSTTAGQDPTMDPAYVAQLARQCPQAGGDPLVAMDYVSPNAFDEGFYKGVMANRGLLSSDQALLSDKNTAVQVVTYANDPATFQSDFAAAMVKMGTVGVLTGASGKIRANCRVA

SEQ ID NO: 9837 - DNA, 2223 bp, Sorghum bicolor
  misc_feature: Ceres ANNOT ID no. 6107705
  misc_feature: Encodes the peptide sequence at SEQ ID NO 9838
atggggggcgccgtgttggtcgccatcgcggcctctatcggcaacttgctgcagggctgggacaatgcgacaattgctggagcggtcttgtacataaagaaggaattcaacttgcagagcgagcccctaattgagggcctcatcgtggccatgtccctcattggggcaacagtcatcacgacgttctctggggcagtggccgactctgttggtaggaggcccatgctgatcgcctcggctatcctctactttgttagtgggctggtgatgctctgggcgccaaatgtgtatgtcttgctccttgcaaggcttatcgatgggtttggtattgggttggccgtcacacttgttcctttgtacatttctgagactgcgccgacggatattcgagggctgttgaacacactaccgcagttcagtggttcaggagggatgttcctttcctactgtatggtgtttggaatgtccctcatgcccacacctgattggaggctcatgcttggagttctgtcgatcccatcacttatttactttggattgactatcttctacttgcctgaatcaccaaggtggctcgtgagtaaaggaaggatggctgaggcaaagcgagtgttgcaaaggctgcggggaagggaagatgtctcaggggaaatggctcttctagttgaaggtttgggggttgggaaagatacacgtattgaagaatacataattggccctgatgacgagcttgctgatgaagggctggctcccgatccagagaagatcaaattatatggacctgaagaaggtctatcttgggttgcccgacctgttcggggacaaagtgctcttggaagcgcattaggtctcatctctcgtcatgggagtatggctagtcagggtaagcccctcgtggatcctgtggtcactcttttcggaagtgttcatgaaaagatgcctgagataatggggagcatgaggagcacattgtttcccaactttggcagcatgtttagtgttgccgaacagcagcaggtgaaggctgactgggatgccgagagtcaaagggagggtgacgattatgcttcagatcatggtggcgatgacattgaggataacctccaaagcccacttatttctcgtcaagcaacaagtgtggaaggaaaggagattgctgcacctcatggtagcataatgggtgctgtgggaagaagcagtagcctgcagggaggggaggcagtaagcagcatgggcattggtggaggatggcagttggcgtggaaatggactgagagagagggcgaagatggggaaaaggaaggtggcttccagcgtatttatttgcatgaggagggcgtacaaggcaggggttctatattgtcattaccaggaggggatgttcctcctggtggtgagttcgtccaggctgcagctcttgtgagtcaaccagctctttactcaaaggaactgctggagcaacgtgctgctggtcctgcgatgatgcatccatctgaggcagttgctaaaggtccaagatgggctgacctgtttgagcctggagtgaagcatgcactgtttgttggcataggaatacagatcctgcaacagtttgctggcatcaatggtgttctctactacactcctcaaattcttgagcaagcaggtgttggtgttcttctgtcgaacattggccttagcgcatcttctgcatcaattcttattagtgccttgacaaccttattgatgcttccaagcattggtattgcaatgaggctcatggatatgtctggaaggaggtttcttctccttgcgacaatccctatcttgatagttgccctagctatcttggtcgtggtcaatattgtggatgtgggaaccatggtgcatgctgcactctccacgattagtgtcatagtctatttctgcttctttgtcatggggtttgggcctattcccaacattctctgtgcagagatctttcccaccaccgtccgcggcatctgcatagccatctgcgccttaaccttctggattggtgacattatcgtgacatacacacttcctgtgatgctgaatgccatcgggctcgctggtgtctttgggatatacgccgtcgtttgcatcctggctcttgtatttgtattcatcaaggtgccagagacaaagggcatgcctctcgaggtcatcactgagttcttctccgttggagcaaagcaagccaaggaagccagggaagattaa

SEQ ID NO: 9838 - protein, 740 aa, Sorghum bicolor
  misc_feature: Ceres ANNOT ID no. 6107705
  misc_feature (6)..(727): Pfam Id: Sugar_tr Pfam Desc: Sugar (and other) transporter
  misc_feature (11)..(678): Pfam Id: MFS_1 Pfam Desc: Major Facilitator Superfamily
  misc_feature (3)..(739): NCBI GI: 26986186 NCBI Desc: hexose transporter [hordeum vulgare subsp. vulgare]
  misc_feature (1)..(740): NCBI GI: 20453189 NCBI Desc: at4g35300/f23e12_140 [arabidopsis thaliana]
  misc_feature (75)..(740): NCBI GI: 26986188 NCBI Desc: sugar transporter [hordeum vulgare subsp. vulgare]
  misc_feature (1)..(740): NCBI GI: 92868426 NCBI Desc: sugar transporter superfamily; major facilitator superfamily mfs_1 [medicago truncatula]
  misc_feature (1)..(740): NCBI GI: 61613105 NCBI Desc: hexose transporter 6 [vitis vinifera]
  misc_feature: The sequence is a functional homolog of SEQ ID NO. 449 in the 11/188,298 US application
  misc_feature: The sequence is a functional homolog of SEQ ID NO. 488 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MGGAVLVAIAASIGNLLQGWDNATIAGAVLYIKKEFNLQSEPLIEGLIVAMSLIGATVITTFSGAVADSVGRRPMLIASAILYFVSGLVMLWAPNVYVLLLARLIDGFGIGLAVTLVPLYISETAPTDIRGLLNTLPQFSGSGGMFLSYCMVFGMSLMPTPDWRLMLGVLSIPSLIYFGLTIFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMASQGKPLVDPVVTLFGSVHEKMPEIMGSMRSTLFPNFGSMFSVAEQQQVKADWDAESQREGDDYASDHGGDDIEDNLQSPLISRQATSVEGKEIAAPHGSIMGAVGRSSSLQGGEAVSSMGIGGGWQLAWKWTEREGEDGEKEGGFQRIYLHEEGVQGRGSILSLPGGDVPPGGEFVQAAALVSQPALYSKELLEQRAAGPAMMHPSEAVAKGPRWADLFEPGVKHALFVGIGIQILQQFAGINGVLYYTPQILEQAGVGVLLSNIGLSASSASILISALTTLLMLPSIGIAMRLMDMSGRRFLLLATIPILIVALAILVVVNIVDVGTMVHAALSTISVIVYFCFFVMGFGPIPNILCAEIFPTTVRGICIAICALTFWIGDIIVTYTLPVMLNAIGLAGVFGIYAVVCILALVFVFIKVPETKGMPLEVITEFFSVGAKQAKEARED

SEQ ID NO: 9839 - DNA, 1677 bp, Sorghum bicolor
  misc_feature: Ceres ANNOT ID no. 6107711
  misc_feature: Encodes the peptide sequence at SEQ ID NO 9840
atgggcggcgacggggacggcacgagggcgctggaccagacgccgacgtgggccgtggccgccgtctgcgctgtcatcgtcgcggcatccatcctcctcgagggcctcctccaccacctcggccagttgctcaacaagaagcggaagatagcgctgttcgacgctctggagaaggttaaatccgagctgatgactctggggttcatatcgctgctgctgaccgtgacggggaggtacatagcgcacatctgcatcccggagggagccgccaacaccatgctgccctgccgccgtcagtccggccactcggaggcggaggagcccgaggaccatggccgacggcacctgtctgaagatcccaccaaccttttttcctgccccaaaggcatggtgtcgcttgtttcagccgacggcatgcatcagctgcacattttcgtcttcttcttggccgtcttccatgttaccttcagtttcttcacaatgtccctgggtagagcaaagactcgtatatggaaggtgtgggaaaaggaaacttgctcccctgagtataattatttaaatgacccctcaaagttcaggctcacgcaccaaacatcttttgtgaggcaacatgcaagctgttggagcaaaagcacaatcactctctattttttcttccgatctgttcggaggacagactaccttactttacgacatggattcatttctgctcatttatctccggggactaggttcaattttcgaaagtacattaaaaggtccttggaggatgattttaagacagttgttggcattagtccaccgttatgggcttctgctttggctgtcatgctcttcaatgttcatggatggcacaacttattctggttctctacaattccccttgtagtgattctagcagttggaacaaagctgcaggctataattgctatgatggctattgaaattacagagaggcatacagttattcaaggcatgccagtggtaaaactgagtgatgatcatttctggttcgggaagcctcgtttggttctccacctcatccatttcgcatcatttcagaatgcatttgaaattacatatttcttttggatttggtacgaatttggcctgaggtcctgcttccatgacaactttgagcttatcattgcaagagtctgccttggctatatcacccttccactctatgcccttgtgtctcagatgggttcacaaatgaagagaacaattttcgacgagcagacagcaaaggccctgaagaaatggcacaaggccgtggtgaagaagaagcaccacaacaagggttcatctcacgactcctccgagacccctagcacggacacagcaacaccggcgagggaggcgggcgagtggcagcggctgcacgacgtgccggtccggcacctccaccggtacaagaccatcgcgcacgtcggcggcgcgaggagcccgctgtcggactcggactacagcgacacggacgacaccgagccgctgtcgtcgtcgcagacgaggcacctgataccgccggcgaagcagcggagcctcgacaccgagcgcgcggaggtgcgcgtggacgtcgtagagacggtggcggcggtggcgccacgcgacgtcctgcaagacagcttctcgtttccaaggctgcttccccctcgccatgtgccggacaagtga

SEQ ID NO: 9840 - protein, 558 aa, Sorghum bicolor
  misc_feature: Ceres ANNOT ID no. 6107711
  misc_feature (6)..(478): Pfam Id: Mlo Pfam Desc: Mlo family
  misc_feature (5)..(558): NCBI GI: 13784977 NCBI Desc: seven transmembrane protein mlo2 [zea mays]
  misc_feature (35)..(554): NCBI GI: 115483192 NCBI Desc: os10g0541000 [oryza sativa (japonica cultivar-group)]
  misc_feature (111)..(457): NCBI GI: 13784985 NCBI Desc: seven transmembrane protein mlo6 [zea mays]
  misc_feature (2)..(433): NCBI GI: 12322628 NCBI Desc: mlo-like protein [arabidopsis thaliana]
  misc_feature (2)..(429): NCBI GI: 33112390 NCBI Desc: mlo-like protein 9 (atmlo9)
MGGDGDGTRALDQTPTWAVAAVCAVIVAASILLEGLLHHLGQLLNKKRKIALFDALEKVKSELMTLGFISLLLTVTGRYIAHICIPEGAANTMLPCRRQSGHSEAEEPEDHGRRHLSEDPTNLFSCPKGMVSLVSADGMHQLHIFVFFLAVFHVTFSFFTMSLGRAKTRIWKVWEKETCSPEYNYLNDPSKFRLTHQTSFVRQHASCWSKSTITLYFFFRSVRRTDYLTLRHGFISAHLSPGTRFNFRKYIKRSLEDDFKTVVGISPPLWASALAVMLFNVHGWHNLFWFSTIPLVVILAVGTKLQAIIAMMAIEITERHTVIQGMPVVKLSDDHFWFGKPRLVLHLIHFASFQNAFEITYFFWIWYEFGLRSCFHDNFELIIARVCLGYITLPLYALVSQMGSQMKRTIFDEQTAKALKKWHKAVVKKKHHNKGSSHDSSETPSTDTATPAREAGEWQRLHDVPVRHLHRYKTIAHVGGARSPLSDSDYSDTDDTEPLSSSQTRHLIPPAKQRSLDTERAEVRVDVVETVAAVAPRDVLQDSFSFPRLLPPRHVPDK

SEQ ID NO: 9841 - DNA, 270 bp, Sorghum bicolor
  misc_feature: Ceres ANNOT ID no. 6107732
  misc_feature: Encodes the peptide sequence at SEQ ID NO 9842
atggagccttcacgggagaagctgtctgccgccgtcgtcctcctgctgacgctcctcgtcatggtcgccgagatgcgtccggttcaggcacgcgactgcctgacgcggagcacccggttaccgggggctctgtgcgtgcgttcggactactgcgcgatcgggtgcagggaggagggcaagggctacaccggcggcaagtgcctcatctcccccaccccgcttgacggaattcgctgctactgcgtcaagccttgtgactcgacgcactga

SEQ ID NO: 9842 - protein, 89 aa, Sorghum bicolor
  misc_feature: Ceres ANNOT ID no. 6107732
  misc_feature (31)..(85): Pfam Id: Gamma-thionin Pfam Desc: Gamma-thionin family
  misc_feature (1)..(88): NCBI GI: 12830545 NCBI Desc: female gametophyte-specific protein es3 precursor [zea mays]
  misc_feature (1)..(88): NCBI GI: 12830543 NCBI Desc: female gametophyte-specific protein es2 precursor [zea mays]
  misc_feature (1)..(87): NCBI GI: 12830541 NCBI Desc: female gametophyte-specific protein es1 precursor [zea mays]
  misc_feature (1)..(88): NCBI GI: 12830547 NCBI Desc: female gametophyte-specific protein es4 precursor [zea mays]
  misc_feature (11)..(85): NCBI GI: 17066707 NCBI Desc: defensin protein precursor [capsicum annuum]
  misc_feature: The sequence is a functional homolog of SEQ ID NO 12 in US patent 7105720
MEPSREKLSAAVVLLLTLLVMVAEMRPVQARDCLTRSTRLPGALCVRSDYCAIGCREEGKGYTGGKCLISPTPLDGIRCYCVKPCDSTH

SEQ ID NO: 9843 - DNA, 1311 bp, Sorghum bicolor
  misc_feature: Ceres ANNOT ID no. 6107795
  misc_feature: Encodes the peptide sequence at SEQ ID NO 9844
atgacgaaggtggaggagctggcggggctggggcacctgctggtgttcgccttcctcttctgcttctccgccttcatggtggcccccgtgatgaccgacgtcaccatggcggcgctctgccccggccgcgacgagtgctccctcgccatctacctcactggcctccagcaagcggttactggtctgggcgcgctggtgctgacgccggtggtgggcaacctgtccgacaggtacggccggaaggcgttgctggcgctgccggccacggcgtccatcgttcctctcggaatcctggcgtacgggcggaccaaaggttacttctacgcgtactacgtaaccaagacgctgacggcgatggtcgccgaaggcaccatgatgtgcctctcgcttgcttacgtggctgacagggtgccggagacgcggcgcgcggcggccttcggcgtcttctccggcgtctgcagcgccggcttcgtcgccagcacagtggcagcccgcttcctccccgcctcatccacgtttcaggtctccgcagtggcagccgtggtgacggccgtctacatgaaggccttcctccaggagacggacggcggagcctccatatcctcctcctgcagcagcagcagcagcaatagcgacgaggaggcctcccggccgctctgccttccctccagcagcagcagcgaggaggcgtcgccgaggcttccgccacttcggaaggcgccgtcgctgtcggagttagcagccactcttaccagcagctcaaccttctctagggcggccgtcgtcacatttttccatggccttggtgagacaggcttactaagtacactactgtacttcctgaaggcaaaattccattatagcaaggaccagtatgccaatttgctacttatcattggcattacaggaagcttctcgcagctaactgtgatgccactcctagtggcaaagcttggtgaacagaagctacttgtcgtagcacttatagcgagctgcgggcaggtcccttatcttgccgcaagcagtgtaatactaagcatgttggtcacaccttgtataagaagcattgtatcaaagaaagcggggccttttgagcagggaatggtccaagggtgcatcactggaataagctcaactgcaagtgtcatatctcctctaatttttactcctctcacagcctggtgtctgtcagaagctacgcctttctacttaaaaggtttcagccttgcctgtgctggatttgcaacgctggtagcgtttgcaacgagcataagtatgaggccaggtgaagtgcagactgataggaaatag

SEQ ID NO: 9844 - protein, 436 aa, Sorghum bicolor
  misc_feature: Ceres ANNOT ID no. 6107795
  misc_feature (13)..(385): Pfam Id: MFS_1 Pfam Desc: Major Facilitator Superfamily
  misc_feature (3)..(427): NCBI GI: 33589702 NCBI Desc: at2g16980 [arabidopsis thaliana]
  misc_feature (6)..(194): NCBI GI: 92871444 NCBI Desc: major facilitator superfamily mfs_1 [medicago truncatula]
  misc_feature (6)..(194): NCBI GI: 92871443 NCBI Desc: major facilitator superfamily mfs_1 [medicago truncatula]
  misc_feature (12)..(202): NCBI GI: 115484211 NCBI Desc: os11g0151500 [oryza sativa (japonica cultivar-group)]
  misc_feature (246)..(430): NCBI GI: 50252129 NCBI Desc: tetracycline transporter protein-like [oryza sativa (japonica cultivar-group)]
  misc_feature: Useful for making plants with modulated biomass
  misc_feature: Useful for making plants with modulated cold sensitivity
  misc_feature: Useful for making plants with modulated drought sensitivity
  misc_feature: Useful for making plants with modulated heat sensitivity
  misc_feature: Useful for making plants with modulated salt sensitivity
  misc_feature: GREAT-hit functional homolog of the protein sequence given in SEQ ID NO 13434
  misc_feature: GREAT-hit functional homolog of the protein sequence given in SEQ ID NO 13472
  misc_feature: GREAT-hit functional homolog of the protein sequence given in SEQ ID NO 13474
  misc_feature: Useful for making plants with modulated cold sensitivity
  misc_feature: Useful for making plants with modulated salt sensitivity
  misc_feature: Functional homolog of the protein sequence given in SEQ ID NO 13474
MTKVEELAGLGHLLVFAFLFCFSAFMVAPVMTDVTMAALCPGRDECSLAIYLTGLQQAVTGLGALVLTPVVGNLSDRYGRKALLALPATASIVPLGILAYGRTKGYFYAYYVTKTLTAMVAEGTMMCLSLAYVADRVPETRRAAAFGVFSGVCSAGFVASTVAARFLPASSTFQVSAVAAVVTAVYMKAFLQETDGGASISSSCSSSSSNSDEEASRPLCLPSSSSSEEASPRLPPLRKAPSLSELAATLTSSSTFSRAAVVTFFHGLGETGLLSTLLYFLKAKFHYSKDQYANLLLIIGITGSFSQLTVMPLLVAKLGEQKLLVVALIASCGQVPYLAASSVILSMLVTPCIRSIVSKKAGPFEQGMVQGCITGISSTASVISPLIFTPLTAWCLSEATPFYLKGFSLACAGFATLVAFATSISMRPGEVQTDRK

SEQ ID NO: 9845 - DNA, 1182 bp, Sorghum bicolor
  misc_feature: Ceres ANNOT ID no. 6107805
  misc_feature: Encodes the peptide sequence at SEQ ID NO 9846
atggattacttgaaatcttgctgggggccggcatcaccggccgggcgcccccgcagaggatcggatgccaccgggcgccaagacgggctcctgtggtacaaggacggcgggcaggtcgtagatggtgagttctccatggccgtggtccaggccaataacctgctggaggaccatagccaggttgaatccgggccgctgagcacatcggagcctggactgcaaggcaccttcgtcggggtctatgatgggcatggtggcccggagacggcgcggtacatcaatgatcatctcttcaaccacctgaggagattcgcatctgagcacaagggcatgtcagcagatgtgattcggaaggcattccgagcgactgaggagggttttatttctgtagttagtgaccaatggtcagtgagacctcagttagcagctgtaggctcttgctgtctagttggcgtggtttgcagcggaactttatatgttgcaaaccttggggactcccgtgctgttcttgggagacttgtcaagggaactggagaggttttggcaatgcaactctcagcagaacacaatgcatcctatgaggaggttagacgagagctgcaggcatcacatcctgatgatccccatattgtggtcctaaaacacaacgtttggcgtgtaaagggtattatccagataacaaggtcaattggagatgcgtatctgaagaaacccgagttcaatagagaaccgttgcacagcaagtttcgtcttcaggaaactttcaggagaccacttcttagtgctgatccagcaattactgtacaccaaatacagccaactgataagttcatcatttttgcatctgatggactctgggagcatcttagcaatcaggaagcggttgacatggtccaaagtagcccacgtaatggaattgctcgaaagttagtaaagtctgcaatgcaggaagcagcaaagaagagggagatgcggtattcagacctcaagaaaattgatcggggggtgaggcggcacttccacgatgatataactgtcattgtggtgtttttcgattcaaatgccatgacagctgctgcctggagcagaccctcggtctctctccgagggggtggcgttccaatcccttcaaacacccttgctccattctcagttcccacagagctaaacaactcttactga

SEQ ID NO: 9846 - protein, 393 aa, Sorghum bicolor
  misc_feature: Ceres ANNOT ID no. 6107805
  misc_feature (45)..(323): Pfam Id: PP2C Pfam Desc: Protein phosphatase 2C
  misc_feature (1)..(392): NCBI GI: 4206122 NCBI Desc: protein phosphatase 2c homolog [mesembryanthemum crystallinum]
  misc_feature (1)..(392): NCBI GI: 7768153 NCBI Desc: protein phosphatase 2c (pp2c) [fagus sylvatica]
  misc_feature (1)..(376): NCBI GI: 20340237 NCBI Desc: protein phosphatase 2c-like protein [thellungiella halophila]
  misc_feature (1)..(388): NCBI GI: 59958308 NCBI Desc: at4g38520 [arabidopsis thaliana]
  misc_feature (2)..(376): NCBI GI: 10177123 NCBI Desc: protein phosphatase 2c-like protein [arabidopsis thaliana]
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: The sequence is a functional homolog of SEQ ID NO. 406 in the 11/188,298 US application
  misc_feature: The sequence is a functional homolog of SEQ ID NO. 386 in the 11/188,298 US application
  misc_feature: The sequence is a functional homolog of SEQ ID NO. 448 in the 11/188,298 US application
  misc_feature: The sequence is a functional homolog of SEQ ID NO. 363 in the 11/188,298 US application
MDYLKSCWGPASPAGRPRRGSDATGRQDGLLWYKDGGQVVDGEFSMAVVQANNLLEDHSQVESGPLSTSEPGLQGTFVGVYDGHGGPETARYINDHLFNHLRRFASEHKGMSADVIRKAFRATEEGFISVVSDQWSVRPQLAAVGSCCLVGVVCSGTLYVANLGDSRAVLGRLVKGTGEVLAMQLSAEHNASYEEVRRELQASHPDDPHIVVLKHNVWRVKGIIQITRSIGDAYLKKPEFNREPLHSKFRLQETFRRPLLSADPAITVHQIQPTDKFIIFASDGLWEHLSNQEAVDMVQSSPRNGIARKLVKSAMQEAAKKREMRYSDLKKIDRGVRRHFHDDITVIVVFFDSNAMTAAAWSRPSVSLRGGGVPIPSNTLAPFSVPTELNNSY

SEQ ID NO: 9847 - DNA, 999 bp, Sorghum bicolor
  misc_feature: Ceres ANNOT ID no. 6107806
  misc_feature: Encodes the peptide sequence at SEQ ID NO 9848
atggtgatcaacctcgaattcatcagggtgatagttactgccgaggaggtgctcctgttggaccctctcgtgcatgaagtgctccctttcgttgaccaattgaggcagcacctgcctctgaggagcctggtgggtgggaatggtgaatgtgcccctgatggcaatggggaaaagcagaagggctcgcctggaggccaagtgccccgtcttaatgaggcgactggtgcggagcacgagctgccattcgagttccatgtgctggaggttgctcttgaggttgtgtgctcatcgttggaccttagcgtggcagaccttgagaggcatgctactccagtgcttgacgagttgaccaagaatgtcagcacgaggaaccttgagcgagtgcggagccttaagagtcatcttacccgtttgcttgcccgtgtgcaaaaggtcagggatgaaatagaacaccttctagatgataatgaagacatggaacatctgtatctaacaaggaagcaagtacaaaaccaacaggttgaggctttaatgtcatctgctgcttccaacagcattgttcttgccggaacaggtgtgcccaggctgaactctagctttcggcgtagcatgagcattgctaccagcatgcatttggataatgatgtggaagacctagaaatgttacttgaggcctacttcatgcagctggatggaatccgcaacagaattttgtcggttcgggagtatattgatgacacagaagactacgtcaacattcaacttgacaaccagcgtaatgaactcattcaactccagcttacactgaccattgtatcctttggcatagctgccaacacttacattgctggagcttttgcaatgaacatcccgacctctctgtacaacactgatggcagcctcttctggccatttgtcgggggcacctcatccgcctgctttgtaatcaccgtcctcttattttggtatgcctggtggaagaagctgctgggtccttga

SEQ ID NO: 9848 - protein, 332 aa, Sorghum bicolor
  misc_feature: Ceres ANNOT ID no. 6107806
  misc_feature (1)..(330): Pfam Id: CorA Pfam Desc: CorA-like Mg2+ transporter protein
  misc_feature (1)..(331): NCBI GI: 92889086 NCBI Desc: mg2+ transporter protein, cora-like [medicago truncatula]
  misc_feature (1)..(331): NCBI GI: 25360850 NCBI Desc: mrs2-4 [arabidopsis thaliana]
  misc_feature (1)..(330): NCBI GI: 30688025 NCBI Desc: magnesium transporter cora-like family protein (mrs2-6) [arabidopsis thaliana]
  misc_feature (1)..(330): NCBI GI: 25360918 NCBI Desc: mrs2-6 [arabidopsis thaliana]
  misc_feature (75)..(331): NCBI GI: 30682808 NCBI Desc: magnesium transporter cora-like family protein (mrs2-7) [arabidopsis thaliana]
MVINLEFIRVIVTAEEVLLLDPLVHEVLPFVDQLRQHLPLRSLVGGNGECAPDGNGEKQKGSPGGQVPRLNEATGAEHELPFEFHVLEVALEVVCSSLDLSVADLERHATPVLDELTKNVSTRNLERVRSLKSHLTRLLARVQKVRDEIEHLLDDNEDMEHLYLTRKQVQNQQVEALMSSAASNSIVLAGTGVPRLNSSFRRSMSIATSMHLDNDVEDLEMLLEAYFMQLDGIRNRILSVREYIDDTEDYVNIQLDNQRNELIQLQLTLTIVSFGIAANTYIAGAFAMNIPTSLYNTDGSLFWPFVGGTSSACFVITVLLFWYAWWKKLLGP

SEQ ID NO: 9849 - DNA, 906 bp, Sorghum bicolor
  misc_feature: Ceres ANNOT ID no. 6107808
  misc_feature: Encodes the peptide sequence at SEQ ID NO 9850
atgctgccctacgcgacggcgggggaggcggaggcggcgctgggccgggccatgacgcccgccgaggcgctgtggttccgctacaccgcgggggtgtccgactaccacctctactgctgcaacatcctcttcctcttcgtcgtcttcacggtggccccgctccccgtcgcgctcctcgagctccgggcccccgccgcggtctcaccgtacaagctgcagccgcgggtgcgcctctccagggccgagttcgtccgctgctacaaggacgtcctccgcatcttcttcctcgtcatcggcccgctccagctcgtctccttccccatggtcaagttggtgggaatccacacgaggttgcctttgccgtccctgggggagattgctgcacagctgctggtgtacttccttgttgaggactacctcaattactggatccacaggcttctccacggggagtgggggtaccagaagatccaccgcgtccaccatgagttcaccgcgccaatcggattcgcagctccatatgcacactgggctgaggtgctcatactcggcatcccctccttcgtcgggccggccattgctccaggccacatgatcacattctggctctggattatactccgtcaggtggaggctatcgagacacatagtggctttgatttcccattcaccccgacaaagtatattccattctatggaggagcagaataccatgactatcatcattatgtaggaggccagagccaaagcaattttgcttctgttttcacttactgtgattacttatatgggactgatagaggttacagattccacaaagcatacctagcaaagctgaaggatctggggcaaaatgatggcgagaaaggagatggcagtggactcagctatgtgaaattggattag

SEQ ID NO: 9850 - protein, 301 aa, Sorghum bicolor
  misc_feature: Ceres ANNOT ID no. 6107808
  misc_feature (130)..(243): Pfam Id: FA_hydroxylase Pfam Desc: Fatty acid hydroxylase
  misc_feature (1)..(296): NCBI GI: 92884635 NCBI Desc: sterol desaturase [medicago truncatula]
  misc_feature (1)..(292): NCBI GI: 23308291 NCBI Desc: at4g12110/f16j13_180 [arabidopsis thaliana]
  misc_feature (1)..(292): NCBI GI: 33337546 NCBI Desc: sterol-4-methyl-oxidase [arabidopsis thaliana]
  misc_feature (1)..(276): NCBI GI: 18416002 NCBI Desc: sterol desaturase family protein [arabidopsis thaliana]
  misc_feature (1)..(273): NCBI GI: 37591406 NCBI Desc: sterol-4-alpha methyl oxidase [arabidopsis thaliana]
MLPYATAGEAEAALGRAMTPAEALWFRYTAGVSDYHLYCCNILFLFVVFTVAPLPVALLELRAPAAVSPYKLQPRVRLSRAEFVRCYKDVLRIFFLVIGPLQLVSFPMVKLVGIHTRLPLPSLGEIAAQLLVYFLVEDYLNYWIHRLLHGEWGYQKIHRVHHEFTAPIGFAAPYAHWAEVLILGIPSFVGPAIAPGHMITFWLWIILRQVEAIETHSGFDFPFTPTKYIPFYGGAEYHDYHHYVGGQSQSNFASVFTYCDYLYGTDRGYRFHKAYLAKLKDLGQNDGEKGDGSGLSYVKLD

SEQ ID NO: 9851 - DNA, 396 bp, Sorghum bicolor
  misc_feature: Ceres ANNOT ID no. 6107812
  misc_feature: Encodes the peptide sequence at SEQ ID NO 9852
atggcgcggagcgtgtcgtacgtttcggcggcgaagctggtgtccatggcgcgaggcaatccccgcctcgccatcatcgacgtcagggatgaggagaggagctaccaggcgcacatcgcgggttcgcaccacttcgccagcggcagcttcgaggcgcggatgccggagctcgcgcgggccgccagcggaaaggacaccctcgttttccactgcgcgctgagccaggtgcgaggtccaacttgtgctcggatgttctcagattatctatcggagaccaaggaggattcagggataaagaacatcatggtactggagctcgggtttaacggatgggagggttcggggcagcctgtctgccgctgcacggacgctccttgcaaagggacgtgctgttaa

SEQ ID NO: 9852 - protein, 131 aa, Sorghum bicolor
  misc_feature: Ceres ANNOT ID no. 6107812
  misc_feature (1)..(130): NCBI GI: 51860752 NCBI Desc: rhodanese-like protein [holcus lanatus]
  misc_feature (1)..(130): NCBI GI: 55669834 NCBI Desc: chain a, nmr structure of a cdc25-like dual-specificity tyrosine phosphatase of arabidopsis thaliana
  misc_feature (4)..(128): NCBI GI: 83630891 NCBI Desc: arsenate reductase [pteris vittata]
  misc_feature (4)..(112): NCBI GI: 19112039 NCBI Desc: rhodanase domain protein [schizosaccharomyces pombe]
  misc_feature (4)..(112): NCBI GI: 5441470 NCBI Desc: spbc839.07 [schizosaccharomyces pombe]
  misc_feature (1)..(130): SWISSPROT Homolog: EC 3.1.3.48 Dual specificity phosphatase Cdc25
MARSVSYVSAAKLVSMARGNPRLAIIDVRDEERSYQAHIAGSHHFASGSFEARMPELARAASGKDTLVFHCALSQVRGPTCARMFSDYLSETKEDSGIKNIMVLELGFNGWEGSGQPVCRCTDAPCKGTCC

SEQ ID NO: 9853 - DNA, 267 bp, Sorghum bicolor
  misc_feature: Ceres ANNOT ID no. 6107827
  misc_feature: Encodes the peptide sequence at SEQ ID NO 9854
atggcctcccgtccaaagctgtctggtattcagaagcaggttttggcgctgtacaggggatttcttcggacagcacgccttaaggcccctgaagagcgccgcaggatcgagtctgttgtctcagcagagttccatgagaacgcaaggagtgtcgaccgtaggaactttgtacacatagagtacttgttgaggagagggaagaagcagcttgagcagctcaagaatcctgatattactggacttgctacgcttgaagtaaagaaatga

SEQ ID NO: 9854 - protein, 88 aa, Sorghum bicolor
  misc_feature: Ceres ANNOT ID no. 6107827
  misc_feature (9)..(75): Pfam Id: Complex1_LYR Pfam Desc: Complex 1 protein (LYR family)
  misc_feature (6)..(78): NCBI GI: 44981682 NCBI Desc: acr206cp [eremothecium gossypii]
  misc_feature (6)..(78): NCBI GI: 45185892 NCBI Desc: acr206cp [eremothecium gossypii]
  misc_feature (7)..(78): NCBI GI: 6692019 NCBI Desc: spac664.12c [schizosaccharomyces pombe]
MASRPKLSGIQKQVLALYRGFLRTARLKAPEERRRIESVVSAEFHENARSVDRRNFVHIEYLLRRGKKQLEQLKNPDITGLATLEVKK

SEQ ID NO: 9855 - DNA, 267 bp, Sorghum bicolor; identical to SEQ ID NO: 9853
  misc_feature: Ceres ANNOT ID no. 6107830
  misc_feature: Encodes the peptide sequence at SEQ ID NO 9856

SEQ ID NO: 9856 - protein, 88 aa, Sorghum bicolor; identical to SEQ ID NO: 9854
  misc_feature: Ceres ANNOT ID no. 6107830
  misc_feature (9)..(75): Pfam Id: Complex1_LYR Pfam Desc: Complex 1 protein (LYR family)
  misc_feature (6)..(78): NCBI GI: 44981682 NCBI Desc: acr206cp [eremothecium gossypii]
  misc_feature (6)..(78): NCBI GI: 45185892 NCBI Desc: acr206cp [eremothecium gossypii]
  misc_feature (7)..(78): NCBI GI: 6692019 NCBI Desc: spac664.12c [schizosaccharomyces pombe]

SEQ ID NO: 9857 - DNA, 948 bp, Sorghum bicolor
  misc_feature: Ceres ANNOT ID no. 6107837
  misc_feature: Encodes the peptide sequence at SEQ ID NO 9858
atggggtggttctcccgcaaagggccctcgggcttctccggcgcctccacggctgaggaggtcaccgccggcatcgacggccatggtctggtcgccgtcatcacaggtgcgtcgagcggcatcgggctggagacggcgcgtgttctggcgttgcgcggcgtgcacgtcgtcatggccgtccgcaacgtctccgccgggctcgaggccagggaggccatcgtggccaagatccccggcgcaaggattgacgtcctggagctggacctcagctccatagcttccgtaaggagattcgcctcccatttcgactctctgaacttgcccctcaacattctcatcaacaacgctggagtgatgacaaggaactgcacacgttcctgcgacggtctggaactgcatttcgcgacaaatcacattggccatttccttctaacaaacctgttattggagaacatgaagaagacatgtagggatagctgtatcgagggacggattgtcaatctgacatcttcagggcattccataacctatcgtgaagggatatgcttcgacaaaattcatgatccttcaggtttgaatgactttgttgcttatggtcaatccaagcttgccaatattcttcattctaatgaactgtcccgaatactcaaggaggaaggtgtgaatatttcagccaatgcagttcatcctggtgtcatcacgactaacctttttaggaacaggactatcgtctctgctctattgaactccattggaagaatcatatgtagaacagtggagcagggtgctgcaacgacatgctatgttgcaatgcatcctcaagtgaaggggataagtggaaagtacttcaccaattgtgatatagccatcccgagctcacaagcttcagatgctgagttggccaagaagctatggcaattcagcttgaaaacgattgtgtcttcttga

SEQ ID NO: 9858 - protein, 315 aa, Sorghum bicolor
  misc_feature: Ceres ANNOT ID no. 6107837
  misc_feature (30)..(181): Pfam Id: adh_short Pfam Desc: short chain dehydrogenase
  misc_feature (3)..(308): NCBI GI: 62956022 NCBI Desc: 3-ketoacyl-coa reductase 3 [gossypium hirsutum]
  misc_feature (3)..(312): NCBI GI: 115480783 NCBI Desc: os09g0570300 [oryza sativa (japonica cultivar-group)]
  misc_feature (5)..(312): NCBI GI: 42725482 NCBI Desc: short-chain dehydrogenase tic32 [pisum sativum]
  misc_feature (1)..(310): NCBI GI: 30686197 NCBI Desc: short-chain dehydrogenase/reductase (sdr) family protein [arabidopsis thaliana]
  misc_feature (2)..(312): NCBI GI: 115457582 NCBI Desc: os04g0291100 [oryza sativa (japonica cultivar-group)]
  misc_feature: The sequence is a functional homolog of SEQ ID NO. 453 in the 11/188,298 US application
MGWFSRKGPSGFSGASTAEEVTAGIDGHGLVAVITGASSGIGLETARVLALRGVHVVMAVRNVSAGLEAREAIVAKIPGARIDVLELDLSSIASVRRFASHFDSLNLPLNILINNAGVMTRNCTRSCDGLELHFATNHIGHFLLTNLLLENMKKTCRDSCIEGRIVNLTSSGHSITYREGICFDKIHDPSGLNDFVAYGQSKLANILHSNELSRILKEEGVNISANAVHPGVITTNLFRNRTIVSALLNSIGRIICRTVEQGAATTCYVAMHPQVKGISGKYFTNCDIAIPSSQASDAELAKKLWQFSLKTIVSS

SEQ ID NO: 9859 - DNA, 942 bp, Sorghum bicolor
  misc_feature: Ceres ANNOT ID no. 6107845
  misc_feature: Encodes the peptide sequence at SEQ ID NO 9860
atgtggtggttctaccgcaaagggccctcgggcttctccggcgcctccacggctgaggaggtcactgccggcgtcgacggccatggtctagttgccgtcatcacaggtgcgacgagcggcatcggactggagacggcgcgcgttcttgtgctgcgcggcgtgcacgtcgtcatggccgtccgcaacgtctccgccgggctcgtggccaaggaggccatcgtggccaaaatccccggcgcaagaattgacgttctggagctagacctcatctccatagcttccgtaaggagattcgcctccgagttcgactctctgaaactgcccctcaacattctcatcaataacgctggtgtgatgacaaggaactgtacactttcctgcgacggtctggaactgcattttgcaacaaatcacattggtcattttcttctaacaaacctcctactggagaacatgaagagcacatgcagggacagaggcatcgagggacggatcgtcaatgtgacgtcttcagggcatgtgatgacttatcctgaagggatatgtttcgaaaaaattcgtgatccttccggtttgaacgacttcattgcttacggtcaatccaagcttgcaaacattcttcactctaatgaattgtctcgaatcttcaaggaggaaggagtgaatatttcagccaattcagttcatcctggtgtcatcgccaccaacctttttaggggcaggactattgttgctgtttttttgaacaccattggcagaatcatgtgtagaagcgcagaacagggtgctgcgacaacatgctatgtggcaatgcatcctcaagtgaagggattaagtggaaagtacttcgccaattgtaatgtagccagcccaagctcgcaagctacggatgttgagttggccaagaagctatggcaattcagtttggagacagtttcttga

SEQ ID NO: 9860 - protein, 313 aa, Sorghum bicolor
  misc_feature: Ceres ANNOT ID no. 6107845
  misc_feature (30)..(181): Pfam Id: adh_short Pfam Desc: short chain dehydrogenase
  misc_feature (2)..(313): NCBI GI: 115480783 NCBI Desc: os09g0570300 [oryza sativa (japonica cultivar-group)]
  misc_feature (1)..(308): NCBI GI: 62956022 NCBI Desc: 3-ketoacyl-coa reductase 3 [gossypium hirsutum]
  misc_feature (1)..(312): NCBI GI: 42725482 NCBI Desc: short-chain dehydrogenase tic32 [pisum sativum]
  misc_feature (1)..(308): NCBI GI: 30686197 NCBI Desc: short-chain dehydrogenase/reductase (sdr) family protein [arabidopsis thaliana]
  misc_feature (1)..(312): NCBI GI: 115457582 NCBI Desc: os04g0291100 [oryza sativa (japonica cultivar-group)]
  misc_feature: The sequence is a functional homolog of SEQ ID NO. 453 in the 11/188,298 US application
MWWFYRKGPSGFSGASTAEEVTAGVDGHGLVAVITGATSGIGLETARVLVLRGVHVVMAVRNVSAGLVAKEAIVAKIPGARIDVLELDLISIASVRRFASEFDSLKLPLNILINNAGVMTRNCTLSCDGLELHFATNHIGHFLLTNLLLENMKSTCRDRGIEGRIVNVTSSGHVMTYPEGICFEKIRDPSGLNDFIAYGQSKLANILHSNELSRIFKEEGVNISANSVHPGVIATNLFRGRTIVAVFLNTIGRIMCRSAEQGAATTCYVAMHPQVKGLSGKYFANCNVASPSSQATDVELAKKLWQFSLETVS

SEQ ID NO: 9861 - DNA, 801 bp, Sorghum bicolor
  misc_feature: Ceres ANNOT ID no. 6107872
  misc_feature: Encodes the peptide sequence at SEQ ID NO 9862
atgggatccctcgccaacaaaatcgtggccatggcggctgtccttgcggcgctcgtcaccggcggctcgtgcgcgcccaagaagttcccgcctggccccaacatcacaaccaactacaacggccagtggctctctgccagggccacctggtacggccagcccaacggcgccggccctgacgacaacggcggtgcgtgcggaatcaagaacgtgaacctgccaccctacaatggcttcacggcctgcggtaacgtccccatcttcaaggatggcaagggctgcggctcatgctacgaggtgagatgcaaggaaatgccagagtgttcgggcaacccgatcacggtgttcatcaccgacatgaactatgagcccatcgcaccctaccactttgacttcagcggcaaggccttcggctccctagcaaagcctgggctcaacgacaagctccgccactgcggcatcatgaacgtggagttcaggagggtgcggtgcaagcttgggggcaagatcatgttccacgttgagaaggggtccaaccccaactacctggccgtgctggtcaagaacgtggcggacgacggcaacatcgtgctcatggaactcgaggacaaggcgtcgccggggttcaagccaatgaagcaatcctggggcgccgtgtggaggtttgacacacccaagccggtcaagggccccttctccatccgcctcaccagcgagtccggcaagaagctcgtcgccccgaacgtcatcccggcgacctggaagcccgacaccctctacaactccaacatccagttctaa

SEQ ID NO: 9862 - protein, 266 aa, Sorghum bicolor
  misc_feature: Ceres ANNOT ID no. 6107872
  misc_feature (170)..(251): Pfam Id: Pollen_allerg_1 Pfam Desc: Pollen allergen
  misc_feature (80)..(159): Pfam Id: DPBB_1 Pfam Desc: Rare lipoprotein A (RlpA)-like double-psi beta-barrel
  misc_feature (1)..(266): NCBI GI: 28630919 NCBI Desc: beta-expansin 9 protein [zea mays]
  misc_feature (1)..(266): NCBI GI: 28630923 NCBI Desc: beta-expansin 1 protein [zea mays]
  misc_feature (1)..(266): NCBI GI: 14193761 NCBI Desc: beta-expansin 1 [zea mays]
  misc_feature (26)..(266): NCBI GI: 114794319 NCBI Desc: chain x, crystal structure of expb1 (zea m 1), a beta-expansin and group-1 pollen allergen from maize
  misc_feature (1)..(266): NCBI GI: 31433387 NCBI Desc: beta-expansin [oryza sativa (japonica cultivar-group)]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 13733
MGSLANKIVAMAAVLAALVTGGSCAPKKFPPGPNITTNYNGQWLSARATWYGQPNGAGPDDNGGACGIKNVNLPPYNGFTACGNVPIFKDGKGCGSCYEVRCKEMPECSGNPITVFITDMNYEPIAPYHFDFSGKAFGSLAKPGLNDKLRHCGIMNVEFRRVRCKLGGKIMFHVEKGSNPNYLAVLVKNVADDGNIVLMELEDKASPGFKPMKQSWGAVWRFDTPKPVKGPFSIRLTSESGKKLVAPNVIPATWKPDTLYNSNIQF

SEQ ID NO: 9863 - DNA, 801 bp, Sorghum bicolor
  misc_feature: Ceres ANNOT ID no. 6107882
  misc_feature: Encodes the peptide sequence at SEQ ID NO 9864
atgggatccctcgccaacaaaatcgtggccatggcggctgtccttgcggcgctcgtcaccggcggctcgtgcgcgcccaagaagttcccgcctggccccaacatcacaaccaactacaacggccaatggctcgttgccagggccacctggtacggccagcccaacggtgccggccctgacgacaatggcggtgcgtgcgggatcaagaacgtgaacctgccaccctacaacggcttcacggcctgcggtaacgtccccatcttcaaggacggcaagggctgcggctcatgctacgaggtgagatgcaaggaaatgccggagtgttcgggcaacccgatcacggtgttcatcaccgacatgaactacgagcccattgcaccctaccactttgacttcagcggcaaggccttcggctccctggcaaagcccgggctcaacgacaagctccgccactgcggcatcatgaacgtggagttcaggagggtgcggtgcaagcttgggggcaagatcatgttccacgttgagaaggggtccaaccccaactacctggccgtgctggtcaagaacgtggcggacgacggcaacatcgtgctcatggaactcgaggacaaggcgtcgccggggttcaagccgatgaagcaatcctggggcgccgtgtggaggtttgacacacccaagccgatcaagggccccttctccatccgcctcaccagcgagtccggcaagaagctcgtcgccccaaacgtcatcccggcatcctggaagcccgacaccctctacaactccaacatccagttctaa

SEQ ID NO: 9864 - protein, 266 aa, Sorghum bicolor
  misc_feature: Ceres ANNOT ID no. 6107882
  misc_feature (170)..(251): Pfam Id: Pollen_allerg_1 Pfam Desc: Pollen allergen
  misc_feature (80)..(159): Pfam Id: DPBB_1 Pfam Desc: Rare lipoprotein A (RlpA)-like double-psi beta-barrel
  misc_feature (1)..(266): NCBI GI: 28630919 NCBI Desc: beta-expansin 9 protein [zea mays]
  misc_feature (1)..(266): NCBI GI: 28630923 NCBI Desc: beta-expansin 1 protein [zea mays]
  misc_feature (1)..(266): NCBI GI: 14193761 NCBI Desc: beta-expansin 1 [zea mays]
  misc_feature (26)..(266): NCBI GI: 114794319 NCBI Desc: chain x, crystal structure of expb1 (zea m 1), a beta-expansin and group-1 pollen allergen from maize
  misc_feature (1)..(266): NCBI GI: 31433387 NCBI Desc: beta-expansin [oryza sativa (japonica cultivar-group)]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 13733
MGSLANKIVAMAAVLAALVTGGSCAPKKFPPGPNITTNYNGQWLVARATWYGQPNGAGPDDNGGACGIKNVNLPPYNGFTACGNVPIFKDGKGCGSCYEVRCKEMPECSGNPITVFITDMNYEPIAPYHFDFSGKAFGSLAKPGLNDKLRHCGIMNVEFRRVRCKLGGKIMFHVEKGSNPNYLAVLVKNVADDGNIVLMELEDKASPGFKPMKQSWGAVWRFDTPKPIKGPFSIRLTSESGKKLVAPNVIPASWKPDTLYNSNIQF

SEQ ID NO: 9865 - DNA, 1224 bp, Sorghum bicolor
  misc_feature: Ceres ANNOT ID no. 6107897
  misc_feature: Encodes the peptide sequence at SEQ ID NO 9866
atggaattcggcgtcgcctctcacggcgccgtcctcgccgccgcgccgctcgtcgcacggccgacctggctcctcctctcgccgccgccaccggcgtcgtgtattcagattcagaatcgtctttattcgatctcgtcactcccactaaaggctggacctgtaagggcatgcagagcttctttagcaagcagctacacgcagacaactgaaacagttgatttggactgggagaacctgggttttggaattgtgcaaactgattatatgtatattgcaaagtgcgggacggatgggaacttttctgagggtgaactggtgccttttggacctatagcgctgagtccatcttctggagtcctaaattatggacagggattgtttgagggcctaaaggcgtataggaaaactgatggatccatcctattatttcgcccagaggaaaatgctcagaggatgcaaacaggtgctgagaggatgtgcatgcctgcaccttctgtcgaacagtttattgatgcagtaaaacaaaccgttctagcaaataagagatggattcctcctactggtaaaggttctttgtatattaggcccttacttatgggaagcggtactgttcttggtcttgcacctgctcctgagtatacattcattatatttgtctctcctgttgggaactactttaaggaaggtttagcaccgataaatttgatagttgaagacaagttccatcgtgctactcctggtggtactggaggtgtgaagaccataggaaattatgcttcggtgttgatggcacagaaaattgcaaaggaaaagggctattctgatgtcctctacttggatgctgttcacaagaagtaccttgaagaagtttcttcatgtaatatttttgttgtcaagggcaatgttatttctaccccggcagtaaaaggaacaatattacctggtatcacaaggaaaagtataattgatgttgctttgagtaagggcttccaggttgaggagcgacttgtttcagtggatgaactgcttgatgctgatgaagtattctgcacaggaaccgctgttgtcgtgtctcctgttgggagtattacatatcaagggaaaagagtggaatacggccaccaaggtgttggcgttgtgtcgcagcagctgtacacttcactgacgagtcttcagatgggtcaaaccgaggactggatgggctggactgtgcaactgaattaa

SEQ ID NO: 9866 - protein, 407 aa, Sorghum bicolor
  misc_feature: Ceres ANNOT ID no. 6107897
  misc_feature (102)..(389): Pfam Id: Aminotran_4 Pfam Desc: Aminotransferase class IV
  misc_feature (59)..(406): NCBI GI: 6319167 NCBI Desc: branched-chain amino acid aminotransferase [solanum tuberosum]
  misc_feature (26)..(407): NCBI GI: 20453389 NCBI Desc: at3g49680/t16k5_30 [arabidopsis thaliana]
  misc_feature (31)..(407): NCBI GI: 9843665 NCBI Desc: branched-chain amino acid transaminase 5 [arabidopsis thaliana]
  misc_feature (26)..(407): NCBI GI: 21593211 NCBI Desc: branched-chain-amino-acid transaminase-like protein [arabidopsis thaliana]
  misc_feature (31)..(407): NCBI GI: 111074416 NCBI Desc: at5g65780 [arabidopsis thaliana]
  misc_feature (26)..(407): SWISSPROT Homolog: EC 2.6.1.42 Branched-chain-amino-acid aminotransferase 3, chloroplast precursor
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: Useful for making plants with modulated nitrogen use efficiency
  misc_feature: Useful for making plants with modulated nitrogen use efficiency
  misc_feature: GREAT-hit functional homolog of the protein sequence given in SEQ ID NO 13131
  misc_feature: Functional homolog of the protein sequence encoded by LOCUS at1g10060
  misc_feature: Functional homolog of the protein sequence encoded by LOCUS at3g19710
  misc_feature: Useful for making plants with modulated nitrogen use efficiency
  misc_feature: Functional homolog of the protein sequence given in SEQ ID NO 13131
  misc_feature: Useful for making plants with modulated biomass
  misc_feature: Useful for making plants with modulated flowering time
  misc_feature: Functional homolog of the protein sequence given in SEQ ID NO 14063
  misc_feature: The sequence is a functional homolog of SEQ ID NO. 504 in the 11/188,298 US application
MEFGVASHGAVLAAAPLVARPTWLLLSPPPPASCIQIQNRLYSISSLPLKAGPVRACRASLASSYTQTTETVDLDWENLGFGIVQTDYMYIAKCGTDGNFSEGELVPFGPIALSPSSGVLNYGQGLFEGLKAYRKTDGSILLFRPEENAQRMQTGAERMCMPAPSVEQFIDAVKQTVLANKRWIPPTGKGSLYIRPLLMGSGTVLGLAPAPEYTFIIFVSPVGNYFKEGLAPINLIVEDKFHRATPGGTGGVKTIGNYASVLMAQKIAKEKGYSDVLYLDAVHKKYLEEVSSCNIFVVKGNVISTPAVKGTILPGITRKSIIDVALSKGFQVEERLVSVDELLDADEVFCTGTAVVVSPVGSITYQGKRVEYGHQGVGVVSQQLYTSLTSLQMGQTEDWMGWTVQLN

SEQ ID NO: 9867 - DNA, 672 bp, Sorghum bicolor
  misc_feature: Ceres ANNOT ID no. 6107907
  misc_feature: Encodes the peptide sequence at SEQ ID NO 9868
atggggcctccgcgaggcagcaggacattgccttgtggcgtcgctacggccttcgtcgccgcggcggtggtgctggccatcatcatctggtccgcagccgctgcggatgtggtcgaggagaggctgacggtgcccatgacgatcgtcgccggcgccgcgtcgatgtgcctcgacgggagcccgccggcgtaccacctgcaccgcggctccggcgcaggtgcgcggaactggctgctccagttcgagggcggcggctggtgcaacgacgtgcggtcgtgcgcggagagggccgggacgcgccgaggatccacccggctcatgcccaaggtcgagttcttctccggcatcctcagcaaccgtccggccatgaatccagacttttacaactggaaccgtgtgaaactgcgttactgcgacggcggatccttcatgggtgattcagtatatataaacagctccacagtcctctactttagtggtcagaggatatgggatgctatcatcactgatctgcttaggaagggactggcgagagccgaaaaggttctgctctcaggttgttcagcaggaggcctagccacattcttccactgcgacagccttaaggagcggcttggaggcattgtcacggtgaaatgcctcggtgacgccggattttttcttgatctgtaa

SEQ ID NO: 9868 - protein, 223 aa, Sorghum bicolor
  misc_feature: Ceres ANNOT ID no. 6107907
  misc_feature (23)..(224): Pfam Id: PAE Pfam Desc: Pectinacetylesterase
  misc_feature (25)..(223): NCBI GI: 115483298 NCBI Desc: os10g0550500 [oryza sativa (japonica cultivar-group)]
  misc_feature (19)..(222): NCBI GI: 10176854 NCBI Desc: pectinacetylesterase [arabidopsis thaliana]
  misc_feature (19)..(222): NCBI GI: 42573459 NCBI Desc: pectinacetylesterase family protein [arabidopsis thaliana]
  misc_feature (19)..(222): NCBI GI: 42573461 NCBI Desc: pectinacetylesterase family protein [arabidopsis thaliana]
  misc_feature (31)..(222): NCBI GI: 140049891 NCBI Desc: pectinacetylesterase [medicago truncatula]
  misc_feature: Useful for making plants with altered cell wall content and/or composition
  misc_feature: Functional homolog of the protein sequence given in SEQ ID NO 13822
  misc_feature: Useful for making plants with altered carbohydrate content
  misc_feature: Functional homolog of the protein sequence given in SEQ ID NO 13670
MGPPRGSRTLPCGVATAFVAAAVVLAIIIWSAAAADVVEERLTVPMTIVAGAASMCLDGSPPAYHLHRGSGAGARNWLLQFEGGGWCNDVRSCAERAGTRRGSTRLMPKVEFFSGILSNRPAMNPDFYNWNRVKLRYCDGGSFMGDSVYINSSTVLYFSGQRIWDAIITDLLRKGLARAEKVLLSGCSAGGLATFFHCDSLKERLGGIVTVKCLGDAGFFLDL

SEQ ID NO: 9869 - DNA, 468 bp, Sorghum bicolor
  misc_feature: Ceres ANNOT ID no. 6107918
  misc_feature: Encodes the peptide sequence at SEQ ID NO 9870
atggcagtgccacgcaggaacggcagtagcgcgacggcactggccgccgttctggcgctaggccacttcctcctcctcgccacccactcggtcgcctgcggttcatcgtcgtgcccgaagccggcgccgccgccgccgtgctccccgacgaccccgaaagcgcggggcggcggcggggcgaggtgcccagtgaacgcgctgaagctgggcgcgtgcgcgagcgttcttggcgggctggtgagcctggagctcggccagcagcagcgcccggcgacgtcgtccacgcagccgtgctgccagctcctgggcgggcttgccgacctggacgcggccgtgtgcctgtgcacggcgctgcgggccaacgtgctgggcgtcgtgcagctgcgcgcccacgttgagctcagcgtcctcgtcaactactgcggcaagaagctcccccagggattccagtgtgccagagctaattaa

SEQ ID NO: 9870 - protein, 155 aa, Sorghum bicolor
  misc_feature: Ceres ANNOT ID no. 6107918
  misc_feature (62)..(151): Pfam Id: Tryp_alpha_amyl Pfam Desc: Protease inhibitor/seed storage/LTP family
  misc_feature (9)..(151): NCBI GI: 60542797 NCBI Desc: arachidonic acid-induced dea1 [capsicum chinense]
  misc_feature (13)..(152): NCBI GI: 4240033 NCBI Desc: zmgr1a [zea mays]
  misc_feature (10)..(152): NCBI GI: 4454097 NCBI Desc: hybrid proline-rich protein [catharanthus roseus]
  misc_feature (8)..(151): NCBI GI: 110816009 NCBI Desc: hyprp2 [gossypium hirsutum]
  misc_feature (10)..(152): NCBI GI: 407410 NCBI Desc: 14 kda polypeptide [catharanthus roseus]
  misc_feature: Bushy plant with varying petiole angles, abnormal phyllotaxy, leafnumber higher than wild-type
  misc_feature: The plant flowers significantly late compared to wild-type.
  misc_feature: Useful for making plants with modulated biomass
  misc_feature: Useful for making plants with modulated flowering time
  misc_feature: Functional homolog of the protein sequence given in SEQ ID NO 13584
MAVPRRNGSSATALAAVLALGHFLLLATHSVACGSSSCPKPAPPPPCSPTTPKARGGGGARCPVNALKLGACASVLGGLVSLELGQQQRPATSSTQPCCQLLGGLADLDAAVCLCTALRANVLGVVQLRAHVELSVLVNYCGKKLPQGFQCARAN

SEQ ID NO: 9871 - DNA, 390 bp, Sorghum bicolor
  misc_feature: Ceres ANNOT ID no. 6107919
  misc_feature: Encodes the peptide sequence at SEQ ID NO 9872
atggctcccaaggctgctctcttccttgccctcggcctcctcttggctgcctccgcgcacggctgcgaaccctcttgctcaggccccgtcgtcccgacaccgccggtcgtgccaacgccgccgacccacagccatggtgggcgctgcccgatcgacgcgctcaagctcagcgtgtgcgccaacgtgctgggcctcgtcaaggtcggcttgcccccgcagcaggaatgctgcccgctgctggaggggctggtggacctcgacgccgcattgtgcctctgcactgccatcaaggccaatgtcctcggcatccacctcaacgtgcccgttagcctgagtctcatcctcaataactgcggcaagatttgcccggaggacttcacttgctactaa

SEQ ID NO: 9872 - protein, 129 aa, Sorghum bicolor
  misc_feature: Ceres ANNOT ID no. 6107919
  misc_feature (49)..(128): Pfam Id: Tryp_alpha_amyl Pfam Desc: Protease inhibitor/seed storage/LTP family
  misc_feature (1)..(128): NCBI GI: 2226329 NCBI Desc: physical impedance induced protein [zea mays]
  misc_feature (4)..(128): NCBI GI: 115483320 NCBI Desc: os10g0552300 [oryza sativa (japonica cultivar-group)]
  misc_feature (1)..(128): NCBI GI: 39748094 NCBI Desc: lipid transfer protein-like protein [oryza sativa (japonica cultivar-group)]
  misc_feature (6)..(128): NCBI GI: 1199774 NCBI Desc: extensin like protein [populus nigra]
  misc_feature (6)..(128): NCBI GI: 60542797 NCBI Desc: arachidonic acid-induced dea1 [capsicum chinense]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MAPKAALFLALGLLLAASAHGCEPSCSGPVVPTPPVVPTPPTHSHGGRCPIDALKLSVCANVLGLVKVGLPPQQECCPLLEGLVDLDAALCLCTAIKANVLGIHLNVPVSLSLILNNCGKICPEDFTCY

SEQ ID NO: 9873 - DNA, 1263 bp, Sorghum bicolor
  misc_feature: Ceres ANNOT ID no. 6107954
  misc_feature: Encodes the peptide sequence at SEQ ID NO 9874
atgccgcgcacggtggccgtggtgggcgccgggccggcggggttggtggccgcgcgcgagctgctccgcgaggaccacgccgtggccgtcttcgagaagtcaggccgcgtggggggcacctgggcgtacgacccgcgcgcggacgccgacccgctggggcgcgacccgggcggccccggcgccgtgcacagcagcgtgtacgcatcgctgcgcaccaacctgccgcgcgagctcatgggcttctcggacttcccgctggcgggacgggtgttcgccggcgatccgcgcacgttcccgggccaccgggagatgctcgccttcctcgacgccttcgccgtgattccggcgtcgccgcgcacgtcaggctcggaggcgagcaaggggagcagtggcgtggcgtggcgcggggaagacggcggtgtcgcggaggagccattcgacgccgtcgtcgtctgcagcggccattgctcggtgcctctggtgcccaagatccgaggaattaacaagtggcaggggaagcaaatgcacagccacaattatcacaccccagaaccatttcaagatcagagtgttgtcgttgtaggattgggagccagcggaattgacattgctagtgaaatctcacatgtggctaaggaagtgcacatcgcagctagatactccaaggacaggcttggaaagattgaactctaccataacgcttggatgcacggcgagatagactgcatccaagatgacggtctggtgcgctttgcggaaggttcatctgtagctgcagataccattctttactgcacagggtaccgctaccatttcccgttcctcgacctggatgggtttaccgttgacgacaaccgtgttgggccactgtacaagcacgtcttcccacccaaatatgcgcccaatctctctttcgttgggctgccatataagtcacttgagctagaatccaagtgggttgctgccctcctgtcggggcgtactgcggcactgccgagcgaggaggacatgatggccgacgtgcaggaggagtaccagcgcatggaggatgccgggaagccgaagcgccacacccacacactgtggcctcgatgggtagagtacctgaactggctggcggaccaagtcggcgagccgcacgtggagctgtggaggtacgagatgcacgagaaggcgctcagatgcgtctggtccttggatgtgggctaccgtgatcgatgggaagaagaaaacatcgacagcggctcgcctccatggttttaa

SEQ ID NO: 9874 - protein, 420 aa, Sorghum bicolor
  misc_feature: Ceres ANNOT ID no. 6107954
  misc_feature (5)..(404): Pfam Id: FMO-like Pfam Desc: Flavin-binding monooxygenase-like
  misc_feature (5)..(412): NCBI GI: 116293735 NCBI Desc: fmo-like protein [thellungiella halophila]
  misc_feature (5)..(414): NCBI GI: 140071240 NCBI Desc: fad-dependent pyridine nucleotide-disulphide oxidoreductase; dimethylaniline monooxygenase, n-oxide-forming [medicago truncatula]
  misc_feature (5)..(414): NCBI GI: 140071237 NCBI Desc: fad-dependent pyridine nucleotide-disulphide oxidoreductase [medicago truncatula]
  misc_feature (5)..(412): NCBI GI: 145323866 NCBI Desc: flavin-containing monooxygenase family protein / fmo family protein [arabidopsis thaliana]
  misc_feature (5)..(412): NCBI GI: 20148451 NCBI Desc: similar to glutamate synthase [arabidopsis thaliana]
MPRTVAVVGAGPAGLVAARELLREDHAVAVFEKSGRVGGTWAYDPRADADPLGRDPGGPGAVHSSVYASLRTNLPRELMGFSDFPLAGRVFAGDPRTFPGHREMLAFLDAFAVIPASPRTSGSEASKGSSGVAWRGEDGGVAEEPFDAVVVCSGHCSVPLVPKIRGINKWQGKQMHSHNYHTPEPFQDQSVVVVGLGASGIDIASEISHVAKEVHIAARYSKDRLGKIELYHNAWMHGEIDCIQDDGLVRFAEGSSVAADTILYCTGYRYHFPFLDLDGFTVDDNRVGPLYKHVFPPKYAPNLSFVGLPYKSLELESKWVAALLSGRTAALPSEEDMMADVQEEYQRMEDAGKPKRHTHTLWPRWVEYLNWLADQVGEPHVELWRYEMHEKALRCVWSLDVGYRDRWEEENIDSGSPPWF

SEQ ID NO: 9875 - DNA, 1461 bp, Sorghum bicolor
  misc_feature: Ceres ANNOT ID no. 6107969
  misc_feature: Encodes the peptide sequence at SEQ ID NO 9876
atggcggggctgccgccggtcgccaggcggcgcccgctcgcgacggcgtcgctgctgctgctgctgttgctcgcggtgaccgcggcggcgcgcgaggagcggggcctcgcggcgcggcgggtggagggcccgccgccgcggcaccgccacgcgtacgccgccatgatgtacatgggcacgccgcgggactacgagttctacgtcgccgtgcgcgtcatgatgcgctccctcacccgggtccaagccgacgccgaccgcgtcctcatcgcctccgccgacgtcccgcgcgactgggtccgcgcaatgacagaagaggatggcttgagggtggtcatagtggagaacctcaggaatccttatgagggcaacctaggagggatcaacaagaggttcaagctgacactgaacaagctttatgcgtggaccctggtggactatgagcgtgtcgtcatgattgactccgataacatcttcctccaaaacacagacgagctattccaatgtggacagttctgtgctgttttcatcaacccgtgctacttccacactggtcttttcgtgctccagccttctattgatgtattcaagggcatgcttcatgacctggagactggccgtgaaaactcagatggtgctgaccaaggctttttggttgggtgctacccagacttgctcgacaaaccaatgtttcaccctccggagaatggtacaaagctcaatgggacctatcgccttcctctcggctatcaaatggatgcatcctactactatctcaagctacattggcatgtcccgtgtgggccaaacagtgtcatcacattccccagcgcaccttggtttaaaccttggtactggtggtcttggccggtcttgccattaggactttcctggcacaagcagcgctgggacgatcttgggtatgctgctgaaatgccagtggttctgatggaggttttaatgtacatagttatcataacagtcaccagattggcaaggccagggatgaccaaactgtgttataaccgacggcctgagaagcaaagtgccctggtgcagtggctgatcaagctggctgcaattgtggctatggtggctgcctattccattccattctttgtgatcccacgcacagttcacccgatcatgggctggtccatctacctatttggtgcccttgccttgtcagtgctcgttatcaatgtttttctgctcccaccacttgacgtgcttacaacgtggcttgcgattgtcggcatgctcttcgttatggcattcccatggtaccatgatggtgttgtgagggctctggcagtctttggatatgcattttgctcagcgccattcttgtgggcatccatggtgaggatgatggactcagtgcagacgatgctggagagggatccattcttcccccggattggtgaaccagctcaggagactgaattcagcaagctgttctga

SEQ ID NO: 9876 - protein, 486 aa, Sorghum bicolor
  misc_feature: Ceres ANNOT ID no. 6107969
  misc_feature (63)..(287): Pfam Id: Glyco_transf_8 Pfam Desc: Glycosyl transferase family 8
  misc_feature (21)..(486): NCBI GI: 116310407 NCBI Desc: osigba0143n19.10 [oryza sativa (indica cultivar-group)]
  misc_feature (55)..(486): NCBI GI: 38345479 NCBI Desc: osjnba0010h02.17 [oryza sativa (japonica cultivar-group)]
  misc_feature (47)..(486): NCBI GI: 92872087 NCBI Desc: glycosyl transferase, family 8 [medicago truncatula]
  misc_feature (25)..(262): NCBI GI: 7268410 NCBI Desc: glucosyltransferase like protein [arabidopsis thaliana]
  misc_feature (15)..(301): NCBI GI: 116310214 NCBI Desc: osigba0145m07.6 [oryza sativa (indica cultivar-group)]
  misc_feature: Useful for making plants with altered cell wall content and/or composition
  misc_feature: Functional homolog of the protein sequence encoded by LOCUS at2g35710
  misc_feature: Useful for making plants with altered carbohydrate content
  misc_feature: Functional homolog of the protein sequence given in SEQ ID NO 13809
  misc_feature: Useful for making plants with altered cell wall content and/or composition
  misc_feature: Functional homolog of the protein sequence given in SEQ ID NO 13810
MAGLPPVARRRPLATASLLLLLLLAVTAAAREERGLAARRVEGPPPRHRHAYAAMMYMGTPRDYEFYVAVRVMMRSLTRVQADADRVLIASADVPRDWVRAMTEEDGLRVVIVENLRNPYEGNLGGINKRFKLTLNKLYAWTLVDYERVVMIDSDNIFLQNTDELFQCGQFCAVFINPCYFHTGLFVLQPSIDVFKGMLHDLETGRENSDGADQGFLVGCYPDLLDKPMFHPPENGTKLNGTYRLPLGYQMDASYYYLKLHWHVPCGPNSVITFPSAPWFKPWYWWSWPVLPLGLSWHKQRWDDLGYAAEMPVVLMEVLMYIVIITVTRLARPGMTKLCYNRRPEKQSALVQWLIKLAAIVAMVAAYSIPFFVIPRTVHPIMGWSIYLFGALALSVLVINVFLLPPLDVLTTWLAIVGMLFVMAFPWYHDGVVRALAVFGYAFCSAPFLWASMVRMMDSVQTMLERDPFFPRIGEPAQETEFSKLF

SEQ ID NO: 9877 - DNA, 444 bp, Sorghum bicolor
  misc_feature: Ceres ANNOT ID no. 6107988
  misc_feature: Encodes the peptide sequence at SEQ ID NO 9878
atggcggagaagctgggccccgagaagcgccacaccttcgtgcacaacgggcagaaggtgttcgagtgggaccagacgctagaggaggtgaacatgtacatcgagctccccaagggcgtgcccaccaagctcttccactgcaccatcaaggctagccacgtcgagcacgacctgacgcaccccgtgaagaccgactcgtcgttctggacaatagaggatggtgagatgcatatcacactgcaaaaaagagagaaggggaaaacatggtcatctccaatacaagggcaaggagttttggatccatatgctgcagatcaagagcaaaagcggcttatgctccaaaggtttcaggaagagaacccagggttcgacttttcgcaggctcagttcagtggaacctgccctgacccaagaaccttcatgggaggaatacgctctgaatga

SEQ ID NO: 9878 - protein, 147 aa, Sorghum bicolor
  misc_feature: Ceres ANNOT ID no. 6107988
  misc_feature (19)..(82): Pfam Id: CS Pfam Desc: CS domain
  misc_feature (1)..(147): NCBI GI: 18461297 NCBI Desc: nuclear movement protein-like [oryza sativa (japonica cultivar-group)]
  misc_feature (62)..(141): NCBI GI: 85000143 NCBI Desc: spliceosome-associated protein [theileria annulata strain ankara]
  misc_feature (8)..(132): NCBI GI: 119581931 NCBI Desc: nudc domain containing 2 [homo sapiens]
  misc_feature (1)..(43): NCBI GI: 146161631 NCBI Desc: eukaryotic aspartyl protease family protein [tetrahymena thermophila sb210]
  misc_feature (23)..(132): NCBI GI: 62858511 NCBI Desc: loc549133 [xenopus tropicalis]
MAEKLGPEKRHTFVHNGQKVFEWDQTLEEVNMYIELPKGVPTKLFHCTIKASHVEHDLTHPVKTDSSFWTIEDGEMHITLQKREKGKTWSSPIQGQGVLDPYAADQEQKRLMLQRFQEENPGFDFSQAQFSGTCPDPRTFMGGIRSE

SEQ ID NO: 9879 - DNA, 801 bp, Sorghum bicolor
  misc_feature: Ceres ANNOT ID no. 6108009
  misc_feature: Encodes the peptide sequence at SEQ ID NO 9880
atggccacctgctcctccacagtagttgcacttggtgcacttctcttctcgctccttgcaacgtgtggctcatgcgctagaccagtgagctttaacgcctccgacttcaccgccgatcccgactgggaggctgccagggcaacctggtacggtgcgcccaccggcgccggccctgatgacgacggtggcgcctgtggattcaagaacgtgaacctgccgccgttctcggcaatgacatcgtgcggcaacgagcccttgttcaaggacggcaagggctgcggctcctgctaccagatacgatgccaaaacaacgatgcctgctccggcaaccctgagacggtgatcatcactgacatgaactactaccccgtgtccaagtatcacttcgacctcagcggcacggcgttcggcgccatggccaagcccggccgcagcgacgagctccgccacgccggcatcatcgacatccagttcaagagggtgccctgcaactaccccgggcagaaggtgacgttccacgtggaggagggctccaaccccgtctacttcgcggtgctcgtcgaattcgaagacggcgacggcgacgtggtgcaggtggacctcatggaggccaactccgggtcgtggacgccgatgcgcgagtcctggggatccatctggaggctggactccggccaccgcctcaccgcgccgttctccctgcgcatcaccaacgagtccggcaagacgctggtggcgaaccaagtcatcccggccaactgggtgcccaacacctactaccgttccatcgtccagtattag

SEQ ID NO: 9880 - protein, 266 aa, Sorghum bicolor
  misc_feature: Ceres ANNOT ID no. 6108009
  misc_feature (170)..(251): Pfam Id: Pollen_allerg_1 Pfam Desc: Pollen allergen
  misc_feature (79)..(158): Pfam Id: DPBB_1 Pfam Desc: Rare lipoprotein A (RlpA)-like double-psi beta-barrel
  misc_feature (3)..(266): NCBI GI: 14193773 NCBI Desc: beta-expansin 7 [zea mays]
  misc_feature (1)..(266): NCBI GI: 8118423 NCBI Desc: beta-expansin [oryza sativa]
  misc_feature (1)..(266): NCBI GI: 115502197 NCBI Desc: expansin-b3 precursor (osexpb3) (beta-expansin-3) (osaexpb1.10)
  misc_feature (1)..(266): NCBI GI: 51242711 NCBI Desc: beta-expansin taexpb2 [triticum aestivum]
  misc_feature (1)..(266): NCBI GI: 44894800 NCBI Desc: expansin expb3 [triticum aestivum]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 14064
MATCSSTVVALGALLFSLLATCGSCARPVSFNASDFTADPDWEAARATWYGAPTGAGPDDDGGACGFKNVNLPPFSAMTSCGNEPLFKDGKGCGSCYQIRCQNNDACSGNPETVIITDMNYYPVSKYHFDLSGTAFGAMAKPGRSDELRHAGIIDIQFKRVPCNYPGQKVTFHVEEGSNPVYFAVLVEFEDGDGDVVQVDLMEANSGSWTPMRESWGSIWRLDSGHRLTAPFSLRITNESGKTLVANQVIPANWVPNTYYRSIVQY

SEQ ID NO: 9881 - DNA, 801 bp, Sorghum bicolor
  misc_feature: Ceres ANNOT ID no. 6108012
  misc_feature: Encodes the peptide sequence at SEQ ID NO 9882
atggcaacgaccttctcttcaaaggctgttgcatttgcagcgatcttctccttcctagtcacgtatggctcctgcgcccggcctgtaagttttaacgcctccgacttcaccgccgaccctaactgggaggccgccagggccacctggtatggggcacctactggcgccggtcctgacgacgacggtggtgcctgtgggttcaagaacgtgaacctgcctccgttctccgcgatgacgtcgtgtggcaacgagccactgttcaaggacggcaagggctgcggctcatgctaccagatccgatgccaaaaccacgctgcatgctccggcaacccggagacggtgatcatcaccgacatgaactactatccggtcgctaagtaccacttcgacctcagcggcacggcgttcggcgccatggctaaacctggccgcagcgatgagctccgccacgccggcatcatcgacatccagttcaagagagtgccctgcaattaccctgggcagaaggtgacattccacgtcgaggaggggtccaactccgtctacctcgcggtgctcgtcgagtttgaagatggcgacggcgacgtggtgcaggtggacctcatggaggccaactccggctactggacgccgatgcgcgagtcctggggatccatctggaggctcgactccaaccacaggctgcaggcgcccttctcgctgcgcatcacaaacgagtccggcaggacgctggtggccaatcaggtcatcccggccaactgggtgcccaacacctactaccgctccattatccagtattga

SEQ ID NO: 9882 - protein, 266 aa, Sorghum bicolor
  misc_feature: Ceres ANNOT ID no. 6108012
  misc_feature (170)..(251): Pfam Id: Pollen_allerg_1 Pfam Desc: Pollen allergen
  misc_feature (79)..(158): Pfam Id: DPBB_1 Pfam Desc: Rare lipoprotein A (RlpA)-like double-psi beta-barrel
  misc_feature (1)..(266): NCBI GI: 14193773 NCBI Desc: beta-expansin 7 [zea mays]
  misc_feature (1)..(266): NCBI GI: 8118423 NCBI Desc: beta-expansin [oryza sativa]
  misc_feature (1)..(266): NCBI GI: 115502197 NCBI Desc: expansin-b3 precursor (osexpb3) (beta-expansin-3) (osaexpb1.10)
  misc_feature (6)..(266): NCBI GI: 51242711 NCBI Desc: beta-expansin taexpb2 [triticum aestivum]
  misc_feature (6)..(266): NCBI GI: 44894800 NCBI Desc: expansin expb3 [triticum aestivum]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 14064
MATTFSSKAVAFAAIFSFLVTYGSCARPVSFNASDFTADPNWEAARATWYGAPTGAGPDDDGGACGFKNVNLPPFSAMTSCGNEPLFKDGKGCGSCYQIRCQNHAACSGNPETVIITDMNYYPVAKYHFDLSGTAFGAMAKPGRSDELRHAGIIDIQFKRVPCNYPGQKVTFHVEEGSNSVYLAVLVEFEDGDGDVVQVDLMEANSGYWTPMRESWGSIWRLDSNHRLQAPFSLRITNESGRTLVANQVIPANWVPNTYYRSIIQY

SEQ ID NO: 9883 - DNA, 144 bp, Sorghum bicolor
  misc_feature: Ceres ANNOT ID no. 6108030
  misc_feature: Encodes the peptide sequence at SEQ ID NO 9884
atgactattgctttccaattagttgtatttgcattaattatgacttcctcagttttagtaattagtgtatcccttgtattttcttctttagatggttggtcaaataataaaaatgtagctattctaaattctcttatttcttga

SEQ ID NO: 9884 - protein, 47 aa, Sorghum bicolor
  misc_feature: Ceres ANNOT ID no. 6108030
  misc_feature (4)..(47): Pfam Id: Ycf9 Pfam Desc: YCF9
  misc_feature (1)..(39): NCBI GI: 50233956 NCBI Desc: photosystem ii reaction center protein z [oryza nivara]
  misc_feature (1)..(39): NCBI GI: 140317 NCBI Desc: photosystem ii reaction center z protein
  misc_feature (1)..(39): NCBI GI: 75291229 NCBI Desc: photosystem ii reaction center z protein
  misc_feature (1)..(39): NCBI GI: 1022811 NCBI Desc: orf 62
  misc_feature (1)..(39): NCBI GI: 48478760 NCBI Desc: photosystem ii lhc complex subunit [saccharum hybrid cultivar sp-80-3280]
MTIAFQLVVFALIMTSSVLVISVSLVFSSLDGWSNNKNVAILNSLIS

SEQ ID NO: 9885 - DNA, 1116 bp, Sorghum bicolor
  misc_feature: Ceres ANNOT ID no. 6108044
  misc_feature: Encodes the peptide sequence at SEQ ID NO 9886
atgtcgcgccggcctcgtatcgtatcggtgctgctcctcctgcttgttggccccctccgcatcatctcctgcgtccacgtagggaccgccgacgggcccgtgacggcgacggtgcaccggcaggacggcggcaccgcgtggcgctccttccagcagctgctggacgcccgccgaggcagccacgtcgcgggcctcgccgagctcaagcgctacctggcgaggttcggctacatgcccatgcccggggcggcggcggcggcggagcgcgagccgacggacgcgttcgacgcgcacatggaggccgccgtgcggcggtaccagtccaagcttagcctgccggtcacggggcagctcgacgccaccacgctggaccggatcatggcgccgcgctgcggcgtcggcgacgacgtgccggtatccctttcgggatcgtcgacggcgagccgggacggcgcggccgtcagccggttcacgttcttcaagggcgagccgcggtggacgcagccggacccgctcgtgctctcgtacgccatctcgccgaccgccaccgtcgactacctgcctgccgagaccgtgcgcgcggtgttccggcgcgcgttcgcgcggtgggcgcgggtcatccccgtgggcttcgtcgagaccgacgactaccaggaggccgacatcagggtgggcttctacgtgggcagccacggcgacgggatccccttcgacgggccgctcggcgtactcggccatgccttctccccaaagaacggccgcctccacctcgacgctgcggaacggtgggcggtcgacatggacacggaaacggtgcactcggctgtcgacttggagtccgtggccacgcacgagattggccacgtcctcgggctggggcactcgtcgtcaccaaaggcggtcatgtacccgagcctcagcccgcggcaaaagaaggcggagctcaccgtcgacgacatcgagggcgtccagtggctgtatgggcccaacccgggattcagtctcagctcgctctaccagcaggactcctccatggggtcggcaaggagcagttggcttcctgcctcggctagtttagtttgtgcagtcttggtcatgctagtgacgcagttgtag

SEQ ID NO: 9886 - protein, 371 aa, Sorghum bicolor
  misc_feature: Ceres ANNOT ID no. 6108044
  misc_feature (165)..(328): Pfam Id: Peptidase_M10 Pfam Desc: Matrixin
  misc_feature (61)..(130): Pfam Id: PG_binding_1 Pfam Desc: Putative peptidoglycan binding domain
  misc_feature (34)..(348): NCBI GI: 140048159 NCBI Desc: peptidase m10a and m12b, matrixin and adamalysin; peptidase, metallopeptidases [medicago truncatula]
  misc_feature (3)..(367): NCBI GI: 21553383 NCBI Desc: proteinase like protein [arabidopsis thaliana]
  misc_feature (96)..(367): NCBI GI: 3128477 NCBI Desc: metalloproteinase [arabidopsis thaliana]
  misc_feature (47)..(354): NCBI GI: 92890172 NCBI Desc: h+-transporting two-sector atpase, delta (oscp) subunit; peptidase, metallopeptidases [medicago truncatula]
  misc_feature (46)..(346): NCBI GI: 92897358 NCBI Desc: peptidase m10a and m12b, matrixin and adamalysin; peptidase, metallopeptidases [medicago truncatula]
MSRRPRIVSVLLLLLVGPLRIISCVHVGTADGPVTATVHRQDGGTAWRSFQQLLDARRGSHVAGLAELKRYLARFGYMPMPGAAAAAEREPTDAFDAHMEAAVRRYQSKLSLPVTGQLDATTLDRIMAPRCGVGDDVPVSLSGSSTASRDGAAVSRFTFFKGEPRWTQPDPLVLSYAISPTATVDYLPAETVRAVFRRAFARWARVIPVGFVETDDYQEADIRVGFYVGSHGDGIPFDGPLGVLGHAFSPKNGRLHLDAAERWAVDMDTETVHSAVDLESVATHEIGHVLGLGHSSSPKAVMYPSLSPRQKKAELTVDDIEGVQWLYGPNPGFSLSSLYQQDSSMGSARSSWLPASASLVCAVLVMLVTQL

SEQ ID NO: 9887 - DNA, 1236 bp, Sorghum bicolor
  misc_feature: Ceres ANNOT ID no. 6108056
  misc_feature: Encodes the peptide sequence at SEQ ID NO 9888
atggcgatggagaagaagagcagctggaaggccaccagagacgttgctgctggtgctttcagcatggactgcttggagttggtgggcgaggaggacgacgacgacgcggtgccggcgataccgccaccgcagacgccgatggagcccatggagtacctctcccggtcgtggagcgtgtcggcgtcggagatctccaagatcctcgtcggtggaggtggcaagaagagcagcgctgctgttgccgcggcgagccggcttccgccggaggtgactataccggagctgtctgtgctcgccaccacgtcctcctccatcgtgcctctcccgtgtcatcatcagcagcatagggatgcaagaagatcttccatgagcagcggccactaccaccaccaccaccaatcgatcggcaaatggttccaggttcaccacagggagacatgccgggcgaagcagagcggcaaggagaagcagcgcgccgacaaggcccacgtgcacgccatggtgtccgtggcccgagtcgcggccgcggtcgccgccgtcgcggcgtccacggccacgagctctgacagtacccaggcggctaccaagatggccacggccatggcgtcggccaccgagctgttggcctcccactgcgtcgaggcagctcagcttgcgggggcgcgccacgatcaggtggctgccgccgttcaggccgcggttggcgtcagaagccccggtgatctgatgacgctcacggcggccgcagcaacctctttgcgaggagcagcgacactgaagcagagagtgcagcgagagacgaggagcaatgcgagtgttctcccgtatgagaaggcgaattcgtggagcccggacatctggtgcaaagagggggagctgctaaaacgcacaagaaaagggggtttgcacaaaataagagtatctatctacatcaacaagaggtcacaggtgatactgaagctgaaaagcaaacacataggaggtgccctgtcaaagaacaacaagagcgtggtttacggtgtatacagcgagctgccaacctgggctgagccagggaaggactccacggaggagacatgctgcttcggccttagcacggcgcaaggtctagtggagttcgagtgtgagggcaacgcgagcaagcagaagtgggttgacgatgtgcagaacctgcttcgtcaggcggctctgcatgatcaagtagggaacaaactgggattagtaaaactcagctag

SEQ ID NO: 9888 - protein, 411 aa, Sorghum bicolor
  misc_feature: Ceres ANNOT ID no. 6108056
  misc_feature (291)..(399): Pfam Id: PH_2 Pfam Desc: Plant pleckstrin homology-like region
  misc_feature (133)..(278): NCBI GI: 115489460 NCBI Desc: os12g0604200 [oryza sativa (japonica cultivar-group)]
  misc_feature (150)..(392): NCBI GI: 116310721 NCBI Desc: osigba0092e01.13 [oryza sativa (indica cultivar-group)]
  misc_feature (150)..(392): NCBI GI: 38345392 NCBI Desc: osjnba0067k08.21 [oryza sativa (japonica cultivar-group)]
  misc_feature (42)..(253): NCBI GI: 79494795 NCBI Desc: ice binding [arabidopsis thaliana]
  misc_feature (131)..(392): NCBI GI: 115483542 NCBI Desc: os10g0568300 [oryza sativa (japonica cultivar-group)]
MAMEKKSSWKATRDVAAGAFSMDCLELVGEEDDDDAVPAIPPPQTPMEPMEYLSRSWSVSASEISKILVGGGGKKSSAAVAAASRLPPEVTIPELSVLATTSSSIVPLPCHHQQHRDARRSSMSSGHYHHHHQSIGKWFQVHHRETCRAKQSGKEKQRADKAHVHAMVSVARVAAAVAAVAASTATSSDSTQAATKMATAMASATELLASHCVEAAQLAGARHDQVAAAVQAAVGVRSPGDLMTLTAAAATSLRGAATLKQRVQRETRSNASVLPYEKANSWSPDIWCKEGELLKRTRKGGLHKIRVSIYINKRSQVILKLKSKHIGGALSKNNKSVVYGVYSELPTWAEPGKDSTEETCCFGLSTAQGLVEFECEGNASKQKWVDDVQNLLRQAALHDQVGNKLGLVKLS

SEQ ID NO: 9889 - DNA, 1359 bp, Sorghum bicolor
  misc_feature: Ceres ANNOT ID no. 6108070
  misc_feature: Encodes the peptide sequence at SEQ ID NO 9890
atggggcagtgggacgctctggtggatgccgcgctcgcgacgctggaggccaggagcctgctacgcgccacgcgacctatcgcgctcgcgccgcccccgccccccgcaaccccgcagaccttcgacggcccggggccctgggaccgtgccgccgtcgaaatacggctcgaccgcgacaccctgcagcaatggctggccgaaggtggtgaggcgagtggacatgaagaggagttggatggaaatctgatccttttctctgggaatgactatatgggcctcagctcccatcctgccgtccgtgagggtttagtgcaggcagctcgagattatggcatggggccaagaggctcggcgttgatctgtgggtatacgagttatcacaagttggtggaggaatctttggcagaattgaagaaaaaagaggattgccttctttgccccactgggttttctgccaacatggctgtaatgacggccctgggaagtattagctctcttttgtccggtgggagaaaacctgcagagtatgagagaattgccatcttctcagatgcgctgaaccatgcttcaatcattgatgggattcggcttttggagcggcagcaagaagcaatagtgtttgtctacaagcactgtgatatgttccatcttgatttcctgctatccagttgctcaatggaaaagaaagttgttgtcacagatagcctgttcagcatggatggtgattttgctccattccctgagcttgtcaaattacgcagaaagtatgggtttctattggtcatcgatgatgcccatgggacatttgtttgtggtgagaatggtggtggtgcagctgagctatttgaatgtgaaaaggacattgacataggtgtcggcaccttaagcaaggccgctggctgccagggtggatttataacatgcagcactagatggaagaggctcattcagtcgcgaggtcgctcgttcatattttcaactgctttgccggtgccagttgttgcttctgtgcatgcggcactctatgtctcgaggaaggagagatggcggagatcggtgatctggaggcacgtgcagtattttgcttctttgaccaatctcgagataactagtcccataatttccattgtcgttggaagtgaagaagcagcgctcagggccggcaggcatttgctaagatctggatttcatgttacaccaatccgaccacccacagtgccacccaactcatgcaggctgagaatcactcttagcgcttcccattcctcggaggacatcaaaagactggttgatgcactcacaccctggctccctgccaaacacagtgaggagagctacgctgcagcgtcgaaactctaa

SEQ ID NO: 9890 - protein, 452 aa, Sorghum bicolor
  misc_feature: Ceres ANNOT ID no. 6108070
  misc_feature (80)..(433): Pfam Id: Aminotran_1_2 Pfam Desc: Aminotransferase class I and II
  misc_feature (39)..(437): NCBI GI: 42573269 NCBI Desc: aminotransferase class i and ii family protein [arabidopsis thaliana]
  misc_feature (4)..(437): NCBI GI: 7406466 NCBI Desc: 8-amino-7-oxononanoate synthase-like protein [arabidopsis thaliana]
  misc_feature (181)..(433): NCBI GI: 39997723 NCBI Desc: 8-amino-7-oxononanoate synthase [geobacter sulfurreducens pca]
  misc_feature (180)..(433): NCBI GI: 115375343 NCBI Desc: 8-amino-7-oxononanoate synthase [stigmatella aurantiaca dw4/3-1]
  misc_feature (180)..(433): NCBI GI: 108759040 NCBI Desc: 8-amino-7-oxononanoate synthase [myxococcus xanthus dk 1622]
MGQWDALVDAALATLEARSLLRATRPIALAPPPPPATPQTFDGPGPWDRAAVEIRLDRDTLQQWLAEGGEASGHEEELDGNLILFSGNDYMGLSSHPAVREGLVQAARDYGMGPRGSALICGYTSYHKLVEESLAELKKKEDCLLCPTGFSANMAVMTALGSISSLLSGGRKPAEYERIAIFSDALNHASIIDGIRLLERQQEAIVFVYKHCDMFHLDFLLSSCSMEKKVVVTDSLFSMDGDFAPFPELVKLRRKYGFLLVIDDAHGTFVCGENGGGAAELFECEKDIDIGVGTLSKAAGCQGGFITCSTRWKRLIQSRGRSFIFSTALPVPVVASVHAALYVSRKERWRRSVIWRHVQYFASLTNLEITSPIISIVVGSEEAALRAGRHLLRSGFHVTPIRPPTVPPNSCRLRITLSASHSSEDIKRLVDALTPWLPAKHSEESYAAASKL

SEQ ID NO: 9891 - DNA, 2262 bp, Sorghum bicolor
  misc_feature: Ceres ANNOT ID no. 6108134
  misc_feature: Encodes the peptide sequence at SEQ ID NO 9892
atggccacgccgcggcggcgggcggcgatcctagtcgcgctcccgctcttcctctccgtctgcggcccctcccccgcgcgcagtggagacctccggcgggtggtggaggtaccgggcgagccgcggtcggtggtgtgggcggtgcagctctcggacctccacctcagcgccttccacccggagcgcaccgccgacttccgccgccacgtgggcgacgcgctcgctatggttaaccccgcgctcgtcctcatcaccggcgatctcaccgacgcaaaaagtaaagatttgttgtcatcaaggcaagaggagtttgaatggattctgtatggacaagttattgatgatgttgctaataggagtgggctgagcaaggaaatattttatgatttacgaggtaatcatgattcatatggtgttcctgaggttggcggtatgtttgatttctacaaaaagcacagcattaatgcaagattaggacgaacaggggctgtccaaagtataacattacagaatagcggcatgaagtatttatttgttggatttgacagtgcaatgggtgttggtctccgaagcccaacaaacatatttggccaacctacagatcggttactttctgatttagatgcagcactttcacagtgggataatcgatcaacaagttccttagtaaccaagatcgtctttggacatttccctatatccttttctgcattgacaacttctggaagaagtgttagagatgtttttctgaagcattcaatctccgcttacctgtgtgggcatcttcataccaacttcggaagaaacttgaagcgacatcatacatctgaccagcaacgattttcttctaaacagtactttcagttagatatccatgaagctatgtcaacaactgtcagtaatggcaattgttctgcaaggacagagtctgtcgcagaattctgggaatgggagatgggtgattggagaagtgccaggagcatgaggattctcgctattgattctggctatgtctcatatacagatatggatttcagatttggctctagagatgtgattatagtacccactttcccgttggattcacggtttatgcataggtcttcatatccttatgatcttacttgccaagccatgagcaccacacatgttgggacagtgagagcacttgtcttttcaagatacaagattgaatctgtaactgttaaaatatacgaatcacattctggaagtcttcaacttgtcctggagcaagaaatggaaagaactaggggcaagggagctagaggagctatgtatacagtcccatggaactggagggattttttagatgagctaccagatcgatactggctccagatagaagtagtggatatgactggggagacttaccatagtgaactgagaccattttctgttaatggtctaactgcaaaagttagttggacgtggaaggaatttagagtaatgggttgccaatggaatcaactgtactacccaattatgtggactacccttgcatttcttttttcattggttctggttcctcgcacttcactcacgttttatgagaatcaattcatgtcaaaatttattagaccaaagatgaccagaagaagtttaggagactttgtgcctgttaattttgagtattttgcagttgagctttcgaagatgtattttatctggtctggaatgttgttctatttgctatatttggtcttcttcccatggtttactggctacgctgtcacggagaactataataagatgtatttgcattacagaggctggagcactaggtttcttgccgacaccactgcattgccatatattggtttgcctgatgtgatggttattgttcttcctcatcttctgtttgtggtcttgccagcgtttctccttatagcagctatagcagcagaaagagcactgtatctaggtcatcatttctcccagagaacaaagaaggatgatgatcactgccaaaaagcatggcacatgaagaatgtttacatattttattggttgagaaagattctaatacttctatgcctaccaattgtctggaaacattggaagcattgtagagctattgtgagggcatatgaggttaacccattcatggatgcacccatctactgttttggtgttccagcacttctatggttggccatatacaggagttcatctgtaggagttcaccaagtcgtccgattaatcgcgattaatcgtcctggtcggtcaggagtgctcgattag

SEQ ID NO: 9892 - protein, 753 aa, Sorghum bicolor
  misc_feature: Ceres ANNOT ID no. 6108134
  misc_feature (45)..(265): Pfam Id: Metallophos Pfam Desc: Calcineurin-like phosphoesterase
  misc_feature (2)..(732): NCBI GI: 34395043 NCBI Desc: calcineurin-related phosphoesterase-like protein [oryza sativa (japonica cultivar-group)]
  misc_feature (11)..(732): NCBI GI: 57899805 NCBI Desc: calcineurin-related phosphoesterase-like [oryza sativa (japonica cultivar-group)]
  misc_feature (11)..(732): NCBI GI: 21952835 NCBI Desc: p0696g06.7 [oryza sativa (japonica cultivar-group)]
  misc_feature (34)..(729): NCBI GI: 144924121 NCBI Desc: metallophosphoesterase [medicago truncatula]
  misc_feature (40)..(264): NCBI GI: 116487833 NCBI Desc: mgc154928 protein [xenopus laevis]
MATPRRRAAILVALPLFLSVCGPSPARSGDLRRVVEVPGEPRSVVWAVQLSDLHLSAFHPERTADFRRHVGDALAMVNPALVLITGDLTDAKSKDLLSSRQEEFEWILYGQVIDDVANRSGLSKEIFYDLRGNHDSYGVPEVGGMFDFYKKHSINARLGRTGAVQSITLQNSGMKYLFVGFDSAMGVGLRSPTNIFGQPTDRLLSDLDAALSQWDNRSTSSLVTKIVFGHFPISFSALTTSGRSVRDVFLKHSISAYLCGHLHTNFGRNLKRHHTSDQQRFSSKQYFQLDIHEAMSTTVSNGNCSARTESVAEFWEWEMGDWRSARSMRILAIDSGYVSYTDMDFRFGSRDVIIVPTFPLDSRFMHRSSYPYDLTCQAMSTTHVGTVRALVFSRYKIESVTVKIYESHSGSLQLVLEQEMERTRGKGARGAMYTVPWNWRDFLDELPDRYWLQIEVVDMTGETYHSELRPFSVNGLTAKVSWTWKEFRVMGCQWNQLYYPIMWTTLAFLFSLVLVPRTSLTFYENQFMSKFIRPKMTRRSLGDFVPVNFEYFAVELSKMYFIWSGMLFYLLYLVFFPWFTGYAVTENYNKMYLHYRGWSTRFLADTTALPYIGLPDVMVIVLPHLLFVVLPAFLLIAAIAAERALYLGHHFSQRTKKDDDHCQKAWHMKNVYIFYWLRKILILLCLPIVWKHWKHCRAIVRAYEVNPFMDAPIYCFGVPALLWLAIYRSSSVGVHQVVRLIAINRPGRSGVLD

SEQ ID NO: 9893 - DNA, 1326 bp, Sorghum bicolor
  misc_feature: Ceres ANNOT ID no. 6108156
  misc_feature: Encodes the peptide sequence at SEQ ID NO 9894
atgctgcccaccggcgactcctctccgccgctgccaccagctccagcgctcaacaagccggcagtgcgccagcttgacgacctcccgtccgacgtcctgaacaagctcctcgctggcctcccggcctccgaggtggtccgcacgtcggttctgtcgcagacctggcgcaggcagtgggagtccgtccctggcctcgacatcgaccttgacgaccgcgtccgcgactgggagtgggagtccgccgcgggcttcctcgagcgctgcgcggcgcctgtccgcggcgtcccgctgcgcctgttcgaccgcgccgatggctgggtgcgcaccgacgccggcaagagaccacggtcgctgtccctggcgctgcctgtgcccaccgcgctcccgtcgctcttcgcctgcgacgccgccgcgctcgcccacatcaagctggtcacctgcgtgctgccaccgccgccgccggccttcgccgggttccgccgcctgaccgcgctggacctggactacgtcatgttctcgggagagaaggggtgggagcggctcgaggccatgatctccgcagccgcgccgacgctgcagaagctgcggctggcgaacatcgccttcgaccatgtcggcgccggcgggggcctccctgtccctggcgcgtggatcatccaggcgcccaacctccggtggctggagctacgcctgacgatggccggcgctggctcctggatgctggggcacctgcccaagcttgactacgcctacatcatgctcaacgcccaggagccgagagactacgggagcatgctcactgccctttctagcgtcagggatcttgagattggcaactttgactgtgccacgtttcaggtcaatggacttactgtacagctagctctttcatgcatatttgtgaatctaaggactttgaaacttcatacacatttttatgaagcttcaaccatgctatcaactatttctctgcttcatcaagctcccttccttcaggtccttgaaattacggacaattctcgacatgaaaccaataaggaagtggatgcatttgctgaagactttctcaggacattgccgaattgcagtttggtgaaaaatctggaacgtctacaaatgaaaagtatctcatgctctccaaatgacatgcactttatcaaacatgttctcctctatgcaagaaatctacaaatggcctcagtggaaaagttcaaaggacataggaattctgctttaaatgcagcaagaatgctcaaagaatttgaaagagtatcaccagcagcaaggatctgttttcaacatcaggactactgttggttggtttag

SEQ ID NO: 9894 - protein, 441 aa, Sorghum bicolor
  misc_feature: Ceres ANNOT ID no. 6108156
  misc_feature (23)..(70): Pfam Id: F-box Pfam Desc: F-box domain
  misc_feature (25)..(430): NCBI GI: 42409365 NCBI Desc: f-box protein family-like [oryza sativa (japonica cultivar-group)]
  misc_feature (8)..(432): NCBI GI: 42409041 NCBI Desc: f-box protein family-like protein [oryza sativa (japonica cultivar-group)]
  misc_feature (10)..(336): NCBI GI: 42409364 NCBI Desc: f-box protein family-like [oryza sativa (japonica cultivar-group)]
  misc_feature (72)..(438): NCBI GI: 51536004 NCBI Desc: f-box protein-like protein [oryza sativa (japonica cultivar-group)]
  misc_feature (25)..(432): NCBI GI: 42409507 NCBI Desc: f-box protein family-like protein [oryza sativa (japonica cultivar-group)]
MLPTGDSSPPLPPAPALNKPAVRQLDDLPSDVLNKLLAGLPASEVVRTSVLSQTWRRQWESVPGLDIDLDDRVRDWEWESAAGFLERCAAPVRGVPLRLFDRADGWVRTDAGKRPRSLSLALPVPTALPSLFACDAAALAHIKLVTCVLPPPPPAFAGFRRLTALDLDYVMFSGEKGWERLEAMISAAAPTLQKLRLANIAFDHVGAGGGLPVPGAWIIQAPNLRWLELRLTMAGAGSWMLGHLPKLDYAYIMLNAQEPRDYGSMLTALSSVRDLEIGNFDCATFQVNGLTVQLALSCIFVNLRTLKLHTHFYEASTMLSTISLLHQAPFLQVLEITDNSRHETNKEVDAFAEDFLRTLPNCSLVKNLERLQMKSISCSPNDMHFIKHVLLYARNLQMASVEKFKGHRNSALNAARMLKEFERVSPAARICFQHQDYCWLV

SEQ ID NO: 9895 - DNA, 735 bp, Sorghum bicolor
  misc_feature: Ceres ANNOT ID no. 6108173
  misc_feature: Encodes the peptide sequence at SEQ ID NO 9896
atggcgcagcggggcgagctggggcggcagctcccgctgagaggccccctgaaagccctagaggcagacatccaccacaggaattatggtggagcatgcgtgcagatgaggctgtcgttcagctccctggctccgttcttcttgtacttcatccaatggctggactgcggctgctgttatgctcttcccagctatttgggactgtttcatattctcatatgcaaggtttacgctgatggagatagctcggtgtcgacatatgaaaggcgggcaagcctgagggaattctatgcaattatctatcctattctgcagcagcttgagagtagtttgattgagagggacctgaaagggaagggtcgatgcaaagatatagtgagtaggaggaggatggaggattggaaaaagatttctggtaaagaccttgaaagggaggacgaatgcgggatttgcatggaggcatgcaccaagatggtcctgcctaattgcagtcatgcaatgtgcataaagtgctatagagactggtataaaagatcagagtcttgccctttctgccgaggaagcctcaaaagaatccgctcaagagacctttgggtgcttacaaattacaatgatgtcattgaccctgcacatttagaaagagaaaacgtgaggcatttctatagttatattgacagcttgcccctaatacttcctgatagtattttctttttctattatgattatctactataa

SEQ ID NO: 9896 - protein, 244 aa, Sorghum bicolor
  misc_feature: Ceres ANNOT ID no. 6108173
  misc_feature (148)..(185): Pfam Id: zf-C3HC4 Pfam Desc: Zinc finger, C3HC4 type (RING finger)
  misc_feature (1)..(244): NCBI GI: 115471529 NCBI Desc: os07g0275300 [oryza sativa (japonica cultivar-group)]
  misc_feature (1)..(244): NCBI GI: 57282792 NCBI Desc: e3 ubiquitin ligase [oryza sativa (indica cultivar-group)]
  misc_feature (36)..(244): NCBI GI: 50509639 NCBI Desc: zinc finger (c3hc4-type ring finger) protein-like [oryza sativa (japonica cultivar-group)]
  misc_feature (7)..(243): NCBI GI: 124360609 NCBI Desc: zinc finger, ring-type [medicago truncatula]
  misc_feature (7)..(239): NCBI GI: 38175742 NCBI Desc: zinc finger protein family-like [oryza sativa (japonica cultivar-group)]
  misc_feature: Useful for making plants with altered Lignin content
  misc_feature: Functional homolog of the protein sequence given in SEQ ID NO 12952
  misc_feature: The sequence is a functional homolog of SEQ ID NO. 271 in the 11/188,298 US application
MAQRGELGRQLPLRGPLKALEADIHHRNYGGACVQMRLSFSSLAPFFLYFIQWLDCGCCYALPSYLGLFHILICKVYADGDSSVSTYERRASLREFYAIIYPILQQLESSLIERDLKGKGRCKDIVSRRRMEDWKKISGKDLEREDECGICMEACTKMVLPNCSHAMCIKCYRDWYKRSESCPFCRGSLKRIRSRDLWVLTNYNDVIDPAHLERENVRHFYSYIDSLPLILPDSIFFFYYDYLL

SEQ ID NO: 9897 - DNA, 1488 bp, Sorghum bicolor
  misc_feature: Ceres ANNOT ID no. 6108199
  misc_feature: Encodes the peptide sequence at SEQ ID NO 9898
atggcgacggctcgtagacccaaatccaagaaacctcgggtggcggcggagggcggcggtggcatcgggggccacgaagagccgccggaattcttggccggaggacccgaccttatcagcgacctcccggacgccatccgcgccaccatcatctccctactccccaccgatgacggcgcccggactcaagccttgtccacgcggtggcgccacctctggggcatctcgcctctcaacctctgcgacggcgacattagcgggtccagccgcgacatcacggccatcgtctcccggatcctctcctcgcatcgcggccccgtccgccgcctctcccttggctggccctggtccctcgtcatgtaccccgacctagactcctggctccggtcccccgcgctcggcagcctgcaggagctcgagctgtggcgcgggttcacgcgtccgggcccgatgccgccggccgcattcccgttgtcatcctccctccgcgccctcgtcctcagcggcggctatggaccgttttgcgacgacggtgatttcctcaactttcctgcggatgacgtggataggatgcgctttcccaacctcaagcagctaacgatcaagtgtgtcatcatcgcggagagcgcgctccacaccctgctctccaaatgccctgtgcttgtgagcttggtactgagccaaaatgtgggctttcgtcgcctccagattagctcccctaaccttcgaagctttgctgtttcggatgaccgtctagacctgtgggatcctgaaaggctgaaagaagtcattattgaggatgcgcctctcctacaaaggttcttcacccgattcgaaattttttctgaaagtgaaggtctatcagttcggatatctggcgcgcccaaacttgagttcttggggtcgctcacacatgacattacaacacttgagcttgagactgctattttgaaggaaactgtgtctgtgaactcaacagcggtggtgcgatcagtgaaggttttggctgtgcacatgtcccctcctagtatcgatgatgttattggccttatgaaatgttttccctgcttgcagaaactatatgtcaaggtttctcttaaggataggtcaaaaagggtgcagcatcataatccacttgattatctcgaatgccttgatctccatctgaagaaagtagtattgatggattatcaagggatgaagagagacgtggaatttaccaacttctttcttttgaatgctaaagtgctagaaattgtggaattaacaacccagcgtcggtgtgattctaaatatttgactgagcagcttgcaaaactgcagttgaagaacagagcttctaaggatgctcaagttcactttcttatgtgtattattagccttcgccatgcaaatgattttatggacatcaggcatctgcatgatatgagtactgttgatccctttgatccgtcattgtgtagctgcagatgtattcagttcctctaa

SEQ ID NO: 9898 - protein, 495 aa, Sorghum bicolor
  misc_feature: Ceres ANNOT ID no. 6108199
  misc_feature (373)..(424): Pfam Id: FBD Pfam Desc: FBD
  misc_feature (76)..(489): NCBI GI: 50509648 NCBI Desc: ribosomal rna apurinic site specific lyase-like [oryza sativa (japonica cultivar-group)]
  misc_feature (36)..(454): NCBI GI: 115471573 NCBI Desc: os07g0287000 [oryza sativa (japonica cultivar-group)]
  misc_feature (144)..(362): NCBI GI: 34395388 NCBI Desc: ribosomal rna apurinic site specific lyase-like protein [oryza sativa (japonica cultivar-group)]
  misc_feature (34)..(482): NCBI GI: 53793450 NCBI Desc: ribosomal rna apurinic site specific lyase-like [oryza sativa (japonica cultivar-group)]
  misc_feature (34)..(482): NCBI GI: 20521321 NCBI Desc: ribosomal rna apurinic site specific lyase-like [oryza sativa (japonica cultivar-group)]
MATARRPKSKKPRVAAEGGGGIGGHEEPPEFLAGGPDLISDLPDAIRATIISLLPTDDGARTQALSTRWRHLWGISPLNLCDGDISGSSRDITAIVSRILSSHRGPVRRLSLGWPWSLVMYPDLDSWLRSPALGSLQELELWRGFTRPGPMPPAAFPLSSSLRALVLSGGYGPFCDDGDFLNFPADDVDRMRFPNLKQLTIKCVIIAESALHTLLSKCPVLVSLVLSQNVGFRRLQISSPNLRSFAVSDDRLDLWDPERLKEVIIEDAPLLQRFFTRFEIFSESEGLSVRISGAPKLEFLGSLTHDITTLELETAILKETVSVNSTAVVRSVKVLAVHMSPPSIDDVIGLMKCFPCLQKLYVKVSLKDRSKRVQHHNPLDYLECLDLHLKKVVLMDYQGMKRDVEFTNFFLLNAKVLEIVELTTQRRCDSKYLTEQLAKLQLKNRASKDAQVHFLMCIISLRHANDFMDIRHLHDMSTVDPFDPSLCSCRCIQFL

SEQ ID NO: 9899 - DNA, 168 bp, Sorghum bicolor
  misc_feature: Ceres ANNOT ID no. 6108219
  misc_feature: Encodes the peptide sequence at SEQ ID NO 9900
atggcggcggcaacgacgaccgtggttgatcgggtggtgttcgccctgaacgggcagaggtacgaggtggccggagtcgacccgtcgacgaggctgctagagttcatccgcacccggacgcccttcacgggccccaagctcggctgcggcgaaggtgttaaagtttaa

SEQ ID NO: 9900 - protein, 55 aa, Sorghum bicolor
  misc_feature: Ceres ANNOT ID no. 6108219
  misc_feature (9)..(52): NCBI GI: 75289690 NCBI Desc: probable aldehyde oxidase 4 (ao-4)
  misc_feature (9)..(52): NCBI GI: 115471561 NCBI Desc: os07g0282300 [oryza sativa (japonica cultivar-group)]
  misc_feature (1)..(52): NCBI GI: 75298567 NCBI Desc: probable aldehyde oxidase 3 (ao-3)
  misc_feature (12)..(52): NCBI GI: 2589164 NCBI Desc: aldehyde oxidase-2 [zea mays]
  misc_feature (13)..(52): NCBI GI: 115481080 NCBI Desc: os10g0138100 [oryza sativa (japonica cultivar-group)]
  misc_feature (14)..(52): SWISSPROT Homolog: EC 1.2.3.14 Abscisic-aldehyde oxidase
  misc_feature (12)..(52): SWISSPROT Homolog: EC 1.2.3.1 Aldehyde oxidase 1
MAAATTTVVDRVVFALNGQRYEVAGVDPSTRLLEFIRTRTPFTGPKLGCGEGVKV

SEQ ID NO: 9901 - DNA, 225 bp, Sorghum bicolor
  misc_feature: Ceres ANNOT ID no. 6108225
  misc_feature: Encodes the peptide sequence at SEQ ID NO 9902
atggcggcggcgacggcggttgatcgggtggtgttcgccctgaacgggcagcggtatgaggtggccggagtcgacccgtcgacgaggctgctggagttcatccgcacccagacgcccttcaagggccccaagctcggctgcggcgaagattacaaccggataggacgagtcatggccaggcttgtaataaccatgcaccgtctaagcatgcatacaaaagtttag

SEQ ID NO: 9902 - protein, 74 aa, Sorghum bicolor
  misc_feature: Ceres ANNOT ID no. 6108225
  misc_feature (3)..(49): NCBI GI: 75298567 NCBI Desc: probable aldehyde oxidase 3 (ao-3)
  misc_feature (7)..(49): NCBI GI: 75289690 NCBI Desc: probable aldehyde oxidase 4 (ao-4)
  misc_feature (7)..(49): NCBI GI: 115471561 NCBI Desc: os07g0282300 [oryza sativa (japonica cultivar-group)]
  misc_feature (2)..(49): NCBI GI: 2589162 NCBI Desc: aldehyde oxidase [zea mays]
  misc_feature (10)..(49): NCBI GI: 2589164 NCBI Desc: aldehyde oxidase-2 [zea mays]
  misc_feature (10)..(49): SWISSPROT Homolog: EC 1.2.3.1 Aldehyde oxidase 1
MAAATAVDRVVFALNGQRYEVAGVDPSTRLLEFIRTQTPFKGPKLGCGEDYNRIGRVMARLVITMHRLSMHTKV

SEQ ID NO: 9903 - DNA, 1329 bp, Sorghum bicolor
  misc_feature: Ceres ANNOT ID no. 6108272
  misc_feature: Encodes the peptide sequence at SEQ ID NO 9904
atggccggcggcggcggcgggttcgtgtcgctgctggtggtttcgtcgatgccggtggcagagctgctgctcataggcgtggcgggcgcctacctcgcgacggcccgctgcggcaacgtgctcacgccgtccgcccgcgccgacatcaaccgcgtcgtctacgccgtgttcacgccggcgctcatgctcgccagcctcgccagcaccgtcacgctcaaagacgtcctcgcctggtggttcatgccggtgaacatcgggatcgccttcttggccggaggagctctcgggtgggtggcggtgctcgtcctcaggccgccgccgcagctccgcggattggtcattgcttcctgctctgctgcaaactttggcaacctgatgctggtggtgatcccggccgtgtgcgaggaggatggaaatccgtttggtttgcccaacagcgtctgcacagagcacggcctctcctacgcctcattctccatggcgcttggaggattgtacatctggacacacacgcacggtattattaagaggtccggcgaaatataccgaaagatgagagaaccaatagtaggcatttctgcagtgacctccgtggtcgtcgagcctaaccacgacgatgactctgtcaaatcagaggaatacaacaccatctcgccatcgtccaaaccggctgatgaaaaaggacaacaccaaatattggttccgctgctttcaggatcaagcgtatttcatcatcatcagcagggtagtggaagcaagagcttgtggcagaagatcaaacaagtcacgcaccaaataacggaggagttaacctcgccaccgacgactggcgcggagggtttccccttttactggaatcttattaataaaaaggaagatggtataaagttcatgaaacaaaaaaaggtcatgggtttggtaataggaacagtgccctggctcaggtctgtatttgtgggcagcaacgctcccctgcgagctgtgcaagactccctcaagctactcggagatggaacaatcccatgccttatgctgattctaggaggaaacttgacaaaagtcatctgcgtgcgctacttgatcctgccgctcatcggggtgctcgttgttagggctgcgcgtgacatgggcttccttccgcctcacccactctaccagtacacgctcatgatgcacttcgctgtcccgcctgcaatgagcatcggaaccatgtctcaattgtatgacgttgggcaagaggagtgctcggttattttgctgtggacatacctcgttgccgcgctagcgcttactgtctggtccaccatcttcatgtggatcctgcaatag

SEQ ID NO: 9904 - protein, 442 aa, Sorghum bicolor
  misc_feature: Ceres ANNOT ID no. 6108272
  misc_feature (14)..(434): Pfam Id: Mem_trans Pfam Desc: Membrane transport protein
  misc_feature (7)..(441): NCBI GI: 115480587 NCBI Desc: os09g0554300 [oryza sativa (japonica cultivar-group)]
  misc_feature (7)..(221): NCBI GI: 140066984 NCBI Desc: auxin efflux carrier [medicago truncatula]
  misc_feature (9)..(176): NCBI GI: 22329697 NCBI Desc: auxin efflux carrier family protein [arabidopsis thaliana]
  misc_feature (7)..(335): NCBI GI: 92867962 NCBI Desc: auxin efflux carrier [medicago truncatula]
  misc_feature (7)..(345): NCBI GI: 92867960 NCBI Desc: auxin efflux carrier [medicago truncatula]
MAGGGGGFVSLLVVSSMPVAELLLIGVAGAYLATARCGNVLTPSARADINRVVYAVFTPALMLASLASTVTLKDVLAWWFMPVNIGIAFLAGGALGWVAVLVLRPPPQLRGLVIASCSAANFGNLMLVVIPAVCEEDGNPFGLPNSVCTEHGLSYASFSMALGGLYIWTHTHGIIKRSGEIYRKMREPIVGISAVTSVVVEPNHDDDSVKSEEYNTISPSSKPADEKGQHQILVPLLSGSSVFHHHQQGSGSKSLWQKIKQVTHQITEELTSPPTTGAEGFPFYWNLINKKEDGIKFMKQKKVMGLVIGTVPWLRSVFVGSNAPLRAVQDSLKLLGDGTIPCLMLILGGNLTKVICVRYLILPLIGVLVVRAARDMGFLPPHPLYQYTLMMHFAVPPAMSIGTMSQLYDVGQEECSVILLWTYLVAALALTVWSTIFMWILQ

SEQ ID NO: 9905 - DNA, 312 bp, Sorghum bicolor
  misc_feature: Ceres ANNOT ID no. 6108298
  misc_feature: Encodes the peptide sequence at SEQ ID NO 9906
atggcaaaagcacaggcattagctgcgctgctcatcgccatgttggccctcgccacaatggagagcgccgacgcaatctgcggcatggcgaacgaggacttcaagctgtgccagcccgcggcatcggtgagtgacccgacggacagcccgtcggcggagtgctgcgctgcgctgggcaaggctgaccttgggtgcatctgccgctacaagggtgtcgccggcatatggatgaggatctaccacatcgaccccagccgcgctatggcgctgccgggcaaatgtggccttacaatgcccagcaactgctcgtga

SEQ ID NO: 9906 - protein, 103 aa, Sorghum bicolor
  misc_feature: Ceres ANNOT ID no. 6108298
  misc_feature (27)..(102): Pfam Id: Tryp_alpha_amyl Pfam Desc: Protease inhibitor/seed storage/LTP family
  misc_feature (1)..(102): NCBI GI: 92869828 NCBI Desc: plant lipid transfer/seed storage/trypsin-alpha amylase inhibitor [medicago truncatula]
  misc_feature (10)..(102): NCBI GI: 1420887 NCBI Desc: non-specific lipid transfer-like protein
  misc_feature (13)..(102): NCBI GI: 25044847 NCBI Desc: pvr3-like protein [ananas comosus]
  misc_feature (2)..(102): NCBI GI: 2598597 NCBI Desc: mtn5 [medicago truncatula]
  misc_feature (8)..(102): NCBI GI: 115441797 NCBI Desc: os01g0914300 [oryza sativa (japonica cultivar-group)]
  misc_feature: The sequence is a functional homolog of SEQ ID NO. 364 in the 11/188,298 US application
MAKAQALAALLIAMLALATMESADAICGMANEDFKLCQPAASVSDPTDSPSAECCAALGKADLGCICRYKGVAGIWMRIYHIDPSRAMALPGKCGLTMPSNCS

SEQ ID NO: 9907 - DNA, 870 bp, Sorghum bicolor
  misc_feature: Ceres ANNOT ID no. 6108302
  misc_feature: Encodes the peptide sequence at SEQ ID NO 9908
atgcctttccgattcgagttcccatggctcaagaatcccaacacgacggccggtacctccaaccgagacactaaccctagcccccgcttcccgaaccccttcctccccatccaagcccacgtcacctccttcctctcctccctcccccaggccctcccgccgccgccgccctgggctcgcatcccctccccctcctcagcctccacctctgtggctctcccgaccgcagagatcgaggagcggctcgccggggtgccagtgtacgcgctcgccaacgccgcccaggagttcgtgctcgtgtcatccacccgcgtgggagggcaagggggcgagggcgtgagggtgaggccaccgccggcgctcgggctgctctgcttccggaaggaagatgccgacgcgctgctggagcagatggagggcgatatgcgcgccggctctagcgtcgtgcccgtggcgctcaacaaggttatccaactgaagtcagatggtgtggcatttagattcctccctgattcatcccaggtggctaatgcaattaagctgatgcaagatgagggactgtatgccagagagggatttccaggagtgccagttttccagtcaaggagcttggtcctgatgagtgacaacaagagatatcgtccagtttttttcagaaaggaggacttggataactcactgcaccggacctcccgcgatcagcaaaaacctaatcctgctgttaggtttggtgacactcaggtttcttctttggaagatatcattaaatctatgaaggatagctcctcctcaaaatgggatgatgttgtatttattcctcctggatttgaccttgctactggctcgacaccatcacacctcagcaagtag

SEQ ID NO: 9908 - protein, 289 aa, Sorghum bicolor
  misc_feature: Ceres ANNOT ID no. 6108302
  misc_feature (5)..(284): Pfam Id: Tic22 Pfam Desc: Tic22-like family
  misc_feature (64)..(275): NCBI GI: 3769671 NCBI Desc: tic22 [pisum sativum]
  misc_feature (62)..(274): NCBI GI: 113475327 NCBI Desc: tic22-like [trichodesmium erythraeum ims101]
  misc_feature (58)..(274): NCBI GI: 86607397 NCBI Desc: chloroplast envelope protein translocase (cept or tic-toc) family protein [cyanobacteria bacterium yellowstone a-prime]
  misc_feature (71)..(273): NCBI GI: 67925831 NCBI Desc: tic22-like [crocosphaera watsonii wh 8501]
  misc_feature (56)..(273): NCBI GI: 86608446 NCBI Desc: chloroplast envelope protein translocase (cept or tic-toc) family protein [cyanobacteria bacterium yellowstone b-prime]
MPFRFEFPWLKNPNTTAGTSNRDTNPSPRFPNPFLPIQAHVTSFLSSLPQALPPPPPWARIPSPSSASTSVALPTAEIEERLAGVPVYALANAAQEFVLVSSTRVGGQGGEGVRVRPPPALGLLCFRKEDADALLEQMEGDMRAGSSVVPVALNKVIQLKSDGVAFRFLPDSSQVANAIKLMQDEGLYAREGFPGVPVFQSRSLVLMSDNKRYRPVFFRKEDLDNSLHRTSRDQQKPNPAVRFGDTQVSSLEDIIKSMKDSSSSKWDDVVFIPPGFDLATGSTPSHLSK

SEQ ID NO: 9909 - DNA, 894 bp, Sorghum bicolor
  misc_feature: Ceres ANNOT ID no. 6108303
  misc_feature: Encodes the peptide sequence at SEQ ID NO 9910
atggcaaccagatcatcgctggtgccactgctgctcattgcagtagctgctgcgcagattgttgggtcacaagctggcagcatttccatatactggggtcagaatggtggcgagggcacactggccgacacctgcgccactggcaactacaagtttgtcaacttggcattccttgtagcctttggcaatggccagcaaccagtgctcaacctagcaggccactgtgacccctcaagtggtggctgcaccagcctaagcgacgacatcaagtcgtgccagagcaatggcgtcaaggtcatgctctcgatcggtggagcttctggtagctactaccttacctcagccgcggatgccaagactgttgcgacatacttgtggaacaatttcttaggggggcaatcatcttctcgccccttgggcgatgcggtccttgatggcatagactttgacatcgagggcggcaccacccagcactgggatgatcttgcaagatacttgaaagggtacagcaactctggcaggagggtgtacctgactgctgcacctcagtgcccgtttcctgatgcctatgtcggtgatgctctcaacaccggccagtttgactacgtctgggtgcagttctacaacaaccctccttgccagtacagctcaggcagcaccactgatcttgctgatgcatggaagcagtggctatcaattccggcaaagcaggtctttcttggcctcccagcttcgcctgaagctgctgggagtggttttataccagctgatgacctcaagtctcaggtgcttccattgatcaagagttcagggaaatatggagggatcatgctgtggtccaagtactatgatgaccaggatgactacagctcttcagtcaagagcgatgtttag

SEQ ID NO: 9910 - protein, 297 aa, Sorghum bicolor
  misc_feature: Ceres ANNOT ID no. 6108303
  misc_feature (26)..(284): Pfam Id: Glyco_hydro_18 Pfam Desc: Glycosyl hydrolases family 18
  misc_feature (1)..(297): NCBI GI: 106647236 NCBI Desc: class iii chitinase [panax ginseng]
  misc_feature (1)..(297): NCBI GI: 10954033 NCBI Desc: class iii acidic chitinase [malus x domestica]
  misc_feature (23)..(297): NCBI GI: 119393870 NCBI Desc: class iii chitinase [casuarina glauca]
  misc_feature (1)..(297): NCBI GI: 33562677 NCBI Desc: class iii chitinase [medicago truncatula]
  misc_feature (1)..(297): NCBI GI: 28971736 NCBI Desc: chitinase iii [vitis vinifera]
  misc_feature (1)..(297): SWISSPROT Homolog: EC 3.2.1.14 Acidic endochitinase precursor
  misc_feature: Useful for making plants with altered cell wall content and/or composition
  misc_feature: GREAT-hit functional homolog of the protein sequence encoded by LOCUS at5g24090
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
MATRSSLVPLLLIAVAAAQIVGSQAGSISIYWGQNGGEGTLADTCATGNYKFVNLAFLVAFGNGQQPVLNLAGHCDPSSGGCTSLSDDIKSCQSNGVKVMLSIGGASGSYYLTSAADAKTVATYLWNNFLGGQSSSRPLGDAVLDGIDFDIEGGTTQHWDDLARYLKGYSNSGRRVYLTAAPQCPFPDAYVGDALNTGQFDYVWVQFYNNPPCQYSSGSTTDLADAWKQWLSIPAKQVFLGLPASPEAAGSGFIPADDLKSQVLPLIKSSGKYGGIMLWSKYYDDQDDYSSSVKSDV

SEQ ID NO: 9911 - DNA, 894 bp, Sorghum bicolor
  misc_feature: Ceres ANNOT ID no. 6108304
  misc_feature: Encodes the peptide sequence at SEQ ID NO 9912
atggcgaccaggtcatcgctggtgccactgctgctcattacagtagttgttgcgcagattgttgggtcacaagctggcagcatttccatatactggggtcaaaatggtggcgagggcacactggccgacacctgcgccactggcaactacaagtttgtcaacttggcattccttgtagcctttggcaatggccagcaaccagtgctcaacctagcaggccactgtgacccctcaagtggtggctgcaccagcctaagcgacgacatcaagtcgtgccagagcaatggcgttaaggtcatgctctcgattggtggagcttctggtagctactaccttacctcagccgcggatgccaagactgttgcgacatacttgtggaacaatttcttaggggggcaatcatcttctcgccccttgggcgatgcggtccttgatggcatagactttgacatcgagggcggcaccacccagcactgggatgatcttgcaagatacttgaaagggtacagcaactctggcaggagggtgtacctgactgctgcacctcagtgcccgtttcctgatgcctatgtcggtgatgctctcaacaccggccagtttgactacgtctgggtgcagttctacaacaaccctccttgccagtacagctcaggcagcaccactgatcttgctgatgcatggaagcagtggctatcaattccggcaaagcaggtctttcttggcctcccagcttcgcctgaagctgctgggagtggttttataccagctgatgacctcaagtctcaggtgcttccattgatcaagagttcagggaaatatggagggatcatgctgtggtccaagtactatgatgaccaggatgactacagctcttcagtcaagagcgatgtttag

SEQ ID NO: 9912 - protein, 297 aa, Sorghum bicolor
  misc_feature: Ceres ANNOT ID no. 6108304
  misc_feature (26)..(284): Pfam Id: Glyco_hydro_18 Pfam Desc: Glycosyl hydrolases family 18
  misc_feature (1)..(297): NCBI GI: 106647236 NCBI Desc: class iii chitinase [panax ginseng]
  misc_feature (2)..(297): NCBI GI: 10954033 NCBI Desc: class iii acidic chitinase [malus x domestica]
  misc_feature (23)..(297): NCBI GI: 119393870 NCBI Desc: class iii chitinase [casuarina glauca]
  misc_feature (1)..(297): NCBI GI: 33562677 NCBI Desc: class iii chitinase [medicago truncatula]
  misc_feature (1)..(297): NCBI GI: 28971736 NCBI Desc: chitinase iii [vitis vinifera]
  misc_feature (10)..(297): SWISSPROT Homolog: EC 3.2.1.14 Acidic endochitinase precursor
  misc_feature: Useful for making plants with altered cell wall content and/or composition
  misc_feature: GREAT-hit functional homolog of the protein sequence encoded by LOCUS at5g24090
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
MATRSSLVPLLLITVVVAQIVGSQAGSISIYWGQNGGEGTLADTCATGNYKFVNLAFLVAFGNGQQPVLNLAGHCDPSSGGCTSLSDDIKSCQSNGVKVMLSIGGASGSYYLTSAADAKTVATYLWNNFLGGQSSSRPLGDAVLDGIDFDIEGGTTQHWDDLARYLKGYSNSGRRVYLTAAPQCPFPDAYVGDALNTGQFDYVWVQFYNNPPCQYSSGSTTDLADAWKQWLSIPAKQVFLGLPASPEAAGSGFIPADDLKSQVLPLIKSSGKYGGIMLWSKYYDDQDDYSSSVKSDV

SEQ ID NO: 9913 - DNA, 894 bp, Sorghum bicolor
  misc_feature: Ceres ANNOT ID no. 6108306
  misc_feature: Encodes the peptide sequence at SEQ ID NO 9914
atggcaaccagatcatcgctggtgccactgctgctcattgcagtagctgttgcacagattgttgggtcacaagctggcagcatttccatatactgggggcagaatggtggcgagggcacactggctgacacctgcgccagcggcaactacaagattgtcaacttggcattccttgtaacatttggcaatggccagactccagagctcaacctagcaggccactgtgatcccacaagtggtggctgcgcaagccaaagcgacgacatcaagtcatgccagagcaatggcgttaaggtcatgctctcgattggtggagcttccggtagctactaccttacctcagccgcggatgccaagactgttgccacatacttgtggaacaatttcttaggggggcactcatcttctcgccccttgggcgatgcggtcctcgatggcatagactttgacatcgagggcggcaccacccaacactgggatgatcttgcaagatacttgaaagggtacagcaactctggcaggagggtgtacctgactgctgcacctcagtgccagtttcctgatgcctatgtcggtgatgcgctcaacactggtttgtttgactacgtctgggtgcagttctacaacaaccctctttgccagtacagctcaggcagcaccactgatcttgctgatgcatggaagcagtggctgtcaattccggcgaagcaggtctttcttggcctcccagcttcgcctgaggcagctgggagtggttttataccagctgatgacctcaagtctcaggtgcttccattgatcaagagctcagggaaatatggagggatcatgctgtggtccaagtactatgatgaccaggatgactacagctcttcagtcaagagcgatgtttag

SEQ ID NO: 9914 - protein, 297 aa, Sorghum bicolor
  misc_feature: Ceres ANNOT ID no. 6108306
  misc_feature (26)..(284): Pfam Id: Glyco_hydro_18 Pfam Desc: Glycosyl hydrolases family 18
  misc_feature (1)..(297): NCBI GI: 106647236 NCBI Desc: class iii chitinase [panax ginseng]
  misc_feature (1)..(297): NCBI GI: 10954033 NCBI Desc: class iii acidic chitinase [malus x domestica]
  misc_feature (23)..(297): NCBI GI: 119393870 NCBI Desc: class iii chitinase [casuarina glauca]
  misc_feature (1)..(297): NCBI GI: 33562677 NCBI Desc: class iii chitinase [medicago truncatula]
  misc_feature (1)..(297): NCBI GI: 28971736 NCBI Desc: chitinase iii [vitis vinifera]
  misc_feature (10)..(297): SWISSPROT Homolog: EC 3.2.1.14 Acidic endochitinase precursor
  misc_feature: Useful for making plants with altered cell wall content and/or composition
  misc_feature: GREAT-hit functional homolog of the protein sequence encoded by LOCUS at5g24090
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
MATRSSLVPLLLIAVAVAQIVGSQAGSISIYWGQNGGEGTLADTCASGNYKIVNLAFLVTFGNGQTPELNLAGHCDPTSGGCASQSDDIKSCQSNGVKVMLSIGGASGSYYLTSAADAKTVATYLWNNFLGGHSSSRPLGDAVLDGIDFDIEGGTTQHWDDLARYLKGYSNSGRRVYLTAAPQCQFPDAYVGDALNTGLFDYVWVQFYNNPLCQYSSGSTTDLADAWKQWLSIPAKQVFLGLPASPEAAGSGFIPADDLKSQVLPLIKSSGKYGGIMLWSKYYDDQDDYSSSVKSDV

SEQ ID NO: 9915 - DNA, 903 bp, Sorghum bicolor
  misc_feature: Ceres ANNOT ID no. 6108308
  misc_feature: Encodes the peptide sequence at SEQ ID NO 9916
atggcgagcaacaagtcatcactgccgctgatggcgctagccatggcagcgctattcgtcgtcgggtcacacgccggcagcatctccatctactggggccagaacgagggcgaaggctcgcttgccgacacctgcgcgacgggcaactacaagttcgtcaatatcgccttcctggcggcgttcggcaacgggcagccgccggtgttcaacctggcggggcactgcgacccgaccaacggcgggtgcgcgagccagagcgccgacatcaagtcgtgccagagccgcggcgtcaaggtgatgctctccatcggcggcggcgccggcagctactacctcaactcctccgccgacgcccggaacgtggccacgtacctgtgggacgccttcctcggcggccggtcgtcctccaccccgcgcccgctcggcgacgccgtcctcgacggcgtcgacttcgacatcgagggcggcacgcccctgcactgggacgacctcgccaggtacctgaaagggtacagcagcagctccggcaggaaggtgtatctgacggcggcgccgcagtgcccgttcccggacgcctgggtcggcggcgccctcgccaccgggctgttcgactacgtctgggtgcagttctacaacaacccgccatgccagtacagctcaggcagcaccactgaccttgctgatgcatggaagcagtggctcacgatcccggcgaagcggatcttcctcggcctcccggcatcgcctcaggcggccggcagcgggtttattccggccgatgttctcaagtcgcaggtgcttccgttgatcaagagctccgggaagtatggagggatcatgctgtggtccaagtactatgatgaccaggatgactacagctcttcggttaagagcgatgtttag

SEQ ID NO: 9916 - protein, 300 aa, Sorghum bicolor
  misc_feature: Ceres ANNOT ID no. 6108308
  misc_feature (26)..(287): Pfam Id: Glyco_hydro_18 Pfam Desc: Glycosyl hydrolases family 18
  misc_feature (1)..(300): NCBI GI: 106647236 NCBI Desc: class iii chitinase [panax ginseng]
  misc_feature (1)..(300): NCBI GI: 10954033 NCBI Desc: class iii acidic chitinase [malus x domestica]
  misc_feature (6)..(300): NCBI GI: 119393870 NCBI Desc: class iii chitinase [casuarina glauca]
  misc_feature (1)..(300): NCBI GI: 4530607 NCBI Desc: chitinase [fragaria x ananassa]
  misc_feature (5)..(300): NCBI GI: 33562677 NCBI Desc: class iii chitinase [medicago truncatula]
  misc_feature (5)..(300): SWISSPROT Homolog: EC 3.2.1.14 Acidic endochitinase precursor
  misc_feature: Useful for making plants with altered cell wall content and/or composition
  misc_feature: GREAT-hit functional homolog of the protein sequence encoded by LOCUS at5g24090
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
MASNKSSLPLMALAMAALFVVGSHAGSISIYWGQNEGEGSLADTCATGNYKFVNIAFLAAFGNGQPPVFNLAGHCDPTNGGCASQSADIKSCQSRGVKVMLSIGGGAGSYYLNSSADARNVATYLWDAFLGGRSSSTPRPLGDAVLDGVDFDIEGGTPLHWDDLARYLKGYSSSSGRKVYLTAAPQCPFPDAWVGGALATGLFDYVWVQFYNNPPCQYSSGSTTDLADAWKQWLTIPAKRIFLGLPASPQAAGSGFIPADVLKSQVLPLIKSSGKYGGIMLWSKYYDDQDDYSSSVKSDV

SEQ ID NO: 9917 - DNA, 234 bp, Sorghum bicolor
  misc_feature: Ceres ANNOT ID no. 6108325
  misc_feature: Encodes the peptide sequence at SEQ ID NO 9918
atggtgacgacgacggactgggggccgatcatcgtggcggtggtgctgttcatcctgctgtcgccggggttcctgttccagctgccggcgagggtgagggtggtggagttcggcaacatgggcaccagcgccctcgccatcctcgtccacgccatcctctacttctgtatactcaccatcgtcgtcgtagccatcggcgtccatgtatacaccaccaaaccggatccggcgtag

SEQ ID NO: 9918 - protein, 77 aa, Sorghum bicolor
  misc_feature: Ceres ANNOT ID no. 6108325
  misc_feature (6)..(70): NCBI GI: 1532168 NCBI Desc: localized according to blastn similarity to est sequences; therefore, the coding span corresponds only to an area of similarity since the initation codon and stop codon could not
  misc_feature (6)..(70): NCBI GI: 1532168 (continued) be precisely determined [arabidopsis thaliana]
  misc_feature (6)..(70): NCBI GI: 115485585 NCBI Desc: os11g0496500 [oryza sativa (japonica cultivar-group)]
  misc_feature (6)..(70): NCBI GI: 1532167 NCBI Desc: localized according to blastn similarity to est sequences; therefore, the coding span corresponds only to an area of similarity since the initation codon and stop codon could not
  misc_feature (6)..(70): NCBI GI: 1532167 (continued) be precisely determined [arabidopsis thaliana]
  misc_feature (5)..(39): NCBI GI: 10178281 NCBI Desc: katanin p80 subunit-like protein [arabidopsis thaliana]
  misc_feature: Useful for making plants with altered cell wall content and/or composition
  misc_feature: Functional homolog of the protein sequence given in SEQ ID NO 13690
MVTTTDWGPIIVAVVLFILLSPGFLFQLPARVRVVEFGNMGTSALAILVHAILYFCILTIVVVAIGVHVYTTKPDPA

SEQ ID NO: 9919 - DNA, 1689 bp, Sorghum bicolor
  misc_feature: Ceres ANNOT ID no. 6108338
  misc_feature: Encodes the peptide sequence at SEQ ID NO 9920
atggcggcgccggctctccgtaccaccccgcggctgggacttgcacttgacggtgccaccgccgcgagacggcgcggggccttggcgcctgcggcggtcccggccgcgccgtgcctgaggaaggcgacggtccggtgccagcgagccgtcagcgccgccgccattgtcgagaagaaggatgcctcggtggcggctgcgcaggagagaggcggcgacggggagctcacagtcgtgatgaagttcggcgggtcgtcggtggcctcggccgagcggatgcgggaggtggcagacctcatcctcagcttccccgaggagcgcccggtcgtcgtgctctcggcgatggggaagaccaccaacaaactgctcatggctggggaaaaagcagtaggctgtggcgcgaccaaagtctcagagctcgaggagctatcctttgtaaaggaattgcatctggggacactcgatcagcttgggctagataggtcaattatttatggtttgttggatgaacttgaacaacttcttaagggaattgctatgatgaaagagctgacccttaggacacgagattatctagtttcatttggtgaatgcatgtctacaagaatatttgctgctcttttaaacaaaattggggtaaaagctcggcagtatgatgcatttgatcttggctttataactactgatgatttcacaaatgcggatattctggaagcaacttatcctgctgttgcaaagaggctacatggggactggattaacgatcctgctattcctatagtcacaggctttcttggaaagggatggagatctggtgcaataaccaccttgggcaggggtggtagcgacttaacagctacaaccattggcaaagccttgggattaagagaaatccaggtttggaaagatgttgatggtgttttaacatgtgacccaaatatccatcctaaggcaaaaccagtgccatacttgacatttgatgaggcagccgaacttgcctattttggagcgcaggttttgcatccacaatcaatgcgaccagctagagaaggcgatgtacctgttagggttaagaactcttataaccgtcgagcccctggtactcttatcactaaagcaagagatatgagtaagactgttttgactagcattgttttgaaatcaaatattacaatgcttgatatagtgagcacacgcatgcttggccagtatggttttctagctaaggttttttcgatatttgaagactcgggcatgtctgttgattgtgtggccactagtgaagtcagcatatctttgacactggatccatcgaaactatggagttgtgaattggttcagcacagaaatgaacttgatgttgtaattgaagagcttgaaaagatagcagttgttcatctactgcagaacaggtcaataatatctttaattggaaatgtgcagaggtcatctttgattcttgaaaaggctttcaatgttctacgaagaaatggtgtcaatgtccagatgatatcgcaaggggcatccaaggtgaacatttccttggtggtccatgacagtgaggccaaacagtgtgttcaagccctccactctgcgttctttgagaatggcttcttgttggaagctgacgagttggatgttctgcatgatggctttacatcgcatcccaatggcacaatccacagcccttag

SEQ ID NO: 9920 - protein, 562 aa, Sorghum bicolor
  misc_feature: Ceres ANNOT ID no. 6108338
  misc_feature (75)..(358): Pfam Id: AA_kinase Pfam Desc: Amino acid kinase family
  misc_feature (11)..(560): NCBI GI: 126257055 NCBI Desc: monofunctional aspartate kinase 1 [zea mays]
  misc_feature (51)..(560): NCBI GI: 115456611 NCBI Desc: os03g0850400 [oryza sativa (japonica cultivar-group)]
  misc_feature (51)..(542): NCBI GI: 5305740 NCBI Desc: precursor monofunctional aspartokinase [glycine max]
  misc_feature (7)..(540): NCBI GI: 23308185 NCBI Desc: at5g13280/t31b5_100 [arabidopsis thaliana]
  misc_feature (7)..(540): NCBI GI: 4376158 NCBI Desc: aspartate kinase [arabidopsis thaliana]
  misc_feature (7)..(540): SWISSPROT Homolog: EC 2.7.2.4 Aspartokinase 1, chloroplast precursor
  misc_feature: Useful for making plants with altered alkaloid content
  misc_feature: Useful for making plants with modulated nitrogen use efficiency
  misc_feature: Functional homolog of the protein sequence given in SEQ ID NO 13262
  misc_feature: Useful for making plants with altered alkaloid content
  misc_feature: Useful for making plants with modulated nitrogen use efficiency
  misc_feature: Functional homolog of the protein sequence given in SEQ ID NO 13262
MAAPALRTTPRLGLALDGATAARRRGALAPAAVPAAPCLRKATVRCQRAVSAAAIVEKKDASVAAAQERGGDGELTVVMKFGGSSVASAERMREVADLILSFPEERPVVVLSAMGKTTNKLLMAGEKAVGCGATKVSELEELSFVKELHLGTLDQLGLDRSIIYGLLDELEQLLKGIAMMKELTLRTRDYLVSFGECMSTRIFAALLNKIGVKARQYDAFDLGFITTDDFTNADILEATYPAVAKRLHGDWINDPAIPIVTGFLGKGWRSGAITTLGRGGSDLTATTIGKALGLREIQVWKDVDGVLTCDPNIHPKAKPVPYLTFDEAAELAYFGAQVLHPQSMRPAREGDVPVRVKNSYNRRAPGTLITKARDMSKTVLTSIVLKSNITMLDIVSTRMLGQYGFLAKVFSIFEDSGMSVDCVATSEVSISLTLDPSKLWSCELVQHRNELDVVIEELEKIAVVHLLQNRSIISLIGNVQRSSLILEKAFNVLRRNGVNVQMISQGASKVNISLVVHDSEAKQCVQALHSAFFENGFLLEADELDVLHDGFTSHPNGTIHSP

SEQ ID NO: 9921 - DNA, 1539 bp, Sorghum bicolor
  misc_feature: Ceres ANNOT ID no. 6108349
  misc_feature: Encodes the peptide sequence at SEQ ID NO 9922
atgggccgcaatcttgacgccgagcaagcggaagcacccaggagcagcaagaaggagaagaagagcaagaaggacaagaagcggaagctggcagccgaggccgaggaggcggcggcggcggccgtgacggcgacagaggagaccgtgaagagcatcaagaagaagaagctggttgagaatggagccggcgcaggaggaggaggggaggcggagaacggcgctgagaagaccgtggcggtgaccgggaagggctccgaggaccccaagtacgcgccgctgcggtcgttctccgctgccgagctgccgtcccaggtgctcgattgctgcagcgcattcgcgcggccgtcgcccattcaggcacacgcctggccgttcctcctcgatggccgcgacttcatcggcatcgccgccaccggatcagggaagacaattgcctttggtgtgccggcgctgatgcacatcaggaagaaggtaggggggaaagcagtgaagaaggctgtgccacggtgcctcgtgctatcaccaacgagggagctcgctcagcagattgcagatgtacttagtgaggctggtgcaccatgtgggataaaatcagtctgcctttatggtggaactaaaaaggaaccccaaatatctgcccttaaatctggagtggatatagtcataggaactcctggtcgtatgaaagaccttattgaaatgggtgtttgccgtcttaatgaggtttcgttcgtggttctagatgaagcagataggatgctggatatgggttttgaacctgaagtcagggcaattttgagccaaacatcatctgtacgtcagatggttatgttcagtgcaacttggcctcttgctgtccacaaattagcccaggagtttatggatccaaatccaataaaggttgttattggatcagaagatcttgctgctaaccatgacgtgatgcaaattgttgaagtattggatgatagaacacgagattcaagattacttgccttgcttgacaaatatcatcaagcacaaagcaacagggttttggtttttgtgctgtacaagaaagaagctgcacgagtggaaacaatgcttcagagaaggggatggaaggctgtttcagtccatggagacaaagctcagcatgacagaacaaaagctttatctttatttaaagaagggaaatgccctttaatgattgctacagatgtcgcttcacgtggacttgatattcctgatgttgaagttgtcattaactatagttatcctttgaccactgaggattacgtccacaggataggaaggactggtcgtgctggcaagaaaggtgttgcacatacctttttcactcaagcgaacaaggcacttgctggtgaacttgtgaatgttttgcgggaggctgatcaggttgttcctccagcccttatgaaatttggcacacatgtcaagaaaaaggaatctaagttatatggatctcatttcaaggaaatcacagcagatgctcctaaatccacgaagatcacatttggtgattctgatgaggactga

SEQ ID NO: 9922 - protein, 512 aa, Sorghum bicolor
  misc_feature: Ceres ANNOT ID no. 6108349
  misc_feature (116)..(289): Pfam Id: DEAD Pfam Desc: DEAD/DEAH box helicase
  misc_feature (361)..(437): Pfam Id: Helicase_C Pfam Desc: Helicase conserved C-terminal domain
  misc_feature (105)..(512): NCBI GI: 32352202 NCBI Desc: rna helicase [oryza sativa (japonica cultivar-group)]
  misc_feature (105)..(512): NCBI GI: 3775989 NCBI Desc: rna helicase [arabidopsis thaliana]
  misc_feature (14)..(506): NCBI GI: 74659944 NCBI Desc: atp-dependent rna helicase dbp3
  misc_feature (18)..(506): NCBI GI: 74693084 NCBI Desc: atp-dependent rna helicase dbp3
  misc_feature (18)..(506): NCBI GI: 44984326 NCBI Desc: afl080wp [eremothecium gossypii]
MGRNLDAEQAEAPRSSKKEKKSKKDKKRKLAAEAEEAAAAAVTATEETVKSIKKKKLVENGAGAGGGGEAENGAEKTVAVTGKGSEDPKYAPLRSFSAAELPSQVLDCCSAFARPSPIQAHAWPFLLDGRDFIGIAATGSGKTIAFGVPALMHIRKKVGGKAVKKAVPRCLVLSPTRELAQQIADVLSEAGAPCGIKSVCLYGGTKKEPQISALKSGVDIVIGTPGRMKDLIEMGVCRLNEVSFVVLDEADRMLDMGFEPEVRAILSQTSSVRQMVMFSATWPLAVHKLAQEFMDPNPIKVVIGSEDLAANHDVMQIVEVLDDRTRDSRLLALLDKYHQAQSNRVLVFVLYKKEAARVETMLQRRGWKAVSVHGDKAQHDRTKALSLFKEGKCPLMIATDVASRGLDIPDVEVVINYSYPLTTEDYVHRIGRTGRAGKKGVAHTFFTQANKALAGELVNVLREADQVVPPALMKFGTHVKKKESKLYGSHFKEITADAPKSTKITFGDSDED

SEQ ID NO: 9923 - DNA, 981 bp, Sorghum bicolor
  misc_feature: Ceres ANNOT ID no. 6108353
  misc_feature: Encodes the peptide sequence at SEQ ID NO 9924
atggcctccgacgcgaggctctccttaccgtgccgcctgccctcgctcctccctccgccggtgctgctgcgccggttgccccgcgccgccgccgccgcggcggcgtcaacctccccgcggtgccgcgtcgccagtacggcggcggcggcgcctgcccgcgcccgcggccggttccggcctcgcgcctccgaggttgaagggcagggcccggtgcagcagcagcagcaggtggaagatgaggtggtggacagcaacgtgctccagtactgcagcatcgaccgcaagaagaagaagaccatcggggagatggagcaggagtttctccaggcgctgcagaaggcgatcatgtccaacgaggagttcgataacctcaaggaggagctcatgtgggaaggaagcagcgttgtgatgttaagcgcagatgagcaaaagcttttggaagcctccatggcatatgtctctggcaaccccatcatgacggatcaagaattcgatgaactaaagctgagacttaagaaagaaggaagtgacattgtaacggaaggtccaagatgcagtctacggagtcgaaaggtctacagtgacttgactgttgactacttcaagatgttgctgctatatgttccagcagctgtggtagctctgacactattcttcttcttggatgatttgacgggatttgaaatcacacttcttcttgagttgccagagcctttcagtttcatcttcacatggtttgctgcactgcctttaatattttgggtagcacaggcattcaccaatgtcatagtgaaagactttctgattttgaagggcccatgtccaaactgtgggactgaaaatctttccttcttcgggaccattttatcagtgtctagcggtggttcaacaaacagtgtgaaatgtgcaagttgtggcactgtcttggagtatgactctgcatcccgattgattacactcccagaaccggctgaggcataa

SEQ ID NO: 9924 - protein, 326 aa, Sorghum bicolor
  misc_feature: Ceres ANNOT ID no. 6108353
  misc_feature: Useful for making plants with modulated nitrogen use efficiency
  misc_feature: GREAT-hit functional homolog of the protein sequence given in SEQ ID NO 12993
  misc_feature: Useful for making plants with modulated nitrogen use efficiency
  misc_feature: Functional homolog of the protein sequence given in SEQ ID NO 12993
MASDARLSLPCRLPSLLPPPVLLRRLPRAAAAAAASTSPRCRVASTAAAAPARARGRFRPRASEVEGQGPVQQQQQVEDEVVDSNVLQYCSIDRKKKKTIGEMEQEFLQALQKAIMSNEEFDNLKEELMWEGSSVVMLSADEQKLLEASMAYVSGNPIMTDQEFDELKLRLKKEGSDIVTEGPRCSLRSRKVYSDLTVDYFKMLLLYVPAAVVALTLFFFLDDLTGFEITLLLELPEPFSFIFTWFAALPLIFWVAQAFTNVIVKDFLILKGPCPNCGTENLSFFGTILSVSSGGSTNSVKCASCGTVLEYDSASRLITLPEPAEA

SEQ ID NO: 9925 - DNA, 1998 bp, Sorghum bicolor
  misc_feature: Ceres ANNOT ID no. 6108355
  misc_feature: Encodes the peptide sequence at SEQ ID NO 9926
atgagcatggaggaggtcctgcggagggaggtggagctggtgcacccctggcctgaatggatcgaactgatggagcggcttgctcagcagaggtacttcgacctcggccgggcctgtggtgccgatgagagctccatggccgccgcggtgcccttggacctatcagaggtcagtgaggaggcagggttcgacttctccagagactggactactgtcaagaacgcctgcatgaactttggccgagaccggttcgacatcctcaagtcattgcctaggaaggatcttcagatattggtcggccatgggtgccctagcttggatgcaaaagtcgtgttttcggcaaaactgataagaaaacgtgtccatcttgatgagggcgatgtatgtagttcttgtaatttacgaactgtatgcacgaggggctatatccttacacgtaaagaagatgaagctcggactcttgatgttatgcgcattttgttgatctatggttttgatcacataaaggaaactgtagagaacaaacctcttctcaaattaaaatctttgaagactgttgttcggaaattaatacatgagattgtaaagttgagtgctgttcctattgatcctaatctcccaccccctataataaagaagcctcctcctaaagtgaagcaaccacctcccccaccaaagaagcgagtgggacgtgatgatgttgagatgaagaaaggagattggctctgccctaagtgtgatttcatgaattttgcaaaaaacactgtttgcttgcagtgtgatgctaagcgtccgaaaaggcaactcctccctggagagtgggaatgccctcggtgcaatttcttgaactataggcggaatatctcatgtttccattgtgaacatgaccgtcctgcagatgagtactccaacagccaaatggaagcaaagcaatctgcactgcggaaaagattggaaagacctccacgcaagtccgatgtttctagtgcatggaactttgattttgatgataacgagtcagatggtgcagatgttgctgcatttgagtttgctgattcatctaaggcgagggagagctcatcagctgacatgtcttatagaggcgcttctaaggtctctgaggatgaggaatatagaatggctgagacaatgactacaggacgaggggataagttctcagaaagagagagcttgccatcttcaagaaatggttttgatgattttgatgatgaagaggatgacattgatagttatgaacttgacttgtcaaaaggtagtcagacaggtggagtgtcaaggatgagttattcagatcttgaaagtgcttctgattcagaaggttttagtgagattgataatagtagagagtccagatatgacaatagtagagagtccagatatgataataatagagagtccagatatgcagccaaggatgaggatgaatttgaggatcacccttcccttagatcgactcatcttgctgattcctggcataaaaccagaggtcagagtggttcaaataactatagaagggcatctttcggatcagagagtgatgatgggatcaattctgatctggatgaggatatcgacaaagattttagaaataatggaagccgtagtcagggaagtcctaacagagcttctgttaggcacaatgcacttgcctacagtgatgatgaaccattttctgatgatgtggattctggtatggttgatcggttccagtctacacggaccaagtcttccatgaacatcaaggataacttcggtgacactagacataatttgaatggaagacggtctagtgggcactgttatggtagaacagaacggaatgaacggttcaacgattttgatatgcaccgtggcagttcagtctcggataagagtcgcagagctaggggtaatcagttagatagtggttcaagaggtttacaaagaaatgtaagaagaaattgggatagaagtggtggctttgacggcaggcactga

SEQ ID NO: 9926 - protein, 665 aa, Sorghum bicolor
  misc_feature: Ceres ANNOT ID no. 6108355
  misc_feature (237)..(266): Pfam Id: zf-RanBP Pfam Desc: Zn-finger in Ran binding protein and others
  misc_feature (1)..(653): NCBI GI: 34393925 NCBI Desc: arp protein-like [oryza sativa (japonica cultivar-group)]
  misc_feature (5)..(663): NCBI GI: 92891175 NCBI Desc: zinc finger, ranbp2-type [medicago truncatula]
  misc_feature (66)..(298): NCBI GI: 18409643 NCBI Desc: zinc finger (ran-binding) family protein [arabidopsis thaliana]
  misc_feature (68)..(298): NCBI GI: 91176378 NCBI Desc: zinc finger, ranbp2-type [medicago truncatula]
  misc_feature (149)..(488): NCBI GI: 18700082 NCBI Desc: at5g17790/mva3_140 [arabidopsis thaliana]
MSMEEVLRREVELVHPWPEWIELMERLAQQRYFDLGRACGADESSMAAAVPLDLSEVSEEAGFDFSRDWTTVKNACMNFGRDRFDILKSLPRKDLQILVGHGCPSLDAKVVFSAKLIRKRVHLDEGDVCSSCNLRTVCTRGYILTRKEDEARTLDVMRILLIYGFDHIKETVENKPLLKLKSLKTVVRKLIHEIVKLSAVPIDPNLPPPIIKKPPPKVKQPPPPPKKRVGRDDVEMKKGDWLCPKCDFMNFAKNTVCLQCDAKRPKRQLLPGEWECPRCNFLNYRRNISCFHCEHDRPADEYSNSQMEAKQSALRKRLERPPRKSDVSSAWNFDFDDNESDGADVAAFEFADSSKARESSSADMSYRGASKVSEDEEYRMAETMTTGRGDKFSERESLPSSRNGFDDFDDEEDDIDSYELDLSKGSQTGGVSRMSYSDLESASDSEGFSEIDNSRESRYDNSRESRYDNNRESRYAAKDEDEFEDHPSLRSTHLADSWHKTRGQSGSNNYRRASFGSESDDGINSDLDEDIDKDFRNNGSRSQGSPNRASVRHNALAYSDDEPFSDDVDSGMVDRFQSTRTKSSMNIKDNFGDTRHNLNGRRSSGHCYGRTERNERFNDFDMHRGSSVSDKSRRARGNQLDSGSRGLQRNVRRNWDRSGGFDGRH

SEQ ID NO: 9927 - DNA, 3042 bp, Sorghum bicolor
  misc_feature: Ceres ANNOT ID no. 6108375
  misc_feature: Encodes the peptide sequence at SEQ ID NO 9928
atggagtgcaacaaggaggaagcttcaagagctaaggatttagctgtggtaaagctgcaagaagcagactatgctggtgctaaaaggattgccctcaaggctcaaaagcttttccctggccttgaaaatatttctcagctgttaactgtctgtgaagttcacatctgtgctgctgttaagatcaatggggagactgactggtatggtatccttcaagtagaaacaactgcagatgacatgttactcaagaaacaataccgcaaacttgctctcttactccatcctgataagaacaagtttgtgggtgctgaagctgcctttaagctaattggagaagctcacatgatactgacagataaagtaaaccgttcgcgtcatgactcaaaaaggaactcatttattccaaaatctgcaccaaagaagcgtggacgaccatcaaacaaaactgactatgttgctaagagggccaataaggagaacactgatgctggacattcaactttctggaccatttgcttgacttgtggaaccaaataccagtatccatatagtttgttgatgaaagttctctggtgccagatctgctcaaagggtttccttgcttatgatttttcagagccaaagaatgtggtaaactctcatccacggggtggatctggtatgcaacaggaaatgtgtcctccgaatgaacccacacatgtatctgaccaaaaactctactatcaaagggcccctggatcaaagaatgtagtgagttctcaaggggcagattttctgaacaataatgcaactgcaaatagtaaccttacagctgaagctggggcttgtagtagagaaaagattacaaaaaaaccatcattcagtgttgaaaatggtgaagatagaactaaatcaccagctgagagttctgataaagttcatctagtaaatgagcaaatgaaaggaaatgaggtagctacaggatccagtcatgccataaatggtagccaggttgctacgaaagatgttcttactgccacaagtgcagataaaacactcgggcagcatccttgtacagcaaggcagcagagaaataatgtaattgttgaagatgggtctgatgggtgtggaaaggttagtgatcatcttcctgattctcctggaaagaaaaggataagaaaagaacattcttcctatactggtggcaaaagtgaccatacaacagaaaatgaagttgctgaagcaaacagccaacacaaatatagtattccaagcaaagagaagatgacaaatcaaaaagaagaaatgatcagtggcttaaatgacaatgtgttgcaaggaacaaaaagaaaacaacaatctacaagttctggaattggaagcgatgctgctgctagatctgtgaacaatagttgtcccagcaacgctacagtttcatgtccagattcagacttctacgactttgagaaaaacagggatgcagatcgattcacagttgatcagatatgggcaatttatgatgatcttgatggcatgccaagatactatgctcgaattaagcaggtttactctccaaactttatgttgcagtacacatggctagagcatgatcctttgtgtgatgctgagaaggaatggtcttctaaggagctgcctgttgcttgtggaaatttcagacttggaaccacactcttgactgaagatatcaagatgttttctcatgttgtttcttggacaaaaggaaggaagaggaacagatatgagatttatcctaagaaaggtgaagtttgggcacttttcaggggatgggacatcaagtggagttcagattccgatgatcataggcattatgattatgatattgttgaaatcacctcagactttgctacgggtttaggcacttatgtggttcccttggtaaagattaaaggttttgtcagcttatttgttcgatcaagcatcgaagcaccatttctgatacctagtggcaacacccttagtttctcgcacagcatcccttttcacaggttggcagaaactgagaggaaacacatcccaaatggtgctcttgagctggatactgcatcactaccttctgatttggacaaagcgtttactcctgtgaaccttgacagcagttttatgagcaccggagatggtaacactacatgtaacgtttcatctactagatcttgtaaagtgccagttggaaagaccgaacagagtcaggatggtactggtacagatgtgaaggatgaagttgagaaattgaatcagaatacaaagattgaacaagataatggctcagaggcttcagtgattgatcattgtggtgatgggtggaatgatagctctccaccagaatcaccgactagcttttgttaccctgatacagagttttgcaacttcactagtttcagatcatttgacaaattcaagaaagggcaagtttgggcactgtattgtgatactgacaagttcccaaagtactatggtttaataaagagcgtcgattcagaagactgcagaattcgcataaagtggcttgagcactgtccatgtgaacaagtggagaagcgcttggcacaagacggtttgtctattggctgtggaatatttgaagtcagcaggcaaagtgaaatctatgattgtacagaagtcttctctcacaatatggaggtgatgctgacgggtaaagggaaaaaatatgaaatccttccttgtactggccaggtatgggctatatacaaggactggagcagtgcatggagctttgaagattacagtagatgtgaatattttctggtcgaggtcatggagatttctaatgttaatataacagtgtcctgtcttacaaaagtggatggctttagcacagtattcatgccagagcagaaaggtgaatccaggagttccatgagaatagcaaggagtgacttgattatgttttctcatcaggttcctgccttccgcttgacaaatgaaaatgactatctttgtggttactgggaacttgatcctgcatcactaccagaagttttactggtcagaaaaaccaagtga

SEQ ID NO: 9928 - protein, 1013 aa, Sorghum bicolor
  misc_feature: Ceres ANNOT ID no. 6108375
  misc_feature (66)..(127): Pfam Id: DnaJ Pfam Desc: DnaJ domain
  misc_feature (376)..(705): NCBI GI: 54290766 NCBI Desc: dnaj heat shock n-terminal domain-containing protein-like [oryza sativa (japonica cultivar-group)]
  misc_feature (1)..(777): NCBI GI: 102139803 NCBI Desc: heat shock protein dnaj n-terminal domain-containing protein [musa acuminata]
  misc_feature (447)..(900): NCBI GI: 115485995 NCBI Desc: os11g0578100 [oryza sativa (japonica cultivar-group)]
  misc_feature (365)..(1008): NCBI GI: 140062656 NCBI Desc: heat shock protein dnaj [medicago truncatula]
  misc_feature (1)..(793): NCBI GI: 124360144 NCBI Desc: heat shock protein dnaj [medicago truncatula]
MECNKEEASRAKDLAVVKLQEADYAGAKRIALKAQKLFPGLENISQLLTVCEVHICAAVKINGETDWYGILQVETTADDMLLKKQYRKLALLLHPDKNKFVGAEAAFKLIGEAHMILTDKVNRSRHDSKRNSFIPKSAPKKRGRPSNKTDYVAKRANKENTDAGHSTFWTICLTCGTKYQYPYSLLMKVLWCQICSKGFLAYDFSEPKNVVNSHPRGGSGMQQEMCPPNEPTHVSDQKLYYQRAPGSKNVVSSQGADFLNNNATANSNLTAEAGACSREKITKKPSFSVENGEDRTKSPAESSDKVHLVNEQMKGNEVATGSSHAINGSQVATKDVLTATSADKTLGQHPCTARQQRNNVIVEDGSDGCGKVSDHLPDSPGKKRIRKEHSSYTGGKSDHTTENEVAEANSQHKYSIPSKEKMTNQKEEMISGLNDNVLQGTKRKQQSTSSGIGSDAAARSVNNSCPSNATVSCPDSDFYDFEKNRDADRFTVDQIWAIYDDLDGMPRYYARIKQVYSPNFMLQYTWLEHDPLCDAEKEWSSKELPVACGNFRLGTTLLTEDIKMFSHVVSWTKGRKRNRYEIYPKKGEVWALFRGWDIKWSSDSDDHRHYDYDIVEITSDFATGLGTYVVPLVKIKGFVSLFVRSSIEAPFLIPSGNTLSFSHSIPFHRLAETERKHIPNGALELDTASLPSDLDKAFTPVNLDSSFMSTGDGNTTCNVSSTRSCKVPVGKTEQSQDGTGTDVKDEVEKLNQNTKIEQDNGSEASVIDHCGDGWNDSSPPESPTSFCYPDTEFCNFTSFRSFDKFKKGQVWALYCDTDKFPKYYGLIKSVDSEDCRIRIKWLEHCPCEQVEKRLAQDGLSIGCGIFEVSRQSEIYDCTEVFSHNMEVMLTGKGKKYEILPCTGQVWAIYKDWSSAWSFEDYSRCEYFLVEVMEISNVNITVSCLTKVDGFSTVFMPEQKGESRSSMRIARSDLIMFSHQVPAFRLTNENDYLCGYWELDPASLPEVLLVRKTK

SEQ ID NO: 9929 - DNA, 966 bp, Sorghum bicolor
  misc_feature: Ceres ANNOT ID no. 6108386
  misc_feature: Encodes the peptide sequence at SEQ ID NO 9930
atggaggccgaggcggcggccaagagggcgcgggagagcggggaggacgccgccgcgggtgcgggtgcgggggccgaggctgcggcagccggggccggcgagcaggcggggatctccgccgtcatcccgggatggttctccgagattagccccatgtggcctggtgaggcgcactctttaaaggtggagaaggtgctgttccaagggaaatcagactaccaaaatgtgatggtttttcagtcctctacgtacgggaaggtgctcgtcctcgatggggttattcaggtgacagagagggatgagtgtgcctaccaagagatgattactcacctgcccctttgctccatcaaagatcccaagaaggtgttggttattggagggggtgatggtggtgttctgcgtgaggtttcaaggcattcctctgtggaacaaattgacatctgtgaaattgacaagatggtggtagatgtctccaagcaatttttccctcatctagctgttggatttgaagaccctcgtgtgtcattacacattggagatggtgtcgcctttttgaaaaatgctccagagggtacatatgatgcagtaattgtggattcatctgatccgataggtcctgctcaggagctttttgaaaagcctttcttccagtcggtggccagagctttgcgtcctggtggagttgtatgcacccaggcagagagcatatggttacatatttttcaaggctcggttaactatgcttggacaacagtacctacataccctagcggagttattgggttcatgctttgctccactgaagggccagctgttgatttccagcaccctgttttcaacattgaggaggatgaacattctacaaaagcaaagggaccccttaagttctacaactcggagatccacacagcatcattctgtttgccctcttttgcaaagagggtaattgagtcaaaggcgaactga

SEQ ID NO: 9930 - protein, 321 aa, Sorghum bicolor
  misc_feature: Ceres ANNOT ID no. 6108386
  misc_feature (44)..(276): Pfam Id: Spermine_synth Pfam Desc: Spermine/spermidine synthase
  misc_feature (1)..(321): NCBI GI: 115471679 NCBI Desc: os07g0408700 [oryza sativa (japonica cultivar-group)]
  misc_feature (1)..(321): NCBI GI: 12229998 NCBI Desc: spermidine synthase 1 (putrescine aminopropyltransferase 1) (spdsy 1)
  misc_feature (31)..(320): NCBI GI: 6094330 NCBI Desc: spermidine synthase 2 (putrescine aminopropyltransferase 2) (spdsy 2)
  misc_feature (34)..(319): NCBI GI: 1561577 NCBI Desc: spermidine synthase 1 [datura stramonium]
  misc_feature (3)..(321): NCBI GI: 126153731 NCBI Desc: spermidine synthase [lotus japonicus]
  misc_feature (1)..(321): SWISSPROT Homolog: EC 2.5.1.16 Spermidine synthase 1
  misc_feature (34)..(318): SWISSPROT Homolog: EC 2.1.1.53 Putrescine N-methyltransferase 1
MEAEAAAKRARESGEDAAAGAGAGAEAAAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQSVARALRPGGVVCTQAESIWLHIFQGSVNYAWTTVPTYPSGVIGFMLCSTEGPAVDFQHPVFNIEEDEHSTKAKGPLKFYNSEIHTASFCLPSFAKRVIESKAN

SEQ ID NO: 9931 - DNA, 1626 bp, Sorghum bicolor
  misc_feature: Ceres ANNOT ID no. 6108470
  misc_feature: Encodes the peptide sequence at SEQ ID NO 9932
atggcgctggagaagctgcacgcgctgcacgcgctggacgtcgcggagacgcagcggtaccacgtccgcgcggtggtcatcgccggcatgggcttcttcgccgacgcgtacgacctcttctgcatcaccctggtgaccaagctcctgggccgcatctactaccacgtcccggggcgcggggagcccgggaggatcccgcccaggctggaggccgccatcgccggcgtcaccttctgcggcatggtcgtggggcagctcctcttcggctggctcggcgacaaggtcggccgcaagaagttctacggcaagaccatcatgctcatgatcctgggctccttcctgtccggcctctccttcggcagcaccgccggcggcgtcatggccacgctctgcttcttccgcttctggctcggcgtcggcatcggcggcgactacccgctctccgccaccatcatgtccgagtacgccaacaagcgcaccaggggcagcttcgtcgccgccgtcttcgccatggaaggcctcggcgtcctcgccggctgcattgtcacgctcgtcgtctcggccacgttccaggcgcgcttcgccgcgccggcgtacgaggaggaccccgcggcgtccaccccgccgcaggccgactacgcgtggcggatcgtcctcatggtcggcgccatcccggcctgcttcacctaccactggcggatgcggatgccggagacggcgcgctacacggcgctggtggcccgcgacgccgacaaggccgcgcgcgacatgtccagggtgctggaggtggacgtcacgggcgagccggacaaggtggagagcatcgccagggacaggggcgactacggcgtcttctcccgccgcttcgcccgccgccacggcgcgcacctcgccggcgccgtcgcctgctggttcgtgctggacgtcgtcttctactcccagaacatcctccaggagaagatcttcagcgacgtcaagtgggtcgcaagggcgcgcaccatgagcgccctcgaggagacctaccgcgtcggccgcgcgcacgccatcatcgcgctctgcggcaccctgccgggctactggttcaccgtcgccttcgtcgacgtcgtcggccgcaaggccatccagttcctgggcttcgccatgatgatgggcttcatgctcgtcatcgccgccttctacgacagcctcatcagccccgggcggaggatatggctggtgctcatgtacaccttcaccttcttcttcgccaacttcgggcccaacagcaccaccttcatcctgccggcggagatcttcccggcgcacctgcgcacgacgtgccacgggatatcggccgcggccgggaaggtcggcgccatcgtcgggacgttcgggttcatgtacgcgggtcaaaaggcggacggcagcgaggccaatgagactgggtacccgtcgggcatcggcgtgcgcgcctccctgttcgtgctcgccgcgtccaactcgctggggatactcttcacctgcttcctaccggagccaatggggcggtcgctggaggaggtgtccggcgaagacggcgagtacacgaacacgagcacgagcagagatgacgctgacgtgggagactcccagattatcccgctgtag

SEQ ID NO: 9932 - protein, 541 aa, Sorghum bicolor
  misc_feature: Ceres ANNOT ID no. 6108470
  misc_feature (28)..(456): Pfam Id: MFS_1 Pfam Desc: Major Facilitator Superfamily
  misc_feature (24)..(518): Pfam Id: Sugar_tr Pfam Desc: Sugar (and other) transporter
  misc_feature (1)..(541): NCBI GI: 37778562 NCBI Desc: phosphate transporter hvpt8 [hordeum vulgare subsp. vulgare]
  misc_feature (1)..(541): NCBI GI: 60677367 NCBI Desc: phosphate transporter [triticum aestivum]
  misc_feature (6)..(540): NCBI GI: 65335848 NCBI Desc: inorganic phosphate transporter 1 [zea mays]
  misc_feature (6)..(517): NCBI GI: 49066604 NCBI Desc: phosphate transport protein [zea mays]
  misc_feature (6)..(517): NCBI GI: 65335863 NCBI Desc: inorganic phosphate transporter 2 [zea mays]
  misc_feature: Useful for making plants with modulated phosphate use efficiency
  misc_feature: Functional homolog of the protein sequence given in SEQ ID NO 13399
  misc_feature: Functional homolog of the protein sequence given in SEQ ID NO 13403
  misc_feature: Useful for making plants with modulated phosphate use efficiency
  misc_feature: Functional homolog of the protein sequence given in SEQ ID NO 13399
  misc_feature: Useful for making plants with modulated carbohydrate content
  misc_feature: Functional homolog of the protein sequence given in SEQ ID NO 13408
  misc_feature: The sequence is a functional homolog of SEQ ID NO. 296 in the 11/188,298 US application
  misc_feature: The sequence is a functional homolog of SEQ ID NO. 331 in the 11/188,298 US application
MALEKLHALHALDVAETQRYHVRAVVIAGMGFFADAYDLFCITLVTKLLGRIYYHVPGRGEPGRIPPRLEAAIAGVTFCGMVVGQLLFGWLGDKVGRKKFYGKTIMLMILGSFLSGLSFGSTAGGVMATLCFFRFWLGVGIGGDYPLSATIMSEYANKRTRGSFVAAVFAMEGLGVLAGCIVTLVVSATFQARFAAPAYEEDPAASTPPQADYAWRIVLMVGAIPACFTYHWRMRMPETARYTALVARDADKAARDMSRVLEVDVTGEPDKVESIARDRGDYGVFSRRFARRHGAHLAGAVACWFVLDVVFYSQNILQEKIFSDVKWVARARTMSALEETYRVGRAHAIIALCGTLPGYWFTVAFVDVVGRKAIQFLGFAMMMGFMLVIAAFYDSLISPGRRIWLVLMYTFTFFFANFGPNSTTFILPAEIFPAHLRTTCHGISAAAGKVGAIVGTFGFMYAGQKADGSEANETGYPSGIGVRASLFVLAASNSLGILFTCFLPEPMGRSLEEVSGEDGEYTNTSTSRDDADVGDSQIIPL

SEQ ID NO: 9933 - DNA, 2940 bp, Sorghum bicolor
  misc_feature: Ceres ANNOT ID no. 6108472
  misc_feature: Encodes the peptide sequence at SEQ ID NO 9934
atggcggcgccgccgagggcgtggaaggcggagtacgccaagtccgggcgggcgtcgtgcaagtcgtgcaagtcccccatcgccaaggaccagctccgtctcggcaagatggttcaggcgtcacagttcgacggcttcatgcccatgtggaaccatgctaggtgcatcttcagtaagaagaaccagataaaatccgtcgatgatgttgaaggaatagatgcacttagatgggatgatcaagagaagataagaaactacattgggagtgcctcagctgctacaagttccacagctgctgctcctgataaatgtactattgagattgctccatctgcccgtacttcatgtagacgatgcagtgaaaagattgcaaaaggatcagtccgtctgtcagctaagcttgagagtcaaggttccaagggtataccatggtatcatgctaactgtttctttgaggtatccccatctgcaactgttgagaagttctcaggctgggatactctgtcagatgaggataagagaaccgtgcttgatcttgttaaaaaagatgtcggtgacaatgaacaaactaagggttccaagcgcaagaagggcgaaaatgatatggatagctgcaaagccgctaggttagatgaaagtacatctgaaggtacagtgcgaaacaaagggaaacttgtggacccatgtgattccaatactagttcagctgatacccaacaaaagcttaaagtgcaaagtgacacactttggaagttaaaggatgaacttaagagccatgtatcggctgctgaattaagggatatgcttgaggctaatgggcaggatatatctggaccagagaggcacctattggaccgctgtgctgatggaatgctatttggagcattgggtccttgcccagtctgtgctagtggcctgtactattataatggtcagtaccaatgcagtggtaatgtgtcagagtggtccaagtgtacatactctaccacagaacctgtccgcattaagaagtggcaagttccagatggaacaaagaatgattaccttatgaagtggttcaagtctcaaaaggttaagaaaccagagagggttcttccaccaatgtcacctgagaaatccggaagtaaagcaactcagagaacgtcatcgctgtcttctaaagggttggacaaattaaggttttctgttgtaggacaatcaaaagaagtggccaatgaatggatcgagaagctcaaacttgctggtgccaacttctatgccagggttgtcaaagatattgattgtttaatttcatgtggtgagctcgacaatgagaatgctgaagtcaggaaagcaaggaggctgaagataccaattgtaagggagggttacattggagaatgcattaaaaagaatagaatgcttccatttgatttgtataaactagagaataccatagagtcctcaaaaggtggtactgtcactgttaaagttaagggtcgaagtgctgttcatgagtcctccggtttgcaagatactgctcatattcttgaagatgggaagagcatttacaatacaaccctaaacatgtctgacctggcactaggtgtgaacagctactatatactccagatcattgaagaggatgatgggtctgagtgctatgtatttcgaaagtggggacgggttgggaatgaaaaaattggagggaaaaagctggaggagatgtcaaaaactgatgcaatcaaggaattcaaaagattatttctggagaagactggaaacccatgggaagcttgggaacgtaaaaccaatttccggaagcagcctgggagattttacccacttgatattgattatggtgttaagcaagcaccaaaacggaaagatatcagtgaaatgaaaagttctcttgctcctcagttgctagaactcatgaagatgcttttcaacgtggagacatatagagctgctatgatggaatttgaaattaatatgtcagaaatgcctcttgggaagctaagcaaggaaaatattcagaaaggctttgaagcattaactgagatacagaatttattgaaggacaccgcggatcaagcactggctgttagagaaagcttaattgttgctgcgagcaatcgctttttcactcttattccttctattcatcctcatattatacgggatgaggatgatttgatgatcaaagcaaaaatgcttgaagctctgcaggatattgaaattgcttcaaagctagttggcttcgatagcgacaatgatgaatctcttgatgataaatatatgaaacttcactgtaacatcaccccgctggatcacgatagtgaagattacaagctaattgagcagtatctcctcaacacacatgctcctactcacaaggactggtcgctggaactggaggaagttttttcactcgatcgagatggagaacttaataaatactcaagatataaaaataatctgcataacaagatgctattatggcatggttcaaggttgacgaattttgtgggaattcttagtcaagggctaagaattgcacctcctgaggcacctgtttcaggctatatgtttggcaaaggcctctactttgcagatttagtaagcaagagcgcacagtattgtaatgtggacaggaataatcctgtaggtttgatgattctttctgaggttgctttaggagacatgaatgaactaaagaaagccacgtacatggacaaacctccaagagggaagcattcgaccaaaggtttaggcaaaactgtgccactggagtcagagtttgtgaagtggagggatgatgtcgtcgttccctgtggcaagccagtgccatcatcaattaggagctctgaactcatgtacaatgagtacatcgtctacaacacatcccaggtaaagatgcagttcttgctgaaggtgcgtttccatcacaagaggtga

SEQ ID NO: 9934 - protein, 979 aa, Sorghum bicolor
  misc_feature: Ceres ANNOT ID no. 6108472
  misc_feature (763)..(975): Pfam Id: PARP Pfam Desc: Poly(ADP-ribose) polymerase catalytic domain
  misc_feature (11)..(88): Pfam Id: zf-PARP Pfam Desc: Poly(ADP-ribose) polymerase and DNA-Ligase Zn-finger region
  misc_feature (107)..(181): Pfam Id: zf-PARP Pfam Desc: Poly(ADP-ribose) polymerase and DNA-Ligase Zn-finger region
  misc_feature (512)..(600): Pfam Id: WGR Pfam Desc: WGR domain
  misc_feature (283)..(336): Pfam Id: PADR1 Pfam Desc: PADR1 (NUC008) domain
  misc_feature (628)..(761): Pfam Id: PARP_reg Pfam Desc: Poly(ADP-ribose) polymerase, regulatory domain
  misc_feature (384)..(462): Pfam Id: BRCT Pfam Desc: BRCA1 C Terminus (BRCT) domain
  misc_feature (1)..(979): NCBI GI: 3928871 NCBI Desc: poly(adp)-ribose polymerase [zea mays]
  misc_feature (1)..(979): NCBI GI: 2632129 NCBI Desc: poly(adp-ribose) polymerase [zea mays]
  misc_feature (1)..(979): NCBI GI: 75139007 NCBI Desc: poly [adp-ribose] polymerase 1 (parp-1) (adprt 1) (nad(+) adp-ribosyltransferase 1) (poly[adp-ribose] synthetase 1)
  misc_feature (459)..(978): NCBI GI: 3220000 NCBI Desc: poly [adp-ribose] polymerase-1 (parp-1) (adprt) (nad(+) adp-ribosyltransferase-1) (poly[adp-ribose] synthetase-1)
  misc_feature (371)..(965): NCBI GI: 119590191 NCBI Desc: poly (adp-ribose) polymerase family, member 1, isoform cra_b [homo sapiens]
  misc_feature (1)..(979): SWISSPROT Homolog: EC 2.4.2.30 Poly [ADP-ribose] polymerase 1
  misc_feature: Useful for making plants with modulated abiotic stress sensitivity
  misc_feature: Functional homolog of the protein sequence given in SEQ ID NO 14065
MAAPPRAWKAEYAKSGRASCKSCKSPIAKDQLRLGKMVQASQFDGFMPMWNHARCIFSKKNQIKSVDDVEGIDALRWDDQEKIRNYIGSASAATSSTAAAPDKCTIEIAPSARTSCRRCSEKIAKGSVRLSAKLESQGSKGIPWYHANCFFEVSPSATVEKFSGWDTLSDEDKRTVLDLVKKDVGDNEQTKGSKRKKGENDMDSCKAARLDESTSEGTVRNKGKLVDPCDSNTSSADTQQKLKVQSDTLWKLKDELKSHVSAAELRDMLEANGQDISGPERHLLDRCADGMLFGALGPCPVCASGLYYYNGQYQCSGNVSEWSKCTYSTTEPVRIKKWQVPDGTKNDYLMKWFKSQKVKKPERVLPPMSPEKSGSKATQRTSSLSSKGLDKLRFSVVGQSKEVANEWIEKLKLAGANFYARVVKDIDCLISCGELDNENAEVRKARRLKIPIVREGYIGECIKKNRMLPFDLYKLENTIESSKGGTVTVKVKGRSAVHESSGLQDTAHILEDGKSIYNTTLNMSDLALGVNSYYILQIIEEDDGSECYVFRKWGRVGNEKIGGKKLEEMSKTDAIKEFKRLFLEKTGNPWEAWERKTNFRKQPGRFYPLDIDYGVKQAPKRKDISEMKSSLAPQLLELMKMLFNVETYRAAMMEFEINMSEMPLGKLSKENIQKGFEALTEIQNLLKDTADQALAVRESLIVAASNRFFTLIPSIHPHIIRDEDDLMIKAKMLEALQDIEIASKLVGFDSDNDESLDDKYMKLHCNITPLDHDSEDYKLIEQYLLNTHAPTHKDWSLELEEVFSLDRDGELNKYSRYKNNLHNKMLLWHGSRLTNFVGILSQGLRIAPPEAPVSGYMFGKGLYFADLVSKSAQYCNVDRNNPVGLMILSEVALGDMNELKKATYMDKPPRGKHSTKGLGKTVPLESEFVKWRDDVVVPCGKPVPSSIRSSELMYNEYIVYNTSQVKMQFLLKVRFHHKR

SEQ ID NO: 9935 - DNA, 996 bp, Sorghum bicolor
  misc_feature: Ceres ANNOT ID no. 6108476
  misc_feature: Encodes the peptide sequence at SEQ ID NO 9936
atggaagtggaagaagcaggagaattggagaccgccggcaaggacgtggcggaggcggagtaccattcgcacgacttcgagtgggaggaactcaaggaggaggtggaatctggacctgccttctcctaccacctctccccttttcccgagcccgccgcgagtaccacctcgccgccgcagctctcgtcggaggcctggagaagcttccaccgtcgccacgcgtccggaaagttcttcaaggaaaggaggtatttgcttaaggaatttcctgaactttgtagcagcaaagatcatgctaaggtcttagaagtggggtgtgggaatggaagcactgctgtttccattctacggtctagtgaaaggatcactgtctttgcttgtgactgtagtaaagacactcttgagagggcaaatgaaattatatccaacacaaaagggattgatatcaaggataggttccacccctttttaatggatgtttctaaagaaactttcccagattggttattctgcaaagcctgtcaatgttcgctgggaaaagatgctgcacttttacttgatccaagtcaccatggaattagaaaagagcacccagtcttccttagagagaaccaatgttgtgctggtggcatggattttattaccatgatattcacactgtcagccatacccttcgacataatgccaactactatagaacaatgtgtttctgttctgaaaccaggcggccttcttctgtttagggattacggtctttacgacatgacaatgcttcggtttttacctcatcaaagagtagggtttcgggaatatatgcgatcagatggtaccttttcatatttcttctcattggatactgtgagagaactctttcatgctgctgggttagtagagttggagctggaatactgctgtgtcaagtccgtgaaccgaaagaaagggaagacgatgcagcgggtatgggtgcatggcaaattccaaaaaccacctacctga

SEQ ID NO: 9936 - protein, 331 aa, Sorghum bicolor
  misc_feature: Ceres ANNOT ID no. 6108476
  misc_feature (198)..(331): NCBI GI: 54641515 NCBI Desc: ga12634-pa [drosophila pseudoobscura]
  misc_feature (212)..(329): NCBI GI: 45550523 NCBI Desc: cg13929-pb, isoform b [drosophila melanogaster]
  misc_feature (212)..(329): NCBI GI: 28574997 NCBI Desc: cg13929-pa, isoform a [drosophila melanogaster]
  misc_feature (209)..(329): NCBI GI: 44890548 NCBI Desc: zgc:56175 protein [danio rerio]
  misc_feature (209)..(329): NCBI GI: 34786012 NCBI Desc: bc004636 protein [mus musculus]
MEVEEAGELETAGKDVAEAEYHSHDFEWEELKEEVESGPAFSYHLSPFPEPAASTTSPPQLSSEAWRSFHRRHASGKFFKERRYLLKEFPELCSSKDHAKVLEVGCGNGSTAVSILRSSERITVFACDCSKDTLERANEIISNTKGIDIKDRFHPFLMDVSKETFPDWLFCKACQCSLGKDAALLLDPSHHGIRKEHPVFLRENQCCAGGMDFITMIFTLSAIPFDIMPTTIEQCVSVLKPGGLLLFRDYGLYDMTMLRFLPHQRVGFREYMRSDGTFSYFFSLDTVRELFHAAGLVELELEYCCVKSVNRKKGKTMQRVWVHGKFQKPPT

SEQ ID NO: 9937 - DNA, 312 bp, Sorghum bicolor
  misc_feature: Ceres ANNOT ID no. 6108481
  misc_feature: Encodes the peptide sequence at SEQ ID NO 9938
atggaaggtgggttcaacaagagcggctcaccggaggcggaaggctcgaggcgggcgccagcgggggcctactacgagtgctccttctgcaagagggggttcaccaacgcgcaggcgctcggcggccacatgaacatccaccgcaaggaccgcggatcaggcggcagtaagtcgacggcgccgccgcagcaggacgacgctggcggcggctcgaggacctacggcggcggggacgtgcacctgggcctgtccctggggaggaaggaggatgtggatttggagctcaggcttggcagctatccttataactag

SEQ ID NO: 9938 - protein, 103 aa, Sorghum bicolor
  misc_feature: Ceres ANNOT ID no. 6108481
  misc_feature (25)..(51): NCBI GI: 41016079 NCBI Desc: c2h2-type zinc finger protein [petunia x hybrida]
  misc_feature (25)..(67): NCBI GI: 37514920 NCBI Desc: one finger-type zinc finger protein for rabbit ears [arabidopsis thaliana]
  misc_feature (25)..(74): NCBI GI: 89274212 NCBI Desc: zinc finger (c2h2 type) containing protein [brassica oleracea]
  misc_feature (25)..(62): NCBI GI: 7939521 NCBI Desc: superman-like protein [arabidopsis thaliana]
  misc_feature (25)..(76): NCBI GI: 89257684 NCBI Desc: zinc finger (c2h2 type) containing protein [brassica oleracea]
  misc_feature: The sequence is a functional homolog of SEQ ID NO 10 in the 10/412,699US patent application
  misc_feature: The sequence is a functional homolog of SEQ ID NO 1013 in the 10/666,642US patent application
  misc_feature: The sequence is a functional homolog of SEQ ID NO 124 in the 11/479,226US patent application
  misc_feature: The sequence is a functional homolog of SEQ ID NO 1290 in the 10/666,642US patent application
  misc_feature: The sequence is a functional homolog of SEQ ID NO 1370 in the 10/666,642US patent application
  misc_feature: The sequence is a functional homolog of SEQ ID NO 2246 in the 10/374,780US patent application
  misc_feature: The sequence is a functional homolog of SEQ ID NO 232 in the 10/666,642US patent application
  misc_feature: The sequence is a functional homolog of SEQ ID NO 256 in the 10/714,887US patent application
  misc_feature: The sequence is a functional homolog of SEQ ID NO 256 in the 11/435,388US patent application
  misc_feature: The sequence is a functional homolog of SEQ ID NO 326 in the 10/666,642US patent application
  misc_feature: The sequence is a functional homolog of SEQ ID NO 332 in the 10/666,642US patent application
  misc_feature: The sequence is a functional homolog of SEQ ID NO 624 in the 10/374,780US patent application
  misc_feature: The sequence is a functional homolog of SEQ ID NO 670 in the 10/225,066US patent application
  misc_feature: The sequence is a functional homolog of SEQ ID NO 90 in the 10/412,699US patent application
  misc_feature: The sequence is a functional homolog of SEQ ID NO 904 in the 10/412,699US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 90 in the 20040045049 US patent application
  misc_feature: The sequence is a functional homolog of SEQ ID NO 904 in the 20040045049 US patent application
  misc_feature: The sequence is a functional homolog of SEQ ID NO 624 in the 20060162006 US patent application
  misc_feature: The sequence is a functional homolog of SEQ ID NO 1013 in the 20070033671 US patent application
  misc_feature: The sequence is a functional homolog of SEQ ID NO 326 in the 20070033671 US patent application
  misc_feature: The sequence is a functional homolog of SEQ ID NO 332 in the 20070033671 US patent application
  misc_feature: The sequence is a functional homolog of SEQ ID NO 232 in the 10/666,642 US patent application
  misc_feature: The sequence is a functional homolog of SEQ ID NO 904 in the 10/412,699 US patent application
  misc_feature: The sequence is a functional homolog of SEQ ID NO 332 in the 10/666,642 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MEGGFNKSGSPEAEGSRRAPAGAYYECSFCKRGFTNAQALGGHMNIHRKDRGSGGSKSTAPPQQDDAGGGSRTYGGGDVHLGLSLGRKEDVDLELRLGSYPYN

SEQ ID NO: 9939 - DNA, 939 bp, Sorghum bicolor
  misc_feature: Ceres ANNOT ID no. 6108483
  misc_feature: Encodes the peptide sequence at SEQ ID NO 9940
atggccgtgcggtcccggcctcgccgctccgccggccacctttaccacctccgcctcccaaggctcctcttcctcctcccgctcgctctccttctcatcctcttcctcgggcacctccccgcgctcctccgcggcgccaacgcacacggccgccggtgtctgccagacgccactgaccacctcctccccttctcccaccccttgccggatccccgcctcagcatcgccatcgtcaccctcgccgacgaggacgccggcaggccgggcggacggcggtccttccgcggcgtgctggcggcgtccgcgcggaacaagcgcgcctacgcggaggcgcacgggtatggcctcgtcgtgctccccgcgtccgccgtcgaccccagccgcccgcccagctggagcaaggtcctcgcgctgcgttcccacctccgccaccaccactggctcttctggaacgacgcggacacactggttactaacccagaaatcccactggagaggattttatcctcagtgatcggatacaatgattttgacaagtcacctgatcttgttctaacagaggattttggtggtgtgaatgctggagttttctttttaaggaggtcaaaatggagtgagaagtttttggatacctggtggaaccagacatcgtttatacagttcggttccacgagaagtggagataatgcagcactcaagcatctcatagatcacttatcagctgaagaaatgcaagagcatgttcggatagcaaaaatgcagtgcctcttcaattcctatccatggacccttacattgaaatcggtgcgccgcctgatcttccacctgcccactacatggaaaggggtttattccgatggagactttatggttcattttgctggtctggatgacaagcaaggttggacgaataagattcttagagagagaggaaattga

SEQ ID NO: 9940 - protein, 312 aa, Sorghum bicolor
  misc_feature: Ceres ANNOT ID no. 6108483
  misc_feature (69)..(306): Pfam Id: Glyco_transf_34 Pfam Desc: galactosyl transferase GMA12/MNN10 family
  misc_feature (1)..(310): NCBI GI: 115471739 NCBI Desc: os07g0417800 [oryza sativa (japonica cultivar-group)]
  misc_feature (168)..(220): NCBI GI: 40644059 NCBI Desc: golgi mannosyltransferase complex subunit [kluyveromyces lactis]
  misc_feature (162)..(220): NCBI GI: 951168 NCBI Desc: bed1p
  misc_feature (58)..(169): NCBI GI: 19115744 NCBI Desc: gma12/mnn10 family galactosyltransferase [schizosaccharomyces pombe]
  misc_feature (58)..(169): NCBI GI: 1220281 NCBI Desc: spac22e12.06c [schizosaccharomyces pombe]
  misc_feature: Useful for making plants with altered cell wall content and/or composition
  misc_feature: Functional homolog of the protein sequence encoded by LOCUS at4g37690
MAVRSRPRRSAGHLYHLRLPRLLFLLPLALLLILFLGHLPALLRGANAHGRRCLPDATDHLLPFSHPLPDPRLSIAIVTLADEDAGRPGGRRSFRGVLAASARNKRAYAEAHGYGLVVLPASAVDPSRPPSWSKVLALRSHLRHHHWLFWNDADTLVTNPEIPLERILSSVIGYNDFDKSPDLVLTEDFGGVNAGVFFLRRSKWSEKFLDTWWNQTSFIQFGSTRSGDNAALKHLIDHLSAEEMQEHVRIAKMQCLFNSYPWTLTLKSVRRLIFHLPTTWKGVYSDGDFMVHFAGLDDKQGWTNKILRERGN

SEQ ID NO: 9941 - DNA, 459 bp, Sorghum bicolor
  misc_feature: Ceres ANNOT ID no. 6108558
  misc_feature: Encodes the peptide sequence at SEQ ID NO 9942
atggccagcaccaacatggcgtcggccacctcgcggttcatgctggccgctggcgtgcccaccgccggcagcggcagcggcagcagcggccgcgtcagcttcgcgccggcgcccaaccagctgggcaggaggctcgtggtccgggctgacccggaagctccggctgaaccggcggaaggggagggcgccgtggccaccaagcccaaggccgagaagccgccgccgatcgggcccaagaggggcaccaaggtgaagatcctgaggagggagtcctactggtacaacgggatcggcaacgtcgtcaccgtcgatcaggaccccaacactcgctacccggtggtggtgcggttcaacaaggtgaactacgccggcgtgtccaccaacaactacgccttggacgaggtccaggagatgtttgtccatttttctataaacttgctgaaaattggagaaacatga

SEQ ID NO: 9942 - protein, 152 aa, Sorghum bicolor
  misc_feature: Ceres ANNOT ID no. 6108558
  misc_feature (78)..(139): Pfam Id: PSI_PsaE Pfam Desc: Photosystem I reaction centre subunit IV / PsaE
  misc_feature (1)..(138): NCBI GI: 226163 NCBI Desc: 10.8kd photosystem i protein
  misc_feature (1)..(138): NCBI GI: 2499967 NCBI Desc: photosystem i reaction center subunit iv b, chloroplast precursor (psi-e b)
  misc_feature (1)..(138): NCBI GI: 92889608 NCBI Desc: photosystem i reaction centre subunit iv/psae [medicago truncatula]
  misc_feature (1)..(138): NCBI GI: 2499966 NCBI Desc: photosystem i reaction center subunit iv a, chloroplast precursor (psi-e a)
  misc_feature (1)..(138): NCBI GI: 1217601 NCBI Desc: psi-e subunit of photosystem i [nicotiana sylvestris]
MASTNMASATSRFMLAAGVPTAGSGSGSSGRVSFAPAPNQLGRRLVVRADPEAPAEPAEGEGAVATKPKAEKPPPIGPKRGTKVKILRRESYWYNGIGNVVTVDQDPNTRYPVVVRFNKVNYAGVSTNNYALDEVQEMFVHFSINLLKIGET

SEQ ID NO: 9943 - DNA, 1275 bp, Sorghum bicolor
  misc_feature: Ceres ANNOT ID no. 6108593
  misc_feature: Encodes the peptide sequence at SEQ ID NO 9944
atggcggcagcagcagcagcagcagcagacgcatcatcagcagaagcgccgccgtcgccgccggcggcgagccgggtggtgtgggtgaacgggccgatcgtggtgggcgcggggccagcgggtctctcagtggcggcgtgcctgcgcgcgcgcggggttccctgcgtcgtgcttgaccgcgccgactgcatcgcgtcgctgtggcagcgccgcacctacgaccggctccgcctccacctgcctcgccacttctgcgagctccctggcttgccgttccccgacaactacccggagtaccccaccaagcgccagttcgtcgactacctcaacgcctacgcggagcaagcgggcgtccagccgaggttcaaccaggccgtcacgtcggcgcgctacgacgccgccgcggggttctggagggtgcgcgccgacgacgtcgtcctcgccgaggacgccgccgccgtcgccgccggcgctacgacgacggagtacatcggccgctggctcgtcgtcgccacgggcgagaacgccgagcgcatcgtcccggagtttgagggcgccgaggacttcgccgggcctgtgtcacacgtctccgagtacaagtccggcgaggcctaccgcggcaagcgcgtcctcgtcgtcggctgcggcaactccggcatggaggtctgcctcgacctctgcgaccacaatgccctcccatccatggtcgtcagggacgcggtgcacgtcctgccgcgggagatgttcggcgtcgccaccttctccgtcgccgtcttcctcctccgcttcctgccgctctggctggtggacgccatcctcgtcctcctcgcgcgcctcttcctcggcgacctcgacaagctcggcatccgccgccctgcggggggtccgctcgagctcaagaacaccaggggaaggacccccgtgctggacatcggcgcgctcgcaaggatccgctccggacacatacagatcgtgccggggatcaagaggttgttccgcggcggcgccgagctcgtcgacggccgccgcgtcgctgccgacgccgtcatactggccaccggataccagagcaacgtccctcagtggctcaagggatgtgatttcttcacccaagaagggtacccaagggtgccgttcccacacggctggaagggggagtcagggctctactctgttggcttcaccaggagaggcctctccggcgtctcctccgacgctgtcaaggttgcgcaggacatcgccgtggaatgggagaagcaaacctccacaatatga

SEQ ID NO: 9944 - protein, 424 aa, Sorghum bicolor
  misc_feature: Ceres ANNOT ID no. 6108593
  misc_feature (25)..(421): NCBI GI: 92889602 NCBI Desc: pyridine nucleotide-disulphide oxidoreductase, class i; fad-dependent pyridine nucleotide-disulphide oxidoreductase [medicago truncatula]
  misc_feature (25)..(421): NCBI GI: 3142293 NCBI Desc: contains similarity to myosin ib heavy chain gbx70400 from gallus gallus. [arabidopsis thaliana]
  misc_feature (27)..(419): NCBI GI: 118624210 NCBI Desc: flavin monooxygenase-like protein [solanum lycopersicum]
  misc_feature (27)..(419): NCBI GI: 118624208 NCBI Desc: flavin monooxygenase-like protein [solanum lycopersicum]
  misc_feature (27)..(419): NCBI GI: 15010541 NCBI Desc: flavin monoxygenase-like protein floozy [petunia x hybrida]
MAAAAAAAADASSAEAPPSPPAASRVVWVNGPIVVGAGPAGLSVAACLRARGVPCVVLDRADCIASLWQRRTYDRLRLHLPRHFCELPGLPFPDNYPEYPTKRQFVDYLNAYAEQAGVQPRFNQAVTSARYDAAAGFWRVRADDVVLAEDAAAVAAGATTTEYIGRWLVVATGENAERIVPEFEGAEDFAGPVSHVSEYKSGEAYRGKRVLVVGCGNSGMEVCLDLCDHNALPSMVVRDAVHVLPREMFGVATFSVAVFLLRFLPLWLVDAILVLLARLFLGDLDKLGIRRPAGGPLELKNTRGRTPVLDIGALARIRSGHIQIVPGIKRLFRGGAELVDGRRVAADAVILATGYQSNVPQWLKGCDFFTQEGYPRVPFPHGWKGESGLYSVGFTRRGLSGVSSDAVKVAQDIAVEWEKQTSTI

SEQ ID NO: 9945 - DNA, 3186 bp, Sorghum bicolor
  misc_feature: Ceres ANNOT ID no. 6108624
  misc_feature: Encodes the peptide sequence at SEQ ID NO 9946
atgggtaagggagggcaggacgaaggcaagcggcgggacggatccgccgcctccgggccggaccccgccgagccggccttcccggcgtgggcgcgcaccccgagcgagtgcctcgcggagctgggcgtctcggcggaccgcggcctcagctccgaggaggcggcggcgcggctgcagcgatacgggcccaacgagctcgagcggcacgccccgccgtcggtctggaagctcgtcctcgagcagtttaacgacacgctcgtgcgcatcctgctcctggcggccgtggtctccttcgtgctcgcgctctacgacggcgcagaaggcggcgaggtcggggtcaccgctttcgtcgagccgctcgtcatcttccttatcctcatcgtcaacgccgtcgtcggcgtctggcaggagagcaacgccgagaaggcgctcgaggcgctcaaggagattcagtcggagcacgcaaccgtcaagcgtgatgggcggtggtcgcatggcctccccgcgcgcgacctcgtccccggggacatcgtcgagctccgggtcggggacaaggtccccgcggacatgcgcgtgctccagctcatcagctctaccctccgcgtcgagcagggatctctcaccggcgagaccgcttctgttaataagaccagccacaagatcgagttggaggatactgacatccagggaaaggagtgcatggttttcgccggtaccactgttgtcaacggcagtgctgtctgtgttgtgacgggcactggcatggccaccgaaattggcaagatccatgcgcagatccaggaggcatctcaggaggaggacgacacgccactgaagaagaagctcaatgagtttggtgaggcgctaactgccataattggggtgatctgtgccttggtctggctcatcaacttgaagtatttcctttcctgggagtatgttgacgggtggcctaggaatttcaaattctcatttgagaagtgcacatattactttgagattgcagtggcactggccgttgcagcaattccagagggcttgcctgctgtgatcaccacgtgcttggcactcggcacaaggaagatggcccagaagaatgcccttgtgaggaagctgcccagtgtggaaacattgggttgtacaactgtcatttgctctgataagaccggaactttgaccacgaaccagatgtcagcagtgaagcttgtggcaattgggaggtggcctgatacacttaggagctttaaggttgatggaaccacttacgatccaactgatgggaagatacacgattggccaagcttgagcatggatgaaaatctccagatgatcgcaaagattgctgcggtttgcaatgatgcaagcattgcccactccgagcatcagtatgttgctactggtatgcccaccgaagctgctctgaaggttttagttgagaaaatggggcttcctggtggttatactccatctctggattcatctgatttgctaaggtgctgtcaatggtggaacaatgctgctaagagagtagcaactctggaatttgatcgcaccagaaagtcaatgggagttattgtgaaagtaaactctgggaagaacttgctgcttgttaagggagcagtagagaatctgctagagagatgtacccacattcagttgctcgatggatctgttgtgctattggatgatggtgcgaaggcgctaatattatctacactccgtgacatgtctgccagtgctttgcgctgtttgggttttgcttacaaggaagaattggcagaatttgcaacatatgatggtgaagaacatgcagctcacaagtatctgcttgatccttcatactactcttccatagagagtaatatgatcttttgtggttttgttggtctaagggatcctccccgagaagaagtccacagagcaattgaagattgcagagctgctggaatacgtgttatggtgataacaggagataacaaagaaacagcagaggccatttgccgtgagattggggtttttggccctcatgaagatatcagttcaaaaagcttcacagggaaggaattcatggcgctttctgataaaaagaagctcttaaggcaacagggtggccttctcttctccagggcagaaccaaaacacaagcaggagatagttagactgctcaaagaagacggtgaagtggttgccatgactggtgatggcgtgaatgatgcgccagctcttaaactggctgatattggagttgcaatgggcattacagggactgaggttgccaaagaagcttcagatatggtacttgcagatgataacttcagcactatagtcgcagcagttggtgaagggaggtctatttacaacaatatgaaggcttttattagatatatgatctcctcaaacatcggagaggttgcatcaatattcctgacatcggctttaggtattccagaaggtctcatcccagtgcaacttctatgggtcaatcttgttacagatggccctccagcgacagctttggggttcaacccacctgataaagacatcatgaagaaacctcctcgaagaagtgatgactctttgatcactccttggatcctgtttcgctatatggttattggcctttatgttggggttgcaacagtgggaatcttcatcatctggtacacgcatggcagtttcctgggaattgacctggctagtgatggtcatacacttgtgtcgtactcccagctctcaaactggggccagtgctcctcatgggagggcttcaaggtgtcgccattcactgcaggagcgaggacattcaaatttgatgcaaatccatgcgattacttccagggtggcaagattaaagcaacgacactctctttgtctgtcttggtgtccattgagatgttcaactcactgaatgccctgtcagaggatggcagccttctgagcatgccgccatgggttaatccgtggcttcttctggccatgtctgtttcttttgggctgcatttcttgatcctctatgtgcctttcctcgctcaagtgtttgggattgtgcccctcagtttgaacgaatggctcttggtgatagcagtggccttcccagtggtgctgatcgatgaggttctcaaatttgtggggcggtgcctgacagcgcgtgcccggaaacaatcagggaagaggaaggcagagtag

SEQ ID NO: 9946 - protein, 1061 aa, Sorghum bicolor
  misc_feature: Ceres ANNOT ID no. 6108624
  misc_feature (121)..(377): Pfam Id: E1-E2_ATPase Pfam Desc: E1-E2 ATPase
  misc_feature (851)..(1047): Pfam Id: Cation_ATPase_C Pfam Desc: Cation transporting ATPase, C-terminus
  misc_feature (19)..(102): Pfam Id: Cation_ATPase_N Pfam Desc: Cation transporter/ATPase, N-terminus
  misc_feature (381)..(755): Pfam Id: Hydrolase Pfam Desc: haloacid dehalogenase-like hydrolase
  misc_feature (184)..(1061): NCBI GI: 67866975 NCBI Desc: ca2+-atpase [oryza sativa (indica cultivar-group)]
  misc_feature (1)..(1057): NCBI GI: 9743458 NCBI Desc: rice est au030811, similar to rice ca+2-atpase (u82966) [oryza sativa]
  misc_feature (35)..(1058): NCBI GI: 2160712 NCBI Desc: ca2+-atpase [oryza sativa]
  misc_feature (1)..(1061): NCBI GI: 8439902 NCBI Desc: strong similarity to er-type calcium pump protein from arabidopsis thaliana gbu93845. it is a member of na+/k+ atpase c-terminus pf00690 and a member of e1-e2 atpase pf00122
  misc_feature (1)..(1061): NCBI GI: 116248597 NCBI Desc: endomembrane ca2+ atpase 4 [arabidopsis thaliana]
  misc_feature (1)..(1061): SWISSPROT Homolog: EC 3.6.3.8 Calcium-transporting ATPase 4, endoplasmic reticulum-type
MGKGGQDEGKRRDGSAASGPDPAEPAFPAWARTPSECLAELGVSADRGLSSEEAAARLQRYGPNELERHAPPSVWKLVLEQFNDTLVRILLLAAVVSFVLALYDGAEGGEVGVTAFVEPLVIFLILIVNAVVGVWQESNAEKALEALKEIQSEHATVKRDGRWSHGLPARDLVPGDIVELRVGDKVPADMRVLQLISSTLRVEQGSLTGETASVNKTSHKIELEDTDIQGKECMVFAGTTVVNGSAVCVVTGTGMATEIGKIHAQIQEASQEEDDTPLKKKLNEFGEALTAIIGVICALVWLINLKYFLSWEYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRSFKVDGTTYDPTDGKIHDWPSLSMDENLQMIAKIAAVCNDASIAHSEHQYVATGMPTEAALKVLVEKMGLPGGYTPSLDSSDLLRCCQWWNNAAKRVATLEFDRTRKSMGVIVKVNSGKNLLLVKGAVENLLERCTHIQLLDGSVVLLDDGAKALILSTLRDMSASALRCLGFAYKEELAEFATYDGEEHAAHKYLLDPSYYSSIESNMIFCGFVGLRDPPREEVHRAIEDCRAAGIRVMVITGDNKETAEAICREIGVFGPHEDISSKSFTGKEFMALSDKKKLLRQQGGLLFSRAEPKHKQEIVRLLKEDGEVVAMTGDGVNDAPALKLADIGVAMGITGTEVAKEASDMVLADDNFSTIVAAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGVATVGIFIIWYTHGSFLGIDLASDGHTLVSYSQLSNWGQCSSWEGFKVSPFTAGARTFKFDANPCDYFQGGKIKATTLSLSVLVSIEMFNSLNALSEDGSLLSMPPWVNPWLLLAMSVSFGLHFLILYVPFLAQVFGIVPLSLNEWLLVIAVAFPVVLIDEVLKFVGRCLTARARKQSGKRKAE

SEQ ID NO: 9947 - DNA, 1809 bp, Sorghum bicolor
  misc_feature: Ceres ANNOT ID no. 6108629
  misc_feature: Encodes the peptide sequence at SEQ ID NO 9948
atggaagcgaagaaccaaaccggtggcgacgaggagtgcagcaggccgcagcagcagccggtggtgatggactcgccgagggcggctcaggcggcgacgcggcgcaagaagatgacgaagcagctgacggggaagcgggacgacacggcgatgcacgcggcggcgcgcgccgggcagctcgcgtccatgcgggagatgatgtccggcaaggacgccgaggagctcggggcgctgctatcgcggcagaaccaggccggggagacgccgctgttcgtggccgccgagtacgggtacgtggccctggtgggggagatgatcaggtgccacgacgtcgccaccgccagcatcaaggcccgcagcggctacgacgcgctccacatcgccgccaagcaaggggatgtaggtattgattggttggtttttcatcagtttctttctcattctcatgcatatgcatgcatgcatgatcgccatccatgtcccaccatcattgcactcaactgtacagacgtcgtgagggagctgctgcaggcgctgcctcagctgtcgctgacggtggactcgtcgaacacgacggcgctgaactcggcggcgacgcagggacacttggacgtggtgaggctcctgctgcaggtggacaggagcctggcgctgatcgcgcgcagcaacggcaagacggcgctgcactcggcggcgcggaacgggcacgtggaggtggtgcgcgcgctgctggaggcggagcccagcatcgcgctgcgcacggacaagaagggccagaccgcgctgcacatggcctccaaggccacccggctggacctcgtcgacgcgctcctcgccgccgagccggcgctgctgaaccagaaggacaacaagggcaacaccgcgctgcacatcgcggcgcgcaaggcgcggcacgagatcatcaggcggctggtcacgatgcccgacacggacctcaaggcgatcaaccggtccggcgagaccccgctggacacggcggagaagatgggcaacggcgacgcggctgagctgctggcggagcacggcgtgcagtcggcgcgcgccatcagcccgggcgccggcggcgggaacaacaagcagcagcgcgagctgaagcagcaggtgagcgacatcaagcacgaggtgcactcgcagctggagcagacgcggcagacccgggtgcggatgcagggcatcgcgaagcgcatcaacaagctgcacgaggaagggctgaacaacgccatcaactcgacgacggtggtggccgtgctgatcgcgacggtggcgttcgcgggcatcttcacggtgcccggggagtacgttgaggacccccgcagcagcctgacgcccgggaaggacgtcggggaggccaacatctcccaccagacggcgttcatcatcttcttcgtcttcgactcggtgtcgctcttcatctcgctggccgtggtggtggtgcagacgtcggtggtggtgatcgagcgcaaggccaagaagcagatgatggcggtgatcaacaagctcatgtgggtggcctgcgtgctcatcagcgtctccttcctggcgctgtcgttcgtggtggtgggccgcgccgagcggtggctggccgtgtccgtcaccatcatgggcaccaccatcctggccaccaccatcggcaccatgctctactgggtgatcgcgcaccgcatggaggccaagcggattcgcaccaacaagcgcaacaggctcagccgctcccgctccttgtccatctccggcatgtcggagggcgagtgggtcgaggaggagtacaagaggatgtacgccatctga

SEQ ID NO: 9948 - protein, 602 aa, Sorghum bicolor
  misc_feature: Ceres ANNOT ID no. 6108629
  misc_feature (223)..(255): Pfam Id: Ank Pfam Desc: Ankyrin repeat
  misc_feature (257)..(290): Pfam Id: Ank Pfam Desc: Ankyrin repeat
  misc_feature (87)..(602): NCBI GI: 92897646 NCBI Desc: ankyrin [medicago truncatula]
  misc_feature (119)..(602): NCBI GI: 8439897 NCBI Desc: it contains ank repeat pf00023. est gbai996003 comes from this gene. [arabidopsis thaliana]
  misc_feature (121)..(602): NCBI GI: 8777346 NCBI Desc: ankyrin-like protein [arabidopsis thaliana]
  misc_feature (86)..(602): NCBI GI: 4887754 NCBI Desc: ankyrin-like protein [arabidopsis thaliana]
  misc_feature (73)..(602): NCBI GI: 55733779 NCBI Desc: at5g02620 [arabidopsis thaliana]
  misc_feature: The sequence is a functional homolog of SEQ ID NO 1841 in the 10/374,780US patent application
  misc_feature: Useful for making plants with modulated growth and phenotype characteristics
  misc_feature: The sequence is a functional homolog of SEQ ID NO 1841 in the 20060162006 US patent application
MEAKNQTGGDEECSRPQQQPVVMDSPRAAQAATRRKKMTKQLTGKRDDTAMHAAARAGQLASMREMMSGKDAEELGALLSRQNQAGETPLFVAAEYGYVALVGEMIRCHDVATASIKARSGYDALHIAAKQGDVGIDWLVFHQFLSHSHAYACMHDRHPCPTIIALNCTDVVRELLQALPQLSLTVDSSNTTALNSAATQGHLDVVRLLLQVDRSLALIARSNGKTALHSAARNGHVEVVRALLEAEPSIALRTDKKGQTALHMASKATRLDLVDALLAAEPALLNQKDNKGNTALHIAARKARHEIIRRLVTMPDTDLKAINRSGETPLDTAEKMGNGDAAELLAEHGVQSARAISPGAGGGNNKQQRELKQQVSDIKHEVHSQLEQTRQTRVRMQGIAKRINKLHEEGLNNAINSTTVVAVLIATVAFAGIFTVPGEYVEDPRSSLTPGKDVGEANISHQTAFIIFFVFDSVSLFISLAVVVVQTSVVVIERKAKKQMMAVINKLMWVACVLISVSFLALSFVVVGRAERWLAVSVTIMGTTILATTIGTMLYWVIAHRMEAKRIRTNKRNRLSRSRSLSISGMSEGEWVEEEYKRMYAI

SEQ ID NO: 9949 - DNA, 1266 bp, Sorghum bicolor
  misc_feature: Ceres ANNOT ID no. 6108633
  misc_feature: Encodes the peptide sequence at SEQ ID NO 9950
atgaagcagctgcaccggcaggccagcatgagcaagcagcaccgcccgcaccaccaccgcgcctccctctcccgcaccctcgcttcctacctcctccgcgagcagcgcctcctcttcgtcctcctcggcttcctcctcgcctcctccttcttcttcctctacccgtcgtccgtcaacccgcattccgccgccagagccggatcctcctccgccaccagtttcgccgccgccgtcgccaggaaaatcccccgcggcggcgtggtctcctccgccgccgcgcgccgcctccccgtcggcgtccggaagcgctccctgcgcgtcgtcgtcaccggcggcgcgggttttgttggcagccacctcgtcgataagctccttgcccgcggggacagcgtcatcgtcgtcgacaacttcttcacgggccgcaaggacaacctcgcgcaccacctcgacaacccgcgattcgagctcatccgccacgacgtcgtcgaacccattctcctagaggtcgaccagatctaccacctcgcctgccccgcgtcccccgtgcactacaaattcaaccccatcaagaccatcatatcctttccgctcccttgtacaaatgtcatggggaccttgaacatgcttggactggcaaagagggtcggggcccggttcttgctgactagtaccagtgaagtgtatggcgatcctcttgagcatccacagaaggagagctactggggccatgtcaatcccataggtgttaggagctgttatgatgaggggaagagaacagctgaaactcttaccatggattaccaccgtggtgctggtgtcgaggtgagaattgcacgcatatttaacacatatggccctcgtatgtgtttagatgatggccgagttgttagcaactttgttgcacaggctttgcggaaacaaccaatgacagtttatggtgatggaaaacagactcgaagttttcaatatgtttcagatctggttgatgggttggtaactctaatggaaagcgaccatattggacctttcaacttggggaatccgggtgaatttacaatgctggaacttgcacaggtggtaaaagaaacgattgacccaggtgcgtctgtggagttcaaacccaacactgcagatgatccacacatgagaaaacctgacatttctaaggccaaatctcttctcaattgggagcccaaagtttcactaaaacaaggcctgccgcgtatggtctcggacttccagaaacgcatcatggatgagaattga

SEQ ID NO: 9950 - protein, 421 aa, Sorghum bicolor
  misc_feature: Ceres ANNOT ID no. 6108633
  misc_feature (107)..(346): Pfam Id: Epimerase Pfam Desc: NAD dependent epimerase/dehydratase family
  misc_feature (109)..(331): Pfam Id: NAD_binding_4 Pfam Desc: Male sterility protein
  misc_feature (108)..(345): Pfam Id: 3Beta_HSD Pfam Desc: 3-beta hydroxysteroid dehydrogenase/isomerase family
  misc_feature (73)..(420): NCBI GI: 45421834 NCBI Desc: udp-glucuronic acid decarboxylase [oryza sativa (japonica cultivar-group)]
  misc_feature (1)..(421): NCBI GI: 28058970 NCBI Desc: dtdp-glucose 4-6-dehydratase-like protein [arabidopsis thaliana]
  misc_feature (1)..(421): NCBI GI: 14595662 NCBI Desc: udp-glucuronic acid decarboxylase [arabidopsis thaliana]
  misc_feature (1)..(419): NCBI GI: 60932236 NCBI Desc: udp-glucuronic acid decarboxylase 1 [populus tomentosa]
  misc_feature (8)..(421): NCBI GI: 60932254 NCBI Desc: udp-glucuronic acid decarboxylase 2 [populus tomentosa]
  misc_feature (23)..(417): SWISSPROT Homolog: EC 4.1.1.35 UDP-glucuronic acid decarboxylase 1
  misc_feature: Useful for making plants with altered cell wall content and/or composition
  misc_feature: GREAT-hit functional homolog of the protein sequence encoded by LOCUS at3g53520
  misc_feature: Useful for making plants with altered cell wall content and/or composition
  misc_feature: Functional homolog of the protein sequence given in SEQ ID NO 13746
  misc_feature: Useful for making plants with altered carbohydrate content
  misc_feature: Functional homolog of the protein sequence given in SEQ ID NO 13747
MKQLHRQASMSKQHRPHHHRASLSRTLASYLLREQRLLFVLLGFLLASSFFFLYPSSVNPHSAARAGSSSATSFAAAVARKIPRGGVVSSAAARRLPVGVRKRSLRVVVTGGAGFVGSHLVDKLLARGDSVIVVDNFFTGRKDNLAHHLDNPRFELIRHDVVEPILLEVDQIYHLACPASPVHYKFNPIKTIISFPLPCTNVMGTLNMLGLAKRVGARFLLTSTSEVYGDPLEHPQKESYWGHVNPIGVRSCYDEGKRTAETLTMDYHRGAGVEVRIARIFNTYGPRMCLDDGRVVSNFVAQALRKQPMTVYGDGKQTRSFQYVSDLVDGLVTLMESDHIGPFNLGNPGEFTMLELAQVVKETIDPGASVEFKPNTADDPHMRKPDISKAKSLLNWEPKVSLKQGLPRMVSDFQKRIMDEN

SEQ ID NO: 9951 - DNA, 4242 bp, Sorghum bicolor
  misc_feature: Ceres ANNOT ID no. 6108639
  misc_feature: Encodes the peptide sequence at SEQ ID NO 9952
atggtgccggctgggttgttcgggtgggcgtcgccccatgtacagccgctcacacccgtatccgaggtctccgagcctccggagtcgccgtccccgtatggggacgggcccgtgggggatgccggcgtgggggcgagggagggggaaggcgctggcggcggagaggaggaagtggaggacgacgaggtcgagccgccgcccgcggcggtgtcgttctggaggcttttcgagttcgccgatggggtcgattgggcccttatggctgttggggcgcttgctgctgctgcgcatggcgccgcgctcgtcgtgtaccttcactacttcgggagggccctgaatttgctcgactctgagcgggttgggtcgtctctctatggccgtggtgatgagctgctccggcggtttaaggagcatgccttgtatattgtctttatagctgctggtgttttcgtcgcaggatggatagaggtatcatgttggattctaactggggaacggcaaactgctgtcatcagatcaaaatatgttcaggttttgctaaatcaagacatgagtttttttgatacatatggtaacaacggagatattgttagtcaagtgctcagtgatgtattgctcattcagtcagctataagtgagaaagttgggaactacatacataatatggctacatttgctggtggtctcattgttggccttctgaattgttggcaaatagcacttctaactcttgccactggacccttgattgttgcagcaggaggaatatctaacatatttcttcataggctggctgaaaacattcaagatgcatatgctgaagcggctagcattgctgaacaggccatctcatacatcaggacactgtatgcttttacaaatgaaactcttgcaaagtactcctatgctacctcacttcaagccacacttagatatggaattttgattagccttgtccaagggattggtcttggatttacatatggacttgccatttgctcttgcgctttgcaactttgggttggaagacatctgatccatcgcagaaaagctgatggcggtgaagttgtggttgctttattctctgtaattctgagcggccttggtttgaatcaagcagctacaaatttttattcatttgagcaagggcgtattgctgcttatagactatatgagatgattagtcgttcaacttccagcaccaatcaagaagggacaaccttaccccaggtgcaggggaatattgaatttcgaaatgtgtactttagctacctgtctcgtcctgaaatcccaatattaagtggtttcttcctcactgtaccggcgagaaaaactgtggcacttgttggtagaaatggctcggggaaaagcagtataattcctctgatggagagattctatgacccaacattaggtgaagttcttttggatggggaaaacataaaaaatttgaaagtagaatggttaagaagccaaattggtctggtgacacaagaaccagccttattgagtttgagcattcgggaaaatattgcttatggaagatctgctacctttgatcagatagaagaggcagcaaaaacagctcatgcccatgggttcatcagttcacttgaaaaggggtatgaaacccaggttggtcgagctggtatagcactcactgatgaacagaagatcaaaatttctattgctcgtgctgtgctttcgaatccatccattctgttgcttgatgaggtcacgggaggacttgattttgaagctgaaaaagctgtgcaagaagcattagatgttctcatgttgggaaggtcaaccattataattgctagacgtctttgcctcattaaaaatgctgattatatagctgtaatggaggagggtcatcttgttgaaatggggacacatgatgaacttctaaacttggatggcctttatgctgagcttttaaggtgtgaggaagcaacaaaacttcccaaaaggatgcctaccaagaacagcagggagcgtaagtcgctccaaattgaggacacatcagtgagccaatattttcaagaatcgtcctctcctaagatggcaaaatcaccttcactacaaaggacacatggcatgcttcaattttggagatcagataccaacagaaactctcatgagtcaccaaaggatcgaagtccaccttcagaacaaactatggacaacgggatacctatggttgcaattgaaaccgaaagaacaccatccattaagaggcaggatagttttgaaatgaaattacctgatcttcctaaagttgatgtccatcctatacagcggcagtcatctaagaattcagaaccagactcacccatatctcctcttttgacttctgatcctaagaacgagcgttcacattcacaaacttttagcagaccacagagtgaacgagatgatacgagttctgaacacagtgaactggatgaggttcagcaccagaaacctccatctttttggcgtcttgcaacacttagtattgctgaatggccttatgctcttttaggtacaattggtgctgctatatttggctcatttaatccactgcttgcttacacaatagcacttatagtgtcagcatactatcaaatagaaatccgtgatatgcgccatgaagtgaacagatggtgtttattcatagtaggcatgggtgttattacagtgctggtcaactggttgcaacatttctattttggaataatgggggagaagatgactgagcgcataagaaggatgatgttctcagcaatgctacgcaatgaagttggatggtttgacaaagaggagaacaatgctgatacactgtccatgcgcctcgcaaatgatgctacatttgtccgtgctgccttcagtaaccggctttccatatttatacaagacactgctgcagtatctgtggctctccttattggaatgttgttggaatggcgggtggcacttattgcccttgcaactttgccagttcttgtcatatctgctattgcacagaaattgtggcttgctggcttctcaagaggaattcaggaaatgcatagaaaggcttcgttagtgcttgaagatgcagtccggaacatatacactgtagtagcattctgtgctggggataagataatggaactctacagactacatcttggcaagatactaaaacaaagtcttgtgcaaggattggctataggctttggctttggtctctcccagttccttctttttgcctgcaatgccctgcttctttggtacactgctatttcagttgaccaacaacgtctgacaatagccacaggactaaaagagtacattctgttttcatttgcatcattcgcattggtggagccatttggacttgcaccttacattcttaaaaggaggaaatctcttacatcagtctttgaaattattgaccgtgagccaaagattgatcctgatgataccactggcttgaaaccacccaatgtctatggaagcattgaattcaagaatgttgatttctcttttcctgctcgccctgacattcttgtgctgagtaattttaatcttaaagtgagtggtgggcaaacagttgcagtggttggggtttcaggatcagggaaaagcactgttatttctttgatcgagagattctatgacccagtttctggtcaagtcctactggatggtcgagatctgaaatcatttaaccttagatggttgcgtagccacatgggcctgattcagcaagatccagttattttctcaacaacaataagagaaaatattatttatgcaaggcacaatgcaacagaggctgagatgaaggaagctgcaaggatagcaaatgctcatcatttcatcagcagcttgccacatggatatgacactcatgtcggaatgagaggggttgatctaacacctgggcaaaagcaacggattgccattgctagggtggttttgaagaatgcacctatattgttgttggatgaggccagctctgcaattgagtccgaatcaagtagagtggtacaggaagctctcgacactctagttatgggtaacaagacaacaattctcattgcgcacagggcagcaatgatgaagcatgtggataacattgttgtcctaaatggtggtaggatagttgagcagggcacacatgactctctgatggaccagaacggtctatatgttagattgatgcaaccccattttggcaagggtcttcgccagcatcggctaatgtaa

SEQ ID NO: 9952 - protein, 1413 aa, Sorghum bicolor
  misc_feature: Ceres ANNOT ID no. 6108639
  misc_feature (443)..(626): Pfam Id: ABC_tran Pfam Desc: ABC transporter
  misc_feature (1192)..(1377): Pfam Id: ABC_tran Pfam Desc: ABC transporter
  misc_feature (87)..(370): Pfam Id: ABC_membrane Pfam Desc: ABC transporter transmembrane region
  misc_feature (841)..(1117): Pfam Id: ABC_membrane Pfam Desc: ABC transporter transmembrane region
  misc_feature (1)..(1413): NCBI GI: 7019665 NCBI Desc: p-glycoprotein-like [arabidopsis thaliana]
  misc_feature (1)..(1413): NCBI GI: 20453064 NCBI Desc: at2g39480/f12l6.14 [arabidopsis thaliana]
  misc_feature (44)..(719): NCBI GI: 27368847 NCBI Desc: mdr-like abc transporter [oryza sativa (japonica cultivar-group)]
  misc_feature (44)..(719): NCBI GI: 115458764 NCBI Desc: os04g0459000 [oryza sativa (japonica cultivar-group)]
  misc_feature (763)..(1399): NCBI GI: 6671365 NCBI Desc: p-glycoprotein [gossypium hirsutum]
MVPAGLFGWASPHVQPLTPVSEVSEPPESPSPYGDGPVGDAGVGAREGEGAGGGEEEVEDDEVEPPPAAVSFWRLFEFADGVDWALMAVGALAAAAHGAALVVYLHYFGRALNLLDSERVGSSLYGRGDELLRRFKEHALYIVFIAAGVFVAGWIEVSCWILTGERQTAVIRSKYVQVLLNQDMSFFDTYGNNGDIVSQVLSDVLLIQSAISEKVGNYIHNMATFAGGLIVGLLNCWQIALLTLATGPLIVAAGGISNIFLHRLAENIQDAYAEAASIAEQAISYIRTLYAFTNETLAKYSYATSLQATLRYGILISLVQGIGLGFTYGLAICSCALQLWVGRHLIHRRKADGGEVVVALFSVILSGLGLNQAATNFYSFEQGRIAAYRLYEMISRSTSSTNQEGTTLPQVQGNIEFRNVYFSYLSRPEIPILSGFFLTVPARKTVALVGRNGSGKSSIIPLMERFYDPTLGEVLLDGENIKNLKVEWLRSQIGLVTQEPALLSLSIRENIAYGRSATFDQIEEAAKTAHAHGFISSLEKGYETQVGRAGIALTDEQKIKISIARAVLSNPSILLLDEVTGGLDFEAEKAVQEALDVLMLGRSTIIIARRLCLIKNADYIAVMEEGHLVEMGTHDELLNLDGLYAELLRCEEATKLPKRMPTKNSRERKSLQIEDTSVSQYFQESSSPKMAKSPSLQRTHGMLQFWRSDTNRNSHESPKDRSPPSEQTMDNGIPMVAIETERTPSIKRQDSFEMKLPDLPKVDVHPIQRQSSKNSEPDSPISPLLTSDPKNERSHSQTFSRPQSERDDTSSEHSELDEVQHQKPPSFWRLATLSIAEWPYALLGTIGAAIFGSFNPLLAYTIALIVSAYYQIEIRDMRHEVNRWCLFIVGMGVITVLVNWLQHFYFGIMGEKMTERIRRMMFSAMLRNEVGWFDKEENNADTLSMRLANDATFVRAAFSNRLSIFIQDTAAVSVALLIGMLLEWRVALIALATLPVLVISAIAQKLWLAGFSRGIQEMHRKASLVLEDAVRNIYTVVAFCAGDKIMELYRLHLGKILKQSLVQGLAIGFGFGLSQFLLFACNALLLWYTAISVDQQRLTIATGLKEYILFSFASFALVEPFGLAPYILKRRKSLTSVFEIIDREPKIDPDDTTGLKPPNVYGSIEFKNVDFSFPARPDILVLSNFNLKVSGGQTVAVVGVSGSGKSTVISLIERFYDPVSGQVLLDGRDLKSFNLRWLRSHMGLIQQDPVIFSTTIRENIIYARHNATEAEMKEAARIANAHHFISSLPHGYDTHVGMRGVDLTPGQKQRIAIARVVLKNAPILLLDEASSAIESESSRVVQEALDTLVMGNKTTILIAHRAAMMKHVDNIVVLNGGRIVEQGTHDSLMDQNGLYVRLMQPHFGKGLRQHRLM

SEQ ID NO: 9953 - DNA, 594 bp, Sorghum bicolor
  misc_feature: Ceres ANNOT ID no. 6108658
  misc_feature: Encodes the peptide sequence at SEQ ID NO 9954
atggcgtatggcaagaggacacggcagaaggccgaggagatggtctggctgcccgacggcgccgacgtcgcgcgcttcctgctgctcttctcgggagaccaccagcaccactaccacggcgccggcggcgtggcatccacggacgcggcctcctcggcgcccgagcgggtgttcgagtgcaagacctgcaacaggcagttcccgtctttccaggcgctcggcggccaccgggccagccacaagaagccccgcctcgcggacggcggcgtcgacgccgccgcggccgagccgcccaagcccaaggtacacggctgctccatctgcggtctcgagttcgccatcggccaggcgctcggcggccacatgcgccgccaccgggctgccgatcaggcggacggcggcagccccggactcgggcttggcctcagcctcggcaccgggctactcgccccgaaagacgacagcggcaagaagaccgcgccgccggccgagctcgtgctggaccttaacgccgtgccggagctggaggaggagcaggatcgcgccaggctctccatcgaattccccgtagcagtagttgacttcttacgttaa

SEQ ID NO: 9954 - protein, 197 aa, Sorghum bicolor
  misc_feature: Ceres ANNOT ID no. 6108658
  misc_feature (40)..(170): NCBI GI: 140060288 NCBI Desc: zinc finger, c2h2-type [medicago truncatula]
  misc_feature (1)..(84): NCBI GI: 115440935 NCBI Desc: os01g0838600 [oryza sativa (japonica cultivar-group)]
  misc_feature (1)..(84): NCBI GI: 30420734 NCBI Desc: zinc finger transcription factor zfp19 [oryza sativa (japonica cultivar-group)]
  misc_feature (5)..(84): NCBI GI: 56784648 NCBI Desc: zinc finger transcription factor zfp19 [oryza sativa (japonica cultivar-group)]
  misc_feature (53)..(138): NCBI GI: 75706702 NCBI Desc: zfp16-2 [hordeum vulgare subsp. vulgare]
  misc_feature: The plant flowers significantly late compared to wild-type.
  misc_feature: The plant is abnormally large.
  misc_feature: The plant is abnormally small.
  misc_feature: The sequence is a functional homolog of SEQ ID NO 10 in the 10/412,699US patent application
  misc_feature: The sequence is a functional homolog of SEQ ID NO 1094 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 124 in the 11/479,226US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 1382 in the 10/666,642US patent application
  misc_feature: The sequence is a functional homolog of SEQ ID NO 140 in the 10/225,066US patent application
  misc_feature: The sequence is a functional homolog of SEQ ID NO 1480 in the 10/666,642US patent application
  misc_feature: The sequence is a functional homolog of SEQ ID NO 2150 in the 10/374,780US patent application
  misc_feature: The sequence is a functional homolog of SEQ ID NO 228 in the 10/714,887US patent application
  misc_feature: The sequence is a functional homolog of SEQ ID NO 228 in the 11/435,388US patent application
  misc_feature: The sequence is a functional homolog of SEQ ID NO 276 in the 10/714,887US patent application
  misc_feature: The sequence is a functional homolog of SEQ ID NO 276 in the 11/435,388US patent application
  misc_feature: The sequence is a functional homolog of SEQ ID NO 62 in the 10/374,780US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 639 in the 10/374,780US patent application
  misc_feature: The sequence is a functional homolog of SEQ ID NO 763 in the 10/666,642US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Useful for making plants with modulated salt sensitivity
  misc_feature: Useful for making plants with modulated drought sensitivity
  misc_feature: Useful for making plants with modulated nitrogen use efficiency
  misc_feature: Functional homolog of the protein sequence given in SEQ ID NO 13265
  misc_feature: Functional homolog of the protein sequence given in SEQ ID NO 13271
  misc_feature: Functional homolog of the protein sequence given in SEQ ID NO 13451
  misc_feature: The sequence is a functional homolog of SEQ ID NO 10 in the 20040045049 US patent application
  misc_feature: The sequence is a functional homolog of SEQ ID NO 1094 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 140 in the 20050160493 US patent application
  misc_feature: The sequence is a functional homolog of SEQ ID NO 276 in the 20060015972 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: Functional homolog of the protein sequence given in SEQ ID NO 13580
  misc_feature: Useful for making plants with modulated biomass
  misc_feature: Functional homolog of the protein sequence given in SEQ ID NO 13580
  misc_feature: The sequence is a functional homolog of SEQ ID NO. 457 in the 11/188,298 US application
  misc_feature: The sequence is a functional homolog of SEQ ID NO. 351 in the 11/188,298 US application
MAYGKRTRQKAEEMVWLPDGADVARFLLLFSGDHQHHYHGAGGVASTDAASSAPERVFECKTCNRQFPSFQALGGHRASHKKPRLADGGVDAAAAEPPKPKVHGCSICGLEFAIGQALGGHMRRHRAADQADGGSPGLGLGLSLGTGLLAPKDDSGKKTAPPAELVLDLNAVPELEEEQDRARLSIEFPVAVVDFLR

SEQ ID NO: 9955 - DNA, 1395 bp, Sorghum bicolor
  misc_feature: Ceres ANNOT ID no. 6108663
  misc_feature: Encodes the peptide sequence at SEQ ID NO 9956
atgccgcccccgtccctcctgcacctccactcccgcgccccgcttcagccccgccccttcaggatgaactcccgggcagctccgagcagggtcgtcgtctgctccgttgcgtccgccgaggggttcatctccgcagcgccgatcctccttcccgacggtccttggaagcaggtagaaggcggcgttactgctgcgaaggggttcaaggcagcgggcatctatggtgggttgcgtgccaagggcgagaagcctgacttggcactggtcacctgcgacgtcgacgcaactgtagcaggaacatttacaacaaacgtcgttgccgctgcacctgttttgtattgcaagcatgcccttagtacatcgaaaacaggtcgtgctgtgttaattaatgctgggcaagcaaatgctgcaactggtgatcttggctatcaggatgcagtggatagtgcagatgctgttgccaagcttctcaatgtgagcacagataacatattgattcagtctactggtgtcattggtcaaaggataaaaaaggaggcacttttaaattcgctacctagacttgtgggctcgctgtcttcttcagttcagggagcgaattctgctgctgtggccattacaactacagaccttgttagcaagagcattgctgtccagactgagattggtggagtggctatcagaataggtggaatggctaaaggttctggaatgattcacccaaatatggcaacaatgctcggtgttttaaccacagatgctcaagtcagcaatgatgtctggagagaaatggtccggacgtcagtgagtagaagtttcaaccaaattacagtggatggtgatactagtaccaatgactgtgttattgctatggcaagtgggttgtctggtttatctagaattcaaagtcttgatagcattgaggctcaacagttccaagcttgcctagatgcagtaatgcaaggtcttgcgaaatctatagcatgggatggtgagggtgcaacatgcctaattgaggttactgtaagtggcgccaacaatgaggcagaagctgctaaaattgctcgttcagtagcatcttcttctctggttaaagccgctgtgtttggaagagacccaaattggggacgaattgcttgctcagttggctattcaggcattcaatttgatgcaaatcgacttgatatttctctgggagttattccactaatgaaaaatggccaaccactcccctttgacagatccgctgctagcaggtatctcaaagatgctggagatgcccatggtacagtgaacattgatatatcagttgggagtggaggaggaaatggaaaggcatggggctgtgatctgagctacaaatatgttgaaataaatgctgaatatacgacgtga

SEQ ID NO: 9956 - protein, 464 aa, Sorghum bicolor
  misc_feature: Ceres ANNOT ID no. 6108663
  misc_feature (68)..(464): Pfam Id: ArgJ Pfam Desc: ArgJ family
  misc_feature (30)..(464): NCBI GI: 78000225 NCBI Desc: glutamate n-acetyltransferase [citrullus lanatus]
  misc_feature (55)..(464): NCBI GI: 75909325 NCBI Desc: arginine biosynthesis protein argj [anabaena variabilis atcc 29413]
  misc_feature (55)..(464): NCBI GI: 113473972 NCBI Desc: arginine biosynthesis bifunctional protein argj [trichodesmium erythraeum ims101]
  misc_feature (55)..(464): NCBI GI: 17229565 NCBI Desc: glutamate n-acetyltransferase [nostoc sp. pcc 7120]
  misc_feature (55)..(464): NCBI GI: 56752208 NCBI Desc: arginine biosynthesis bifunctional protein argj [synechococcus elongatus pcc 6301]
MPPPSLLHLHSRAPLQPRPFRMNSRAAPSRVVVCSVASAEGFISAAPILLPDGPWKQVEGGVTAAKGFKAAGIYGGLRAKGEKPDLALVTCDVDATVAGTFTTNVVAAAPVLYCKHALSTSKTGRAVLINAGQANAATGDLGYQDAVDSADAVAKLLNVSTDNILIQSTGVIGQRIKKEALLNSLPRLVGSLSSSVQGANSAAVAITTTDLVSKSIAVQTEIGGVAIRIGGMAKGSGMIHPNMATMLGVLTTDAQVSNDVWREMVRTSVSRSFNQITVDGDTSTNDCVIAMASGLSGLSRIQSLDSIEAQQFQACLDAVMQGLAKSIAWDGEGATCLIEVTVSGANNEAEAAKIARSVASSSLVKAAVFGRDPNWGRIACSVGYSGIQFDANRLDISLGVIPLMKNGQPLPFDRSAASRYLKDAGDAHGTVNIDISVGSGGGNGKAWGCDLSYKYVEINAEYTT

SEQ ID NO: 9957 - DNA, 1965 bp, Sorghum bicolor
  misc_feature: Ceres ANNOT ID no. 6108679
  misc_feature: Encodes the peptide sequence at SEQ ID NO 9958
atggaagcgcctgcgtccgcgcacgcctcggcggcggcggcggcggccgctgatagccaggaggaatcggcgtccgcgcccgcggcggcaaacgaggaggcgcagccggcagcagctgcggtgcccgcgctgtacgtcggcgatctgcacgaggacgtggcggaggagcacctgttcgacgccttcagcaagatcggcactgtcacgtccgtgcgtgtctgccgcgacaacgccacaagcagatctctccgctatggatacgtgaactacttctctcgggccgacgctgtgatggctcttgataagttgaatcatagcttggttttggataagccaataagggtgatgtggtccaacagggatccagatgccaggagaagtggtgttggtaacatttttgttaagaaccttaataattctgttgacaatgcgagccttcaagaattgttctccaagtttggagatgttttatcttgtaaagttgccaaaaatgaggatgggaccagcagaggatatgggtttgttcaatttgcatcgcaagaatcagcagatgaagcaattgggaacctcaatggctcccttttcaatgatagaaaactgcatgtagctactttcattaagaaaagtgaacgatctgcaaataatgatgacaagtttactaacttgtatatgaagcatctagatgatgacataacggaggaacttgttaaattaaagttctctcagtttggtccgatagttagtgtgaagattatgaggagacctgatgggtcatctttggggtttggatttgttagtttccaaaaccctgaaagtgccattaaagcacaagagaccatgcatgggatgctactaggatcgaaagccttgtacgtggcgagggctcaaaagaaggaggaaaggaaacaatatttgcagcgcttacacgaggaaaagagaaatgaaataataactaagagcaatgaatcaaatgtctatatcaaaaacatccatgatgaagttgatgatgatgcacttcgtgctcgctttgctgaatatggcaacatcacatcagcaaaggtcatgcgtgatgataagggcatcagtaggggctttggatttgtatgctatagtacccctgaggaggccaagagtgttgtaaatagcatgcgaggtgttatgttttttggaaaaccattgtatgttgctattttccaaagaaaagaggagagaagagccaagttgcaacaacattttgctcagcttgcaagaatggttggacctacgaactctatgatccccactggatatccacaagtatattttgcccacccaaatgctcatatccctcaaggtcctccaagacatggatttgtgtatccacccatgggacttagtcatgaatggagaccaaatatgttcccctcagcaccaaatctcccgcaaatacattcaccaatgatgccaaattcaccaaggcactatagaagcaatcggggaaggatgggtgggaacatgatgcctcttcctcatgcagttcatgcaatgaactatgtgacacatgcacaaccaacaaaagaattcatgtccatgcctcgacagcgattcaaccattccaagtacttctcgaatgatgttatggccaatggtttggctatccatcaaagtgaccctgtttcgacgatgaatgattctttcagcagctatttggcttctgctccacccgcggaacaaaaaaacttgcttgggaacaggctctatccgcttgttgagagacatcagcctgaacttgcaagcaaaatcactgggatgttgttggagcttgataactctgaggtggtcacattgctttgctcgtcagagatgttgtcagtcaaggtcgacgagtgtgtccagctgttacaagcaaccaagcctaagacagaggaccatgaggcattacacccagggttcatgatggagtctcctagtgtaaatgccagttga

SEQ ID NO: 9958 - protein, 654 aa, Sorghum bicolor
  misc_feature: Ceres ANNOT ID no. 6108679
  misc_feature (44)..(115): Pfam Id: RRM_1 Pfam Desc: RNA recognition motif. (a.k.a. RRM, RBD, or RNP domain)
  misc_feature (132)..(202): Pfam Id: RRM_1 Pfam Desc: RNA recognition motif. (a.k.a. RRM, RBD, or RNP domain)
  misc_feature (222)..(292): Pfam Id: RRM_1 Pfam Desc: RNA recognition motif. (a.k.a. RRM, RBD, or RNP domain)
  misc_feature (325)..(395): Pfam Id: RRM_1 Pfam Desc: RNA recognition motif. (a.k.a. RRM, RBD, or RNP domain)
  misc_feature (556)..(627): Pfam Id: PABP Pfam Desc: Poly-adenylate binding protein, unique domain
  misc_feature (37)..(465): NCBI GI: 4504715 NCBI Desc: poly a binding protein, cytoplasmic 4 [homo sapiens]
  misc_feature (37)..(465): NCBI GI: 48734702 NCBI Desc: pabpc4 protein [homo sapiens]
  misc_feature (37)..(465): NCBI GI: 119627673 NCBI Desc: poly(a) binding protein, cytoplasmic 4 (inducible form), isoform cra_h [homo sapiens]
  misc_feature (37)..(465): NCBI GI: 119627667 NCBI Desc: poly(a) binding protein, cytoplasmic 4 (inducible form), isoform cra_b [homo sapiens]
  misc_feature (37)..(465): NCBI GI: 13096978 NCBI Desc: poly(a) binding protein, cytoplasmic 4, isoform 1 [mus musculus]
  misc_feature: The sequence is a functional homolog of SEQ ID NO. 339 in the 11/188,298 US application
MEAPASAHASAAAAAAADSQEESASAPAAANEEAQPAAAAVPALYVGDLHEDVAEEHLFDAFSKIGTVTSVRVCRDNATSRSLRYGYVNYFSRADAVMALDKLNHSLVLDKPIRVMWSNRDPDARRSGVGNIFVKNLNNSVDNASLQELFSKFGDVLSCKVAKNEDGTSRGYGFVQFASQESADEAIGNLNGSLFNDRKLHVATFIKKSERSANNDDKFTNLYMKHLDDDITEELVKLKFSQFGPIVSVKIMRRPDGSSLGFGFVSFQNPESAIKAQETMHGMLLGSKALYVARAQKKEERKQYLQRLHEEKRNEIITKSNESNVYIKNIHDEVDDDALRARFAEYGNITSAKVMRDDKGISRGFGFVCYSTPEEAKSVVNSMRGVMFFGKPLYVAIFQRKEERRAKLQQHFAQLARMVGPTNSMIPTGYPQVYFAHPNAHIPQGPPRHGFVYPPMGLSHEWRPNMFPSAPNLPQIHSPMMPNSPRHYRSNRGRMGGNMMPLPHAVHAMNYVTHAQPTKEFMSMPRQRFNHSKYFSNDVMANGLAIHQSDPVSTMNDSFSSYLASAPPAEQKNLLGNRLYPLVERHQPELASKITGMLLELDNSEVVTLLCSSEMLSVKVDECVQLLQATKPKTEDHEALHPGFMMESPSVNAS

SEQ ID NO: 9959 - DNA, 774 bp, Sorghum bicolor
  misc_feature: Ceres ANNOT ID no. 6108681
  misc_feature: Encodes the peptide sequence at SEQ ID NO 9960
atggccgagacgctcgacatgaccctcgacgacatcatcaagaacaacaagaagagtaactcctcctccggtgggggccgccgcagccgcggcggatccgcccctggcggcggcggcggcggcggcagcggcggggtcgggccgaccaggcgccccttcaagagggccgggaacaggcaggcgccctaccagccgccgaaggcccccgacgttgcgtggcagcacgacatgtaccctgcggtcgccgcaggaggaggcggcggcgggagggtctcggctctcgagactggtaccaagctctacatctccaacctggactttggggtttcgaacgaggatatcaaggagcttttctctgagctaggtgatctgaagcgctactccataaattatgatcgaagtggcaggtctaagggtacagcagaagttgtattcgcaaggcgttctgatgctgtagcggcagttaagaagtataacaatgtccaacttgatggtaagcccatgaagatagagatagttgggaccaatactccaactgcagctgctgctcttccagtctctaatggtggccatgctaggaatgctgcgaggagtgcacctaggggtgccgccccagcaggtatgccgcagcgtagaccccatcagaggggtgggaggcgtggtggtggatctggtggtggtcgtcgtggcaaagagcgcagcacgccgaagtcggctgaagaacttgatgctgacttggagaagtatcatgctgatgcgatgcagaccaactaa

SEQ ID NO: 9960 - protein, 257 aa, Sorghum bicolor
  misc_feature: Ceres ANNOT ID no. 6108681
  misc_feature (100)..(170): Pfam Id: RRM_1 Pfam Desc: RNA recognition motif. (a.k.a. RRM, RBD, or RNP domain)
  misc_feature (1)..(257): NCBI GI: 51490665 NCBI Desc: aly protein [nicotiana benthamiana]
  misc_feature (5)..(257): NCBI GI: 94466657 NCBI Desc: aly protein [nicotiana benthamiana]
  misc_feature (5)..(257): NCBI GI: 51490663 NCBI Desc: aly protein [nicotiana benthamiana]
  misc_feature (1)..(257): NCBI GI: 21555029 NCBI Desc: transcriptional coactivator-like protein [arabidopsis thaliana]
  misc_feature (1)..(257): NCBI GI: 9757916 NCBI Desc: rna and export factor binding protein 2-i-like protein [arabidopsis thaliana]
  misc_feature: The plant is abnormally small.
  misc_feature: Useful for making plants with modulated biomass
  misc_feature: GREAT-hit functional homolog of the protein sequence given in SEQ ID NO 13041
  misc_feature: Useful for making plants with modulated biomass
  misc_feature: Functional homolog of the protein sequence given in SEQ ID NO 13041
  misc_feature: The sequence is a functional homolog of SEQ ID NO. 458 in the 11/188,298 US application
MAETLDMTLDDIIKNNKKSNSSSGGGRRSRGGSAPGGGGGGGSGGVGPTRRPFKRAGNRQAPYQPPKAPDVAWQHDMYPAVAAGGGGGGRVSALETGTKLYISNLDFGVSNEDIKELFSELGDLKRYSINYDRSGRSKGTAEVVFARRSDAVAAVKKYNNVQLDGKPMKIEIVGTNTPTAAAALPVSNGGHARNAARSAPRGAAPAGMPQRRPHQRGGRRGGGSGGGRRGKERSTPKSAEELDADLEKYHADAMQTN

SEQ ID NO: 9961 - DNA, 1245 bp, Sorghum bicolor
  misc_feature: Ceres ANNOT ID no. 6108695
  misc_feature: Encodes the peptide sequence at SEQ ID NO 9962
atgaggaagctgacgccggcgcaccgcctccggtggatgcgcgcgctgctcctcgcgctcccgctcctctcgctccccatcctctacgcggcgctcggcgcggcgcgctcgtcgtcctccacggcctcggcctcggcgccgcggctaccccagcagcagcagcagcaggagcagcggaggccgcccgcgccgccgccgaggctggcgtacctcatcacgggcgcgggccccggggacggcccgcggatccggaggctgctgcgggcgctctaccacccgtggaactactacctcgtcggcgtggcgggggaggacgagcgcgcggatctcgaggccttcgtgcgcggccaggaggcgccgcgccggtacggcaacgtccgtgtggcggccgcgggggagtggggcgccgtatcgcggaggggacccaccgaattggccgccacgctccacgccgccgctgtgctgctccgggagttcgatggctggagctggttcatcaacctcagcgcatccgattacccgctcatgccccaagatgatatccttcatatcttctcatacatgccaagagacctcaatttcattgagcacacaagcaatattggctggaaagagcatcaaagagcccgaccaatcattgtagatccagcattgcaggtcccaaataaaactgaggttgtaacaacaaaggagaaaaggagcatgccctcagctttcaaaatatttgtaggttcgtcttgggtgatgcttagtcgatcattcctggagttttgcttattgggatgggacaaccttcctcgcacactactgatgtatttcaccaacttcctctcatcctcagaaggctacttccacacagtgatctgcaactctgagtactaccagaacaccactgtgaacagtgacctgcgtttcatggcttgggataacccccctcggatgcaccctgttaacctcacagcagagcattttgatgcaatggcaaacagtggggccccatttgcacactcctttgccaatgataattctgtcctggatatgattgacaccaagttgttgggccgagcacatgaccgcttcaccccgggtggctggtgcttgggtagctcagtaggcgggaaagatccgtgtacctttttgggaaggtcctttgttctcaggccgaccaaagcctcggccaagctagagaagttgttgttaaaacttttggaacctgataacttcaggcctaaacagtgtaaataa

SEQ ID NO: 9962 - protein, 414 aa, Sorghum bicolor
  misc_feature: Ceres ANNOT ID no. 6108695
  misc_feature (68)..(293): Pfam Id: Branch Pfam Desc: Core-2/I-Branching enzyme
  misc_feature (9)..(371): NCBI GI: 115452231 NCBI Desc: os03g0276900 [oryza sativa (japonica cultivar-group)]
  misc_feature (11)..(414): NCBI GI: 77556820 NCBI Desc: glycosylation enzyme-like protein [oryza sativa (japonica cultivar-group)]
  misc_feature (63)..(413): NCBI GI: 45736153 NCBI Desc: n-acetylglucosaminyltransferase-like protein [oryza sativa (japonica cultivar-group)]
  misc_feature (57)..(414): NCBI GI: 46358506 NCBI Desc: glycosylation enzyme-like protein [triticum monococcum]
  misc_feature (65)..(413): NCBI GI: 145323728 NCBI Desc: glycosyltransferase family 14 protein / core-2/i-branching enzyme family protein [arabidopsis thaliana]
  misc_feature: Useful for making plants with altered carbohydrate content
  misc_feature: Functional homolog of the protein sequence given in SEQ ID NO 14022
MRKLTPAHRLRWMRALLLALPLLSLPILYAALGAARSSSSTASASAPRLPQQQQQQEQRRPPAPPPRLAYLITGAGPGDGPRIRRLLRALYHPWNYYLVGVAGEDERADLEAFVRGQEAPRRYGNVRVAAAGEWGAVSRRGPTELAATLHAAAVLLREFDGWSWFINLSASDYPLMPQDDILHIFSYMPRDLNFIEHTSNIGWKEHQRARPIIVDPALQVPNKTEVVTTKEKRSMPSAFKIFVGSSWVMLSRSFLEFCLLGWDNLPRTLLMYFTNFLSSSEGYFHTVICNSEYYQNTTVNSDLRFMAWDNPPRMHPVNLTAEHFDAMANSGAPFAHSFANDNSVLDMIDTKLLGRAHDRFTPGGWCLGSSVGGKDPCTFLGRSFVLRPTKASAKLEKLLLKLLEPDNFRPKQCK

SEQ ID NO: 9963 - DNA, 1686 bp, Sorghum bicolor
  misc_feature: Ceres ANNOT ID no. 6108729
  misc_feature: Encodes the peptide sequence at SEQ ID NO 9964
atggctgccgacgccgcaactgcggcgatggccgcggcttccctctgcgacgaccttgagcccgccaccgcgcgcacccgcatccgtgatgtccttgccgcaggcaccgcgcgtgccggggaccgcgtcgtggtcggggggtgggtccggacgggccgggagcaggggaagggctccttcgccttcctggagctcagcgacggctcctgcgccgccacgcttcaggtcatcgtcgacgccgccgtgcacccgctcgcgcgcctcaccgccaccgggacctccgtgctcgtcgagggcgagatcaaggagccgcccgaggggaccaagcagaacgtcgagctcaaggtcagccgcgtgcttgaggtcggcgaggtcgatgccgccgtctacccgctgcccaagggcaaggtcaaactcacgctcgagaaactcagggacgtcgttcatctccgttcgcgcaccaacacgattggagcggttgctaggattaggcaccagttagcctatgcgtcacacactttcttcaatgagaatggatttctctatgtacatacaccaataataactaccagtgactgtgaaggtgctggtgagatgttccaagtgacaactctgtttagtcaggctgaaaaaactgagaaggaattgagagagaacccggcaccatctgattctgaaattgaggcagctaaatttcttgtcaaggaaagaggtgatgtggtcgcacagcttaaagctgcgaaagccagcaaacaagagatatcagctgctgttgatgagctaaatagggcaaaggaaattgtttcaaaactggaggaaaggtccaagttaaagcctggggttccacgcaaggatgatggttcaatagcttttgaaaatgacttcttcaagcgtcaagcttttttgacagtgtctggacagcttcaggttgagacatatgcatgtgctcttagtagcgtttatacctttggaccaacattccgggcagagaactcacatacatcacggcatttggcagagttttggatggttgaaccggaaattgcattcgcaaacttgcaggatgatatgaactgtgcagaaaaatatgtacaatacctttgcaagtggctgcttgaccattgccaggaagatatggagtttatggtgaaaaattatgataagagtgcaattgaacgcctggagcttgtttcctcgactccttttgtgcggatttcatatacaaaggctgtggagctcttgaaaaatgttacagacaagaagtttgataacaaagttgaatggggaattgatttagcctctgagcatgaaaggtatttaacagaggatatatttaagaagccagtgattgtctataactatccgaaaggaataaaggctttttatatgaggctcaatgatgatgacaagacggtggctgcaatggatgttcttgtgcctaaggtcggcgaattgattggtggaagccaaagggaggaacggctagatgttctgaaacaaaggatacttgatgctggcttgcctttggaaccctatgagtggtacttggacctccgccgctttggatctgtaaagcacagtggctttgggttgggttttgaaaggatgattctttttgcaaccggaatggagaacatcagagatgttatacccttcccaaggtacccagggagggctgatctgtga

SEQ ID NO: 9964 - protein, 561 aa, Sorghum bicolor
  misc_feature: Ceres ANNOT ID no. 6108729
  misc_feature (140)..(557): Pfam Id: tRNA-synt_2 Pfam Desc: tRNA synthetases class II (D, K and N)
  misc_feature (43)..(122): Pfam Id: tRNA_anti Pfam Desc: OB-fold nucleic acid binding domain
  misc_feature (35)..(561): NCBI GI: 92893958 NCBI Desc: aspartyl-trna synthetase, class iib; trna synthetase, class ii (d, k and n) [medicago truncatula]
  misc_feature (10)..(561): NCBI GI: 10176772 NCBI Desc: sync1 protein [arabidopsis thaliana]
  misc_feature (266)..(560): NCBI GI: 59798542 NCBI Desc: asparaginyl-trna synthetase (asparagine--trna ligase) (asnrs)
  misc_feature (281)..(560): NCBI GI: 19310458 NCBI Desc: at4g17300/dl4685w [arabidopsis thaliana]
  misc_feature (281)..(560): NCBI GI: 2664210 NCBI Desc: asparaginyl-trna synthetase [arabidopsis thaliana]
  misc_feature (10)..(561): SWISSPROT Homolog: EC 6.1.1.22 Asparaginyl-tRNA synthetase, cytoplasmic 1
  misc_feature: Abnormal phyllotaxy, leaf number higher than wild-type
  misc_feature: Useful for making plants with modulated biomass
  misc_feature: GREAT-hit functional homolog of the protein sequence given in SEQ ID NO 13551
  misc_feature: Useful for making plants with modulated biomass
  misc_feature: Functional homolog of the protein sequence given in SEQ ID NO 13551
MAADAATAAMAAASLCDDLEPATARTRIRDVLAAGTARAGDRVVVGGWVRTGREQGKGSFAFLELSDGSCAATLQVIVDAAVHPLARLTATGTSVLVEGEIKEPPEGTKQNVELKVSRVLEVGEVDAAVYPLPKGKVKLTLEKLRDVVHLRSRTNTIGAVARIRHQLAYASHTFFNENGFLYVHTPIITTSDCEGAGEMFQVTTLFSQAEKTEKELRENPAPSDSEIEAAKFLVKERGDVVAQLKAAKASKQEISAAVDELNRAKEIVSKLEERSKLKPGVPRKDDGSIAFENDFFKRQAFLTVSGQLQVETYACALSSVYTFGPTFRAENSHTSRHLAEFWMVEPEIAFANLQDDMNCAEKYVQYLCKWLLDHCQEDMEFMVKNYDKSAIERLELVSSTPFVRISYTKAVELLKNVTDKKFDNKVEWGIDLASEHERYLTEDIFKKPVIVYNYPKGIKAFYMRLNDDDKTVAAMDVLVPKVGELIGGSQREERLDVLKQRILDAGLPLEPYEWYLDLRRFGSVKHSGFGLGFERMILFATGMENIRDVIPFPRYPGRADL

SEQ ID NO: 9965 - DNA, 1347 bp, Sorghum bicolor
  misc_feature: Ceres ANNOT ID no. 6108739
  misc_feature: Encodes the peptide sequence at SEQ ID NO 9966
atggggcacggcgctagctgcggccgcccaagcgacgaggtagacttcttcggcgcggcgcaggccggggacacggcccgcctcgccgccgcgcttcgctcccgccccaccttgctcacccgcaccacgctcttcgaccgcctctccgcgctccacatcgccgccgcgcacggccacctccaggtggtctctctggcattggatctttgcgtgcaccccgacgtcgttaaccgccacaagcagacggcgttgatgctcgcggcgatgcacgggaagaccgactgcgtccggcggctgctcgacgccggcgccaatatcgtgatgttcgattcctcgcacgggcggacgtgcctgcactacgcggcgtactacgggcacgcggactgcctccggaccatcctctcggcggccaagtccgcgccggtctcggaatcctgggggttcgcgcgcttcgtgaacgtgcgggacgacaccggggcgacgccgctgcaccttgcggcgaggcagggctggcggcgctgtgtccacgtcctgctcgagaacggcgccatcgtgtccgcctcaagtggcgccttcggattccccgggagcacgccgctgcatttggccgcgcgcggcggcaacctggactgcgtccggcaactcctctcctggggcgccgaccgcctccagcgagactccgtcgggagaattccgtatgaggtcgcagtgaagcgaggccacgtcgcgtgcgcggcgctgctgaacccgtcatcggcggagcccctggtctggccgtccgctctcaagttcatcagcgagctggaacccaacgccaagtccctgctcgaagcagcgctgatggaggccaatagagagagggagaggaggatcctcaaagggactaagaatgcactgccgtcgccatcgcaccccgatgacggcgctcatgacacggccatagccgaggctagcgacgcggaggtgtgcagcatctgcttcgagcaggcgtgcagcatcgaggtccgggagtgcgggcaccagatgtgctcggcgtgcacgctggcgctgtgctgccacgccaagcccaacccggcgacgcagtcccagccgcagccgacctgcccgttctgccgcggcggcatcgcgcggctggtggtggcgacgcggacgagggccggcgacgacgaagacgacgaggagcggggcaggctggagtcgcccaggcaccggcggtcccgccggtccatgaacctcagcggcgacgcgggcagcaccagcacactcatgggcagcatcgcctcctccatcggcaagatgggccgccggcgaacagatagcagcgagcaggtcgacgtcaagccgtag

SEQ ID NO: 9966 - protein, 448 aa, Sorghum bicolor
  misc_feature: Ceres ANNOT ID no. 6108739
  misc_feature (46)..(78): Pfam Id: Ank Pfam Desc: Ankyrin repeat
  misc_feature (79)..(111): Pfam Id: Ank Pfam Desc: Ankyrin repeat
  misc_feature (158)..(190): Pfam Id: Ank Pfam Desc: Ankyrin repeat
  misc_feature (195)..(227): Pfam Id: Ank Pfam Desc: Ankyrin repeat
  misc_feature (1)..(448): NCBI GI: 14279688 NCBI Desc: receptor-like kinase xa21-binding protein 3 [oryza sativa]
  misc_feature (1)..(435): NCBI GI: 62869545 NCBI Desc: ring zinc finger protein [artemisia desertorum]
  misc_feature (2)..(448): NCBI GI: 144962158 NCBI Desc: ubiquitin ligase [mirabilis jalapa]
  misc_feature (116)..(446): NCBI GI: 115452211 NCBI Desc: os03g0275300 [oryza sativa (japonica cultivar-group)]
  misc_feature (1)..(217): NCBI GI: 16226319 NCBI Desc: at2g28840/f8n16.13 [arabidopsis thaliana]
MGHGASCGRPSDEVDFFGAAQAGDTARLAAALRSRPTLLTRTTLFDRLSALHIAAAHGHLQVVSLALDLCVHPDVVNRHKQTALMLAAMHGKTDCVRRLLDAGANIVMFDSSHGRTCLHYAAYYGHADCLRTILSAAKSAPVSESWGFARFVNVRDDTGATPLHLAARQGWRRCVHVLLENGAIVSASSGAFGFPGSTPLHLAARGGNLDCVRQLLSWGADRLQRDSVGRIPYEVAVKRGHVACAALLNPSSAEPLVWPSALKFISELEPNAKSLLEAALMEANRERERRILKGTKNALPSPSHPDDGAHDTAIAEASDAEVCSICFEQACSIEVRECGHQMCSACTLALCCHAKPNPATQSQPQPTCPFCRGGIARLVVATRTRAGDDEDDEERGRLESPRHRRSRRSMNLSGDAGSTSTLMGSIASSIGKMGRRRTDSSEQVDVKP

SEQ ID NO: 9967 - DNA, 2040 bp, Sorghum bicolor
  misc_feature: Ceres ANNOT ID no. 6108747
  misc_feature: Encodes the peptide sequence at SEQ ID NO 9968
atggtgttccaaaagaggtcgtcgtcagagatggagtcgtgcggtggaggccaagtcgcggagatgccgcgcgttcccaagtctgcaaggggcaagagatcggtcaggaagaaggaggcccagagcccggcccagatgtccgcattcgaccttctcgcgacggtggcagggaagctgcttgatgagggggtgggctcgctggggaacatgagcgccggtgcctctgccttggctgcgtgcgcgaaggatgtccgtgtgaagcaggagcagtgtgatgaggaaatgaagcagttcaagcatgaggtgacggatcaggacagctgcaatgagagtgcaattctcccccacattgctttccagcgggcggtgaataatgctcggactgaggatcctaaggcgaaatctgaggcccaggacaaggaatcctccatgatcagctgtaccaaggctgaattgggttgtaattttggtgtgatcgcagataggtggtcgcctgaatccgtggaatcaggagccttcacaggagatgcagtggcgagcctgatgccgacggccccagcaggatttcataagaatgcacccgaaatgtataatttgcttgattcaatggatgtggatgccaagcctcctcctttggtcagctctgacagcaccggagagatgccattgtatggcgataaaattcaccgctcaacctccttaccaaggggcccaaagggagtggggggttttgctgtagatagagatgatgacgacgataagtcctctgggtgcactcatccgagcaccaccactaacagggatttcaggtccaattgtacagctgagtatagtagggtaaggaagctgctcactagtaagtacaggaaagttgctccagcgaggattcacaaatctgatctttcctatagtgatgtcgagcggaagccttctttccggaacaagaaaatgcattatacacgacagaggacacaaaggagtacattcaagcggaggaagctctttgatcgccattcagttctagcatctgaatttggtgcagcaaatggaaagggaagcacaaaggttaccggaagagactctcatgctgaagcaaacaaggggactaattcaatgccattccagaaatcttgtgtgtcaaatgattgccatgtgaaacttagaattaagtcttttaaggtgcctgaacttcttgttgaaatcccagaaagtgcaactgttggctcactaaagaaaactgttcttgaggcggtgactgcgattcttggaggtggtctacgtgtcggtgttcttcaccatggaaagaaagtcagagatgatagtaaaacgttaattcaggctgggattggccaggatgatatgctggacaacctaggcttttcacttgaacccaactgtacacaaaacccacaagtccaagttcctgaagatatcagtttccttgaaaccattgatactaccgaaccccttgcaaggattgcacctgctgactcatgttctaagcatggtgaagtggatgtatcacaggagcttgcattgaccccattagcaatgaactaccagggcagtgatcatgattctgtgcactcccctcggggtgtctcatcacccgataaagtgtccacacactcgcgagctttagttccagttccagctgcagatcccaatgcaggagctgtagttccagcgaataagtctaagaggtcaccagagcaggggcaacgcagaatcaggcgcccgttttctgttgctgaagtagaagcacttgtgctcgcagttgaaaagcttggaacgggaaggtggcgagatgttaaacttcgcgcttttgacaatgcaaagcaccgtacttacgttgatcttaaggacaaatggaagacgctggtgcacacagcgagcatctcgccacagcagcggcgtggcgagccggtgcctcaggagctgctcgaccgggtcctggcggcccaggcctactggtcccagcagcaagccaagctccagcctaagacgcccccgctggctgaggctcgcttgctcacctaa

SEQ ID NO: 9968 - protein, 679 aa, Sorghum bicolor
  misc_feature: Ceres ANNOT ID no. 6108747
  misc_feature (1)..(679): NCBI GI: 483444 NCBI Desc: initiator-binding protein [zea mays]
  misc_feature (1)..(679): NCBI GI: 483490 NCBI Desc: initiator binding protein [zea mays]
  misc_feature (299)..(679): NCBI GI: 115452203 NCBI Desc: os03g0274300 [oryza sativa (japonica cultivar-group)]
  misc_feature (16)..(676): NCBI GI: 23664357 NCBI Desc: telomere binding protein tbp1 [nicotiana glutinosa]
  misc_feature (1)..(664): NCBI GI: 117970379 NCBI Desc: telomere binding protein [solanum lycopersicum]
  misc_feature: The sequence is a functional homolog of SEQ ID NO 1142 in the 11/479,226US patent application
  misc_feature: The sequence is a functional homolog of SEQ ID NO 1240 in the 11/479,226US patent application
  misc_feature: The sequence is a functional homolog of SEQ ID NO 164 in the 10/374,780US patent application
  misc_feature: The sequence is a functional homolog of SEQ ID NO 1796 in the 10/412,699US patent application
  misc_feature: The sequence is a functional homolog of SEQ ID NO 2042 in the 10/374,780US patent application
  misc_feature: The sequence is a functional homolog of SEQ ID NO 398 in the 10/412,699US patent application
  misc_feature: The sequence is a functional homolog of SEQ ID NO 502 in the 10/412,699US patent application
  misc_feature: The sequence is a functional homolog of SEQ ID NO 566 in the 10/412,699US patent application
  misc_feature: The sequence is a functional homolog of SEQ ID NO 770 in the 10/412,699US patent application
  misc_feature: The sequence is a functional homolog of SEQ ID NO 8 in the 10/286,264US patent application
  misc_feature: The sequence is a functional homolog of SEQ ID NO 88 in the 10/286,264US patent application
  misc_feature: The sequence is a functional homolog of SEQ ID NO 894 in the 10/225,066US patent application
  misc_feature: The sequence is a functional homolog of SEQ ID NO 945 in the 11/479,226US patent application
  misc_feature: Useful for making plants with modulated growth and phenotype characteristics
  misc_feature: The sequence is a functional homolog of SEQ ID NO 8 in the 20030093837 US patent application
  misc_feature: The sequence is a functional homolog of SEQ ID NO 88 in the 20030093837 US patent application
  misc_feature: The sequence is a functional homolog of SEQ ID NO 1796 in the 20040045049 US patent application
  misc_feature: The sequence is a functional homolog of SEQ ID NO 566 in the 20040045049 US patent application
MVFQKRSSSEMESCGGGQVAEMPRVPKSARGKRSVRKKEAQSPAQMSAFDLLATVAGKLLDEGVGSLGNMSAGASALAACAKDVRVKQEQCDEEMKQFKHEVTDQDSCNESAILPHIAFQRAVNNARTEDPKAKSEAQDKESSMISCTKAELGCNFGVIADRWSPESVESGAFTGDAVASLMPTAPAGFHKNAPEMYNLLDSMDVDAKPPPLVSSDSTGEMPLYGDKIHRSTSLPRGPKGVGGFAVDRDDDDDKSSGCTHPSTTTNRDFRSNCTAEYSRVRKLLTSKYRKVAPARIHKSDLSYSDVERKPSFRNKKMHYTRQRTQRSTFKRRKLFDRHSVLASEFGAANGKGSTKVTGRDSHAEANKGTNSMPFQKSCVSNDCHVKLRIKSFKVPELLVEIPESATVGSLKKTVLEAVTAILGGGLRVGVLHHGKKVRDDSKTLIQAGIGQDDMLDNLGFSLEPNCTQNPQVQVPEDISFLETIDTTEPLARIAPADSCSKHGEVDVSQELALTPLAMNYQGSDHDSVHSPRGVSSPDKVSTHSRALVPVPAADPNAGAVVPANKSKRSPEQGQRRIRRPFSVAEVEALVLAVEKLGTGRWRDVKLRAFDNAKHRTYVDLKDKWKTLVHTASISPQQRRGEPVPQELLDRVLAAQAYWSQQQAKLQPKTPPLAEARLLT

SEQ ID NO: 9969 - DNA, 1386 bp, Sorghum bicolor
  misc_feature: Ceres ANNOT ID no. 6108749
  misc_feature: Encodes the peptide sequence at SEQ ID NO 9970
atgggatccaaggaccagggcggaggggccgcctcctcgggcggcggcttcttctcgtcgttcgccgccggcatgcgcagctggggcaccgccgtccacaaatccgtcaacgggctgcttggttatgaaggccttgaagttattaaccctgatggaggcacagatgatgctgaagaagaagctttgaggggacgatggaagcaggaggatcgtgatagctattggaagatgatgcacaagtacataggatcagatgttacatcacttgtgacacttccagtcataatttttgagccaatgacaatgcttcagaaaatggccgagttgatggaatactgtgaattgttagacaaagcagatgaatgtgaggatccgtacatgcgtatggtttatgcttctacatgggctgtttcggtgtactttgcgtatcagcgcacgtggaagccttttaatccaatccttggagagacttatgagatggttaaccaccagggcattacatttcttgctgagcaggtaagccatcaccccccaatgggtgttgctcattgtgagaatgagcattttacttatgatatcacgtctaagttgaggaccaagttcttgggaaattctgtggaaatttacccagttggaaggacaagagtgacactaaaaaaatctggtgtcgtgttggatttggtgccgccactaacaaaggttaacaacctgatatttggacgcacttgggttgatactcctggagagatggtcatgacaaacctgacaactggagacaaagttgtgctatatttccagccatgcggctggtttggggctggccgttatgaggtggatgggtatgtgtacagtgcagcggaagaacccaaaataatgattacagggaaatggaacaaatctctgagttaccaaccatgtgaccaagaaggcgatcctcttccaggcacggagctgaaggagatctggagagttgctcctgccccacagggcgacaagtatcagtacacacactttgcacacaaaataaacagctttgacacagcacctaagaagctgttggcatctgattcgcggttgagacctgatagatatgccctcgagaagggtgacatgtctaagtctggcgcagagaagagcaggcttgaggaacaacaaagagctgagaaaagaactcgagatgccaagggcgagcaatttactccaagatggttcaacatgacagatgtggttgctcctacaccgtggggtgacctggaaatttatgaatacaacggcaaatacacagagtaccgggctgccatagacagctccagtgtcaccggcgagacagatgtgacttcaaccgagttcaacccatggcaatatggtagctcatcttctcaatga

SEQ ID NO: 9970 - protein, 461 aa, Sorghum bicolor
  misc_feature: Ceres ANNOT ID no. 6108749
  misc_feature (30)..(433): Pfam Id: Oxysterol_BP Pfam Desc: Oxysterol-binding protein
  misc_feature (7)..(461): NCBI GI: 23197814 NCBI Desc: oxysterol-binding protein [arabidopsis thaliana]
  misc_feature (7)..(461): NCBI GI: 8885548 NCBI Desc: oxysterol-binding protein [arabidopsis thaliana]
  misc_feature (1)..(458): NCBI GI: 38639323 NCBI Desc: oxysterol-binding protein [solanum tuberosum]
  misc_feature (73)..(309): NCBI GI: 49115449 NCBI Desc: loc398688 protein [xenopus laevis]
  misc_feature (73)..(305): NCBI GI: 17529997 NCBI Desc: oxysterol-binding protein-like protein osbpl1a [homo sapiens]
MGSKDQGGGAASSGGGFFSSFAAGMRSWGTAVHKSVNGLLGYEGLEVINPDGGTDDAEEEALRGRWKQEDRDSYWKMMHKYIGSDVTSLVTLPVIIFEPMTMLQKMAELMEYCELLDKADECEDPYMRMVYASTWAVSVYFAYQRTWKPFNPILGETYEMVNHQGITFLAEQVSHHPPMGVAHCENEHFTYDITSKLRTKFLGNSVEIYPVGRTRVTLKKSGVVLDLVPPLTKVNNLIFGRTWVDTPGEMVMTNLTTGDKVVLYFQPCGWFGAGRYEVDGYVYSAAEEPKIMITGKWNKSLSYQPCDQEGDPLPGTELKEIWRVAPAPQGDKYQYTHFAHKINSFDTAPKKLLASDSRLRPDRYALEKGDMSKSGAEKSRLEEQQRAEKRTRDAKGEQFTPRWFNMTDVVAPTPWGDLEIYEYNGKYTEYRAAIDSSSVTGETDVTSTEFNPWQYGSSSSQ

SEQ ID NO: 9971 - DNA, 2172 bp, Sorghum bicolor
  misc_feature: Ceres ANNOT ID no. 6108752
  misc_feature: Encodes the peptide sequence at SEQ ID NO 9972
atgggtctggataatacttatggggagctatctggcatgttctgtggaggcctgtcttatgatggctacatagatcacagcagcggaagtgattatttcaggttcaccgatccacttcctgtggttgtgccccagatgacagcagaagcttgttcaaatccttcctccactgtgtcaagggccaacactgaaactgacaacccagaggattgggaattcatctcagatgagtccctcaactatattagccggatgctcatggaggaggatatagatgagaaagtcagcatgtaccaggcggagtcagcggcactgcgtgctgctgcaaagccgttctatgacattcttgggcacaagtttccaccgtctcctgatcaccagccgatcccttggtccatggacagccccagtgagagtagcagtagcatttgtacacaatctattgcaagtagtgtcactagcagcagcattggtggcacagtggatagcaactggcgctacgacgttggacgcagtgagcagttggaagcttatcaaggcttgtgtggtcagtcttctcaaccgcttgttggtacatctagtgatgcttccaatgcagtggatgggctagatgaccctttgatcacgaatggccagatccctgagtatttgtttgagagccttccaacttgggatttcaggagaggtattgaggaagcccagaagtttcttcctgttagcaatacactagtgattgatttagaagctggtggtatcacaagacctcaagaagcaaggaaagatgtttctttgaatgccaaaaaggcagatgtattgaaggccaagaaaaacagacagagtgaagaccttgacctgattgaaggccggaactttaaacagtccgcatttagttccgatgaacctgattggattgagatgtttgatgatctgcttcggcaaactgagaagaaggctacagatctgcgagagcttatgcgcaatgaagcttccaagaattctcaggtcactcagacgaaaggaccaagtgggccacggccgcggggaaggaaaccaacaaagaaggatgtggtggaccttaggaccatcctcatccactgtgcacaggctgtggcagcagatgaccgcagaactgctaatgaattgttaaagcaaataaggcaccattccaagccaaatggcgatggatcccagaggttagcacattgttttgcagatggtcttgaggctcgtttggcaggcacagggagtcagctttaccggaagcttatagcgaaacgtacaactgcctcagacatgcttaaagcctaccacctttaccttgcagcatgcccattcaagaggctttcacattttctttccgatcaaacaatcttgagtatgattaaaaatgcatcaaaggtgcatatcagtgacttcggcatttattttggcttccaatggccatgcctaatcaggcgtctctcccagagggaaagcggtccacctgttctgtttcgcccctctgagagaattgaagagactggacaaaggcttgcagaatatcctgcgaagttcaaggtgccttatgagtatcagggaatagcatcaaagtgggaaaccatccgagttgaggatctcaaagttggtaaggacgaagttgtgattgttaattgcctgtacagattcagaaacctgattgatgaaacagttgctgtagacagtcctaggaatagagtgctcaacacaataaggcaagtaaacccagctattttcatccatggaattgtgaatgggtcatacagtgttcccttcttcatcacacgtttccgtgaggcactgttccatttctctgcattgtttgacatgctagagacaactgtcccacgggatgatccccagcgtgcactcatagagagggaaatgtttggccgagaggcactcaatgttattgcttgtgagggctcagacagagttgagagacccgagacatacaaacagtggcaggtgaggaacctcagggctggatttgttcagtctccgttaaacaaagaaattgtgatgaaagccaaggacaaagtaaaagacatttatcacaaggactttgtcatagatgaagacagtggatggctcctgcaaggctggaaaggaaggataatctatgcgatatctacatggaagcctaagaataactag

SEQ ID NO: 9972 - protein, 723 aa, Sorghum bicolor
  misc_feature: Ceres ANNOT ID no. 6108752
  misc_feature (333)..(628): Pfam Id: GRAS Pfam Desc: GRAS family transcription factor
  misc_feature (48)..(722): NCBI GI: 32813435 NCBI Desc: scarecrow-like protein [lilium longiflorum]
  misc_feature (352)..(723): NCBI GI: 15222433 NCBI Desc: scarecrow-like transcription factor 14 (scl14) [arabidopsis thaliana]
  misc_feature (352)..(712): NCBI GI: 8778540 NCBI Desc: f22g5.9 [arabidopsis thaliana]
  misc_feature (273)..(720): NCBI GI: 125743130 NCBI Desc: scarecrow-like protein 1 [pinus radiata]
  misc_feature (272)..(720): NCBI GI: 89474466 NCBI Desc: gras4 [solanum lycopersicum]
  misc_feature: The sequence is a functional homolog of SEQ ID NO 1324 in the 10/374,780US patent application
  misc_feature: The sequence is a functional homolog of SEQ ID NO 1327 in the 10/374,780US patent application
  misc_feature: The sequence is a functional homolog of SEQ ID NO 1392 in the 11/479,226US patent application
  misc_feature: The sequence is a functional homolog of SEQ ID NO 1471 in the 10/412,699US patent application
  misc_feature: The sequence is a functional homolog of SEQ ID NO 1938 in the 10/412,699US patent application
  misc_feature: The sequence is a functional homolog of SEQ ID NO 204 in the 10/374,780US patent application
  misc_feature: The sequence is a functional homolog of SEQ ID NO 2202 in the 10/374,780US patent application
  misc_feature: The sequence is a functional homolog of SEQ ID NO 576 in the 10/225,066US patent application
  misc_feature: The sequence is a functional homolog of SEQ ID NO 654 in the 10/412,699US patent application
  misc_feature: The sequence is a functional homolog of SEQ ID NO 92 in the 11/375,241US patent application
  misc_feature: Useful for making plants with modulated growth and phenotype characteristics
  misc_feature: The sequence is a functional homolog of SEQ ID NO 1471 in the 20040045049 US patent application
  misc_feature: The sequence is a functional homolog of SEQ ID NO 1938 in the 20040045049 US patent application
  misc_feature: The sequence is a functional homolog of SEQ ID NO 654 in the 20040045049 US patent application
  misc_feature: The sequence is a functional homolog of SEQ ID NO 1327 in the 20060162006 US patent application
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: The sequence is a functional homolog of SEQ ID NO 1938 in the 10/412,699 US patent application
  misc_feature: The sequence is a functional homolog of SEQ ID NO 2202 in the 10/374,780 US patent application
MGLDNTYGELSGMFCGGLSYDGYIDHSSGSDYFRFTDPLPVVVPQMTAEACSNPSSTVSRANTETDNPEDWEFISDESLNYISRMLMEEDIDEKVSMYQAESAALRAAAKPFYDILGHKFPPSPDHQPIPWSMDSPSESSSSICTQSIASSVTSSSIGGTVDSNWRYDVGRSEQLEAYQGLCGQSSQPLVGTSSDASNAVDGLDDPLITNGQIPEYLFESLPTWDFRRGIEEAQKFLPVSNTLVIDLEAGGITRPQEARKDVSLNAKKADVLKAKKNRQSEDLDLIEGRNFKQSAFSSDEPDWIEMFDDLLRQTEKKATDLRELMRNEASKNSQVTQTKGPSGPRPRGRKPTKKDVVDLRTILIHCAQAVAADDRRTANELLKQIRHHSKPNGDGSQRLAHCFADGLEARLAGTGSQLYRKLIAKRTTASDMLKAYHLYLAACPFKRLSHFLSDQTILSMIKNASKVHISDFGIYFGFQWPCLIRRLSQRESGPPVLFRPSERIEETGQRLAEYPAKFKVPYEYQGIASKWETIRVEDLKVGKDEVVIVNCLYRFRNLIDETVAVDSPRNRVLNTIRQVNPAIFIHGIVNGSYSVPFFITRFREALFHFSALFDMLETTVPRDDPQRALIEREMFGREALNVIACEGSDRVERPETYKQWQVRNLRAGFVQSPLNKEIVMKAKDKVKDIYHKDFVIDEDSGWLLQGWKGRIIYAISTWKPKNN
